(12) United States Patent
Harper et al.

(10) Patent No.: US 7,109,033 B2
(45) Date of Patent: Sep. 19, 2006

(54) STRESS-REGULATED GENES OF PLANTS, TRANSGENIC PLANTS CONTAINING SAME, AND METHODS OF USE

(75) Inventors: Jeffrey F. Harper, Del Mar, CA (US); Joel Kreps, Carlsbad, CA (US); Xun Wang, San Diego, CA (US); Tong Zhu, San Diego, CA (US)

(73) Assignees: The Scripps Research Institute, La Jolla, CA (US); Syngenta Participations AG, Basel (CH)

( * ) Notice: Subject to any disclaimer, the term of this patent is extended or adjusted under 35 U.S.C. 154(b) by 576 days.

(21) Appl. No.: 09/938,842

(22) Filed: Aug. 24, 2001

(65) Prior Publication Data

US 2002/0160378 A1     Oct. 31, 2002
US 2004/0009476 A9     Jan. 15, 2004

Related U.S. Application Data

(60) Provisional application No. 60/300,111, filed on Jun. 22, 2001, provisional application No. 60/264,647, filed on Jan. 26, 2001, provisional application No. 60/227,866, filed on Aug. 24, 2000.

(51) Int. Cl.
*C12N 5/14*     (2006.01)
(52) U.S. Cl. ............... 435/419; 435/320.1; 435/252.3; 435/468; 435/410; 536/23.6; 536/24.1
(58) Field of Classification Search ............ 435/6, 435/410, 419, 320.1; 800/289, 298; 536/23.6, 536/24.1
See application file for complete search history.

(56) References Cited

FOREIGN PATENT DOCUMENTS

EP     1 033 405 A2     9/2000
WO     WO 00/08187     2/2000

OTHER PUBLICATIONS

Seki et al., "Monitoring the Expression Pattern of 1300 Arabidopsis Genes under Drought and Cold Stresses by Using a Full-Length cDNA Microarray," *The Plant Cell*, vol. 13, Jan. 2001, pp. 61-72.

Schenk et al., "Coordinated plant defense responses in *Arabidopsis* revealed by microarray analysis," *PNAS*, vol. 97, No. 21, Oct. 10, 2000, pp. 11655-11660.

Reymond et al., "Differential Gene Expression in Response to Mechanical Wounding and Insect Feeding in Arabidopsis," *The Plant Cell*, vol. 12, May 2000, pp. 707-719.

Nuccio et al., "Metabolic engineering of plants for osmotic stress resistance," *Plant Biotechnology*, Apr. 1999, pp. 128-134.

Ruan et al., "Towards *Arabidopsis* genome analysis: monitoring expression profiles of 1400 genes using cDNA microarrays," *The Plant Journal*, vol. 15, (1998), pp. 821-833.

Schena et al., "Quantitative Monitoring of Gene Expression Patterns with a Complementary DNA Microarray," *Science*, vol. 270, Oct. 20, 1995, pp. 467-470.

Jaglo-Ottosen et al., "Arabidopsis CBF-1 Overexpression Induces COR Genes and Enhances Freezing Tolerance," *Science*, vol. 280, pp. 104-106, Apr. 3, 1998.

Kasuga et al., "Improving plant drought, salt, and freezing tolerance by gene transfer of a single stress-inducible transcription factor," *Nature Biotechnology*, vol. 17, pp. 287-291, Mar. 1999.

Cubas et al., "The TCP domain: a motif found in proteins regulating plant growth and development, " *The Plant Journal*, 18:2, pp. 215-222 (1999).

Kosugi et al., "DNA binding and dimerization specificity and potential targets for the TCP protein family," *The Plant Journal*, 30:3, pp. 337-348 (2002).

*Primary Examiner*—James Martinell
(74) *Attorney, Agent, or Firm*—DLA Piper Rudnick Gray Cary US LLP

(57) ABSTRACT

Clusters of plant genes that are regulated in response to one or more stress conditions are provided, as are isolated plant stress-regulated genes, including portions thereof comprising a coding sequence or a regulatory element, and to consensus sequences comprising a plant stress-regulated regulatory element. In addition, a recombinant polynucleotide, which includes a plant stress-regulated gene, or functional portion thereof, operatively linked to a heterologous nucleotide sequence, is provided, as are transgenic plants, which contain a plant stress-regulated gene or functional portion thereof that was introduced into a progenitor cell of the plant. Also provided are methods of using a plant stress-regulated gene to confer upon a plant a selective advantage to a stress condition, methods of identifying an agent that modulates the activity of a plant stress-regulated regulatory element, and methods of determining whether a plant has been exposed to a stress.

6 Claims, No Drawings

STRESS-REGULATED GENES OF PLANTS, TRANSGENIC PLANTS CONTAINING SAME, AND METHODS OF USE

This application claims the benefit under 35 U.S.C. 119(e) of U.S. Ser. No. 60/227,866, filed Aug. 24, 2000; U.S. Ser. No. 60/264,647, filed Jan. 26, 2001; and U.S. Ser. No. 60/300,111, filed Jun. 22, 2001, each of which is incorporated herein by reference in its entirety.

Three CD-R compact discs, labeled "Copy 1", "Copy 2", and "CRF" and having the files listed below, are submitted herewith and are incorporated herein by reference. Copy 1 and Copy 2 each contain two text documents: 1) a file named SCRIP1300-3_SEQUENCE_LISTING, which contains the Sequence Listing, was created on Aug. 20, 2001 (and recorded on the CD-R on Aug. 21, 2001), and is 9,972 KB in size; and 2) a file named SCRIP1300-3_Table__32, which contains Table 32, was created on Aug. 20, 2001 (and recorded on the CD-R on Aug. 21, 2001), and is 1,251 KB in size. The CRF contains a single file named SCRIP1300-3_SEQUENCE_LISTING, which contains the Sequence Listing, was created on Aug. 20, 2001 (and recorded on the CD-R on Aug. 21, 2001), is 9,972 KB in size, and is identical to the files having the same name on Copy 1 and Copy 2.

BACKGROUND OF THE INVENTION

1. Field of the Invention

The present invention relates generally to plant genes, the expression of which are regulated in response to stress, and more specifically to the gene regulatory elements involved in a stress-induced response in plants, to uses of the coding sequences and regulatory elements of such plant stress-regulated genes, and to transgenic plants genetically modified to express such a coding sequence or to express a heterologous polynucleotide from such a regulatory element.

2. Background Information

Microarray technology is a powerful tool that can be used to identify the presence and level of expression of a large number of polynucleotides in a single assay. A microarray is formed by linking a large number of discrete polynucleotide sequences, for example, a population of polynucleotides representative of a genome of an organism, to a solid support such as a microchip, glass slide, or the like, in a defined pattern. By contacting the microarray with a nucleic acid sample obtained from a cell of interest, and detecting those polynucleotides expressed in the cell can hybridize specifically to complementary sequences on the chip, the pattern formed by the hybridizing polynucleotides allows the identification of clusters of genes that are expressed in the cell. Furthermore, where each polynucleotide linked to the solid support is known, the identity of the hybridizing sequences from the nucleic acid sample can be identified.

A strength of microarray technology is that it allows the identification of differential gene expression simply by comparing patterns of hybridization. For example, by comparing the hybridization pattern of nucleic acid molecules obtained from cells of an individual suffering from a disease with the nucleic acids obtained from the corresponding cells of a healthy individual, genes that are differentially expressed can be identified. The identification of such differentially expressed genes provides a means to identify new genes, and can provide insight as to the etiology of a disease.

Microarray technology has been widely used to identify patterns of gene expression associated with particular stages of development or of disease conditions in animal model systems, and is being applied to the identification of specific patterns of gene expression in humans. The recent availability of information for the genomes of plants provides a means to adapt microarray technology to the study of plant gene expression.

Plants and plant products provide the primary sustenance, either directly or indirectly, for all animal life, including humans. For the majority of the world's human population and for many animals, plants and plant products provide the sole source of nutrition. As the world population increases, the best hope to prevent widespread famine is to increase the quantity and improve the quality of food crops, and to make the crops available to the regions of the world most in need of food.

Throughout history, a continual effort has been made to increase the yield and nutritious value of food crops. For centuries, plants having desirable characteristics such as greater resistance to drought conditions or increased size of fruit were crossbred and progeny plants exhibiting the desired characteristics were selected and used to produce seed or cuttings for propagation. Using such classical genetic methods, plants having, for example, greater disease resistance, increased yield, and better flavor have been obtained. The identification of plant genes involved in conferring a selective advantage on the plant to an environmental challenge would facilitate the generation and yield of plants, thereby increasing the available food supply to an increasing world population. The involvement of these genes in a single organism to responses to multiple stress conditions, however, remains unknown. Thus, a need exists to identify plant genes and polynucleotides that are involved in modulating the response of a plant to changing environmental conditions. The present invention satisfies this need and provides additional advantages.

SUMMARY OF THE INVENTION

The present invention relates to clusters of genes that are regulated in response to a stress condition in plants. Such clusters include, for example, plant polynucleotides whose expression is altered in response to two or more different stress conditions; and plant polynucleotides the expression of which are altered in response to one stress condition, but not to others. The identification of such clusters, using microarray technology, has allowed the identification of plant stress-regulated genes in *Arabidopsis thaliana* (see Tables 1 and 2); and homologs and orthologs thereof in other plant species (see Table 32). Thus, the invention provides isolated polynucleotide portions of *Arabidopsis* plant stress-regulated genes, and homologs and orthologs thereof; variants of such sequences, and polynucleotides encoding substantially similar plant stress-regulated polypeptides expressed therefrom. Such sequences include, for example, sequences encoding transcription factors; enzymes, including kinases; and structural proteins, including channel proteins (see Tables 29–31). Accordingly, the present invention also relates to an isolated polynucleotide comprising all or a portion of a plant stress-regulated gene, and to polynucleotide portions thereof, including a coding region (open reading frame), which encodes all or a portion of a stress-regulated polypeptide, for example, as set forth in SEQ ID NOS:1–2703; and a regulatory element involved in regulating the response of the plant to a stress condition such exposure to an abnormal level of salt, osmotic pressure, temperature or any combination thereof, for example, as set forth in SEQ ID NOS:2704–5379.

The present invention also relates to a recombinant polynucleotide, which contains a nucleotide sequence of a plant stress-regulated gene or functional portion thereof operatively linked to a heterologous nucleotide sequence. In one embodiment, the recombinant polynucleotide comprises a plant stress-regulated gene regulatory element operatively linked to a heterologous nucleotide sequence, which is not regulated by the regulatory element in a naturally occurring plant. The heterologous nucleotide sequence, when expressed from the regulatory element, can confer a desirable phenotype to a plant cell containing the recombinant polynucleotide. In another embodiment, the recombinant polynucleotide comprises a coding region, or portion thereof, of a plant stress-regulated gene operatively linked to a heterologous promoter. The heterologous promoter provides a means to express an encoded stress-regulated polypeptide constitutively, or in a tissue-specific or phase-specific manner.

Accordingly, in one aspect, the present invention provides an isolated polynucleotide comprising a nucleotide sequence of a plant gene that hybridizes under stringent conditions, preferably high stringency conditions, to any one of SEQ ID NOS:1–5379 (see Tables 1 and 2), including to a coding region (SEQ ID NOS:1–2703) or a regulatory region, which can alter transcription of an operatively linked nucleic acid sequence in response to an abiotic stress (SEQ ID NOS: 2704–5379; see Table 2), or to a complement thereof. Additional aspects provide sequences that hybridize under stringent conditions, preferably high stringency conditions, to the complements of SEQ ID NO 1–1261 (cold responsive genes; Tables 3–6), SEQ ID NOS:2227–2427 (saline responsive genes; Tables 7–10), SEQ ID NOS:2428–2585 (osmotic responsive genes; Tables 11–14), SEQ ID NOS:1699–1969 (cold and osmotic responsive genes; Tables 15–17), SEQ ID NOS:1970–2226 (cold and saline responsive genes; Tables 18–20), SEQ ID NOS:2586–2703 (osmotic and saline responsive genes; Tables 21–23), and SEQ ID NOS:1262–1698 (cold, osmotic and saline responsive genes; Tables 24–26), and which can comprise regulatory regions that can alter transcription in response to cold stress, osmotic stress, saline stress, or combinations thereof (SEQ ID NOS:2704–5379; see Table 2). Also provided are nucleotide sequences complementary thereto, and expression cassettes, plants and seeds comprising any of the above isolated sequences.

In another aspect, the present invention provides an isolated polynucleotide comprising a plant nucleotide sequence that hybridizes under stringent conditions, preferably high stringency conditions, to the complement of any one of SEQ ID NOS:1–2703 (Table 1), including to a coding region thereof (SEQ ID NOS:2704–5379), wherein expression of said coding region is altered in response to an abiotic stress. Additional aspects provide sequences that hybridize under high stringency conditions to the complements of SEQ ID NO 1–1261 (cold responsive genes; Tables 3–6), SEQ ID NOS:2227–2427 (saline responsive genes; Tables 7–10), SEQ ID NOS:2428–2585 (osmotic responsive genes; Tables 11–14), SEQ ID NOS:1699–1969 (cold and osmotic responsive genes; Tables 15–17), SEQ ID NOS:1970–2226 (cold and saline responsive genes; Tables 18–20), SEQ ID NOS:2586–2703 (osmotic and saline responsive genes; Tables 21–23), and SEQ ID NOS:1262–1698 (cold, osmotic and saline responsive genes; Tables 24–26), and which can comprise a coding region whose transcription is altered in response to cold stress, osmotic stress, saline stress, or a combination thereof. Also provided are nucleotide sequences complementary thereto, and expression cassettes, plants and seeds comprising any of the above sequences.

The invention further relates to a method of producing a transgenic plant, which comprises at least one plant cell that exhibits altered responsiveness to a stress condition. In one embodiment, the method can be performed by introducing a polynucleotide portion of plant stress-regulated gene into a plant cell genome, whereby the polynucleotide portion of the plant stress-regulated gene modulates a response of the plant cell to a stress condition.

The polynucleotide portion of the plant stress-regulated gene can encode a stress-regulated polypeptide or functional peptide portion thereof (see SEQ ID NOS:1–2703), wherein expression of the stress-regulated polypeptide or functional peptide portion thereof either increases the stress tolerance of the transgenic plant, or decreases the stress tolerance of the transgenic plant. The polynucleotide portion of the plant stress-regulated gene encoding the stress-regulated polypeptide or functional peptide portion thereof can be operatively linked to a heterologous promoter. The polynucleotide portion of the plant stress-regulated gene also can comprise a stress-regulated gene regulatory element (see SEQ ID NOS: 2704–5379). The stress-regulated gene regulatory element can integrate into the plant cell genome in a site-specific manner, whereupon it can be operatively linked to a heterologous nucleotide sequence, which can be expressed in response to a stress condition specific for the regulatory element; or can be a mutant regulatory element, which is not responsive to the stress condition, whereby upon integrating into the plant cell genome, the mutant regulatory element disrupts an endogenous stress-regulated regulatory element of a plant stress-regulated gene, thereby altering the responsiveness of the plant stress-regulated gene to the stress condition.

In one aspect, the invention provides a method for producing a transgenic plant by introducing into at least one plant cell a recombinant nucleic acid construct comprising i) all or a portion of any one of SEQ ID NOS:1–5379; ii) a polynucleotide comprising a coding region that hybridizes under conditions of high stringency to all or a portion of the complement of any one of SEQ ID NOS:1–2703; iii) a polynucleotide comprising a sequence that alters transcription of an operatively linked coding region in response to abiotic stress, and that hybridizes under conditions of high stringency to the complement of any one of SEQ ID NOS: 2704–5379; iv) a polynucleotide having at least 90% sequence identity with any one of SEQ ID NO:1–5379; v) a fragment of any one of the sequences of iv), wherein the fragment comprises a coding region; or vi) a fragment of any one of the sequences of iv), wherein the fragment comprises a nucleotide sequence that alters transcription of an operatively linked coding region in response to abiotic stress; and regenerating a plant from the at least one plant cell.

Another aspect provides a method for producing a transgenic plant comprising introducing into at least one plant cell a recombinant nucleic acid construct comprising i) any one of SEQ ID NOS:1–1261 or 2704–3955; ii) a polynucleotide comprising a coding region that hybridizes under conditions of high stringency to the complement of any one of SEQ ID NOS:1–1261; iii) a polynucleotide comprising a sequence that alters transcription of an operatively linked coding region in response to cold stress that hybridizes under conditions of high stringency to the complement of any one of SEQ ID NOS:2704–3955; iv) a polynucleotide that has at least 90% sequence identity with any one of SEQ ID NOS:1–1261 or 2704–3955; v) a fragment of any one of the sequences of iv), wherein the fragment comprises a coding region; or vi) a fragment of any one of the sequences of iv) wherein the fragment comprises a sequence or region that alters transcription of an operatively linked coding region in response to cold stress; and regenerating a plant from the at least one plant cell.

In another aspect, the invention provides a method for producing a transgenic plant by introducing into at least one plant cell a recombinant nucleic acid construct comprising i) any one of SEQ ID NOS:2428–2585 or 5108–5263; ii) a polynucleotide comprising a coding region that hybridizes under conditions of high stringency to the complement of any one of SEQ ID NOS:2428–2585; iii) a polynucleotide comprising a sequence that alters transcription of an operatively linked coding region in response to osmotic stress that hybridizes under conditions of high stringency to the complement of any one of SEQ ID NOS:5108–5263; iv) a polynucleotide that has at least 90% sequence identity with any one of SEQ ID NOS:2428–2585 or 5108–5263; v) a fragment of any one of the sequences of iv), wherein the fragment comprises a coding region; or vi) a fragment of any one of the sequences of iv), wherein the fragment comprises a sequence or region that alters transcription of an operatively linked coding region in response to osmotic stress; and regenerating a plant from the at least one plant cell.

Still another aspect provides a method for producing a transgenic plant comprising introducing into at least one plant cell a recombinant nucleic acid construct comprising i) any one of SEQ ID NOS:2227–2427 or 4910–5107; ii) a polynucleotide comprising a coding region that hybridizes under conditions of high stringency to the complement of any one of SEQ ID NOS:2227–2427; iii) a polynucleotide comprising a sequence that alters transcription of an operatively linked coding region in response to saline stress that hybridizes under conditions of high stringency to the complement of any one of SEQ ID NOS:2227–2427; iv) a polynucleotide that has at least 90% sequence identity with any one of SEQ ID NOS:4910–5107; v) a fragment of any one of the sequences of iv), wherein the fragment comprises a coding region; or vi) a fragment of any one of the sequences of iv) wherein the fragment comprises a sequence or region that alters transcription of an operatively linked coding region in response to saline stress; and regenerating a plant from the at least one plant cell.

Yet another aspect provides a method for producing a transgenic plant comprising introducing into at least one plant cell a recombinant nucleic acid construct comprising i) any one of SEQ ID NOS:1699–1969 or 4389–4654; ii) a polynucleotide comprising a coding region that hybridizes under conditions of high stringency to the complement of any one of SEQ ID NOS:1699–1969; iii) a polynucleotide comprising a sequence that alters transcription of an operatively linked coding region in response to a combination of cold and osmotic stress that hybridizes under conditions of high stringency to the complement of any one of SEQ ID NOS:4389–4654; iv) a polynucleotide that has at least 90% sequence identity with any one of SEQ ID NOS:1699–1969 or 4389–4654; v) a fragment of any one of the sequences of iv), wherein the fragment comprises a coding region; or vi) a fragment of any one of the sequences of iv), wherein the fragment comprises a sequence or region that alters transcription of an operatively linked coding region in response to a combination of cold and osmotic stress; and regenerating a plant from the at least one plant cell.

Yet another aspect provides a method for producing a transgenic plant comprising introducing into at least one plant cell a recombinant nucleic acid construct comprising i) any one of SEQ ID NOS:1970–2226 or 4655–4909; ii) a polynucleotide comprising a coding region that hybridizes under conditions of high stringency to the complement of any one of SEQ ID NOS:1970–2226; iii) a polynucleotide comprising a sequence that alters transcription of an operatively linked coding region in response to a combination of cold and saline stress that hybridizes under conditions of high stringency to the complement of any one of SEQ ID NOS:4655–4909; iv) a polynucleotide that has at least 90% sequence identity with any one of SEQ ID NOS:1970–2226 or 4655–4909; v) a fragment of any one of the sequences of iv), wherein the fragment comprises a coding region; or vi) a fragment of any one of the sequences of iv), wherein the fragment comprises a sequence or region that alters transcription of an operatively linked coding region in response to a combination of cold and saline stress; and regenerating a plant from the at least one plant cell.

A further aspect provides a method for producing a transgenic plant comprising introducing into at least one plant cell a recombinant nucleic acid construct comprising i) any one of SEQ ID NOS:2586–2703 or 5264–5379; ii) a polynucleotide comprising a coding region that hybridizes under conditions of high stringency to the complement of any one of SEQ ID NOS:2586–2703; iii) a polynucleotide comprising a sequence that alters transcription of an operatively linked coding region in response to a combination of osmotic and saline stress that hybridizes under conditions of high stringency to the complement of any one of SEQ ID NOS: 5264–5379; iv) a polynucleotide that has at least 90% sequence identity with any one of SEQ ID NOS:2586–2703 or 5264–5379; v) a fragment of any one of the sequences of iv), wherein the fragment comprises a coding region; or vi) a fragment of any one of the sequences of iv), wherein the fragment comprises a sequence or region that alters transcription of an operatively linked coding region in response to a combination of osmotic and saline stress; and regenerating a plant from the at least one plant cell.

Another aspect provides a method for producing a transgenic plant comprising introducing into at least one plant cell a recombinant nucleic acid construct comprising i) any one of SEQ ID NOS:1262–1698 or 3956–4388; ii) a polynucleotide comprising a coding region that hybridizes under conditions of high stringency to the complement of any one of SEQ ID NOS:1262–1698; iii) a polynucleotide comprising a sequence that alters transcription of an operatively linked coding region in response to a combination of cold, osmotic and saline stress that hybridizes under conditions of high stringency to the complement of any one of SEQ ID NOS:3956–4388; iv) a polynucleotide that has at least 90% sequence identity with any one of SEQ ID NOS:1262–1698 or 3956–4388; v) a fragment of any one of the sequences of iv), wherein the fragment comprises a coding region; or vi) a fragment of any one of the sequences of iv) wherein the fragment comprises a sequence or region that alters transcription of an operatively linked coding region in response to a combination of cold, osmotic and saline stress; and regenerating a plant from the at least one plant cell. Further aspects include plants and uniform populations of plants made by the above methods as well as seeds and progeny from such plants.

In another embodiment, a transgene introduced into a plant cell according to a method of the invention can encode a polypeptide that regulates expression from an endogenous plant stress-regulated gene. Such a polypeptide can be, for example, a recombinantly produced polypeptide comprising a zinc finger domain, which is specific for the regulatory element, and an effector domain, which can be a repressor domain or an activator domain. The polynucleotide encoding the recombinant polypeptide can be operatively linked to and expressed from a constitutively active, inducible or tissue specific or phase specific regulatory element. Expression of the recombinant polypeptide from a plant stress-regulated promoter as disclosed herein can be particularly advantageous in that the polypeptide can be coordinately expressed with the endogenous plant stress-regulated genes upon exposure to a stress condition. The invention also provides transgenic plants produced by a method as disclosed, as well as to a plant cell obtained from such transgenic plant, wherein said plant cell exhibits altered responsiveness to the stress condition; a seed produced by the transgenic plant; and a cDNA or genomic DNA library prepared from the transgenic plant, or from a plant cell from said transgenic plant, wherein said plant cell exhibits altered responsiveness to the stress condition.

In one aspect, the invention provides an isolated nucleic acid molecule comprising a nucleotide sequence substantially similar to a sequence of any one of SEQ ID NOS: 2704–5379, which can alter transcription of an operatively linked polynucleotide in a plant cell in response to an abiotic stress. Additional aspects of the invention provide isolated polynucleotides, including, for example, sequences substantially similar to any of SEQ ID NOS:2704–3955, which can alter transcription of an operatively linked polynucleotide in response to a cold stress; isolated polynucleotides substantially similar to a sequence of any of SEQ ID NOS: 5108–5263, which can alter transcription of an operatively linked polynucleotide in response to an osmotic stress; isolated polynucleotides substantially similar to a sequence of any of SEQ ID NOS:4910–5107, which can alter transcription of an operatively linked polynucleotide in response to a saline stress; isolated polynucleotides substantially similar to a sequence of any of SEQ ID NOS:4389–4654, which can alter transcription of an operatively linked polynucleotide in response to a combination of cold and osmotic stresses; isolated polynucleotides substantially similar to a sequence of any of SEQ ID NOS:4655–4909, which can alter transcription of an operatively linked polynucleotide in response to a combination of cold and saline stresses; isolated polynucleotides substantially similar to a sequence of any of SEQ ID NOS:5264–5379, which can alter transcription of an operatively linked polynucleotide in response to a combination of osmotic and saline stresses; and isolated polynucleotides substantially similar to a sequence of any of SEQ ID NOS:3956–4388, which can alter transcription of an operatively linked polynucleotide in response to a combination of cold, osmotic and saline stresses.

Related aspects of the invention provide an isolated nucleotide sequences that can alter transcription of an operatively linked polynucleotide in response to an abiotic stress, and that hybridize under stringent conditions, preferably highly stringent conditions, to the complement of any one of SEQ ID NOS:2704–5379. Additional aspects provide an isolated nucleotide sequence that can alter transcription of an operatively linked polynucleotide in response to cold stress, and that hybridizes under stringent conditions, preferably highly stringent conditions, to the complement of any one of SEQ ID NOS:2704–3955; a nucleotide sequence that alters transcription of an operatively linked polynucleotide in response to osmotic stress, and that hybridizes under stringent conditions, preferably highly stringent conditions, to the complement of any one of SEQ ID NOS:5108–5263; a nucleotide sequence that alters transcription of an operatively linked polynucleotide in response to saline stress, and that hybridizes under stringent conditions, preferably highly stringent conditions, to the complement of any one of SEQ ID NOS:4910–5107; a nucleotide sequence that alters transcription of an operatively linked polynucleotide in response to a combination of cold and osmotic stress, and that hybridizes under stringent conditions, preferably highly stringent conditions, to the complement of any one of SEQ ID NOS:4389–4654; a nucleotide sequence that alters transcription of an operatively linked polynucleotide in response to a combination of cold and saline stress, and that hybridizes under stringent conditions, preferably highly stringent conditions, to the complement of any one of SEQ ID NOS:4655–4909; a nucleotide sequence that alters transcription of an operatively linked polynucleotide in response to an combination of osmotic and saline stress, and that hybridizes under stringent conditions, preferably highly stringent conditions, to the complement of any one of SEQ ID NOS:5264–5379; and a nucleotide sequence that alters transcription of an operatively linked polynucleotide in response to a combination of cold, osmotic and saline stress, and that hybridizes under stringent conditions, preferably highly stringent conditions, to the complement of any one of SEQ ID NOS:3956–4388.

Further aspects provide an expression cassette comprising as operatively linked components any of the above isolated nucleic acid sequences that alter transcription, a coding region, and a termination sequence. Also provided are host cells and seeds comprising such expression cassettes, plants containing such host cells and seeds and progeny of plants containing said host cells. In related aspects, the coding region of the expression cassettes comprise sequences encoding marker proteins and sequences involved in gene silencing such as antisense sequences, double stranded RNAi sequences, a triplexing agent, and sequences comprising dominant negative mutations. In additional related aspects, the coding regions comprise sequences encoding polypeptides that alter the response of a plant to an abiotic stress.

The present invention also relates to a method of modulating the responsiveness of a plant cell to a stress condition. Such a method can be performed, for example, by introducing a polynucleotide portion of a plant stress-regulated genes described herein into the plant cell, thereby modulating the responsiveness of the plant cell to a stress condition. Such a method can result in the responsiveness of the plant cell being increased upon exposure to the stress condition, which, in turn, can result in increased or decreased tolerance of the plant cell to a stress condition; or can result in the responsiveness of the plant cell to the stress condition being decreased, which, in turn, can result in increased or decreased tolerance of the plant cell to a stress condition. In one embodiment, the polynucleotide portion of the plant stress-regulated gene can integrate into the genome of the plant cell, thereby modulating the responsiveness of the plant cell to the stress condition. In another embodiment, the polynucleotide portion of the plant stress-regulated gene encodes a stress-regulated polypeptide or functional peptide portion thereof, and can be operatively linked to a heterologous promoter. The polynucleotide portion of the plant stress-regulated gene also can contain a mutation, whereby upon integrating into the plant cell genome, the polynucleotide disrupts (knocks-out) an endogenous plant stress-regulated sequence, thereby modulating the responsiveness of the plant cell to the stress condition. Depending on whether the knocked-out gene encodes an adaptive or a maladaptive stress-regulated polypeptide, the responsiveness of the plant will be modulated accordingly.

The present invention further relates to a method of modulating the activity of a biological pathway in a plant cell, wherein the pathway involves a stress-regulated polypeptide or a non-protein regulatory molecule. Such a method can be performed by introducing a polynucleotide portion of a plant stress-regulated gene, or a polynucleotide derived therefrom, for example a ribozyme derived from a nucleotide sequence as set forth in any of SEQ ID NOS: 1–2703, into the plant cell, thereby modulating the activity of the biological pathway. The method can be performed with respect to a pathway involving any of the stress-regulated polypeptides as disclosed herein or encoded by the polynucleotides disclosed herein, as well as using homologs or orthologs thereof. In one embodiment, the method is performed by introducing a polynucleotide portion of a plant stress-regulated gene into the plant cell, wherein the plant stress-regulated gene comprises a nucleotide sequence as set forth in any of SEQ ID NOS:1–155, 157–228, 230–232, 234–557, 559–572, 574–605, 607–634, 636–786, 788–812, 814–1262, 1264–1386, 1387–1390, 1392–1404, 1406–1444, 1446–1483, 1485–1588, 1590–1608, 1610–1633, 1634–1725, 1727–1865, 1867–1917, 1919–1927, 1929–2855, 2857–2928, 2930–2932, 2934–3256, 3258–3271, 3273–3304, 3306–3323, 3325–3333, 3335–3485, 3487–3511, 3313–3956, 3958–4078, 4080–4097, 4099–4136, 4138–4175, 4177–4279, 4281–4299, 4301–4324, 4326–4414, 4416–4552, 4554–4602, and 4604–5379, thereby modulating the activity of the biological pathway.

The present invention also relates to a method of identifying a polynucleotide that modulates a stress response in a plant cell. In one embodiment the method comprises determining gene expression in a plant exposed to at least one stress to produce an expression profile and identifying sequences whose expression is altered at least two fold compared to plants not exposed to the stress. Such an expression profile can be obtained, for example, by contacting an array of probes representative of a plant cell genome with nucleic acid molecules expressed in a plant cell exposed to the stress; and detecting one or more nucleic acid molecules expressed at a level different from a level of expression in the absence of the stress. The method can further comprise introducing the differentially expressed nucleic acid molecule into a plant cell; and detecting a modulated response of the genetically modified plant cell to a stress, thereby identifying a polynucleotide that modulates a stress response in a plant cell. The stress can be any stress, for example, an abiotic stress such as exposure to an abnormal level of cold, osmotic pressure, and salinity. The contacting is under conditions that allow for selective hybridization of a nucleic acid molecule with probe having sufficient complementarity, for example, under stringent hybridization conditions. Expression of the nucleic acid molecule can increase or decrease the tolerance of the plant cell to the stress, and the nucleic acid molecule can be expressed at a level that is less than or greater than the level of expression in the absence of the stress.

In still another embodiment, the polynucleotide portion of the plant stress-regulated gene can comprise a stress-regulated regulatory element, which can be operatively linked to a heterologous nucleotide sequence, the expression of which can modulate the responsiveness of the plant cell to a stress condition. Such a heterologous nucleotide sequence can encode, for example, a stress-inducible transcription factor such as DREB1A. The heterologous nucleotide sequence also can encode a polynucleotide that is specific for a plant stress-regulated gene, for example, an antisense molecule, an RNAi molecule, a ribozyme, and a triplexing agent, any of which, upon expression in the plant cell, reduces or inhibits expression of a stress-regulated polypeptide encoded by the gene, thereby modulating the responsiveness of the plant cell to a stress condition, for example, an abnormal level of cold, osmotic pressure, and salinity. In another aspect, the method can include introducing a polynucleotide portion of a plant stress-regulated gene into the plant cell, wherein the plant stress-regulated gene includes a nucleotide sequence of a polynucleotide as set forth in any of SEQ ID NOS:1–155, 157–228, 230–232, 234–557, 559–572, 574–605, 607–634, 636–786, 788–812, 814–1262, 1264–1386, 1387–1390, 1392–1404, 1406–1444, 1446–1483, 1485–1588, 1590–1608, 1610–1633, 1634–1725, 1727–1865, 1867–1917, 1919–1927, 1929–2855, 2857–2928, 2930–2932, 2934–3256, 3258–3271, 3273–3304, 3306–3323, 3325–3333, 3335–3485, 3487–3511, 3313–3956, 3958–4078, 4080–4097, 4099–4136, 4138–4175, 4177–4279, 4281–4299, 4301–4324, 4326–4414, 4416–4552, 4554–4602, and 4604–5379, thereby modulating the responsiveness of the plant cell to a stress condition. The invention also relates to a plant cell obtained by any of the methods of modulating the responsiveness of a plant to a stress condition or combination of stress conditions, and to a plant comprising such a plant cell.

The present invention further relates to a method of selecting a plant having an altered resistance to an abiotic stress condition or a combination of abiotic stress conditions, such a method being useful for marker-assisted breeding. Such a method can be performed, for example, by contacting nucleic acid molecules representative of expressed polynucleotides in a plant cell of a plant to be examined for having an altered resistance to an abiotic stress with a nucleic acid probes that selectively hybridizes under stringent conditions to a plant stress-regulated gene comprising a nucleotide sequence as set forth in any of SEQ ID NO:1–5379; detecting a level of selective hybridization of the nucleic acid probes to a nucleic acid molecule representative of an expressed polynucleotide in the plant cell, wherein the level of selective hybridization corresponds to the level of the expressed polynucleotide in the plant cell, which is indicative of resistance of the plant to an abiotic stress; and selecting a plant having a level of expression of a polynucleotide indicative of altered resistance to an abiotic stress condition. For example, the abiotic stress condition can be cold stress, and the nucleic acid probe can include at least about 15 nucleotides of a nucleotide sequence as set forth in any of SEQ ID NOS:1–1261 and 2704–3955, for example, at least about 15 nucleotides of a nucleotide sequence as set forth in any of SEQ ID NOS:1–155, 157–228, 230–232, 234–557, 559–572, 574–605, 607–634, 636–786, 788–812, 814–1261, 2704–2855, 2857–2928, 2930–2932, 2934–3256, 3258–3271, 3273–3304, 3306–3323, 3325–3333, 3335–3485, 3487–3511, and 3313–3955; or the abiotic stress condition can be saline stress, and the nucleic acid probe can include at least about 15 nucleotides of a nucleotide sequence as set forth in any of SEQ ID NOS:2226–2427 and 4910–5107; or the abiotic stress condition can be osmotic stress, and the nucleic acid probe can include at least about 15 nucleotides of a nucleotide sequence as set forth in any of SEQ ID NOS:2428–2585 and 5108–5263. In addition, a combination of abiotic stress conditions can be a combination of cold stress and osmotic stress, and the nucleic acid probe can include at least about 15 nucleotides of a nucleotide sequence as set forth in any of SEQ ID NOS:1669–1969 and 4389–4654, for example, at least about 15 nucleotides of a nucleotide sequence as set forth in any of SEQ ID NOS:

1699–1725, 1727–1865, 1867–1917, 1919–1927, 1929–1969, 4389–4414, 4416–4552, 4554–4602, 4604–4612, and 4613–4654; or the combination of abiotic stress conditions can be a combination of cold stress and saline stress, and the nucleic acid probe can include at least about 15 nucleotides of a nucleotide sequence as set forth in any of SEQ ID NOS: 1970–2226 and 4655–4909; or the combination of abiotic stress conditions can be a combination of osmotic stress and saline stress, and the nucleic acid probe can include at least about 15 nucleotides of a nucleotide sequence as set forth in any of SEQ ID NOS:2586–2703 and 5264–5379; or the combination of abiotic stress conditions can be a combination of cold stress, osmotic stress and saline stress, and the nucleic acid probe can include at least about 15 nucleotides of a nucleotide sequence as set forth in any of SEQ ID NOS:1262–1698 and 3956–4388, for example, at least about 15 nucleotides of a nucleotide sequence as set forth in any of SEQ ID NOS: 1262, 1264–1386, 1387–1390, 1392–1404, 1406–1444, 1446–1483, 1485–1588, 1590–1608, 1610–1633, 1634–1698, 3956, 3958–4078, 4080–4097, 4099–4136, 4138–4175, 4177–4279, 4281–4299, 4301–4324, and 4326–4388.

The present invention also relates to a method of expressing a heterologous nucleotide sequence in a plant cell. Such a method can be performed, for example, by introducing into the plant cell a plant stress-regulated regulatory element operatively linked to the heterologous nucleotide sequence, whereby, upon exposure of the plant cell to a stress condition, the heterologous nucleotide sequence is expressed in the plant cell. In one embodiment, the stress-regulated gene regulatory element is any of the sequences described herein that are capable of altering transcription of an operatively linked sequence in response to an abiotic stress, for example, SEQ ID NOS:2704–5379. In another embodiment, stress-regulated gene regulatory element comprises a nucleotide sequence as set forth in any of SEQ ID NOS:2704–2855, 2857–2928, 2930–2932, 2934–3256, 3258–3271, 3273–3304, 3306–3323, 3325–3333, 3335–3485, 3487–3511, 3313–3956, 3958–4078, 4080–4097, 4099–4136, 4138–4175, 4177–4279, 4281–4299, 4301–4324, 4326–4414, 4416–4552, 4554–4602, and 4604–5379, whereby, upon exposure of the plant cell to stress condition, the heterologous nucleotide sequence is expressed in the plant cell. The heterologous nucleotide sequence can encode a selectable marker, a diagnostic marker, or a polypeptide that confers a desirable trait upon the plant cell, for example, a polypeptide that improves the nutritional value, digestibility or ornamental value of the plant cell, or a plant comprising the plant cell.

The present invention additionally relates to a method of identifying a stress condition to which a plant cell was exposed by comparing an expression profile from a test plant suspected of having been exposed to at least one stress condition to an expression profile obtained from a reference plant, preferably of the same species, which has been exposed to the suspected stress condition. Such a method can be performed, for example, by contacting nucleic acid molecules representative of expressed polynucleotides in cells of the test plant with at least one nucleic acid probe under conditions suitable for selective hybridization to a complementary nucleotide sequence, wherein the probe comprises at least 15 nucleotides of a plant stress-regulated gene, wherein the stress-regulated gene does not have a nucleotide sequence of a polynucleotide as set forth in any of SEQ ID NOS:156, 229, 233, 558, 573, 606, 635, 787, 813, 1263, 1386, 1391, 1405, 1445, 1484, 1589, 1609, 1634, 1726, 1866, 1918 or 1928, or a nucleotide sequence complementary thereto, whereby detecting selective hybridization of at least one nucleic acid probe, or detecting a change in a level of selective hybridization as compared to a level of selective hybridization obtained using nucleic acid molecules representative of expressed polynucleotides in cells of a plant known not have been exposed to an abiotic stress, indicates that the test plant has been exposed to an abiotic stress, and whereby an absence of selective hybridization of at least one nucleic acid probe indicates that the test plant has not been exposed to an abiotic stress. For example, the abiotic stress is cold stress, and the probe can include at least 15 nucleotides of a nucleotide sequence as set forth in any of SEQ ID NOS:1–155, 157–228, 230–232, 234–557, 559–572, 574–605, 607–634, 636–786, 788–812, 814–1261 or a nucleotide sequence complementary thereto; or the abiotic stress can be a saline stress, and the probe can include at least 15 nucleotides of a nucleotide sequence as set forth in any of SEQ ID NOS:2226–2427 or a nucleotide sequence complementary thereto; or the abiotic stress can be an osmotic stress, and the probe can include at least 15 nucleotides of a nucleotide sequence as set forth in two or more of SEQ ID NOS:2428–2585 or a nucleotide sequence complementary thereto.

A method of identifying a stress condition to which a plant cell was exposed also can be performed, for example, by contacting nucleic acid molecules expressed in the test plant cell with an array of probes representative of the plant cell genome; detecting a profile of expressed nucleic acid molecules characteristic of a stress response, and comparing the expression pattern in the test plant to the expression pattern obtained from a reference plant thereby identifying the stress condition to which the plant cell was exposed. The contacting is under conditions that allow for selective hybridization of a nucleic acid molecule with probes having sufficient complementarity, for example, under stringent hybridization conditions. The profile can be characteristic of exposure to a single stress condition, for example, an abnormal level of cold, osmotic pressure, or salinity, or can be characteristic of exposure to more than one stress condition, for example, cold, increased osmotic pressure and increased salinity. In one embodiment, the nucleotide sequence of a gene whose expression is detected is selected from a polynucleotide comprising any of SEQ ID NOS:1–2703. In further embodiments, the nucleotide sequence of a gene that is expressed in response a particular stress or combination of stresses can comprise a polynucleotide expressed in response to cold stress (SEQ ID NOS:1–1261), osmotic stress (SEQ ID NOS:2428–2585), saline (salt) stress (SEQ ID NOS: 2227–2427), a combination of cold and osmotic stress (SEQ ID NOS:1699–1969), a combination of saline and osmotic stress (SEQ ID NOS:1970–2226), a combination of osmotic and saline stress (SEQ ID NOS:2586–2703), or a combination of cold, osmotic and saline stress (SEQ ID NOS: 1262–1698).

In another embodiment, the method can be used for determining whether a test plant has been exposed to a combination of abiotic stress conditions. Such a method can be performed, for example, by contacting nucleic acid molecules representative of expressed polynucleotides in cells of the test plant with at least one nucleic acid probe under conditions suitable for selective hybridization to a complementary nucleotide sequence, whereby detecting selective hybridization of at least one nucleic acid probe, or detecting a change in a level of selective hybridization as compared to a level of selective hybridization obtained using nucleic acid molecules representative of expressed polynucleotides in cells of a plant known not have been exposed to a combination of stress conditions, indicates that the test plant has been exposed to a combination of abiotic stress conditions, and whereby an absence of selective hybridization of at least one nucleic acid probe indicates that the test plant has not been exposed to a combination of abiotic stress conditions. For example, the combination of abiotic stress conditions can be a combination of a cold stress and an osmotic stress, and the probe can include at least 15 nucleotides of a nucleotide sequence as set forth in any of SEQ ID NOS:1699–1969, or a nucleotide sequence complementary thereto; or the combination of abiotic stress conditions can be a combination of a cold stress and a saline stress, and the probe can include at least 15 nucleotides of a nucleotide sequence as set forth in any of SEQ ID NOS:1970–2226, or a nucleotide sequence complementary thereto; or the combination of abiotic stress conditions can be a combination of an osmotic stress and a saline stress, and the probe can included at least 15 nucleotides of a nucleotide sequence as set forth in any of SEQ ID NOS:2586–2703, or a nucleotide sequence complementary thereto; or the combination of abiotic stress conditions can be a combination of a cold stress, a saline stress and an osmotic stress, and the probe can include at least 15 nucleotides of a nucleotide sequence as set forth in any of SEQ ID NOS:1262–1698, or a nucleotide sequence complementary thereto.

The present invention also relates to a method for monitoring a population of plants for exposure to a stress condition or combination of stress conditions. Such a method can be performed, for example, by introducing into the population of a plants a sentinel plant, wherein said sentinel plant is a transgenic plant, which contains plant cells containing a stress-regulated regulatory element operatively linked to a polynucleotide encoding a detectable marker; and examining the sentinel plant for expression of the detectable marker, which is indicative of exposure of the population of plants to a stress condition or combination of stress conditions. The stress condition or combination of stress conditions can be any such condition or conditions, particularly an abiotic stress condition or combination of abiotic stress conditions. The detectable marker can be any reporter molecule that is readily or conveniently detectable, particularly a marker that is visibly detectable, for example, a luminescent detectable marker such as luciferin, or a fluorescent detectable marker such as a green fluorescent protein, a yellow fluorescent protein, a cyan fluorescent protein, a red fluorescent protein, or an enhanced or modified form thereof.

The present invention further relates to a transgenic plant, which contains a nucleic acid construct comprising a polynucleotide portion of plant stress-regulated polynucleotide. In one embodiment, the transgenic plant exhibits altered responsiveness to a stress condition as compared to a corresponding reference plant not containing the construct. Such a transgenic plant can contain, for example, a construct that disrupts an endogenous stress-regulated gene in the plant, thereby reducing or inhibiting expression of the gene in response to a stress condition. Such a knock-out can increase or decrease tolerance of the plant to a stress condition. The transgene also can comprise a coding sequence of a plant stress-regulated gene, which can be operatively linked to a heterologous regulatory element such as a constitutively active regulatory element, an regulated regulatory element, a tissues specific or phase specific regulatory element, or the like. In another embodiment, the transgenic plant contains a nucleic acid construct comprising a plant stress-regulated regulatory element, which can be operatively linked to a heterologous nucleotide sequence that can encode a polypeptide. Expression of the heterologous polypeptide can confer a desirable characteristic on the plant, for example, can improve the nutritional or ornamental value of the transgenic plant. In still another embodiment, the transgenic plant contains multiple nucleic acid constructs, which can be multiple copies of the same construct, or can be two or more different constructs.

The present invention also relates to a plant stress-regulated regulatory element, which is obtained from a plant stress-regulated polynucleotide disclosed herein for example any of SEQ ID NOS:2704–5379; a homolog or ortholog thereof The invention also provides a method of identifying an agent, for example a transcription factor, that specifically binds to or activates a plant stress-regulated regulatory element. Such a method can be performed, for example, by contacting the regulatory element with a plant cell extract, and identifying polypeptides that specifically bind to the regulatory element. Confirmation that the specifically binding polypeptide is a transcription factor can be demonstrated using, for example, the stress-regulated regulatory element operably linked to a reporter gene, and detecting expression of the reporter gene. Control constructs comprising a regulatory element, other than a plant stress-regulated regulatory element, operatively linked to a reporter molecule can be used to confirm that the transcription factor is specific for the plant stress-regulated regulatory element. A polynucleotide encoding such a transcription factor also can be obtained.

The present invention also relates to a method of using a polynucleotide portion of a plant stress-regulated gene to confer a selective advantage on a plant cell. In one embodiment, such a method is performed by introducing a plant stress-regulated regulatory element into a plant cell such as those described herein, wherein, upon exposure of the plant cell to a stress condition to which the regulatory element is responsive, a nucleotide sequence operatively linked to the regulatory element is expressed, thereby conferring a selective advantage to plant cell. The operatively linked nucleotide sequence can be, for example, a transcription factor, the expression of which induces the further expression of polynucleotides involved in a stress response, thereby enhancing the response of a plant to the stress condition. In another embodiment, a coding sequence of a plant stress-regulated gene as disclosed herein is introduced into the cell, thereby providing the plant with a selective advantage in response to a stress condition. In still another embodiment, the method results in the knock-out of a plant stress-regulated gene as disclosed herein in a first population of plants, thereby providing a selective advantage to a stress condition in a second population of plants.

The invention further relates to a method of identifying an agent that modulates the activity of a stress-regulated regulatory element of a plant. In a particular embodiment, is provided a method for identifying an agent that alters the activity of an abiotic stress responsive regulatory element comprising contacting the agent or a composition containing an agent to be tested with at least one abiotic stress responsive regulatory element, preferably selected from the group consisting of SEQ ID NOS:2704–5379 (see Table 2), and determining the effect of the agent on the ability of the regulatory sequence to regulate transcription. In further embodiments, the regulatory elements are associated with particular stresses or combination of stresses such as cold stress (SEQ ID NOS:2704–3955), osmotic stress (SEQ ID NOS:5108–5263), saline stress (SEQ ID NOS:4910–5107), a combination of cold and osmotic stress (SEQ ID NOS: 4389–4654), a combination of cold and saline stress (SEQ ID NOS:4655–4909), a combination of osmotic and saline stress (SEQ ID NOS:5264–5379), or a combination of cold, osmotic and saline stress (SEQ ID NOS:3956–4388). In one embodiment, the regulatory element can be operatively linked to a heterologous polynucleotide encoding a reporter molecule, and an agent that modulates the activity of the stress-regulated regulatory element can be identified by detecting a change in expression of the reporter molecule due to contacting the regulatory element with the agent. Such a method can be performed in vitro in a plant cell-free system, or in a plant cell in culture or in a plant in situ. In another embodiment, the agent is contacted with a transgenic plant containing an introduced plant stress-regulated regulatory element, and an agent that modulates the activity of the regulatory element is identified by detecting a phenotypic change in the transgenic plant. The methods of the invention can be performed in the presence or absence of the stress condition to which the particularly regulatory element is responsive.

Another aspect provides a method for identifying an agent that alters abiotic stress responsive polynucleotide expression in a plant or plant cell comprising contacting a plant or plant cell with a test agent; subjecting the plant cell or plant cell to an abiotic stress or combination of stresses before, during or after contact with the agent to be tested; obtaining an expression profile of the plant or plant cell and comparing the expression profile of the plant or plant cell to an expression profile from a plant or plant cell not exposed to the abiotic stress or combination of stresses. In one embodiment, the expression profile comprises expression data for at least one nucleotide sequence comprising any of SEQ ID NOS:1–5379 (see Tables 1 and 2). In additional embodiments, the expression profile comprises expression data for at least one, and preferably two or more sequences associated with a particular abiotic stress or combination of stresses such as cold stress (SEQ ID NOS:1–1261 and 2704–3955), osmotic stress (SEQ ID NOS:2428–2585 and 5108–5263), saline stress (SEQ ID NOS:2227–2427 and 4910–5107), a combination of cold and osmotic stress (SEQ ID NOS:1699–1969 and 4389–4654), a combination of cold and saline stress (SEQ ID NOS:1970–2226 and 4655–4909), a combination of osmotic and saline stress (SEQ ID NOS: 2586–2703 and 5264–5379), or a combination of cold, osmotic and saline stress (SEQ ID NOS:1262–1698 and 3956–4388).

Still another aspect provides nucleotide probes useful for detecting an abiotic stress response in plants, the probes comprising a nucleotide sequence of at least 15, 25, 50 or 100 nucleotides that hybridizes under stringent, preferably highly stringent, conditions to at least one sequence comprising any of SEQ ID NOS:1–2703. Also provided are nucleotide probes comprising at least 15, 25, 50 or 100 nucleotides in length that hybridize under stringent, preferably highly stringent conditions, to at least one gene associated with a particular stress or combination of stresses, for example cold stress, (SEQ ID NOS:1–1261), osmotic stress (SEQ ID NOS:2428–2585), saline stress (SEQ ID NOS: 2227–2427), a combination of cold and osmotic stress (SEQ ID NOS:1699–1969), a combination of cold and saline stress (SEQ ID NOS: 1970–2226), a combination of osmotic and saline stress (SEQ ID NOS:2586–2703), or a combination of cold, osmotic, and saline stress (SEQ ID NOS: 1262–1698).

An additional aspect provides a method for marker-assisted breeding to select plants having an altered resistance to abiotic stress comprising obtaining nucleic acid molecules from the plants to be selected; contacting the nucleic acid molecules with one or more probes that selectively hybridize under stringent, preferably highly stringent, conditions to a nucleic acid sequence selected from the group consisting of SEQ ID NOS:1–2703; detecting the hybridization of the one or more probes to the nucleic acid sequences wherein the presence of the hybridization indicates the presence of a gene associated with altered resistance to abiotic stress; and selecting plants on the basis of the presence or absence of such hybridization. Marker-assisted selection can also be accomplished using one or more probes which selectively hybridize under stringent, preferably highly stringent conditions, to a nucleotide sequence comprising a polynucleotide expressed in response associated with a particular stress, for example, a nucleotide sequence comprising any of SEQ ID NOS:1–1261 (cold stress), SEQ ID NOS:2428–2585 (osmotic stress), SEQ ID NOS:2227–2427 (saline stress), SEQ ID NOS:1699–1969 (cold and osmotic stress), SEQ ID NOS:1970–2226 (cold and saline stress), SEQ ID NOS:2586–2703 (osmotic and saline stress), or SEQ ID NOS:1262–1698 (cold, osmotic and saline stress). In each case marker-assisted selection can be accomplished using a probe or probes to a single sequence or multiple sequences. If multiple sequences are used they can be used simultaneously or sequentially.

A further aspect provides a method for monitoring a population of plants comprising providing at least one sentinel plant containing a recombinant polynucleotide comprising a stress responsive regulatory sequence selected from the group consisting of SEQ ID NOS:2704–5379 which is operatively linked to a nucleotide sequence encoding a detectable marker, for example a fluorescent protein. Additional aspects provide the use of various regulatory sequences including those associated with cold stress (SEQ ID NOS:2704–3955), osmotic stress (SEQ ID NOS: 5108–5263), saline stress (SEQ ID NOS:4910–5107), cold and osmotic stress (SEQ ID NOS:4389–4654), cold and saline stress (SEQ ID NOS:4655–4909), osmotic and saline stress (SEQ ID NOS:5264–5379), and cold, osmotic and saline stress (SEQ ID NOS:3956–4388), or fragments thereof wherein such fragments can alter transcription of an operatively linked nucleotide sequence in response to an abiotic stress.

A further aspect provides a computer readable medium having stored thereon computer executable instructions for performing a method comprising receiving data on gene expression in a test plant of at least one nucleic acid molecule having at least 70%, preferably at least 80%, more preferably at least 90%, and most preferably at least 95% nucleotide sequence identity to one or more polynucleotide sequences as set forth in any of SEQ ID NOS:1–2703; and comparing expression data from the test plant to expression data for the same polynucleotide sequence or sequences in a plant that has been exposed to at least one abiotic stress.

Yet a further aspect provides a computer readable medium having stored thereon a data structure comprising, sequence data for at least one, and preferably a plurality of nucleic acid molecules having at least 70%, preferably at least 80%, more preferably at least 90%, and most preferably at least 95% nucleotide sequence identity to a polynucleotide comprising any of SEQ ID NOS:1–2703, or the complement thereof; and a module receiving the nucleic acid molecule sequence data which compares the nucleic acid molecule sequence data to at least one other nucleic acid sequence.

DETAILED DESCRIPTION OF THE INVENTION

The present invention relates to clusters of genes that are induced in response to one or a combination of abiotic stress conditions. Abiotic stress conditions, such as a shortage or excess of solar energy, water and nutrients, and salinity, high and low temperature, or pollution (e.g., heavy metals), can have a major impact on plant growth and can significantly reduce the yield, for example, of cultivars. Under conditions of abiotic stress, the growth of plant cells is inhibited by arresting the cell cycle in late G1, before DNA synthesis, or at the G2/M boundary (see Dudits, Plant Cell Division, Portland Press Research, Monograph; Francis, Dudits, and Inze, eds., 1997; chap. 2, page 21; Bergounioux, *Protoplasma* 142:127–136, 1988). The identification of stress-regulated gene clusters, using microarray technology, provides a means to identify plant stress-regulated genes.

As used herein, the term "cluster," when used in reference to stress-regulated genes, refers to nucleotide sequences of genes that have been selected by drawing Venn diagrams, and selecting those genes that are regulated only by a selected stress condition. In general, a cluster of stress-regulated genes includes at least 5, 10, 15, or 20 genes, including polynucleotide portions thereof, each of which is responsive to the same selected stress condition or conditions. The selected stress condition can be a single stress condition, for example, cold, osmotic stress or salinity stress (see Tables 3–14), or can be a selected combination of stress conditions, for example, cold, osmotic stress and salinity stress (see Tables 15–26). In addition, a cluster can be selected based on specifying that all of the genes are coordinately regulated, for example, they all start at a low level and are induced to a higher level. However, a cluster of saline stress-regulated genes, for example, that was selected for coordinate regulation from low to high, also can be decreased in response to cold or mannitol. By varying the parameters used for selecting a cluster of gene nucleotide sequences, those genes that are expressed in a specific manner following a stress can be identified.

As used herein in reference to a polynucleotide or polynucleotide portion of a gene or nucleic acid molecule, the term "isolated" means a polynucleotide, polynucleotide portion of a gene, or nucleic acid molecule that is free of one or both of the nucleotide sequences that normally flank the polynucleotide in a genome of a naturally-occurring organism from which the polynucleotide is derived. The term includes, for example, a polynucleotide or fragment thereof that is incorporated into a vector or expression cassette; into an autonomously replicating plasmid or virus; into the genomic DNA of a prokaryote or eukaryote; or that exists as a separate molecule independent of other polynucleotides. It also includes a recombinant polynucleotide that is part of a hybrid polynucleotide, for example, one encoding a polypeptide sequence.

The terms "polynucleotide," "oligonucleotide," and "nucleic acid sequence" are used interchangeably herein to refer to a polymeric (2 or more monomers) form of nucleotides of any length, either ribonucleotides or deoxyribonucleotides. Although nucleotides are usually joined by phosphodiester linkages, the term also includes polymers containing neutral amide backbone linkages composed of aminoethyl glycine units. The terms are used only to refer to the primary structure of the molecule. Thus, the term includes double stranded and single stranded DNA molecules, including a sense strand or an antisense strand, and RNA molecules as well as genomic DNA, cDNA, mRNA and the like. It will be recognized that such polynucleotides can be modified, for example, by including a label such as a radioactive, fluorescent or other tag, by methylation, by the inclusion of a cap structure, by containing a substitution of one or more of the naturally occurring nucleotides with a nucleotide analog, by containing an internucleotide modification such as having uncharged linkages (e.g., methyl phosphonates, phosphotriesters, phosphoramidates, carbamates, or the like), by containing a pendant moiety such as a protein (e.g., a nuclease, toxin, antibody, signal peptide, poly-L-lysine, or the like), by containing an intercalator such as acridine or psoralen, by containing a chelator, which can be a metal such as boron, an oxidative metal, or a radioactive metal, by containing an alkylator, or by having a modified linkage (e.g., an alpha anomeric nucleic acid).

The term "recombinant nucleic acid molecule" refers to a polynucleotide produced by human intervention. A recombinant nucleic acid molecule can contain two or more nucleotide sequences that are linked in a manner such that the product is not found in a cell in nature. In particular, the two or more nucleotide sequences can be operatively linked and, for example, can encode a fusion polypeptide, or can comprise a nucleotide sequence and a regulatory element. A recombinant nucleic acid molecule also can be based on, but different, from a naturally occurring polynucleotide, for example, a polynucleotide having one or more nucleotide changes such that a first codon, which normally is found in the polynucleotide, is replaced with a degenerate codon that encodes the same or a conservative amino acid, or such that a sequence of interest is introduced into the polynucleotide, for example, a restriction endonuclease recognition site or a splice site, a promoter, a DNA replication initiation site, or the like.

As used herein, the term "abiotic stress" or "abiotic stress condition" refers to the exposure of a plant, plant cell, or the like, to a non-living ("abiotic") physical or chemical agent or condition that has an adverse effect on metabolism, growth, development, propagation and/or survival of the plant (collectively "growth"). An abiotic stress can be imposed on a plant due, for example, to an environmental factor such as water (e.g., flooding, drought, dehydration), anaerobic conditions (e.g., a low level of oxygen), abnormal osmotic conditions, salinity or temperature (e.g., hot/heat, cold, freezing, frost), a deficiency of nutrients or exposure to pollutants, or by a hormone, second messenger or other molecule. Anaerobic stress, for example, is due to a reduction in oxygen levels (hypoxia or anoxia) sufficient to produce a stress response. A flooding stress can be due to prolonged or transient immersion of a plant, plant part, tissue or isolated cell in a liquid medium such as occurs during monsoon, wet season, flash flooding or excessive irrigation of plants, or the like. A cold stress or heat stress can occur due to a decrease or increase, respectively, in the temperature from the optimum range of growth temperatures for a particular plant species. Such optimum growth temperature ranges are readily determined or known to those skilled in the art. Dehydration stress can be induced by the loss of water, reduced turgor, or reduced water content of a cell, tissue, organ or whole plant. Drought stress can be induced by or associated with the deprivation of water or reduced supply of water to a cell, tissue, organ or organism. Saline stress (salt stress) can be associated with or induced by a perturbation in the osmotic potential of the intracellular or extracellular environment of a cell. Osmotic stress also can be associated with or induced by a change, for example, in the concentration of molecules in the intracellular or extracellular environment of a plant cell, particularly where the molecules cannot be partitioned across the plant cell membrane.

As disclosed herein, clusters of plant stress-regulated genes (Example 1; see, also, Tables 1–31) and homologs and orthologs thereof (Table 32) have been identified. Remarkably, several of the stress-regulated genes previously were known to encode polypeptides having defined cellular functions, including roles as transcription factors, enzymes such as kinases, and structural proteins such as channel proteins (see Tables 29–31). The identification of *Arabidopsis* stress-regulated genes provides a means to identify homologous and orthologous genes and gene sequences in other plant species using well known procedures and algorithms based on identity (or homology) to the disclosed sequences. Thus, the invention provides polynucleotide sequences comprising plant stress-regulated genes that are homologs or orthologs, variants, or otherwise substantially similar to the polynucleotides disclosed herein, and having an E value $\leq 1 \times 10^{-8}$, which can be identified, for example, by a BLASTN search using the *Arabidopsis* polynucleotides of Tables 1 and 2 (SEQ ID NOS:1–5379) as query sequences (see Table 32, on CD).

A polynucleotide sequence of a stress-regulated gene as disclosed herein can be particularly useful for performing the methods of the invention on a variety of plants, including but not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Cofea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea ultilane*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, duckweed (*Lemna*), barley, tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals such as azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum are also included. Additional ornamentals within the scope of the invention include impatiens, Begonia, Pelargonium, Viola, Cyclamen, Verbena, Vinca, Tagetes, Primula, Saint Paulia, Agertum, Amaranthus, Antihirrhinum, Aquilegia, Cineraria, Clover, Cosmo, Cowpea, Dahlia, Datura, Delphinium, Gerbera, Gladiolus, Gloxinia, Hippeastrum, Mesembryanthemum, Salpiglossos, and Zinnia. Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*), Douglas-fir (*Pseudotsuga menziesii*); Western hemlock (*Tsuga ultilane*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*).

Leguminous plants which may be used in the practice of the present invention include beans and peas. Beans include guar, locust bean, fenugreek, soybean, garden beans, cowpea, mung bean, lima bean, fava bean, lentils, chickpea, etc. Legumes include, but are not limited to, *Arachis*, e.g., peanuts, *Vicia*, e.g., crown vetch, hairy vetch, adzuki bean, mung bean, and chickpea, *Lupinus*, e.g., lupine, trifolium, *Phaseolus*, e.g., common bean and lima bean, *Pisum*, e.g., field bean, *Melilotus*, e.g., clover, *Medicago*, e.g., alfalfa, *Lotus*, e.g., trefoil, lens, e.g., lentil, and false indigo. Preferred forage and turf grass for use in the methods of the invention include alfalfa, orchard grass, tall fescue, perennial ryegrass, creeping bent grass, and redtop.

Other plants within the scope of the invention include *Acacia*, aneth, artichoke, arugula, blackberry, canola, cilantro, clementines, escarole, eucalyptus, fennel, grapefruit, honey dew, jicama, kiwifruit, lemon, lime, mushroom, nut, okra, orange, parsley, persimmon, plantain, pomegranate, poplar, radiata pine, radicchio, Southern pine, sweetgum, tangerine, triticale, vine, yams, apple, pear, quince, cherry, apricot, melon, hemp, buckwheat, grape, raspberry, chenopodium, blueberry, nectarine, peach, plum, strawberry, watermelon, eggplant, pepper, cauliflower, *Brassica*, e.g., broccoli, cabbage, ultilan sprouts, onion, carrot, leek, beet, broad bean, celery, radish, pumpkin, endive, gourd, garlic, snapbean, spinach, squash, turnip, ultilane, chicory, groundnut and zucchini.

As used herein, the term "substantially similar", when used herein with respect to a nucleotide sequence, means a nucleotide sequence corresponding to a reference nucleotide sequence, wherein the corresponding sequence encodes a polypeptide or comprises a regulatory element having substantially the same structure and function as the polypeptide encoded by the reference nucleotide sequence, for example, where only changes in amino acids not affecting the polypeptide function occur. For purposes of the present invention, a reference (or query) sequence is a polynucleotide sequence as set forth in any of SEQ ID NOS:1–2703 or a polypeptide encoded thereby. Desirably, a substantially similar nucleotide sequence encodes the polypeptide encoded by the reference nucleotide sequence. The percentage of identity between the substantially similar nucleotide sequence and the reference nucleotide sequence desirably is at least 60%, more desirably at least 75%, preferably at least 90%, more preferably at least 95%, still more preferably at least 99% and including 100%. A nucleotide sequence is "substantially similar" to reference nucleotide sequence hybridizes to the reference nucleotide sequence in 7% sodium dodecyl sulfate (SDS), 0.5 M NaPO$_4$, 1 mM EDTA at 50° C. with washing in 2×SSC, 0.1% SDS at 50° C., more desirably in 7% sodium dodecyl sulfate (SDS), 0.5 M NaPO$_4$, 1 mM EDTA at 50° C. with washing in 1×SSC, 0.1% SDS at 50° C. (stringent conditions), more desirably still in 7% sodium dodecyl sulfate (SDS), 0.5 M NaPO$_4$, 1 mM EDTA at 50° C. with washing in 0.5×SSC, 0.1% SDS at 50° C. (high stringency), preferably in 7% sodium dodecyl sulfate (SDS), 0.5 M NaPO$_4$, 1 mM EDTA at 50° C. with washing in 0.1×SSC, 0.1% SDS at 50° C. (very high stringency), more preferably in 7% sodium dodecyl sulfate (SDS), 0.5 M NaPO$_4$, 1 mM EDTA at 50° C. with washing in 0.1×SSC, 0.1% SDS at 65° C. (extremely high stringency).

In addition, the term "substantially similar," when used in reference to a polypeptide sequence, means that an amino acid sequence relative to a reference (query) sequence shares at least about 65% amino acid sequence identity, particularly at least about 75% amino acid sequence identity, and preferably at least about 85%, more preferably at least about 90%, and most preferably at least about 95% or greater amino acid sequence identity. Generally, sequences having an E≦10$^{-8}$ are considered to be substantially similar to a query sequence. Such sequence identity can take into account conservative amino acid changes that do not substantially affect the function of a polypeptide. As such, homologs or orthologs of the *Arabidopsis* stress-regulated nucleotide sequences disclosed herein, variants thereof, and polypeptides substantially similar to the polynucleotide sequence of *Arabidopsis* stress-regulated genes set forth in SEQ ID NOS:1–5379 are encompassed within the present invention and, therefore, useful for practicing the methods of the invention (see, for example, Table 32, which is on the CD-R filed herewith, and incorporated herein by reference).

Homology or identity is often measured using sequence analysis software such as the Sequence Analysis Software Package of the Genetics Computer Group (University of Wisconsin Biotechnology Center, 1710 University Avenue, Madison, Wis. 53705). Such software matches similar sequences by assigning degrees of homology to various deletions, substitutions and other modifications. The terms "homology" and "identity," when used herein in the context of two or more nucleic acids or polypeptide sequences, refer to two or more sequences or subsequences that are the same or have a specified percentage of amino acid residues or of nucleotides that are the same when compared and aligned for maximum correspondence over a comparison window or designated region as measured using any number of sequence comparison algorithms or by manual alignment and visual inspection.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

The term "comparison window" is used broadly herein to include reference to a segment of any one of the number of contiguous positions, for example, about 20 to 600 positions, for example, amino acid or nucleotide position, usually about 50 to about 200 positions, more usually about 100 to about 150 positions, in which a sequence may be compared to a reference sequence of the same number of contiguous positions after the two sequences are optimally aligned. Methods of alignment of sequence for comparison are well-known in the art. Optimal alignment of sequences for comparison can be conducted, for example, by the local homology algorithm of Smith and Waterman (*Adv. Appl. Math.* 2:482, 1981), by the homology alignment algorithm of Needleman and Wunsch (*J. Mol. Biol.* 48:443, 1970), by the search for similarity method of Person and Lipman (*Proc. Natl. Acad. Sci., USA* 85:2444, 1988), each of which is incorporated herein by reference; by computerized implementations of these algorithms (GAP, BESTFIT, FASTA, and TFASTA in the Wisconsin Genetics Software Package, Genetics Computer Group, 575 Science Dr., Madison, Wis.); or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences.

A number of genome databases are available for comparison. Several databases containing genomic information annotated with some functional information are maintained by different organizations, and are accessible via the internet, for example, at world wide web addresses (url's) "wwwtigr.org/tdb"; "genetics.wisc.edu"; "genome-www-.stanford.edu/~ball"; "hiv-web.lanl.gov"; "ncbi.nlm.nih-.gov"; "ebi.ac.uk"; "Pasteur.fr/other/biology"; and "genome.wi.mit.edu".

In particular, the BLAST and BLAST 2.0 algorithms using default parameters are particularly useful for identifying polynucleotide and polypeptides encompassed within the present invention (Altschul et al. (*Nucleic Acids Res.* 25:3389–3402, 1977; *J. Mol. Biol.* 215:403–410, 1990, each of which is incorporated herein by reference). Software for performing BLAST analyses is publicly available through the National Center for Biotechnology Information (http://www.ncbi.nlm.nih.gov). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra, 1977, 1990). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=4 and a comparison of both strands. For amino acid sequences, the BLASTP program uses as defaults a wordlength of 3, and expectations (E) of 10, and the BLOSUM62 scoring matrix (see Henikoff and Henikoff, *Proc. Natl. Acad. Sci., USA* 89:10915, 1989) alignments (B) of 50, expectation (E) of 10, M=5, N=4, and a comparison of both strands.

The BLAST algorithm also performs a statistical analysis of the similarity between two sequences (see, for example, Karlin and Altschul, *Proc. Natl. Acad. Sci. USA* 90:5873, 1993, which is incorporated herein by reference). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more preferably less than about 0.01, and most preferably less than about 0.001. Significantly, upon identifying polynucleotides that are substantially similar to those of SEQ ID NOS:1–5379, the identified polynucleotides can be used as query sequences in a BLAST search to identify polynucleotides and polypeptides substantially similar thereto.

It should be noted that the nucleotide sequences set forth as SEQ ID NOS:1–2703 comprise coding sequences, whereas the nucleotide sequences set forth as SEQ ID NOS:2704–5379 comprise regulatory sequences. In addition, the coding sequences and regulatory sequences are related in that, for example, SEQ ID NO:1 is the coding sequence of a plant cold regulated gene having a 5' upstream (regulatory) sequence set forth as SEQ ID NO:2704 (see Table 2). Similarly, SEQ ID NO:2705 comprises a regulatory region of SEQ ID NO:2, SEQ ID NO:2706 comprises a regulatory region of SEQ ID NO:3, and so forth as shown in Table 2. As such, reference herein, for example, to a "polynucleotide comprising SEQ ID NO:1" can, unless indicated otherwise, include at least SEQ ID NO:2704. In some cases, the entire coding region of a plant stress regulated gene or the 5' upstream sequence has not yet been determined (see, for example, SEQ ID NO:43 in Table 3, where "none" indicates that 5' upstream regulatory sequences have not yet been determined). However, the determination of a complete coding sequence where only a portion is known or of regulatory sequences where a portion of the coding sequence is known can be made using methods as disclosed herein or otherwise known in the art.

In one embodiment, protein and nucleic acid sequence homologies are evaluated using the Basic Local Alignment Search Tool ("BLAST"). In particular, five specific BLAST programs are used to perform the following task:

(1) BLASTP and BLAST3 compare an amino acid query sequence against a protein sequence database;
(2) BLASTN compares a nucleotide query sequence against a nucleotide sequence database;
(3) BLASTX compares the six-frame conceptual translation products of a query nucleotide sequence (both strands) against a protein sequence database;
(4) TBLASTN compares a query protein sequence against a nucleotide sequence database translated in all six reading frames (both strands); and
(5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., *Science* 256:1443–1445, 1992; Henikoff and Henikoff, *Proteins* 17:49–61, 1993, each of which is incorporated herein by reference). Less preferably, the PAM or PAM250 matrices may also be used (Schwartz and Dayhoff, eds., "Matrices for Detecting Distance Relationships: Atlas of Protein Sequence and Structure" (Washington, National Biomedical Research Foundation 1978)). BLAST programs are accessible through the U.S. National Library of Medicine, for example, on the world wide web at address (url) "ncbi.nlm.nih.gov".

The parameters used with the above algorithms may be adapted depending on the sequence length and degree of homology studied. In some embodiments, the parameters may be the default parameters used by the algorithms in the absence of instructions from the user.

The term "substantially similar" also is used in reference to a comparison of expression profiles of nucleotide sequences, wherein a determination that an expression profile characteristic of a stress response is substantially similar to the profile of nucleic acid molecules expressed in a plant cell being examined ("test plant") is indicative of exposure of the test plant cell to one or a combination of abiotic stress conditions. When used in reference to such a comparison of expression profiles, the term "substantially similar" means that the individual nucleotide sequences in the test plant cell profile are altered in the same manner as the corresponding nucleotide sequences in the expression profile characteristic of the stress response.

By way of example, where exposure to saline results in an increased expression of nucleotide sequences A, B and C, and a decreased expression of nucleotide sequences D and E, as indicated by the expression profile characteristic of a saline stress response, a determination that corresponding nucleotide sequences A, B and C in the test plant cell are increased and that nucleotides sequences D and E are decreased is indicative of exposure of the test plant cell to a saline stress condition. It should be recognized that, where, for example, only nucleotide sequences A, B, D and E are examined in the test plant cell, an increase in A and B and a decrease in D and E expression of the test plant cells is considered to be substantially similar to the expression profile characteristic of a saline stress condition and, therefore, is indicative of exposure of the plant cell to a saline stress condition. Similarly, where the levels of expression of the nucleotide sequences examined in a test plant are altered in the same manner, i.e., are increased or are decreased, as that observed in an expression profile characteristic of a particular stress response, the absolute levels of expression may vary, for example, two-fold, five-fold, ten-fold, or the like. Nevertheless, the expression profile of the test plant cell is considered to be substantially similar to the expression profile characteristic of the particular stress response and, therefore, indicative of exposure of the plant cell to the stress condition.

As disclosed herein, clusters of stress-regulated genes (and their products), some of which also have been described as having cellular functions such as enzymatic activity or roles as transcription factors, are involved in the response of plant cells to various abiotic stresses (see Tables 29–31; see, also, Tables 1 and 32). As such, the polynucleotide sequences comprising the genes in a cluster likely share common stress-regulated regulatory elements, including, for example, cold-regulated regulatory elements (SEQ ID NOS:2704–3955), salinity-regulated regulatory elements (SEQ ID NOS:4910–5107, and osmotic pressure-regulated regulatory elements (SEQ ID NO:5108–5263), as well as regulatory elements that are responsive to a combination of stress conditions, but not to any of the individual stress conditions, alone (SEQ ID NOS:3956–4909 and 5263–5379). The identification of such clusters of genes thus provides a means to identify the stress-regulated regulatory elements that control the level of expression of these genes.

As used herein, the term "plant stress-regulated gene" means a polynucleotide sequence of a plant, the transcription of which is altered in response to exposure to a stress condition, and the regulatory elements linked to such a polynucleotide sequence and involved in the stress response, which can be induction or repression. In general, plant stress gene regulatory elements are contained within a sequence including approximately two kilobases upstream (5') of the transcription or translation start site and two kilobases downstream (3') of the transcription or translation termination site. In the absence of an abiotic stress condition, the stress-regulated gene can normally be unexpressed in the cells, can be expressed at a basal level, which is induced to a higher level in response to the stress condition, or can be expressed at a level that is reduced (decreased) in response to the stress condition. The coding region of a plant stress-regulated gene encodes a stress-regulated polypeptide, and also can be the basis for expression of a functional RNA molecule such as an antisense molecule or ribozyme. A stress-regulated polypeptide can have an adaptive effect on a plant, thereby allowing the plant to better tolerate stress conditions; or can have a maladaptive effect, thereby decreasing the ability of the plant to tolerate the stress conditions.

The present invention provides an isolated plant stress-regulated regulatory element, which regulates expression of an operatively linked nucleotide sequence in a plant in response a stress condition. As disclosed herein, a plant stress-regulated regulatory element can be isolated from a polynucleotide sequence of a plant stress-regulated gene comprising a nucleotide sequence as set forth in SEQ ID NOS:1–2703, for example any of SEQ ID NOS:2704–5379 (see Table 2). It is recognized that certain of the polynucleotides set forth as SEQ ID NOS:1–5379 previously have been described as being involved in a stress-regulated response in plants, including SEQ ID NOS:156, 229, 233, 558, 573, 606, 625, 635, 787, 813, 1263, 1386, 1391, 1405, 1445, 1484, 1589, 1609, 1634, 1726, 1866, 1918, and 1928 and, therefore, are not encompassed, in whole or in part, within the compositions of the invention, and are encompassed within only certain particular methods of the invention, for example, methods of making a transgenic plant that is resistant to two or more stress conditions, since, even where such a gene was known to be expressed in response to a single stress condition such as cold or saline (e.g., SEQ ID NO:1263), it was not known prior to the present disclosure that any of these genes was responsive to a combination of stress conditions (for example, a combination of cold and osmotic stress for SEQ ID NOS:1726, 1866, 1918, and 1928; or a combination of cold, osmotic and saline stress for SEQ ID NOS:1263, 1386, 1391, 1405, 1445, 1484, 1589, 1609, and 1634).

Methods for identifying and isolating the stress-regulated regulatory element from the disclosed polynucleotides, or genomic DNA clones corresponding thereto, are well known in the art. For example, methods of making deletion constructs or linker-scanner constructs can be used to identify nucleotide sequences that are responsive to a stress condition. Generally, such constructs include a reporter gene operatively linked to the sequence to be examined for regulatory activity. By performing such assays, a plant stress-regulated regulatory element can be defined within a sequence of about 500 nucleotides or fewer, generally at least about 200 nucleotides or fewer, particularly about 50 to 100 nucleotides, and more particularly at least about 20 nucleotides or fewer. Preferably the minimal (core) sequence required for regulating a stress response of a plant is identified.

The nucleotide sequences of the genes of a cluster also can be examined using a homology search engine such as described herein to identify sequences of conserved identity, particularly in the nucleotide sequence upstream of the transcription start site. Since all of the genes in a cluster as disclosed are induced in response to a particular stress condition or a particular combination of stress conditions, some or all of the nucleotide sequences can share conserved stress-regulated regulatory elements. By performing such a homology search, putative stress-regulated regulatory elements can be identified. The ability of such identified sequences to function as a plant stress-regulated regulatory element can be confirmed, for example, by operatively linking the sequence to a reporter gene and assaying the construct for responsiveness to a stress condition.

As used herein, the term "regulatory element" means a nucleotide sequence that, when operatively linked to a coding region of a gene, effects transcription of the coding region such that a ribonucleic acid (RNA) molecule is transcribed from the coding region. A regulatory element generally can increase or decrease the amount of transcription of a nucleotide sequence, for example, a coding sequence, operatively linked to the element with respect to the level at which the nucleotide sequence would be transcribed absent the regulatory element. Regulatory elements are well known in the art and include promoters, enhancers, silencers, inactivated silencer intron sequences, 3'-untranslated or 5'-untranslated sequences of transcribed sequence, for example, a poly-A signal sequence, or other protein or RNA stabilizing elements, or other gene expression control elements known to regulate gene expression or the amount of expression of a gene product. A regulatory element can be isolated from a naturally occurring genomic DNA sequence or can be synthetic, for example, a synthetic promoter.

Regulatory elements can be constitutively expressed regulatory element, which maintain gene expression at a relative level of activity (basal level), or can be regulated regulatory elements. Constitutively expressed regulatory elements can be expressed in any cell type, or can be tissue specific, which are expressed only in particular cell types, phase specific, which are expressed only during particular developmental or growth stages of a plant cell, or the like. A regulatory element such as a tissue specific or phase specific regulatory element or an inducible regulatory element useful in constructing a recombinant polynucleotide or in a practicing a method of the invention can be a regulatory element that generally, in nature, is found in a plant genome. However, the regulatory element also can be from an organism other than a plant, including, for example, from a plant virus, an animal virus, or a cell from an animal or other multicellular organism.

A regulatory element useful for practicing method of the present is a promoter element. Useful promoters include, but are not limited to, constitutive, inducible, temporally regulated, developmentally regulated, spatially-regulated, chemically regulated, stress-responsive, tissue-specific, viral and synthetic promoters. Promoter sequences are known to be strong or weak. A strong promoter provides for a high level of gene expression, whereas a weak promoter provides for a very low level of gene expression. An inducible promoter is a promoter that provides for the turning on and off of gene expression in response to an exogenously added agent, or to an environmental or developmental stimulus. A bacterial promoter such as the $P_{tac}$ promoter can be induced to varying levels of gene expression depending on the level of isothiopropylgalactoside added to the transformed bacterial cells. An isolated promoter sequence that is a strong promoter for heterologous nucleic acid is advantageous because it provides for a sufficient level of gene expression to allow for easy detection and selection of transformed cells and provides for a high level of gene expression when desired.

Within a plant promoter region there are several domains that are necessary for full function of the promoter. The first of these domains lies immediately upstream of the structural gene and forms the "core promoter region" containing consensus sequences, normally 70 base pairs immediately upstream of the gene. The core promoter region contains the characteristic CAAT and TATA boxes plus surrounding sequences, and represents a transcription initiation sequence that defines the transcription start point for the structural gene.

The presence of the core promoter region defines a sequence as being a promoter: if the region is absent, the promoter is non-functional. The core promoter region, however, is insufficient to provide full promoter activity. A series of regulatory sequences upstream of the core constitute the remainder of the promoter. These regulatory sequences determine expression level, the spatial and temporal pattern of expression and, for an important subset of promoters, expression under inductive conditions (regulation by external factors such as light, temperature, chemicals, hormones).

To define a minimal promoter region, a DNA segment representing the promoter region is removed from the 5' region of the gene of interest and operably linked to the coding sequence of a marker (reporter) gene by recombinant DNA techniques well known to the art. The reporter gene is operably linked downstream of the promoter, so that transcripts initiating at the promoter proceed through the reporter gene. Reporter genes generally encode proteins which are easily measured, including, but not limited to, chloramphenicol acetyl transferase (CAT), beta-glucuronidase (GUS), green fluorescent protein (GFP), β-galactosidase (β-GAL), and luciferase.

The construct containing the reporter gene under the control of the promoter is then introduced into an appropriate cell type by transfection techniques well known to the art. To assay for the reporter protein, cell lysates are prepared and appropriate assays, which are well known in the art, for the reporter protein are performed. For example, if CAT were the reporter gene of choice, the lysates from cells transfected with constructs containing CAT under the control of a promoter under study are mixed with isotopically labeled chloramphenicol and acetyl-coenzyme A (acetyl-CoA). The CAT enzyme transfers the acetyl group from acetyl-CoA to the 2-position or 3-position of chloramphenicol. The reaction is monitored by thin layer chromatography, which separates acetylated chloramphenicol from unreacted material. The reaction products are then visualized by autoradiography.

The level of enzyme activity corresponds to the amount of enzyme that was made, which in turn reveals the level of expression from the promoter of interest. This level of expression can be compared to other promoters to determine the relative strength of the promoter under study. In order to be sure that the level of expression is determined by the promoter, rather than by the stability of the mRNA, the level of the reporter mRNA can be measured directly, for example, by northern blot analysis.

Once activity is detected, mutational and/or deletional analyses may be employed to determine the minimal region and/or sequences required to initiate transcription. Thus, sequences can be deleted at the 5' end of the promoter region and/or at the 3' end of the promoter region, and nucleotide substitutions introduced. These constructs are then introduced to cells and their activity determined.

The choice of promoter will vary depending on the temporal and spatial requirements for expression, and also depending on the target species. In some cases, expression in multiple tissues is desirable. While in others, tissue-specific, e.g., leaf-specific, seed-specific, petal-specific, anther-specific, or pith-specific, expression is desirable. Although many promoters from dicotyledons have been shown to be operational in monocotyledons and vice versa, ideally dicotyledonous promoters are selected for expression in dicotyledons, and monocotyledonous promoters for expression in monocotyledons. There is, however, no restriction to the origin or source of a selected promoter. It is sufficient that the promoters are operational in driving the expression of a desired nucleotide sequence in the particular cell.

A range of naturally-occurring promoters are known to be operative in plants and have been used to drive the expression of heterologous (both foreign and endogenous) genes and nucleotide sequences in plants: for example, the constitutive 35S cauliflower mosaic virus (CaMV) promoter, the ripening-enhanced tomato polygalacturonase promoter (Bird et al., 1988), the E8 promoter (Diekman and Fischer, 1988) and the fruit specific 2A1 promoter (Pear et al., 1989). Many other promoters, e.g., U2 and U5 snRNA promoters from maize, the promoter from alcohol dehydrogenase, the Z4 promoter from a gene encoding the Z4 22 kD zein protein, the Z10 promoter from a gene encoding a 10 kD zein protein, a Z27 promoter from a gene encoding a 27 kD zein protein, the A20 promoter from the gene encoding a 19 kD zein protein, inducible promoters, such as the light inducible promoter derived from the pea rbcS gene and the actin promoter from rice, e.g., the actin 2 promoter (WO 00/70067); seed specific promoters, such as the phaseolin promoter from beans, may also be used. The nucleotide sequences of the stress-regulated genes of this invention can also be expressed under the regulation of promoters that are chemically regulated. This enables the nucleic acid sequence or encoded polypeptide to be synthesized only when the crop plants are treated with the inducing chemicals. Chemical induction of gene expression is detailed in EP 0 332 104 and U.S. Pat. No. 5,614,395.

In some instances it may be desirable to link a constitutive promoter to a polynucleotide comprising a stress regulated gene of the invention. Examples of some constitutive promoters include the rice actin 1 (Wang et al., 1992; U.S. Pat.

No. 5,641,876), CaMV 35S (Odell et al., 1985), CaMV 19S (Lawton et al., 1987), nos, Adh, sucrose synthase; and the ubiquitin promoters.

In other situations it may be desirable to limit expression of stress-related sequences to specific tissues or stages of development. As used herein, the term "tissue specific or phase specific regulatory element" means a nucleotide sequence that effects transcription in only one or a few cell types, or only during one or a few stages of the life cycle of a plant, for example, only for a period of time during a particular stage of growth, development or differentiation. The terms "tissue specific" and "phase specific" are used together herein in referring to a regulatory element because a single regulatory element can have characteristics of both types of regulatory elements. For example, a regulatory element active only during a particular stage of plant development also can be expressed only in one or a few types of cells in the plant during the particular stage of development. As such, any attempt to classify such regulatory elements as tissue specific or as phase specific can be difficult. Accordingly, unless indicated otherwise, all regulatory elements having the characteristic of a tissue specific regulatory element, or a phase specific regulatory element, or both are considered together for purposes of the present invention.

Examples of tissue specific promoters which have been described include the lectin (Vodkin, 1983; Lindstrom et al., 1990) corn alcohol dehydrogenase 1 (Vogel et al., 1989; Dennis et al., 1984), corn light harvesting complex (Simpson, 1986; Bansal et al., 1992), corn heat shock protein (Odell et al., 1985), pea small subunit RuBP carboxylase (Poulsen et al., 1986), Ti plasmid mannopine synthase and Ti plasmid nopaline synthase (Langridge et al., 1989), petunia chalcone isomerase (vanTunen et al., 1988), bean glycine rich protein 1 (Keller et al., 1989), truncated CaMV 35s (Odell et al., 1985), potato patatin (Wenzler et al., 1989), root cell (Yamamoto et al., 1990), maize zein (Reina et al., 1990; Kriz et al., 1987; Wandelt et al., 1989; Langridge et al., 1983; Reina et al., 1990), globulin-1 (Belanger et al., 1991), α-tubulin, cab (Sullivan et al., 1989), PEPCase (Hudspeth & Grula, 1989), R gene complex-associated promoters (Chandler et al., 1989), histone, and chalcone synthase promoters (Franken et al., 1991). Tissue specific enhancers are described by Fromm et al. (1989).

Several other tissue-specific regulated genes and/or promoters have been reported in plants, including genes encoding seed storage proteins such as napin, cruciferin, beta-conglycinin, and phaseolin, zein or oil body proteins such as oleosin, genes involved in fatty acid biosynthesis, including acyl carrier protein, stearoyl-ACP desaturase, fatty acid desaturases (fad 2-1), and other genes expressed during embryonic development such as Bce4 (see, for example, EP 255378 and Kridl et al., 1991). Particularly useful for seed-specific expression is the pea vicilin promoter (Czako et al., 1992). (See also U.S. Pat. No. 5,625,136, which is incorporated herein by reference.) Other useful promoters for expression in mature leaves are those that are switched on at the onset of senescence, such as the SAG promoter from *Arabidopsis* (Gan et al., 1995).

A class of fruit-specific promoters expressed at or during antithesis through fruit development, at least until the beginning of ripening, is discussed in U.S. Pat. No. 4,943,674. cDNA clones that are preferentially expressed in cotton fiber have been isolated (John et al., 1992). cDNA clones from tomato displaying differential expression during fruit development have been isolated and characterized (Mansson et al., 1985, Slater et al., 1985). The promoter for polygalacturonase gene is active in fruit ripening. The polygalacturonase gene is described in U.S. Pat. Nos. 4,535,060, 4,769,061, 4,801,590, and 5,107,065, each of which is incorporated herein by reference.

Other examples of tissue-specific promoters include those that direct expression in leaf cells following damage to the leaf (for example, from chewing insects), in tubers (for example, patatin gene promoter), and in fiber cells (an example of a developmentally-regulated fiber cell protein is E6 (John et al., 1992). The E6 gene is most active in fiber, although low levels of transcripts are found in leaf, ovule and flower.

Additional tissue specific or phase specific regulatory elements include, for example, the AGL8/FRUITFULL regulatory element, which is activated upon floral induction (Hempel et al., *Development* 124:3845–3853, 1997, which is incorporated herein by reference); root specific regulatory elements such as the regulatory elements from the RCP1 gene and the LRP1 gene (Tsugeki and Fedoroff, *Proc. Natl. Acad., USA* 96:12941–12946, 1999; Smith and Fedoroff, *Plant Cell* 7:735–745, 1995, each of which is incorporated herein by reference); flower specific regulatory elements such as the regulatory elements from the LEAFY gene and the APETELA1 gene (Blazquez et al., *Development* 124: 3835–3844, 1997, which is incorporated herein by reference; Hempel et al., supra, 1997); seed specific regulatory elements such as the regulatory element from the oleosin gene (Plant et al., *Plant Mol. Biol.* 25:193–205, 1994, which is incorporated herein by reference), and dehiscence zone specific regulatory element. Additional tissue specific or phase specific regulatory elements include the Zn13 promoter, which is a pollen specific promoter (Hamilton et al., *Plant Mol. Biol.* 18:211–218, 1992, which is incorporated herein by reference); the UNUSUAL FLORAL ORGANS (UFO) promoter, which is active in apical shoot meristem; the promoter active in shoot meristems (Atanassova et al., *Plant J.* 2:291, 1992, which is incorporated herein by reference), the cdc2a promoter and cyc07 promoter (see, for example, Ito et al., *Plant Mol. Biol.* 24:863, 1994; Martinez et al., *Proc. Natl. Acad. Sci., USA* 89:7360, 1992; Medford et al., *Plant Cell* 3:359, 1991; Terada et al., *Plant J.* 3:241, 1993; Wissenbach et al., *Plant J.* 4:411, 1993, each of which is incorporated herein by reference); the promoter of the APETELA3 gene, which is active in floral meristems (Jack et al., *Cell* 76:703, 1994, which is incorporated herein by reference; Hempel et al., supra, 1997); a promoter of an agamous-like (AGL) family member, for example, AGL8, which is active in shoot meristem upon the transition to flowering (Hempel et al., supra, 1997); floral abscission zone promoters; L1-specific promoters; and the like.

The tissue-specificity of some "tissue-specific" promoters may not be absolute and may be tested by one skilled in the art using the diphtheria toxin sequence. One can also achieve tissue-specific expression with "leaky" expression by a combination of different tissue-specific promoters (Beals et al., 1997). Other tissue-specific promoters can be isolated by one skilled in the art (see U.S. Pat. No. 5,589,379). Several inducible promoters ("gene switches") have been reported, many of which are described in the review by Gatz (1996) and Gatz (1997). These include tetracycline repressor system, Lac repressor system, copper inducible systems, salicylate inducible systems (such as the PR1a system), glucocorticoid (Aoyama et al., 1997) and ecdysone inducible systems. Also included are the benzene sulphonamide (U.S. Pat. No. 5,364,780) and alcohol (WO 97/06269 and WO 97/06268) inducible systems and glutathione S-transferase promoters.

In some instances it might be desirable to inhibit expression of a native DNA sequence within a plant's tissues to achieve a desired phenotype. In this case, such inhibition might be accomplished with transformation of the plant to comprise a constitutive, tissue-independent promoter operably linked to an antisense nucleotide sequence, such that constitutive expression of the antisense sequence produces an RNA transcript that interferes with translation of the mRNA of the native DNA sequence.

Inducible regulatory elements also are useful for purposes of the present invention. As used herein, the term "inducible regulatory element" means a regulatory element that, when exposed to an inducing agent, effects an increased level of transcription of a nucleotide sequence to which it is operatively linked as compared to the level of transcription, if any, in the absence of an inducing agent. Inducible regulatory elements can be those that have no basal or constitutive activity and only effect transcription upon exposure to an inducing agent, or those that effect a basal or constitutive level of transcription, which is increased upon exposure to an inducing agent. Inducible regulatory elements that effect a basal or constitutive level of expression generally are useful in a method or composition of the invention where the induced level of transcription is substantially greater than the basal or constitutive level of expression, for example, at least about two-fold greater, or at least about five-fold greater. Particularly useful inducible regulatory elements do not have a basal or constitutive activity, or increase the level of transcription at least about ten-fold greater than a basal or constitutive level of transcription associated with the regulatory element.

Inducible promoters that have been described include the ABA- and turgor-inducible promoters, the promoter of the auxin-binding protein gene (Schwob et al., 1993), the UDP glucose flavonoid glycosyl-transferase gene promoter (Ralston et al., 1988), the MPI proteinase inhibitor promoter (Cordero et al., 1994), and the glyceraldehyde-3-phosphate dehydrogenase gene promoter (Kohler et al., 1995; Quigley et al., 1989; Martinez et al., 1989).

The term "inducing agent" is used to refer to a chemical, biological or physical agent or environmental condition that effects transcription from an inducible regulatory element. In response to exposure to an inducing agent, transcription from the inducible regulatory element generally is initiated de novo or is increased above a basal or constitutive level of expression. Such induction can be identified using the methods disclosed herein, including detecting an increased level of RNA transcribed from a nucleotide sequence operatively linked to the regulatory element, increased expression of a polypeptide encoded by the nucleotide sequence, or a phenotype conferred by expression of the encoded polypeptide.

An inducing agent useful in a method of the invention is selected based on the particular inducible regulatory element. For example, the inducible regulatory element can be a metallothionein regulatory element, a copper inducible regulatory element or a tetracycline inducible regulatory element, the transcription from which can be effected in response to metal ions, copper or tetracycline, respectively (Furst et al., *Cell* 55:705–717, 1988; Mett et al., *Proc. Natl. Acad. Sci. USA* 90:4567–4571, 1993; Gatz et al., *Plant J.* 2:397–404, 1992; Roder et al., *Mol. Gen. Genet.* 243:32–38, 1994, each of which is incorporated herein by reference). The inducible regulatory element also can be an ecdysone regulatory element or a glucocorticoid regulatory element, the transcription from which can be effected in response to ecdysone or other steroid (Christopherson et al., *Proc. Natl. Acad. Sci., USA* 89:6314–6318, 1992; Schena et al., *Proc. Natl. Acad. Sci., USA* 88:10421–10425, 1991, each of which is incorporated herein by reference). In addition, the regulatory element can be a cold responsive regulatory element or a heat shock regulatory element, the transcription of which can be effected in response to exposure to cold or heat, respectively (Takahashi et al., *Plant Physiol.* 99:383–390, 1992, which is incorporated herein by reference). Additional regulatory elements useful in the methods or compositions of the invention include, for example, the spinach nitrite reductase gene regulatory element (Back et al., *Plant Mol. Biol.* 17:9, 1991, which is incorporated herein by reference); a light inducible regulatory element (Feinbaum et al., *Mol. Gen. Genet.* 226:449, 1991; Lam and Chua, *Science* 248:471, 1990, each of which is incorporated herein by reference), a plant hormone inducible regulatory element (Yamaguchi-Shinozaki et al., *Plant Mol. Biol.* 15:905, 1990; Kares et al., *Plant Mol. Biol.* 15:225, 1990, each of which is incorporated herein by reference), and the like.

An inducible regulatory element also can be a plant stress-regulated regulatory element of the invention. In addition to the known stress conditions that specifically induce or repress expression from such elements, the present invention provides methods of identifying agents that mimic a stress condition. Accordingly, such stress mimics are considered inducing or repressing agents with respect to a plant stress-regulated regulatory element. In addition, a recombinant polypeptide comprising a zinc finger domain, which is specific for the regulatory element, and an effector domain, particularly an activator, can be useful as an inducing agent for a plant stress-regulated regulatory element. Furthermore, such a recombinant polypeptide provides the advantage that the effector domain can be a repressor domain, thereby providing a repressing agent, which decreases expression from the regulatory element. In addition, use of such a method of modulating expression of an endogenous plant stress-regulated gene provides the advantage that the polynucleotide encoding the recombinant polypeptide can be introduced into cells of the plant, thus providing a transgenic plant that can be regulated coordinately with the endogenous plant stress-regulated gene upon exposure to a stress condition. A polynucleotide encoding such a recombinant polypeptide can be operatively linked to and expressed from a constitutively active, inducible or tissue specific or phase specific regulatory element.

In one embodiment, the promoter may be a gamma zein promoter, an oleosin ole16 promoter, a globulin I promoter, an actin I promoter, an actin c1 promoter, a sucrose synthetase promoter, an INOPS promoter, an EXM5 promoter, a globulin2 promoter, a b-32, ADPG-pyrophosphorylase promoter, an LtpI promoter, an Ltp2 promoter, an oleosin ole17 promoter, an oleosin ole18 promoter, an actin 2 promoter, a pollen-specific protein promoter, a pollen-specific pectate lyase promoter, an anther-specific protein promoter (Huffman), an anther-specific gene RTS2 promoter, a pollen-specific gene promoter, a tapeturn-specific gene promoter, tapeturn-specific gene RAB24 promoter, a anthranilate synthase alpha subunit promoter, an alpha zein promoter, an anthranilate synthase beta subunit promoter, a dihydrodipicolinate synthase promoter, a Thi 1 promoter, an alcohol dehydrogenase promoter, a cab binding protein promoter, an H3C4 promoter, a RUBISCO SS starch branching enzyme promoter, an ACCase promoter, an actin3 promoter, an actin7 promoter, a regulatory protein GF14-12 promoter, a ribosomal protein L9 promoter, a cellulose biosynthetic enzyme promoter, an S-adenosyl-L-homocysteine hydrolase promoter, a superoxide dismutase promoter, a C-kinase receptor promoter, a phosphoglycerate mutase promoter, a root-specific RCc3 mRNA promoter, a glucose-6 phosphate isomerase promoter, a pyrophosphate-fructose 6-phosphate-1-phosphotransferase promoter, an ubiquitin promoter, a beta-ketoacyl-ACP synthase promoter, a 33 kDa photosystem 11 promoter, an oxygen evolving protein promoter, a 69 kDa vacuolar ATPase subunit promoter, a metallothionein-like protein promoter, a glyceraldehyde-3-phosphate dehydrogenase promoter, an ABA- and ripening-inducible-like protein promoter, a phenylalanine ammonia lyase promoter, an adenosine triphosphatase S-adenosyl-L-homocysteine hydrolase promoter, an a-tubulin promoter, a cab promoter, a PEPCase promoter, an R gene promoter, a lectin promoter, a light harvesting complex promoter, a heat shock protein promoter, a chalcone synthase promoter, a zein promoter, a globulin-1 promoter, an ABA promoter, an auxin-binding protein promoter, a UDP glucose flavonoid glycosyl-transferase gene promoter, an NTI promoter, an actin promoter, an opaque 2 promoter, a b70 promoter, an oleosin promoter, a CaMV 35S promoter, a CaMV 19S promoter, a histone promoter, a turgor-inducible promoter, a pea small subunit RuBP carboxylase promoter, a Ti plasmid mannopine synthase promoter, Ti plasmid nopaline synthase promoter, a petunia chalcone isomerase promoter, a bean glycine rich protein I promoter, a CaMV 35S transcript promoter, a potato patatin promoter, or a S-E9 small subunit RuBP carboxylase promoter.

In addition to promoters, a variety of 5' and 3' transcriptional regulatory sequences are also available for use in the present invention. Transcriptional terminators are responsible for the termination of transcription and correct mRNA polyadenylation. The 3'-untranslated regulatory DNA sequence preferably includes from about 50 to about 1,000, more preferably about 100 to about 1,000, nucleotide base pairs and contains plant transcriptional and translational termination sequences. Appropriate transcriptional terminators and those which are known to function in plants include the CaMV 35S terminator, the tml terminator, the nopaline synthase terminator, the pea rbcS E9 terminator, the terminator for the T7 transcript from the octopine synthase gene of *Agrobacterium tumefaciens*, and the 3' end of the protease inhibitor I or II genes from potato or tomato, although other 3' elements known to those of skill in the art can also be employed. Alternatively, one also could use a gamma coixin, oleosin 3 or other terminator from the genus *Coix*. Preferred 3' elements include those from the nopaline synthase gene of *Agrobacterium tumefaciens* (Bevan et al., 1983), the terminator for the T7 transcript from the octopine synthase gene of *Agrobacterium tumefaciens*, and the 3' end of the protease inhibitor I or II genes from potato or tomato.

As the DNA sequence between the transcription initiation site and the start of the coding sequence, i.e., the untranslated leader sequence, can influence gene expression, one may also wish to employ a particular leader sequence. Preferred leader sequences are contemplated to include those that include sequences predicted to direct optimum expression of the attached sequence, i.e., to include a preferred consensus leader sequence that may increase or maintain mRNA stability and prevent inappropriate initiation of translation. The choice of such sequences will be known to those of skill in the art in light of the present disclosure. Sequences that are derived from genes that are highly expressed in plants will be most preferred.

Other sequences that have been found to enhance gene expression in transgenic plants include intron sequences (e.g., from Adh1, bronze1, actin1, actin2 (WO 00/760067), or the sucrose synthase intron) and viral leader sequences (e.g., from TMV, MCMV and AMV). For example, a number of non-translated leader sequences derived from viruses are known to enhance expression. Specifically, leader sequences from tobacco mosaic virus (TMV), maize chlorotic mottle virus (MCMV), and alfalfa mosaic virus (AMV) have been shown to be effective in enhancing expression (e.g., Gallie et al., 1987; Skuzeski et al., 1990). Other leaders known in the art include but are not limited to picornavirus leaders, for example, EMCV leader (encephalomyocarditis virus 5' non-coding region; Elroy-Stein et al., 1989); potyvirus leaders, for example, TEV leader (tobacco etch virus); MDMV leader (maize dwarf mosaic virus); human immunoglobulin heavy chain binding protein (BiP) leader, (Macejak et al., 1991); untranslated leader from the coat protein mRNA of AMV (AMV RNA 4; Jobling et al., 1987), TMV (Gallie et al., 1989), and MCMV (Lommel et al., 1991; see also, della Cioppa et al., 1987).

Regulatory elements such as Adh intron 1 (Callis et al., 1987), sucrose synthase intron (Vasil et al., 1989) or TMV omega element (Gallie, et al., 1989), may further be included where desired. Examples of enhancers include elements from the CaMV 35S promoter, octopine synthase genes (Ellis et al., 1987), the rice actin I gene, the maize alcohol dehydrogenase gene (Callis et al., 1987), the maize shrunken I gene (Vasil et al., 1989), TMV Omega element (Gallie et al., 1989) and promoters from non-plant eukaryotes (e.g. yeast; Ma et al., 1988).

Vectors for use in accordance with the present invention may be constructed to include the ocs enhancer element, which was first identified as a 16 bp palindromic enhancer from the octopine synthase (ocs) gene of ultilane (Ellis et al., 1987), and is present in at least 10 other promoters (Bouchez et al., 1989). The use of an enhancer element, such as the ocs element and particularly multiple copies of the element, will act to increase the level of transcription from adjacent promoters when applied in the context of monocot transformation.

The methods of the invention provide genetically modified plant cells, which can contain, for example, a coding region, or peptide portion thereof, of a plant stress-regulated gene operatively linked to a heterologous inducible regulatory element; or a plant stress-regulated regulatory element operatively linked to a heterologous nucleotide sequence encoding a polypeptide of interest. In such a plant, the expression from the inducible regulatory element can be effected by exposing the plant cells to an inducing agent in any of numerous ways depending, for example, on the inducible regulatory element and the inducing agent. For example, where the inducible regulatory element is a cold responsive regulatory element present in the cells of a transgenic plant, the plant can be exposed to cold conditions, which can be produced artificially, for example, by placing the plant in a thermostatically controlled room, or naturally, for example, by planting the plant in an environment characterized, at least in part, by attaining temperatures sufficient to induce transcription from the promoter but not so cold as to kill the plants. By examining the phenotype of such transgenic plants, those plants that ectopically express a gene product that confers increased resistance of the plant to cold can be identified. Similarly, a transgenic plant containing a metallothionein promoter can be exposed to metal ions such as cadmium or copper by watering the plants with a solution containing the inducing metal ions, or can be planted in soil that is contaminated with a level of such metal ions that is toxic to most plants. The phenotype of surviving plants can be observed, those expressing desirable traits can be selected.

As used herein, the term "phenotype" refers to a physically detectable characteristic. A phenotype can be identified visually by inspecting the physical appearance of a plant following exposure, for example, to increased osmotic conditions; can be identified using an assay to detecting a product produced due to expression of reporter gene, for example, an RNA molecule, a polypeptide such as an enzyme, or other detectable signal such as disclosed herein; or by using any appropriate tool useful for identifying a phenotype of a plant, for example, a microscope, a fluorescence activated cell sorter, or the like.

A transgenic plant containing an inducible regulatory element such as a steroid inducible regulatory element can be exposed to a steroid by watering the plants with a solution containing the steroid. The use of an inducible regulatory element that is induced upon exposure to a chemical or biological inducing agent that can be placed in solution or suspension in an aqueous medium can be particularly useful because the inducing agent can be applied conveniently to a relatively large crop of transgenic plants containing the inducible regulatory element, for example, through a watering system or by spraying the inducing agent over the field. As such, inducible regulatory elements that are responsive to an environmental inducing agent, for example, cold; heat; metal ions or other potentially toxic agents such as a pesticides, which can contaminate a soil; or the like; or inducible regulatory elements that are regulated by inducing agents that conveniently can be applied to plants, can be particularly useful in a method or composition of the invention, and allow the identification and selection of plants that express desirable traits and survive and grow in environments that otherwise would not support growth of the plants.

As disclosed herein, the present invention provides plant stress-regulated regulatory elements, which are identified based on the expression of clusters of plant genes in response to stress. As used herein, the term "stress-regulated regulatory element of a plant" or "plant stress-regulated regulatory element" means a nucleotide sequence of a plant genome that can respond to a stress such that expression of a gene product encoded by a gene comprising the regulatory element (a stress-inducible gene) is increased above or decreased below the level of expression of the gene product in the absence of the stress condition. The regulatory element can be any gene regulatory element, including, for example, a promoter, an enhancer, a silencer, or the like. In one embodiment, the plant stress-regulated regulatory element is a plant stress-regulated promoter.

For purposes of modulating the responsiveness of a plant to a stress condition, it can be useful to introduce a modified plant stress-regulated regulatory element into a plant. Such a modified regulatory element can have any desirable characteristic, for example, it can be inducible to a greater level than the corresponding wild-type promoter, or it can be inactivated such that, upon exposure to a stress, there is little or no induction of expression of a nucleotide sequence operatively linked to the mutant element. A plant stress-regulated regulatory element can be modified by incorporating random mutations using, for example, in vitro recombination or DNA shuffling (Stemmer et al., *Nature* 370: 389–391, 1994; U.S. Pat. No. 5,605,793, each of which is incorporated herein by reference). Using such a method, millions of mutant copies of the polynucleotide, for example, stress-regulated regulatory element, can be produced based on the original nucleotide sequence, and variants with improved properties, such as increased inducibility can be recovered.

A mutation method such as DNA shuffling encompasses forming a mutagenized double-stranded polynucleotide from a template double-stranded polynucleotide, wherein the template double-stranded polynucleotide has been cleaved into double stranded random fragments of a desired size, and comprises the steps of adding to the resultant population of double-stranded random fragments one or more single or double stranded oligonucleotides, wherein the oligonucleotides comprise an area of identity and an area of heterology to the double stranded template polynucleotide; denaturing the resultant mixture of double stranded random fragments and oligonucleotides into single stranded fragments; incubating the resultant population of single stranded fragments with a polymerase under conditions that result in the annealing of the single stranded fragments at the areas of identity to form pairs of annealed fragments, the areas of identity being sufficient for one member of a pair to prime replication of the other, thereby forming a mutagenized double-stranded polynucleotide; and repeating the second and third steps for at least two further cycles, wherein the resultant mixture in the second step of a further cycle includes the mutagenized double-stranded polynucleotide from the third step of the previous cycle, and the further cycle forms a further mutagenized double-stranded polynucleotide. Preferably, the concentration of a single species of double stranded random fragment in the population of double stranded random fragments is less than 1% by weight of the total DNA. In addition, the template double stranded polynucleotide can comprise at least about 100 species of polynucleotides. The size of the double stranded random fragments can be from about 5 base pairs to 5 kilobase pairs. In a further embodiment, the fourth step of the method comprises repeating the second and the third steps for at least 10 cycles.

A plant stress-regulated regulatory element of the invention is useful for expressing a nucleotide sequence operatively linked to the element in a cell, particularly a plant cell. As used herein, the term "expression" refers to the transcription and/or translation of an endogenous gene or a transgene in plants. In the case of an antisense molecule, for example, the term "expression" refers to the transcription of the polynucleotide encoding the antisense molecule.

As used herein, the term "operatively linked," when used in reference to a plant stress-regulated regulatory element, means that the regulatory element is positioned with respect to a second nucleotide sequence such that the regulatory element effects transcription or transcription and translation of the nucleotide sequence in substantially the same manner, but not necessarily to the same extent, as it does when the regulatory element is present in its natural position in a genome. Transcriptional promoters, for example, generally act in a position and orientation dependent manner and usually are positioned at or within about five nucleotides to about fifty nucleotides 5' (upstream) of the start site of transcription of a gene in nature. In comparison, enhancers and silencers can act in a relatively position or orientation independent manner and, therefore, can be positioned several hundred or thousand nucleotides upstream or downstream from a transcription start site, or in an intron within the coding region of a gene, yet still be operatively linked to a coding region so as to effect transcription.

The second nucleotide sequence, i.e., the sequence operatively linked to the plant stress-regulated regulatory element, can be any nucleotide sequence, including, for example, a coding region of a gene or cDNA; a sequence encoding an antisense molecule, an RNAi molecule, ribozyme, triplexing agent (see, for example, Frank-Kamenetskii and Mirkin,

*Ann. Rev. Biochem.* 64:65–95, 1995), or the like; or a sequence that, when transcribed, can be detected in the cell using, for example, by hybridization or amplification, or when translated produces a detectable signal. The term "coding region" is used broadly herein to include a nucleotide sequence of a genomic DNA or a cDNA molecule comprising all or part of a coding region of the coding strand. A coding region can be transcribed from an operatively linked regulatory element, and can be translated into a full length polypeptide or a peptide portion of a polypeptide. It should be recognized that, in a nucleotide sequence comprising a coding region, not all of the nucleotides in the sequence need necessarily encode the polypeptide and, particularly, that a gene transcript can contain one or more introns, which do not encode an amino acid sequence of a polypeptide but, nevertheless, are part of the coding region, particularly the coding strand, of the gene.

The present invention also relates to a recombinant polynucleotide, which contains a polynucleotide portion of a plant stress-regulated gene operatively linked to a heterologous nucleotide sequence. As used herein, the term "polynucleotide portion of plant stress-regulated sequence" means a contiguous nucleotide sequence of the plant stress-regulated gene that provides a function. The portion can be any portion of the sequence, particularly a coding sequence, or a sequence encoding a peptide portion of the stress-regulated polypeptide; the stress-regulated regulatory element; a sequence useful as an antisense molecule or triplexing agent; or a sequence useful for disrupting (knocking-out) an endogenous plant stress-regulated gene.

A heterologous nucleotide sequence is a nucleotide sequence that is not normally part of the plant stress-regulated gene from which the polynucleotide portion of the plant stress-regulated gene-component of the recombinant polynucleotide is obtained; or, if it is a part of the plant stress-regulated gene from which the polynucleotide portion is obtained, it is an orientation other than it would normally be in, for example, is an antisense sequence, or comprises at least partially discontinuous as compared to the genomic structure, for example, a single exon operatively linked to the regulatory element. In general, where the polynucleotide portion of the plant stress-regulated gene comprises the coding sequence in a recombinant polynucleotide of the invention, the heterologous nucleotide sequence will function as a regulatory element. The regulatory element can be any heterologous regulatory element, including, for example, a constitutively active regulatory element, an inducible regulatory element, or a tissue specific or phase specific regulatory element, as disclosed above. Conversely, where the polynucleotide portion of the plant stress-regulated polynucleotide comprises the stress-regulated regulatory element of a recombinant polynucleotide of the invention, the heterologous nucleotide sequence generally will be a nucleotide sequence that can be transcribed and, if desired, translated. Where the heterologous nucleotide sequence is expressed from a plant stress-regulated regulatory element, it generally confers a desirable phenotype to a plant cell containing the recombinant polynucleotide, or provides a means to identify a plant cell containing the recombinant polynucleotide. It should be recognized that a "desirable" phenotype can be one that decreases the ability of a plant cell to compete where the plant cell, or a plant containing the cell, is an undesired plant cell. Thus, a heterologous nucleotide sequence can allow a plant to grow, for example, under conditions in which it would not normally be able to grow.

A heterologous nucleotide sequence can be, or encode, a selectable marker. As used herein, the term "selectable marker" is used herein to refer to a molecule that, when present or expressed in a plant cell, provides a means to identify a plant cell containing the marker. As such, a selectable marker can provide a means for screening a population of plants, or plant cells, to identify those having the marker. A selectable marker also can confer a selective advantage to the plant cell, or a plant containing the cell. The selective advantage can be, for example, the ability to grow in the presence of a negative selective agent such as an antibiotic or herbicide, compared to the growth of plant cells that do not contain the selectable marker. The selective advantage also can be due, for example, to an enhanced or novel capacity to utilize an added compound as a nutrient, growth factor or energy source. A selectable advantage can be conferred, for example, by a single polynucleotide, or its expression product, or to a combination of polynucleotides whose expression in a plant cell gives the cell with a positive selective advantage, a negative selective advantage, or both.

Examples of selectable markers include those that confer antimetabolite resistance, for example, dihydrofolate reductase, which confers resistance to methotrexate (Reiss, *Plant Physiol.* (Life Sci. Adv.) 13:143–149, 1994); neomycin phosphotransferase, which confers resistance to the aminoglycosides neomycin, kanamycin and paromycin (Herrera-Estrella, *EMBO J.* 2:987–995, 1983) and hygro, which confers resistance to hygromycin (Marsh, *Gene* 32:481–485, 1984), trpB, which allows cells to utilize indole in place of tryptophan; hisD, which allows cells to utilize histinol in place of histidine (Hartman, *Proc. Natl. Acad. Sci., USA* 85:8047, 1988); mannose-6-phosphate isomerase which allows cells to utilize mannose (WO 94/20627); ornithine decarboxylase, which confers resistance to the ornithine decarboxylase inhibitor, 2-(difluoromethyl)-DL-ornithine (DFMO; McConlogue, 1987, In: Current Communications in Molecular Biology, Cold Spring Harbor Laboratory ed.); and deaminase from *Aspergillus terreus*, which confers resistance to Blasticidin S (Tamura, *Biosci. Biotechnol. Biochem.* 59:2336–2338, 1995). Additional selectable markers include those that confer herbicide resistance, for example, phosphinothricin acetyltransferase gene, which confers resistance to phosphinothricin (White et al., *Nucl. Acids Res.* 18:1062, 1990; Spencer et al., *Theor. Appl. Genet.* 79:625–631, 1990), a mutant EPSPV-synthase, which confers glyphosate resistance (Hinchee et al., *Bio/Technology* 91:915–922, 1998), a mutant acetolactate synthase, which confers imidazolione or sulfonylurea resistance (Lee et al., *EMBO J.* 7:1241–1248, 1988), a mutant psbA, which confers resistance to atrazine (Smeda et al., *Plant Physiol.* 103:911–917, 1993), or a mutant protoporphyrinogen oxidase (see U.S. Pat. No. 5,767,373), or other markers conferring resistance to an herbicide such as glufosinate. In addition, markers that facilitate identification of a plant cell containing the polynucleotide encoding the marker include, for example, luciferase (Giacomin, *Plant Sci.* 116:59–72, 1996; Scikantha, *J. Bacteriol.* 178:121, 1996), green fluorescent protein (Gerdes, *FEBS Lett.* 389:44–47, 1996) or fl-glucuronidase (Jefferson, *EMBO J.* 6:3901–3907, 1997), and numerous others as disclosed herein or otherwise known in the art. Such markers also can be used as reporter molecules.

A heterologous nucleotide sequence can encode an antisense molecule, particularly an antisense molecule specific for a nucleotide sequence of a plant stress-regulated gene, for example, the gene from which the regulatory component of the recombinant polynucleotide is derived. Such a recombinant polynucleotide can be useful for reducing the expression of a plant stress-regulated polypeptide in response to a stress condition because the antisense molecule, like the polypeptide, only will be induced upon exposure to the stress. A heterologous nucleotide sequence also can be, or can encode, a ribozyme or a triplexing agent. In addition to being useful as heterologous nucleotide sequences, such molecules also can be used directly in a method of the invention, for example, to modulate the responsiveness of a plant cell to a stress condition. Thus, an antisense molecule, ribozyme, or triplexing agent can be contacted directly with a target cell and, upon uptake by the cell, can effect their antisense, ribozyme or triplexing activity; or can be encoded by a heterologous nucleotide sequence that is expressed in a plant cell from a plant stress-regulated regulatory element, whereupon it can effect its activity.

An antisense polynucleotide, ribozyme or triplexing agent is complementary to a target sequence, which can be a DNA or RNA sequence, for example, messenger RNA, and can be a coding sequence, a nucleotide sequence comprising an intron-exon junction, a regulatory sequence such as a Shine-Delgarno-like sequence, or the like. The degree of complementarity is such that the polynucleotide, for example, an antisense polynucleotide, can interact specifically with the target sequence in a cell. Depending on the total length of the antisense or other polynucleotide, one or a few mismatches with respect to the target sequence can be tolerated without losing the specificity of the polynucleotide for its target sequence. Thus, few if any mismatches would be tolerated in an antisense molecule consisting, for example, of twenty nucleotides, whereas several mismatches will not affect the hybridization efficiency of an antisense molecule that is complementary, for example, to the full length of a target mRNA encoding a cellular polypeptide. The number of mismatches that can be tolerated can be estimated, for example, using well known formulas for determining hybridization kinetics (see Sambrook et al., "Molecular Cloning; A Laboratory Manual" 2nd Edition (Cold Spring Harbor Laboratory Press, Cold Spring Harbor, N.Y.; 1989)) or can be determined empirically using methods as disclosed herein or otherwise known in the art, particularly by determining that the presence of the antisense polynucleotide, ribozyme, or triplexing agent in a cell decreases the level of the target sequence or the expression of a polypeptide encoded by the target sequence in the cell.

A nucleotide sequence useful as an antisense molecule, a ribozyme or a triplexing agent can inhibit translation or cleave a polynucleotide encoded by plant stress-regulated gene, thereby modulating the responsiveness of a plant cell to a stress condition. An antisense molecule, for example, can bind to an mRNA to form a double stranded molecule that cannot be translated in a cell. Antisense oligonucleotides of at least about 15 to 25 nucleotides are preferred since they are easily synthesized and can hybridize specifically with a target sequence, although longer antisense molecules can be expressed from a recombinant polynucleotide introduced into the target cell. Specific nucleotide sequences useful as antisense molecules can be identified using well known methods, for example, gene walking methods (see, for example, Seimiya et al., *J. Biol. Chem.* 272:4631–4636 (1997), which is incorporated herein by reference). Where the antisense molecule is contacted directly with a target cell, it can be operatively associated with a chemically reactive group such as iron-linked EDTA, which cleaves a target RNA at the site of hybridization. A triplexing agent, in comparison, can stall transcription (Maher et al., *Antisense Res. Devel.* 1:227 (1991); Helene, *Anticancer Drug Design* 6:569 (1991)).

A plant stress-regulated regulatory element can be included in an expression cassette. As used herein, the term "expression cassette" refers to a nucleotide sequence that can direct expression of an operatively linked polynucleotide. Thus, a plant stress-regulated regulatory element can constitute an expression cassette, or component thereof. An expression cassette is particularly useful for directing expression of a nucleotide sequence, which can be an endogenous nucleotide sequence or a heterologous nucleotide sequence, in a cell, particularly a plant cell. If desired, an expression cassette also can contain additional regulatory elements, for example, nucleotide sequences required for proper translation of a polynucleotide sequence into a polypeptide. In general, an expression cassette can be introduced into a plant cell such that the plant cell, a plant resulting from the plant cell, seeds obtained from such a plant, or plants produced from such seeds are resistant to a stress condition.

Additional regulatory sequences as disclosed above or other desirable sequences such as selectable markers or the like can be incorporated into an expression cassette containing a plant stress-regulated regulatory element (see, for example, WO 99/47552). Examples of suitable markers include dihydrofolate reductase (DHFR) or neomycin resistance for eukaryotic cells and tetracycline or ampicillin resistance for *E. coli*. Selection markers in plants include bleomycin, gentamycin, glyphosate, hygromycin, kanamycin, methotrexate, phleomycin, phosphinotricin, spectinomycin, streptomycin, sulfonamide and sulfonylureas resistance (see, for example, Maliga et al., *Methods in Plant Molecular Biology*, Cold Spring Harbor Laboratory Press, 1995, page 39). The selection marker can have its own promoter or its expression can be driven by the promoter operably linked to the sequence of interest. Additional sequences such as intron sequences (e.g. from Adh1 or bronze1) or viral leader sequences (e.g. from TMV, MCMV and AIVIV), all of which can enhance expression, can be included in the cassette. In addition, where it is desirable to target expression of a nucleotide sequence operatively linked to the stress-regulated regulatory element, a sequence encoding a cellular localization motif can be included in the cassette, for example, such that an encoded transcript or translation product is translocated to and localizes in the cytosol, nucleus, a chloroplast, or another subcellular organelle. Examples of useful transit peptides and transit peptide sequences can be found in Von Heijne et al., *Plant Mol. Biol. Rep.* 9: 104, 1991; Clark et al., *J. Biol. Chem.* 264:17544, 1989; della Cioppa et al., *Plant Physiol.* 84:965, 1987; Romer et al., *Biochem. Biophys. Res. Comm.* 196: 1414, 1993; Shah et al., *Science* 233:478, 1986; Archer et al., *J. Bioenerg Biomemb.* 22:789, 1990; Scandalios, *Prog. Clin. Biol. Res.* 344:515, 1990; Weisbeek et al., *J. Cell Sci. Suppl.* 11: 199, 1989; Bruce, *Trends Cell Biol.* 10:440, 2000. The present invention can utilize native or heterologous transit peptides. The encoding sequence for a transit peptide can include all or a portion of the encoding sequence for a particular transit peptide, and may also contain portions of the mature protein encoding sequence associated with a particular transit peptide.

A polynucleotide portion of a plant stress-regulated plant gene, or an expression cassette, can be introduced into a cell as a naked DNA molecule, can be incorporated in a matrix such as a liposome or a particle such as a viral particle, or can be incorporated into a vector. Such vectors can be cloning or expression vectors, but other uses are within the scope of the present invention. A cloning vector is a self-replicating DNA molecule that serves to transfer a DNA segment into a host cell. The three most common types of cloning vectors are bacterial plasmids, phages, and other viruses. An expression vector is a cloning vector designed so that a coding sequence inserted at a particular site will be transcribed and translated into a protein. Incorporation of the polynucleotide into a vector can facilitate manipulation of the polynucleotide, or introduction of the polynucleotide into a plant cell. A vector can be derived from a plasmid or a viral vector such as a T-DNA vector (Horsch et al., *Science* 227:1229–1231, 1985, which is incorporated herein by reference). If desired, the vector can comprise components of a plant transposable element, for example, a Ds transposon (Bancroft and Dean, *Genetics* 134:1221–1229, 1993, which is incorporated herein by reference) or an Spm transposon (Aarts et al., *Mol. Gen. Genet.* 247:555–564, 1995, which is incorporated herein by reference).

In addition to containing the polynucleotide portion of a plant stress-regulated gene, a vector can contain various nucleotide sequences that facilitate, for example, rescue of the vector from a transformed plant cell; passage of the vector in a host cell, which can be a plant, animal, bacterial, or insect host cell; or expression of an encoding nucleotide sequence in the vector, including all or a portion of a rescued coding region. As such, the vector can contain any of a number of additional transcription and translation elements, including constitutive and inducible promoters, enhancers, and the like (see, for example, Bitter et al., *Meth. Enzymol.* 153:516–544, 1987). For example, a vector can contain elements useful for passage, growth or expression in a bacterial system, including a bacterial origin of replication; a promoter, which can be an inducible promoter; and the like. In comparison, a vector that can be passaged in a mammalian host cell system can have a promoter such as a metallothionein promoter, which has characteristics of both a constitutive promoter and an inducible promoter, or a viral promoter such as a retrovirus long terminal repeat, an adenovirus late promoter, or the like. A vector also can contain one or more restriction endonuclease recognition and cleavage sites, including, for example, a polylinker sequence, to facilitate rescue of a nucleotide sequence operably linked to the polynucleotide portion.

The present invention also relates to a method of using a polynucleotide portion of a plant stress-regulated gene to confer a selective advantage on a plant cell. Such a method can be performed by introducing, for example, a plant stress-regulated regulatory element into a plant cell, wherein, upon exposure of the plant cell to a stress condition to which the regulatory element is responsive, a nucleotide sequence operatively linked to the regulatory element is expressed, thereby conferring a selective advantage to plant cell. The operatively linked nucleotide sequence can be a heterologous nucleotide sequence, which can be operatively linked to the regulatory element prior to introduction of the regulatory sequence into the plant cell; or can be an endogenous nucleotide sequence into which the regulatory element was targeted by a method such as homologous recombination. The selective advantage conferred by the operatively linked nucleotide sequence can be such that the plant is better able to tolerate the stress condition; or can be any other selective advantage.

As used herein, the term "selective advantage" refers to the ability of a particular organism to better propagate, develop, grow, survive, or otherwise tolerate a condition as compared to a corresponding reference organism that does not contain a plant-stress regulated polynucleotide portion of the present invention. In one embodiment, a selective advantage is exemplified by the ability of a desired plant, plant cell, or the like, that contains an introduced plant stress-regulated regulatory element, to grow better than an undesired plant, plant cell, or the like, that does not contain the introduced regulatory element. For example, a recombinant polynucleotide comprising a plant stress-regulated regulatory element operatively linked to a heterologous nucleotide sequence encoding an enzyme that inactivates an herbicide can be introduced in a desired plant. Upon exposure of a mixed population of plants comprising the desired plants, which contain the recombinant polynucleotide, and one or more other populations of undesired plants, which lack the recombinant polynucleotide, to a stress condition that induces expression of the regulatory element and to the herbicide, the desired plants will have a greater likelihood of surviving exposure to the toxin and, therefore, a selective advantage over the undesired plants.

In another embodiment, a selective advantage is exemplified by the ability of a desired plant, plant cell, or the like, to better propagate, develop, grow, survive, or otherwise tolerate a condition as compared to an undesired plant, plant cell, or the like, that contains an introduced plant stress-regulated regulatory element. For example, a recombinant polynucleotide comprising a plant stress-regulated regulatory element operatively linked to a plant cell toxin can be introduced into cells of an undesirable plant present in a mixed population of desired and undesired plants, for example, food crops and weeds, respectively, then the plants can be exposed to stress conditions that induce expression from the plant stress-regulated regulatory element, whereby expression of the plant cell toxin results in inhibition of growth or death of the undesired plants, thereby providing a selective advantage to the desired plants, which no longer have to compete with the undesired plants for nutrients, light, or the like. In another example, a plant stress-regulated regulatory element operatively linked to a plant cell toxin can be introduced into cells of plants used as a nurse crop. Nurse crops, also called cover or companion crops, are planted in combination with plants of interest to provide, among other things, shade and soil stability during establishment of the desired plants. Once the desired plants have become established, the presence of the nurse crop may no longer be desirable. Exposure to conditions inducing expression of the gene linked to the plant stress-regulated regulatory element allows elimination of the nurse crop. Alternatively nurse crops can be made less tolerate to abiotic stress by the inhibition of any of the stress-regulated sequences disclosed herein. Inhibition can be accomplished by any of the method described herein. Upon exposure of the nurse crop to the stress, the decreased ability of the nurse crop to respond to the stress will result in elimination of the nurse crop, leaving only the desired plants.

The invention also provides a means of producing a transgenic plant, which comprises plant cells that exhibit altered responsiveness to a stress condition. As such, the present invention further provides a transgenic plant, or plant cells or tissues derived therefrom, which are genetically modified to respond to stress differently than a corresponding wild-type plant or plant not containing constructs of the present invention would respond. As used herein, the term "responsiveness to a stress condition" refers to the ability of a plant to express a plant stress-regulated gene upon exposure to the stress condition. A transgenic plant cell contains a polypeptide portion of a plant stress-regulated gene, or a mutant form thereof, for example, a knock-out mutant. A knock-out mutant form of a plant stress-regulated gene can contain, for example, a mutation such that a STOP codon is introduced into the reading frame of the translated portion of the gene such that expression of a functional stress-regulated polypeptide is prevented; or a mutation in the stress-regulated regulatory element such that inducibility of the element in response to a stress condition is inhibited. Such transgenic plants of the invention can display any of various idiotypic modifications is response to an abiotic stress, including altered tolerance to the stress condition, as well as increased or decreased plant growth, root growth, yield, or the like, as compared to the corresponding wild-type plant.

The term "plant" is used broadly herein to include any plant at any stage of development, or to part of a plant, including a plant cutting, a plant cell, a plant cell culture, a plant organ, a plant seed, and a plantlet. A plant cell is the structural and physiological unit of the plant, comprising a protoplast and a cell wall. A plant cell can be in the form of an isolated single cell or a cultured cell, or can be part of higher organized unit, for example, a plant tissue, plant organ, or plant. Thus, a plant cell can be a protoplast, a gamete producing cell, or a cell or collection of cells that can regenerate into a whole plant. As such, a seed, which comprises multiple plant cells and is capable of regenerating into a whole plant, is considered plant cell for purposes of this disclosure. A plant tissue or plant organ can be a seed, protoplast, callus, or any other groups of plant cells that is organized into a structural or functional unit. Particularly useful parts of a plant include harvestable parts and parts useful for propagation of progeny plants. A harvestable part of a plant can be any useful part of a plant, for example, flowers, pollen, seedlings, tubers, leaves, stems, fruit, seeds, roots, and the like. A part of a plant useful for propagation includes, for example, seeds, fruits, cuttings, seedlings, tubers, rootstocks, and the like.

A transgenic plant can be regenerated from a transformed plant cell. As used herein, the term "regenerate" means growing a whole plant from a plant cell; a group of plant cells; a protoplast; a seed; or a piece of a plant such as a callus or tissue. Regeneration from protoplasts varies from species to species of plants. For example, a suspension of protoplasts can be made and, in certain species, embryo formation can be induced from the protoplast suspension, to the stage of ripening and germination. The culture media generally contains various components necessary for growth and regeneration, including, for example, hormones such as auxins and cytokinins; and amino acids such as glutamic acid and proline, depending on the particular plant species. Efficient regeneration will depend, in part, on the medium, the genotype, and the history of the culture. If these variables are controlled, however, regeneration is reproducible.

Regeneration can occur from plant callus, explants, organs or plant parts. Transformation can be performed in the context of organ or plant part regeneration. (see *Meth. Enzymol.* Vol. 118; Klee et al. *Ann. Rev. Plant Physiol.* 38:467, 1987, which is incorporated herein by reference). Utilizing the leaf disk-transformation-regeneration method, for example, disks are cultured on selective media, followed by shoot formation in about two to four weeks (see Horsch et al., supra, 1985). Shoots that develop are excised from calli and transplanted to appropriate root-inducing selective medium. Rooted plantlets are transplanted to soil as soon as possible after roots appear. The plantlets can be repotted as required, until reaching maturity.

In vegetatively propagated crops, the mature transgenic plants are propagated utilizing cuttings or tissue culture techniques to produce multiple identical plants. Selection of desirable transgenotes is made and new varieties are obtained and propagated vegetatively for commercial use. In seed propagated crops, the mature transgenic plants can be self crossed to produce a homozygous inbred plant. The resulting inbred plant produces seeds that contain the introduced plant stress-induced regulatory element, and can be grown to produce plants that express a polynucleotide or polypeptide in response to a stress condition that induces expression from the regulatory element. As such, the invention further provides seeds produced by a transgenic plant obtained by a method of the invention.

In addition, transgenic plants comprising different recombinant sequences can be crossbred, thereby providing a means to obtain transgenic plants containing two or more different transgenes, each of which contributes a desirable characteristic to the plant. Methods for breeding plants and selecting for crossbred plants having desirable characteristics or other characteristics of interest are well known in the art.

A method of the invention can be performed by introducing a polynucleotide portion of a plant stress-regulated gene into the plant. As used herein, the term "introducing" means transferring a polynucleotide into a plant cell. A polynucleotide can be introduced into a cell by a variety of methods well known to those of ordinary skill in the art. For example, the polynucleotide can be introduced into a plant cell using a direct gene transfer method such as electroporation or microprojectile mediated transformation, or using *Agrobacterium* mediated transformation. Non-limiting examples of methods for the introduction of polynucleotides into plants are provided in greater detail herein. As used herein, the term "transformed" refers to a plant cell containing an exogenously introduced polynucleotide portion of a plant stress-regulated gene that is or can be rendered active in a plant cell, or to a plant comprising a plant cell containing such a polynucleotide.

It should be recognized that one or more polynucleotides, which are the same or different can be introduced into a plant, thereby providing a means to obtain a genetically modified plant containing multiple copies of a single transgenic sequence, or containing two or more different transgenic sequences, either or both of which can be present in multiple copies. Such transgenic plants can be produced, for example, by simply selecting plants having multiple copies of a single type of transgenic sequence; by cotransfecting plant cells with two or more populations of different transgenic sequences and identifying those containing the two or more different transgenic sequences; or by crossbreeding transgenic plants, each of which contains one or more desired transgenic sequences, and identifying those progeny having the desired sequences.

Methods for introducing a polynucleotide into a plant cell to obtain a transformed plant also include direct gene transfer (see European Patent A 164 575), injection, electroporation, biolistic methods such as particle bombardment, pollen-mediated transformation, plant RNA virus-mediated transformation, liposome-mediated transformation, transformation using wounded or enzyme-degraded immature embryos, or wounded or enzyme-degraded embryogenic callus, and the like. Transformation methods using *Agrobacterium tumefaciens* tumor inducing (Ti) plasmids or root-inducing (Ri) plasmids, or plant virus vectors are well known in the art (see, for example, WO 99/47552; Weissbach & Weissbach, "Methods for Plant Molecular Biology" (Academic Press, NY 1988), section VIII, pages 421–463; Grierson and Corey, "Plant Molecular Bioloy" 2d Ed. (Blackie, London 1988), Chapters 7–9, each of which is incorporated herein by reference; Horsch et al., supra, 1985). The wild-type form of *Agrobacterium*, for example, contains a Ti plasmid, which directs production of tumorigenic crown gall growth on host plants. Transfer of the tumor inducing T-DNA region of the Ti plasmid to a plant genome requires the Ti plasmid-encoded virulence genes as well as T-DNA borders, which are a set of direct DNA repeats that delineate the region to be transferred. An *Agrobacterium* based vector is a modified form of a Ti plasmid, in which the tumor inducing functions are replaced by a nucleotide sequence of interest that is to be introduced into the plant host.

Methods of using *Agrobacterium* mediated transformation include cocultivation of *Agrobacterium* with cultured isolated protoplasts; transformation of plant cells or tissues with *Agrobacterium*; and transformation of seeds, apices or meristems with *Agrobacterium*. In addition, in planta transformation by *Agrobacterium* can be performed using vacuum infiltration of a suspension of *Agrobacterium* cells (Bechtold et al., *C. R. Acad. Sci. Paris* 316:1194, 1993, which is incorporated herein by reference).

*Agrobacterium* mediated transformation can employ cointegrate vectors or binary vector systems, in which the components of the Ti plasmid are divided between a helper vector, which resides permanently in the *Agrobacterium* host and carries the virulence genes, and a shuttle vector, which contains the gene of interest bounded by T-DNA sequences. Binary vectors are well known in the art (see, for example, De Framond, *BioTechnology* 1:262, 1983; Hoekema et al., *Nature* 303:179, 1983, each of which is incorporated herein by reference) and are commercially available (Clontech; Palo Alto Calif.). For transformation, *Agrobacterium* can be cocultured, for example, with plant cells or wounded tissue such as leaf tissue, root explants, hypocotyledons, stem pieces or tubers (see, for example, Glick and Thompson, "Methods in Plant Molecular Biology and Biotechnology" (Boca Raton Fla., CRC Press 1993), which is incorporated herein by reference). Wounded cells within the plant tissue that have been infected by *Agrobacterium* can develop organs de novo when cultured under the appropriate conditions; the resulting transgenic shoots eventually give rise to transgenic plants, which contain an exogenous polynucleotide portion of a plant stress-regulated gene.

*Agrobacterium* mediated transformation has been used to produce a variety of transgenic plants, including, for example, transgenic cruciferous plants such as *Arabidopsis*, mustard, rapeseed and flax; transgenic leguminous plants such as alfalfa, pea, soybean, trefoil and white clover; and transgenic solanaceous plants such as eggplant, petunia, potato, tobacco and tomato (see, for example, Wang et al., "Transformation of Plants and Soil Microorganisms" (Cambridge, University Press 1995), which is incorporated herein by reference). In addition, *Agrobacterium* mediated transformation can be used to introduce an exogenous polynucleotide sequence, for example, a plant stress-regulated regulatory element into apple, aspen, belladonna, black currant, carrot, celery, cotton, cucumber, grape, horseradish, lettuce, morning glory, muskmelon, neem, poplar, strawberry, sugar beet, sunflower, walnut, asparagus, rice and other plants (see, for example, Glick and Thompson, supra, 1993; Hiei et al., *Plant J.* 6:271–282, 1994; Shimamoto, *Science* 270: 1772–1773, 1995).

Suitable strains of *Agrobacterium tumefaciens* and vectors as well as transformation of Agrobacteria and appropriate growth and selection media are well known in the art (GV3101, pMK90RK), Koncz, *Mol. Gen. Genet.* 204:383–396, 1986; (C58C1, pGV3850kan), Deblaere, *Nucl. Acid Res.* 13:4777, 1985; Bevan, *Nucl. Acid Res.* 12:8711, 1984; Koncz, *Proc. Natl. Acad. Sci. USA* 86:8467–8471, 1986; Koncz, *Plant Mol. Biol.* 20:963–976, 1992; Koncz, Specialized vectors for gene tagging and expression studies. In: Plant Molecular Biology Manual Vol. 2, Gelvin and Schilperoort (Eds.), Dordrecht, The Netherlands: Kluwer Academic Publ. (1994), 1–22; European Patent A-1 20 516; Hoekema: The Binary Plant Vector System, Offsetdrukkerij Kanters B. V., Alblasserdam (1985), Chapter V; Fraley, *Crit. Rev. Plant. Sci.*, 4:1–46; An, *EMBO J.* 4:277–287, 1985).

Where a polynucleotide portion of a plant stress-regulated gene is contained in vector, the vector can contain functional elements, for example "left border" and "right border" sequences of the T-DNA of *Agrobacterium*, which allow for stable integration into a plant genome. Furthermore, methods and vectors that permit the generation of marker-free transgenic plants, for example, where a selectable marker gene is lost at a certain stage of plant development or plant breeding, are known, and include, for example, methods of co-transformation (Lyznik, *Plant Mol. Biol.* 13:151–161, 1989; Peng, *Plant Mol. Biol.* 27:91–104, 1995), or methods that utilize enzymes capable of promoting homologous recombination in plants (see, e.g., WO97/08331; Bayley, *Plant Mol. Biol.* 18:353–361, 1992; Lloyd, *Mol. Gen. Genet.* 242:653–657, 1994; Maeser, *Mol. Gen. Genet.* 230:170–176, 1991; Onouchi, *Nucl. Acids Res.* 19:6373–6378, 1991; see, also, Sambrook et al., supra, 1989).

A direct gene transfer method such as electroporation also can be used to introduce a polynucleotide portion of a plant stress-regulated gene into a cell such as a plant cell. For example, plant protoplasts can be electroporated in the presence of the regulatory element, which can be in a vector (Fromm et al., *Proc. Natl. Acad. Sci., USA* 82:5824, 1985, which is incorporated herein by reference). Electrical impulses of high field strength reversibly permeabilize membranes allowing the introduction of the nucleic acid. Electroporated plant protoplasts reform the cell wall, divide and form a plant callus. Microinjection can be performed as described in Potrykus and Spangenberg (eds.), Gene Transfer To Plants (Springer Verlag, Berlin, N.Y. 1995). A transformed plant cell containing the introduced polynucleotide can be identified by detecting a phenotype due to the introduced polynucleotide, for example, increased or decreased tolerance to a stress condition.

Microprojectile mediated transformation also can be used to introduce a polynucleotide into a plant cell (Klein et al., *Nature* 327:70–73, 1987, which is incorporated herein by reference). This method utilizes microprojectiles such as gold or tungsten, which are coated with the desired nucleic acid molecule by precipitation with calcium chloride, spermidine or polyethylene glycol. The microprojectile particles are accelerated at high speed into a plant tissue using a device such as the BIOLISTIC PD-1000 (BioRad; Hercules Calif.).

Microprojectile mediated delivery ("particle bombardment") is especially useful to transform plant cells that are difficult to transform or regenerate using other methods. Methods for the transformation using biolistic methods are well known (Wan, *Plant Physiol.* 104:37–48, 1984; Vasil, *Bio/Technology* 11:1553–1558, 1993; Christou, *Trends in Plant Science* 1:423–431, 1996). Microprojectile mediated transformation has been used, for example, to generate a variety of transgenic plant species, including cotton, tobacco, corn, hybrid poplar and papaya (see Glick and Thompson, supra, 1993). Important cereal crops such as wheat, oat, barley, sorghum and rice also have been transformed using microprojectile mediated delivery (Duan et al., *Nature Biotech.* 14:494–498, 1996; Shimamoto, *Curr. Opin.*

Biotech. 5:158–162, 1994). A rapid transformation regeneration system for the production of transgenic plants such as a system that produces transgenic wheat in two to three months (see European Patent No. EP 0709462A2, which is incorporated herein by reference) also can be useful for producing a transgenic plant using a method of the invention, thus allowing more rapid identification of gene functions. The transformation of most dicotyledonous plants is possible with the methods described above. Transformation of monocotyledonous plants also can be transformed using, for example, biolistic methods as described above, protoplast transformation, electroporation of partially permeabilized cells, introduction of DNA using glass fibers, *Agrobacterium* mediated transformation, and the like.

Plastid transformation also can be used to introduce a polynucleotide portion of a plant stress-regulated gene into a plant cell (U.S. Pat. Nos. 5,451,513, 5,545,817, and 5,545,818; WO 95/16783; McBride et al., *Proc. Natl. Acad. Sci., USA* 91:7301–7305, 1994). Chloroplast transformation involves introducing regions of cloned plastid DNA flanking a desired nucleotide sequence, for example, a selectable marker together with polynucleotide of interest into a suitable target tissue, using, for example, a biolistic or protoplast transformation method (e.g., calcium chloride or PEG mediated transformation). One to 1.5 kb flanking regions ("targeting sequences") facilitate homologous recombination with the plastid genome, and allow the replacement or modification of specific regions of the plastome. Using this method, point mutations in the chloroplast 16S rRNA and rps12 genes, which confer resistance to spectinomycin and streptomycin, can be utilized as selectable markers for transformation (Svab et al., *Proc. Natl. Acad. Sci., USA* 87:8526–8530, 1990; Staub and Maliga, *Plant Cell* 4:39–45, 1992), resulted in stable homopiasmic transformants; at a frequency of approximately one per 100 bombardments of target leaves. The presence of cloning sites between these markers allowed creation of a plastid targeting vector for introduction of foreign genes (Staub and Maliga, *EMBO J.* 12:601–606, 1993). Substantial increases in transformation frequency are obtained by replacement of the recessive rRNA or r-protein antibiotic resistance genes with a dominant selectable marker, the bacterial aadA gene encoding the spectinomycin-detoxifying enzyme aminoglycoside-3'-adenyltransferase (Svab and Maliga, *Proc. Natl. Acad. Sci., USA* 90:913–917, 1993). Approximately 15 to 20 cell division cycles following transformation are generally required to reach a homoplastidic state. Plastid expression, in which genes are inserted by homologous recombination into all of the several thousand copies of the circular plastid genome present in each plant cell, takes advantage of the enormous copy number advantage over nuclear-expressed genes to permit expression levels that can readily exceed 10% of the total soluble plant protein.

Plants suitable to treatment according to a method of the invention can be monocots or dicots and include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Cofea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea ultilane*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, duckweed (*Lemna*), barley, tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*).

Ornamentals such as azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum are also included. Additional ornamentals within the scope of the invention include impatiens, Begonia, Pelargonium, Viola, Cyclamen, Verbena, Vinca, Tagetes, Primula, Saint Paulia, Agertum, Amaranthus, Antihirrhinum, Aquilegia, Cineraria, Clover, Cosmo, Cowpea, Dahlia, Datura, Delphinium, Gerbera, Gladiolus, Gloxinia, Hippeastrum, Mesembryanthemum, Salpiglossos, and Zinnia.

Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*), Douglas-fir (*Pseudotsuga menziesii*); Western hemlock (*Tsuga ultilane*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*).

Leguminous plants which may be used in the practice of the present invention include beans and peas. Beans include guar, locust bean, fenugreek, soybean, garden beans, cowpea, mungbean, lima bean, fava bean, lentils, chickpea, etc. Legumes include, but are not limited to, *Arachis*, e.g., peanuts, *Vicia*, e.g., crown vetch, hairy vetch, adzuki bean, mung bean, and chickpea, *Lupinus*, e.g., lupine, trifolium, *Phaseolus*, e.g., common bean and lima bean, *Pisum*, e.g., field bean, *Melilotus*, e.g., clover, *Medicago*, e.g., alfalfa, *Lotus*, e.g., trefoil, lens, e.g., lentil, and false indigo. Preferred forage and turf grass for use in the methods of the invention include alfalfa, orchard grass, tall fescue, perennial ryegrass, creeping bent grass, and redtop.

Other plants within the scope of the invention include *Acacia*, aneth, artichoke, arugula, blackberry, canola, cilantro, clementines, escarole, eucalyptus, fennel, grapefruit, honey dew, jicama, kiwifruit, lemon, lime, mushroom, nut, okra, orange, parsley, persimmon, plantain, pomegranate, poplar, radiata pine, radicchio, Southern pine, sweetgum, tangerine, triticale, vine, yams, apple, pear, quince, cherry, apricot, melon, hemp, buckwheat, grape, raspberry, chenopodium, blueberry, nectarine, peach, plum, strawberry, watermelon, eggplant, pepper, cauliflower, *Brassica*, e.g., broccoli, cabbage, ultilan sprouts, onion, carrot, leek, beet, broad bean, celery, radish, pumpkin, endive, gourd, garlic, snapbean, spinach, squash, turnip, ultilane, chicory, groundnut and zucchini.

Angiosperms are divided into two broad classes based on the number of cotyledons, which are seed leaves that generally store or absorb food; a monocotyledonous angiosperm has a single cotyledon, and a dicotyledonous angiosperm has two cotyledons. Angiosperms produce a variety of useful products including materials such as lumber, rubber, and paper; fibers such as cotton and linen; herbs and medicines such as quinine and vinblastine; ornamental flowers such as roses and orchids; and foodstuffs such as grains, oils, fruits and vegetables.

Angiosperms encompass a variety of flowering plants, including, for example, cereal plants, leguminous plants, oilseed plants, hardwood trees, fruit-bearing plants and ornamental flowers, which general classes are not necessarily exclusive. Cereal plants, which produce an edible grain cereal, include, for example, corn, rice, wheat, barley, oat, rye, orchardgrass, guinea grass, sorghum and turfgrass. Leguminous plants include members of the pea family (Fabaceae) and produce a characteristic fruit known as a legume. Examples of leguminous plants include, for example, soybean, pea, chickpea, moth bean, broad bean, kidney bean, lima bean, lentil, cowpea, dry bean, and peanut, as well as alfalfa, birdsfoot trefoil, clover and sainfoin. Oilseed plants, which have seeds that are useful as a source of oil, include soybean, sunflower, rapeseed (canola) and cottonseed.

Angiosperms also include hardwood trees, which are perennial woody plants that generally have a single stem (trunk). Examples of such trees include alder, ash, aspen, basswood (linden), beech, birch, cherry, cottonwood, elm, eucalyptus, hickory, locust, maple, oak, persimmon, poplar, sycamore, walnut, sequoia, and willow. Trees are useful, for example, as a source of pulp, paper, structural material and fuel.

Angiosperms are fruit-bearing plants that produce a mature, ripened ovary, which generally contains seeds. A fruit can be suitable for human or animal consumption or for collection of seeds to propagate the species. For example, hops are a member of the mulberry family that are prized for their flavoring in malt liquor. Fruit-bearing angiosperms also include grape, orange, lemon, grapefruit, avocado, date, peach, cherry, olive, plum, coconut, apple and pear trees and blackberry, blueberry, raspberry, strawberry, pineapple, tomato, cucumber and eggplant plants. An ornamental flower is an angiosperm cultivated for its decorative flower. Examples of commercially important ornamental flowers include rose, orchid, lily, tulip and chrysanthemum, snapdragon, camellia, carnation and petunia plants. The skilled artisan will recognize that the methods of the invention can be practiced using these or other angiosperms, as desired, as well as gymnosperms, which do not produce seeds in a fruit.

A method of producing a transgenic plant can be performed by introducing a polynucleotide portion of plant stress-regulated gene into a plant cell genome, whereby the polynucleotide portion of the plant stress-regulated gene modulates a response of the plant cell to a stress condition, thereby producing a transgenic plant, which comprises plant cells that exhibit altered responsiveness to the stress condition. In one embodiment, the polynucleotide portion of the plant stress-regulated gene encodes a stress-regulated polypeptide or functional peptide portion thereof, wherein expression of the stress-regulated polypeptide or functional peptide portion thereof either increases the stress tolerance of the transgenic plant, or decreases the stress tolerance of the transgenic plant. The polynucleotide portion of the plant stress-regulated gene encoding the stress-regulated polypeptide or functional peptide portion thereof can be operatively linked to a heterologous promoter.

In another embodiment, the polynucleotide portion of the plant stress-regulated gene comprises a stress-regulated regulatory element. The stress-regulated regulatory element can integrate into the plant cell genome in a site-specific manner, whereupon it can be operatively linked to an endogenous nucleotide sequence, which can be expressed in response to a stress condition specific for the regulatory element; or can be a mutant regulatory element, which is not responsive to the stress condition, whereby upon integrating into the plant cell genome, the mutant regulatory element disrupts an endogenous stress-regulated regulatory element of a plant stress-regulated gene, thereby altering the responsiveness of the plant stress-regulated gene to the stress condition. Accordingly, the invention also provides genetically modified plants, including transgenic plants, produced by such a method, and a plant cell obtained from such genetically modified plant, wherein said plant cell exhibits altered responsiveness to the stress condition; a seed produced by a transgenic plant; and a cDNA library prepared from a transgenic plant.

Also provided is a method of modulating the responsiveness of a plant cell to a stress condition. Such a method can be performed, for example, by introducing a polynucleotide portion of a plant stress-regulated gene into the plant cell, thereby modulating the responsiveness of the plant cell to a stress condition. As disclosed herein, the responsiveness of the plant cell can be increased or decreased upon exposure to the stress condition, and the altered responsiveness can result in increased or decreased tolerance of the plant cell to a stress condition. The polynucleotide portion of the plant stress-regulated gene can, but need not, be integrated into the genome of the plant cell, thereby modulating the responsiveness of the plant cell to the stress condition. Accordingly, the invention also provide a genetically modified plant, including a transgenic plant, which contains an introduced polynucleotide portion of a plant stress-regulated gene, as well as plant cells, tissues, and the like, which exhibit modulated responsiveness to a stress condition.

The polynucleotide portion of the plant stress-regulated gene can encode a stress-regulated polypeptide or functional peptide portion thereof, which can be operatively linked to a heterologous promoter. As used herein, reference to a "functional peptide portion of a plant stress-regulated polypeptide" means a contiguous amino acid sequence of the polypeptide that has an activity of the full length polypeptide, or that has an antagonist activity with respect to the fall length polypeptide, or that presents an epitope unique to the polypeptide. Thus, by expressing a functional peptide portion of a plant stress-regulated polypeptide in a plant cell, the peptide can act as an agonist or an antagonist of the polypeptide, thereby modulating the responsiveness of the plant cell to a stress condition.

A polynucleotide portion of the plant stress-regulated nucleotide sequence also can contain a mutation, whereby upon integrating into the plant cell genome, the polynucleotide disrupts (knocks-out) an endogenous plant stress-regulated nucleotide sequence, thereby modulating the responsiveness of said plant cell to the stress condition. Depending on whether the knocked-out gene encodes an adaptive or a maladaptive stress-regulated polypeptide, the responsiveness of the plant will be modulated accordingly. Thus, a method of the invention provides a means of producing a transgenic plant having a knock-out phenotype of a plant stress-regulated nucleotide sequence.

Alternatively, the responsiveness of a plant or plant cell to a stress condition can be modulated by use of a suppressor construct containing dominant negative mutation for any of the stress-regulated sequences described herein. Expression of a suppressor construct containing a dominant mutant mutation generates a mutant transcript that, when coexpressed with the wild-type transcript inhibits the action of the wild-type transcript. Methods for the design and use of dominant negative constructs are well known (see, for example, in Herskowitz, *Nature* 329:219–222, 1987; Lagna and Hemmati-Brivanlou, *Curr. Topics Devel. Biol.* 36:75–98, 1998).

The polynucleotide portion of the plant stress-regulated gene also can comprise a stress-regulated regulatory element, which can be operatively linked to a heterologous nucleotide sequence, which, upon expression from the regulatory element in response to a stress condition, modulates the responsiveness of the plant cell to the stress condition. Such a heterologous nucleotide sequence can encode, for example, a stress-inducible transcription factor such as DREB1A, which, upon exposure to the stress condition, is expressed such that it can amplify the stress response (see Kasuga et al., supra, 1999). The heterologous nucleotide sequence also can encode a polynucleotide that is specific for a plant stress-regulated gene, for example, an antisense molecule, a ribozyme, and a triplexing agent, either of which, upon expression in the plant cell, reduces or inhibits expression of a stress-regulated polypeptide encoded by the gene, thereby modulating the responsiveness of the plant cell to a stress condition, for example, an abnormal level of cold, osmotic pressure, and salinity. As used herein, the term "abnormal," when used in reference to a condition such as temperature, osmotic pressure, salinity, or any other condition that can be a stress condition, means that the condition varies sufficiently from a range generally considered optimum for growth of a plant that the condition results in an induction of a stress response in a plant. Methods of determining whether a stress response has been induced in a plant are disclosed herein or otherwise known in the art.

A plant stress-regulated regulatory element can be operatively linked to a heterologous polynucleotide sequence, such that the regulatory element can be introduced into a plant genome in a site-specific matter by homologous recombination. For example, a mutant plant stress-regulated regulatory element for a maladaptive stress-induced polypeptide can be transformed into a plant genome in a site specific manner by in vivo mutagenesis, using a hybrid RNA-DNA oligonucleotide ("chimeroplast" (*TIBTECH* 15:441–447, 1997; WO 95/15972; Kren, *Hepatology* 25:1462–1468, 1997; Cole-Strauss, *Science* 273:1386–1389, 1996, each of which is incorporated herein by reference). Part of the DNA component of the RNA-DNA oligonucleotide is homologous to a nucleotide sequence comprising the regulatory element of the maladaptive gene, but includes a mutation or contains a heterologous region which is surrounded by the homologous regions. By means of base pairing of the homologous regions of the RNA-DNA oligonucleotide and of the endogenous nucleic acid molecule, followed by a homologous recombination the mutation contained in the DNA component of the RNA-DNA oligonucleotide or the heterologous region can be transferred to the plant genome, resulting in a "mutant" gene that, for example, is not induced in response to a stress and, therefore, does not confer the maladaptive phenotype. Such a method similarly can be used to knock-out the activity of a stress-regulated gene, for example, in an undesirable plant. Such a method can provide the advantage that a desirable wild-type plant need not compete with the undesirable plant, for example, for light, nutrients, or the like.

A method of modulating the responsiveness of a plant cell to a stress condition also can be performed by introducing a mutation in the chromosomal copy of a plant stress-regulated gene, for example, in the stress-regulated regulatory element, by transforming a cell with a chimeric oligonucleotide composed of a contiguous stretch of RNA and DNA residues in a duplex conformation with double hairpin caps on the ends. An additional feature of the oligonucleotide is the presence of 2'-O-methylation at the RNA residues. The RNA/DNA sequence is designed to align with the sequence of a chromosomal copy of the target regulatory element and to contain the desired nucleotide change (see U.S. Pat. No. 5,501,967, which is incorporated herein by reference).

A plant stress-regulated regulatory element also can be operatively linked to a heterologous polynucleotide such that, upon expression from the regulatory element in the plant cell, confers a desirable phenotype on the plant cell. For example, the heterologous polynucleotide can encode an aptamer, which can bind to a stress-induced polypeptide. Aptamers are nucleic acid molecules that are selected based on their ability to bind to and inhibit the activity of a protein or metabolite. Aptamers can be obtained by the SELEX (Systematic Evolution of Ligands by Exponential Enrichment) method (see U.S. Pat. No. 5,270,163), wherein a candidate mixture of single stranded nucleic acids having regions of randomized sequence is contacted with a target, and those nucleic acids having a specific affinity to the target are partitioned from the remainder of the candidate mixture, and amplified to yield a ligand enriched mixture. After several iterations a nucleic acid molecule (aptamer) having optimal affinity for the target is obtained. For example, such a nucleic acid molecule can be operatively linked to a plant stress-regulated regulatory element and introduced into a plant. Where the aptamer is selected for binding to a polypeptide that normally is expressed from the regulatory element and is involved in an adaptive response of the plant to a stress, the recombinant molecule comprising the aptamer can be useful for inhibiting the activity of the stress-regulated polypeptide, thereby decreasing the tolerance of the plant to the stress condition.

The invention provides a genetically modified plant, which can be a transgenic plant, that is tolerant or resistant to a stress condition. As used herein, the term "tolerant" or "resistant," when used in reference to a stress condition of a plant, means that the particular plant, when exposed to a stress condition, shows less of an effect, or no effect, in response to the condition as compared to a corresponding reference plant (naturally occurring wild-type plant or a plant not containing a construct of the present invention). As a consequence, a plant encompassed within the present invention grows better under more widely varying conditions, has higher yields and/or produces more seeds. Thus, a transgenic plant produced according to a method of the invention can demonstrate protection (as compared to a corresponding reference plant) from a delay to complete inhibition of alteration in cellular metabolism, or reduced cell growth or cell death caused by the stress. Preferably, the transgenic plant is capable of substantially normal growth under environmental conditions where the corresponding reference plant shows reduced growth, metabolism or viability, or increased male or female sterility.

The determination that a plant modified according to a method of the invention has increased resistance to a stress-inducing condition can be made by comparing the treated plant with a control (reference) plant using well known methods. For example, a plant having increased tolerance to saline stress can be identified by growing the plant on a medium such as soil, which contains a higher content of salt in the order of at least about 10% compared to a medium the corresponding reference plant is capable of growing on. Advantageously, a plant treated according to a method of the invention can grow on a medium or soil containing at least about 50%, or more than about 75%, particularly at least about more than 100%, and preferably more than about 200% salt than the medium or soil on which a corresponding reference plant can grow. In particular, such a treated plant can grow on medium or soil containing at least 40 mM, generally at least 100 mM, particularly at least 200 mM, and preferably at least 300 mM salt, including, for example, a water soluble inorganic salt such as sodium sulfate, magnesium sulfate, calcium sulfate, sodium chloride, magnesium chloride, calcium chloride, potassium chloride, or the like; salts of agricultural fertilizers, and salts associated with alkaline or acid soil conditions; particularly NaCl.

In another embodiment, the invention provides a plant that is less tolerant or less resistant to a stress condition as compared to a corresponding reference plant. As used herein, the term "less tolerant" or "less resistant," when used in reference to a stress condition of a plant, means that the particular plant, when exposed to a stress condition, shows an alteration in response to the condition as compared to a corresponding reference plant. As a consequence, such a plant, which generally is an undesirable plant species, is less likely to grow when exposed to a stress condition than an untreated plant.

The present invention also relates to a method of expressing a heterologous nucleotide sequence in a plant cell. Such a method can be performed, for example, by introducing into the plant cell a plant stress-regulated regulatory element operatively linked to the heterologous nucleotide sequence, whereby, upon exposure of the plant cell to stress condition, the heterologous nucleotide sequence is expressed in the plant cell. The heterologous nucleotide sequence can encode a selectable marker, or preferably, a polypeptide that confers a desirable trait upon the plant cell, for example, a polypeptide that improves the nutritional value, digestibility or ornamental value of the plant cell, or a plant comprising the plant cell. Accordingly, the invention provides a transgenic plant that, in response to a stress condition, can produce a heterologous polypeptide from a plant stress-regulated regulatory element. Such transgenic plants can provide the advantage that, when grown in a cold environment for example, expression of the heterologous polypeptide from a plant cold-regulated regulatory element can result in increased nutritional value of the plant.

The present invention further relates to a method of modulating the activity of a biological pathway in a plant cell, wherein the pathway involves a stress-regulated polypeptide. As used herein, reference to a pathway that "involves" a stress-regulated polypeptide means that the polypeptide is required for normal function of the pathway. For example, plant stress-regulated polypeptides as disclosed herein include those acting as kinases or as transcription factors, which are well known to be involved in signal transduction pathways. As such, a method of the invention provides a means to modulate biological pathways involving plant stress-regulated polypeptides, for example, by altering the expression of the polypeptides in response to a stress condition. Thus, a method of the invention can be performed, for example, by introducing a polynucleotide portion of a plant stress-regulated gene into the plant cell, thereby modulating the activity of the biological pathway.

A method of the invention can be performed with respect to a pathway involving any of the stress-regulated polypeptides as encoded by a polynucleotide of SEQ ID NOS: 1–2703, including for example, a stress-regulated transcription factor, an enzyme, including a kinase, a channel protein (see, for example, Tables 29–31; see, also, Table 1). Pathways in which the disclosed stress-regulated stress factors are involved can be identified, for example, by searching the Munich Information Center for Protein Sequences (MIPS) *Arabidopsis thaliana* database (MATDB), which is at http://www.mips.biochem.mpg.de/proj/thal/.

The present invention also relates to a method of identifying a polynucleotide that modulates a stress response in a plant cell. Such a method can be performed, for example, by contacting an array of probes representative of a plant cell genome and nucleic acid molecules expressed in plant cell exposed to the stress; detecting a nucleic acid molecule that is expressed at a level different from a level of expression in the absence of the stress; introducing the nucleic acid molecule that is expressed differently into a plant cell; and detecting a modulated response of the plant cell containing the introduced nucleic acid molecule to a stress, thereby identifying a polynucleotide that modulates a stress response in a plant cell. The contacting is under conditions that allow for selective hybridization of a nucleic acid molecule with probe having sufficient complementarity, for example, under stringent hybridization conditions.

As used herein, the term "array of probes representative of a plant cell genome" means an organized group of oligonucleotide probes that are linked to a solid support, for example, a microchip or a glass slide, wherein the probes can hybridize specifically and selectively to nucleic acid molecules expressed in a plant cell. Such an array is exemplified herein by a GeneChip® Arabidopsis Genome Array (Affymetrix; see Example 1). In general, an array of probes that is "representative" of a plant genome will identify at least about 30% or the expressed nucleic acid molecules in a plant cell, generally at least about 50% or 70%, particularly at least about 80% or 90%, and preferably will identify all of the expressed nucleic acid molecules. It should be recognized that the greater the representation, the more likely all nucleotide sequences of cluster of stress-regulated genes will be identified.

A method of the invention is exemplified in Example 1, wherein clusters of *Arabidopsis* genes induced to cold, to increased salinity, to increased osmotic pressure, and to a combination of the above three stress conditions were identified. Based on the present disclosure, the artisan readily can obtain nucleic acid samples for *Arabidopsis* plants exposed to other stress conditions, or combinations of stress conditions, and identify clusters of genes induced in response to the stress conditions. Similarly, the method is readily adaptable to identifying clusters of stress-regulated genes expressed in other plant species, particularly commercially valuable plant species, where a substantial amount of information is known regarding the genome.

The clusters of genes identified herein include those clusters of genes that are induced or repressed in response to a combination of stress conditions, but not to any of the stress conditions alone; and clusters of genes that are induced or repressed in response to a selected stress condition, but not to other stress conditions tested. Furthermore, clusters of genes that respond to a stress condition in a temporally regulated manner are also included, such as gene clusters that are induced early (for example, within about 3 hours), late (for example, after about 8 to 24 hours), or continuously in a stress response. In addition, the genes within a cluster are represented by a variety of cellular proteins, including transcription factors, enzymes such as kinases, channel proteins, and the like (see Tables 1 and 29–31). Thus, the present invention further characterizes nucleotide sequences that previously were known to encode cellular peptides by classifying them within clusters of stress-regulated genes.

The present invention additionally relates to a method of identifying a stress condition to which a plant cell was exposed. Such a method can be performed, for example, by contacting nucleic acid molecules expressed in the plant cell and an array of probes representative of the plant cell genome; and detecting a profile of expressed nucleic acid molecules characteristic of a stress response, thereby identifying the stress condition to which the plant cell was exposed. The contacting generally is under conditions that allow for selective hybridization of a nucleic acid molecule with probe having sufficient complementarity, for example, under stringent hybridization conditions. The profile can be characteristic of exposure to a single stress condition, for example, an abnormal level of cold, osmotic pressure, or salinity (Tables 3–14), or can be characteristic of exposure to more than one stress condition (Tables 15–26, for example, cold, increased osmotic pressure and increased salinity (see Tables 24–26).

The method can be practiced using at least one nucleic acid probe and can identify one or combination of stress conditions by detecting altered expression of one or a plurality of polynucleotides representative of plant stress-regulated genes. As used herein, the term "at least one" includes one, two, three or more, for example, five, ten, twenty, fifty or more polynucleotides, nucleic acid probes, and the like. The term "plurality" is used herein to mean two or more, for example, three, four, five or more, including ten, twenty, fifty or more polynucleotides, nucleic acid probes, and the like.

In a method of the invention, nucleic acid samples from the plant cells to be collected can be contacted with an array, then the profile can be compared with known expression profiles prepared from nucleic acid samples of plants exposed to a known stress condition or combination of stress conditions. By creating a panel of such profiles, representative of various stress conditions, an unknown stress condition to which a plant was exposed can be identified simply by comparing the unknown profile with the known profiles and determining which known profile that matches the unknown profile. Preferably, the comparison is automated. Such a method can be useful, for example, to identify a cause of damage to a crop, where the condition causing the stress is not known or gradually increases over time. For example, accumulation in soils over time of salts from irrigation water can result in gradually decreasing crop yields. Because the accumulation is gradual, the cause of the decreased yield may not be readily apparent. Using the present methods, it is possible to evaluate the stress to which the plants are exposed, thus revealing the cause of the decreased yields.

The present invention, therefore includes a computer readable medium containing executable instructions form receiving expression data for sequences substantially similar to any of those disclosed herein and comparing expression data from a test plant to a reference plant that has been exposed to an abiotic stress. Also provided is a computer-readable medium containing sequence data for sequences substantially similar to any of the sequences described herein, or the complements thereof, and a module for comparing such sequences to other nucleic acid sequences.

Also provided are plants and plant cells comprising plant stress-regulatory elements of the present invention operably linked to a nucleotide sequence encoding a detectable signal. Such plants can be used as diagnostic or "sentinel" plants to provide early warning that nearby plants are being stressed so that appropriate actions can be taken. In one embodiment, the signal is one that alters the appearance of the plant. For example, an osmotic stress regulatory element of the present invention can be operably linked to a nucleotide sequence encoding a fluorescent protein such as green fluorescent protein. When subjected to osmotic stress, the expression of the green fluorescent protein in the sentinel plant provides a visible signal so that appropriate actions can be taken to remove or alleviate the stress. The use of fluorescent proteins in plants is well known (see, for example, in Leffel et al., *BioTechniques* 23:912, 1997).

The invention further relates to a method of identifying an agent that modulates the activity of a stress-regulated regulatory element of a plant. As used herein, the term "modulate the activity," when used in reference to a plant stress-regulated regulatory element, means that expression of a polynucleotide from the regulatory element is increased or decreased. In particular, expression can be increased or decreased with respect to the basal activity of the promoter, i.e., the level of expression, if any, in the absence of a stress condition that normally induces expression from the regulatory element; or can be increased or decreased with respect to the level of expression in the presence of the inducing stress condition. As such, an agent can act as a mimic of a stress condition, or can act to modulate the response to a stress condition.

Such a method can be performed, for example, by contacting the regulatory element with an agent suspected of having the ability to modulate the activity of the regulatory element, and detecting a change in the activity of the regulatory element. In one embodiment, the regulatory element can be operatively linked to a heterologous polynucleotide encoding a reporter molecule, and an agent that modulates the activity of the stress-regulated regulatory element can be identified by detecting a change in expression of the reporter molecule due to contacting the regulatory element with the agent. Such a method can be performed in vitro in a plant cell-free system, or in a plant cell in culture or in a plant in situ.

A method of the invention also can be performed by contacting the agent is contacted with a genetically modified cell or a transgenic plant containing an introduced plant stress-regulated regulatory element, and an agent that modulates the activity of the regulatory element is identified by detecting a phenotypic change in the modified cell or transgenic plant.

A method of the invention can be performed in the presence or absence of the stress condition to which the particularly regulatory element is responsive. As such, the method can identify an agent that modulates the activity of plant stress-regulated promoter in response to the stress, for example, an agent that can enhance the stress response or can reduce the stress response. In particular, a method of the invention can identify an agent that selectively activates the stress-regulated regulatory elements of a cluster of plant stress-regulated genes, but does not affect the activity of other stress-regulated regulatory genes. As such, the method provides a means to identify an agent that acts as a stress mimic. Such agents can be particularly useful to prepare a plant to an expected stress condition. For example, a agent that acts as a cold mimic can be applied to a field of plants prior to the arrival of an expected cold front. Thus, the cold stress response can be induced prior to the actual cold weather, thereby providing the plants with the protection of the stress response, without the plants suffering from any initial damage due to the cold. Similarly, an osmotic pressure mimic can be applied to a crop of plants prior a field being flooded by a rising river.

In one embodiment, the present invention provides a method for marker-assisted selection. Marker-assisted selection involves the selection of plants having desirable phenotypes based on the presence of particular nucleotide sequences ("markers"). The use of markers allows plants to be selected early in development, often before the phenotype would normally be manifest. Because it allows for early selection, marker-assisted selection decreases the amount of time need for selection and thus allows more rapid genetic progress.

Briefly, marker-assisted selection involves obtaining nucleic acid from a plant to be selected. The nucleic acid obtained is then probed with probes that selectively hybridize under stringent, preferably highly stringent, conditions to a nucleotide sequence or sequences associated with the desired phenotype. In one embodiment, the probes hybridize to any of the stress-responsive genes or regulatory regions disclosed herein, for example, any one of SEQ ID NOS: 1–2703. The presence of any hybridization products formed is detected and plants are then selected on the presence or absence of the hybridization products.

The following examples are intended to illustrate but not limit the invention.

EXAMPLE 1

Profiling of Plant Stress-Regulated Genes

This example demonstrates that clusters of stress-regulated genes can be identified in plant cells exposed to various stress conditions, either alone or in combination.

A GeneChip® Arabidopsis Genome Array (Affymetrix, Santa Clara, Calif.) was used to identify clusters of genes that were coordinately induced in response to various stress conditions. The GeneChip® Arabidopsis Genome Array contains probes synthesized in situ and is designed to measure temporal and spatial gene expression of approximately 8700 genes in greater than 100 EST clusters. The sequences used to develop the array were obtained from GenBank (http://www.ncbi.nlm.nih.gov/) in collaboration with Torrey Mesa Research Institute (San Diego, Calif.), formerly known as Novartis Agriculture Discovery Institute. Eighty percent of the nucleotide sequences represented on the array are predicted coding sequences from genomic BAC entries; twenty percent are high quality cDNA sequences. The array also contains over 100 EST clusters that share homology with the predicted coding sequences from BAC clones (see, for example, world wide web at address (url) "affymetrix.com/products/Arabidopsis_content.html".

The Affymetrix GeneChip® array was used to define nucleotide sequences/pathways affected by various abiotic stresses and to define which are uniquely regulated by one stress and those that respond to multiple stress, and to identify candidate nucleotide sequences for screening for insertional mutants. Of the approximately 8,700 nucleotide sequences represented on the Affymetrix GeneChip® array, 2862 nucleotide sequences showed at least a 2-fold change in expression in at least one sample, relative to no-treatment controls. Of those 2,862 nucleotide sequences 1,335 were regulated only by cold stress, 166 were regulated only mannitol stress and 209 were regulated only by saline stress. Furthermore, of the 2,862 nucleotide sequences 123 nucleotide sequences were regulated by salt and mannitol stress, 293 were regulated by mannitol and cold stress, 274 were regulated by cold and saline stress and 462 were regulated by cold, mannitol and salt. Of the 2,862 nucleotide sequences, 771 passed the higher stringency of showing at least a 2-fold change in expression in at least 2 samples, relative to control. And, 508 of the 771 nucleotide sequences were found in an in-house collection of insertion mutants.

The following describes in more detail how the experiments were done. Transcriptional profiling was performed by hybridizing fluorescence labeled cRNA with the oligonucleotides probes on the chip, washing, and scanning. Each gene is represented on the chip by about sixteen oligonucleotides (25-mers). Expression level is related to fluorescence intensity. Starting material contained 1 to 10 μg total RNA; detection specificity was about $1:10^6$; approximately a 2-fold change was detectable, with less than 2% false positive; the dynamic range was approximately 500×. Nucleotide sequences having up to 70% to 80% identity could be discriminated using this system.

Seven day old axenic *Arabidopsis* seedlings were transferred to Magenta boxes with rafts floating on MS medium. Three weeks later (28 day old seedlings), stresses were applied as follows: Control–no treatment; Cold–Magenta box placed in ice; Mannitol–medium+200 mM mannitol; Salt–medium+100 mM NaCl. Tissue samples were collected at 3 hours and 27 hours into the stress, roots and aerial portions were harvested, RNA was purified, and the samples were analyzed using the GeneChip® Arabidopsis Genome Array (Affymetrix, Santa Clara, Calif.) following the manufacturer's protocol.

Raw fluorescence values as generated by Affymetrix software were processed as follows: the values were brought into Microsoft Excel and values of 25 or less were set to 25 (an empirically determined baseline, Zhu and Wang, Plant Physiol. 124:1472–1476; 2000). The values from the stressed samples were then converted to fold change relative to control by dividing the values from the stressed samples by the values from the no-treatment control samples. Expression patterns that were altered at least 2-fold with respect to the control were selected. This method gave very robust results and resulted in a larger number of nucleotide sequences called as stress-regulated than previous methods had permitted.

Based on the profiles obtained following hybridization of nucleic acid molecules obtained from plant cells exposed to various stress conditions to the probes in the microarray, clusters of nucleotide sequences that were altered in response to the stress conditions were identified (see Tables 3–6, cold responsive; Tables 7–10, salt (saline) responsive; Tables 11 to 14, mannitol (osmotic) responsive; Tables 15–17, cold and mannitol responsive; Tables 18–20, 6 salt and cold responsive; Tables 21–23, salt and mannitol responsive; Tables 24–26, cold, salt and mannitol responsive. Examples of plant gene sequences that varied in expression at least two-fold in response to a combination of cold, saline and osmotic stress in root cells and leaf cells are shown in Tables 27 and 28, respectively. In addition, examples of plant gene sequences that encode transcription factors (Table 29), phosphatases (Table 30), and kinases (Table 31) and that varied at least two-fold in response to a combination of cold, saline and osmotic stress are provided.

Affymetrix ID numbers and corresponding SEQ ID NOS: for the respective *Arabidopsis* nucleotide sequences are provided Tables 3–26, and can be used to determine SEQ ID NOS: for the sequences shown by Affymetrix ID number in Tables 27–31. The Affymetrix ID number refers to a particular nucleotide sequence on the GeneChip® Arabidopsis Genome Array. In some cases, a particular plant stress-regulated gene sequence hybridized to more than one nucleotide sequence on the GeneChip® Arabidopsis Genome Array (see, for example, Table 3, where SEQ ID NO:36 is shown to have hybridized to the 12187_AT and 15920_I_AT nucleotide sequences on the GeneChip®). In addition, it should be recognized that the disclosed sequences are not limited to coding sequences but, in some cases, include 5' untranslated sequences (see Table 2) or a longest coding region. As such, while the sequences set forth as SEQ ID NOS:1–2073 generally start with an ATG codon, in most cases each comprises a longer nucleotide sequence, including a regulatory region (see Table 2).

The results disclosed herein demonstrate that several polynucleotides, some of which were known to function as transcription factors, enzymes, and structural proteins, also are involved in the response of a plant cell to stress. The identification of the clusters of stress-regulated genes as disclosed herein provides a means to identify stress-regulated regulatory elements present in *Arabidopsis thaliana* nucleotide sequences, including consensus regulatory elements. It should be recognized, however that the regulatory elements of the plant genes comprising a sequence as set forth in SEQ ID NOS:156, 229, 233, 558, 573, 606, 625, 635, 787, and 813, which previously have been described as cold regulated genes, are not encompassed within the stress-regulated gene regulatory element of the invention, and the regulatory elements of the plant genes comprising the nucleotide sequences set forth as SEQ ID NOS:1263, 1386, 1391, 1405, 1445, 1484, 1589, 1609, 1634, 1726, 1866, 1918, and 1928, which previously have been identified as genes that are responsive to a single stress condition such as cold or saline stress, are not encompassed within the plant stress-regulated gene regulatory elements of the invention to the extent that they confer stress-regulated expression only with respect to the known single stress. Furthermore, the identification of the *Arabidopsis* stress-regulated genes provides a means to identify the corresponding homologs and orthologs in other plants, including commercially valuable food crops such as wheat, rice, soy, and barley, and ornamental plants. BLASTN and BLASTP searches to identify such sequences revealed the polynucleotide sequences set forth in Table 32, which is on the CD-R compact disc submitted herewith.

Although the invention has been described with reference to the above example, it will be understood that modifications and variations are encompassed within the spirit and scope of the invention. Accordingly, the invention is limited only by the claims, which follow Tables 1 to 31.

TABLE 1

SEQUENCE DESCRIPTIONS

| Seq ID | Description | Seq ID | Description |
|---|---|---|---|
| 1 | unknown protein | 1352 | bZIP transcription factor-like protein |
| 2 | unknown protein | 1353 | Medicago nodulin N21-like protein |
| 3 | unknown protein | 1354 | putative endo-1,4-beta glucanase |
| 4 | putative auxin-induced protein | 1355 | 1-aminocyclopropane-1-carboxylate oxidase |
| 5 | unknown protein | 1356 | putative anion exchange protein |
| 6 | hypothetical protein | 1357 | SRG1-like protein |
| 7 | putative protein | 1358 | putative protein |
| 8 | unknown protein | 1359 | putative phi-1-like phosphate-induced protein |
| 9 | unknown protein | 1360 | putative protein |
| 10 | unknown protein | 1361 | putative embryo-abundant protein |
| 11 | putative protein | 1362 | putative hydrolase |
| 12 | Thioredoxin-like protein | 1363 | unknown protein |
| 13 | putative RNA helicase | 1364 | unknown protein |
| 14 | putative protein | 1365 | hexose transporter-like protein |
| 15 | putative protein | 1366 | unknown protein |
| 16 | RING zinc finger protein, putative | 1367 | unknown protein |
| 17 | putative cyclin | 1368 | peptide transport-like protein |
| 18 | putative protein | 1369 | unknown protein |
| 19 | putative protein | 1370 | putative peptide transporter |
| 20 | unknown protein | 1371 | disease resistance protein, putative |
| 21 | putative protein | 1372 | cysteine protease component of protease-inhibitor complex |
| 22 | putative protein | 1373 | putative cytochrome P450 |
| 23 | hypothetical protein | 1374 | putative protein |
| 24 | unknown protein | 1375 | hypothetical protein |
| 25 | hypothetical protein | 1376 | unknown protein |
| 26 | unknown protein | 1377 | putative phosphoribosylaminoimidazolecarboxamide formyltransferase |
| 27 | unknown protein | 1378 | putative protein |
| 28 | unknown protein | 1379 | HSP like protein |
| 29 | unknown protein | 1380 | unknown protein |
| 30 | putative protein | 1381 | unknown protein |
| 31 | putative protein | 1382 | putative cytochrome P450 |
| 32 | putative protein | 1383 | similar to pectinesterase |
| 33 | unknown protein | 1384 | putative glucosyltransferase |

TABLE 1-continued

SEQUENCE DESCRIPTIONS

| Seq ID | Description | Seq ID | Description |
|---|---|---|---|
| 34 | putative ribonuclease III | 1385 | thaumatin-like protein |
| 35 | unknown protein | 1386 | drought-inducible cysteine proteinase RD19A precursor |
| 36 | unknown protein | 1387 | vegetative storage protein Vsp2 |
| 37 | unknown protein | 1388 | unknown protein |
| 38 | unknown protein | 1389 | unknown protein |
| 39 | unknown protein | 1390 | anthranilate N-benzoyltransferase-like protein |
| 40 | putative histidine kinase | 1391 | delta-1-pyrroline 5-carboxylase synthetase (P5C1) |
| 41 | scarecrow-like 7 (SCL7) | 1392 | glutathione S-conjugate transporting ATPase (AtMRP1) |
| 42 | putative protein | 1393 | hypothetical protein |
| 43 | No function assigned by TIGR | 1394 | hypothetical protein |
| 44 | unknown protein | 1395 | unknown protein |
| 45 | unknown protein | 1396 | putative protein |
| 46 | succinyl-CoA-ligase alpha subunit | 1397 | putative protein |
| 47 | putative protein | 1398 | No function assigned by TIGR |
| 48 | CLV1 receptor kinase like protein | 1399 | unknown protein |
| 49 | putative receptor-like protein kinase | 1400 | putative protein kinase |
| 50 | putative squalene synthase | 1401 | unknown protein |
| 51 | putative receptor protein kinase | 1402 | hypothetical protein |
| 52 | somatic embryogenesis receptor-like kinase, putative | 1403 | unknown protein |
| 53 | putative protein | 1404 | putative calcium-binding EF-hand protein |
| 54 | putative beta-glucosidase | 1405 | cinnamyl-alcohol dehydrogenase ELI3-1 |
| 55 | multi-drug resistance protein | 1406 | putative protein |
| 56 | receptor protein kinase (TMK1), putative | 1407 | unknown protein |
| 57 | putative receptor-like protein kinase | 1408 | senescence-associated protein sen1 |
| 58 | putative pectate lyase | 1409 | hypothetical protein |
| 59 | putative protein kinase | 1410 | putative cytochrome P450 |
| 60 | putative peroxidase | 1411 | proline oxidase, mitochondrial precursor (osmotic stress-induced proline dehydrogenase) |
| 61 | cytochrome P450-like protein | 1412 | putative response regulator 3 |
| 62 | putative beta-amylase | 1413 | hypothetical protein |
| 63 | monosaccharide transporter STP3 | 1414 | glutamine-dependent asparagine synthetase |
| 64 | *Lycopersicon esculentum* proteinase TMP, Pir2:T07617 | 1415 | lysine-ketoglutarate reductase/saccharopine |
| 65 | putative receptor-like protein kinase | 1416 | En/Spm-like transposon protein |
| 66 | G-box-binding factor 1 | 1417 | G-box binding bZIP transcription factor |
| 67 | amino acid carrier, putative | 1418 | putative protein |
| 68 | myb-related protein | 1419 | putative protein |
| 69 | No function assigned by TIGR | 1420 | putative protein |
| 70 | SNF1 like protein kinase | 1421 | ATFP4-like |
| 71 | Cu/Zn superoxide dismutase-like protein | 1422 | unknown protein |
| 72 | putative protein kinase | 1423 | unknown protein |
| 73 | small nuclear ribonucleoprotein U1A | 1424 | putative protein |
| 74 | ras-like GIF-binding protein | 1425 | invertase inhibitor homolog (emb|CAA73335.1) |
| 75 | oleoyl-[acyl-carrier-protein] hydrolase-like protein | 1426 | unknown protein |
| 76 | putative heat shock transcription factor | 1427 | unknown protein |
| 77 | putative protein | 1428 | putative cytochrome b5 |
| 78 | membrane-bound small GTP-binding-like protein | 1429 | putative protein |
| 79 | putative protein (fragment) | 1430 | putative protein |

TABLE 1-continued

SEQUENCE DESCRIPTIONS

| Seq ID | Description | Seq ID | Description |
|---|---|---|---|
| 80 | indole-3-acetate beta-glucosyltransferase like protein | 1431 | putative protein |
| 81 | HD-zip transcription factor (athb-8) | 1432 | No function assigned by TIGR |
| 82 | putative cAMP-dependent protein kinase | 1433 | putative copper/zinc superoxide dismutase |
| 83 | glucuronosyl transferase-like protein | 1434 | protein phosphatase ABI1 |
| 84 | putative leucine-rich repeat disease resistance protein | 1435 | glutamate dehydrogenase 2 |
| 85 | 98b like protein | 1436 | No function assigned by TIGR |
| 86 | putative receptor-like protein kinase | 1437 | low-temperature-induced protein 78 (sp|Q06738) |
| 87 | IAA-Ala hydrolase (IAR3) | 1438 | putative myo-inositol 1-phosphate synthase |
| 88 | putative AP2 domain transcription factor | 1439 | phosphate transporter (gb|AAB17265.1) |
| 89 | putative expansin | 1440 | 4-hydroxyphenylpyruvate dioxygenase (HPD) |
| 90 | putative Ap2 domain protein | 1441 | histone H1 |
| 91 | expansin (At-EXP1) | 1442 | hypothetical protein |
| 92 | cytochrome P450-like protein | 1443 | No function assigned by TIGR |
| 93 | putative ATP-dependent RNA helicase A | 1444 | neoxanthin cleavage enzyme-like protein |
| 94 | unknown protein | 1445 | dehydration-induced protein RD22 |
| 95 | predicted protein | 1446 | zinc finger protein ZAT7 |
| 96 | putative glucosyltransferase | 1447 | unknown protein |
| 97 | unknown protein | 1448 | unknown protein |
| 98 | putative xyloglucan-specific glucanase | 1449 | unknown protein |
| 99 | cysteine synthase | 1450 | unknown protein |
| 100 | clathrin assembly protein AP19 homolog | 1451 | putative protein |
| 101 | dynein light chain like protein | 1452 | putative protein |
| 102 | chaperonin CPN10 | 1453 | RNA helicase, putative |
| 103 | putative bHLH transcription factor | 1454 | putative glycine-rich protein |
| 104 | putative glyoxysomal malate dehydrogenase precursor | 1455 | hypothetical protein |
| 105 | ATP-dependent RNA helicase, putative | 1456 | putative protein |
| 106 | chlorophyll synthetase | 1457 | peroxidase |
| 107 | similar to epoxide hydrolases | 1458 | peroxidase ATP3a (emb|CAA67340.1) |
| 108 | putative protein | 1459 | metallothionein-like protein |
| 109 | unknown protein | 1460 | endomembrane-associated protein |
| 110 | hypothetical protein | 1461 | ferritin 1 precursor |
| 111 | putative membrane transporter | 1462 | dehydrin RAB18-like protein (sp|P30185) |
| 112 | putative tyrosyl-tRNA synthetase | 1463 | HSR201 like protein |
| 113 | ARGININE/SERINE-RICH SPLICING FACTOR RSP31 | 1464 | light regulated protein, putative |
| 114 | putative oxidoreductase | 1465 | Dr4 (protease inhibitor) |
| 115 | unknown protein | 1466 | mitogen activated protein kinase kinase (nMAPKK) |
| 116 | linker histone protein, putative | 1467 | glutathione S-transferase |
| 117 | hypothetical protein | 1468 | transcriptional activator CBF1/CRT/CRE binding factor 1 |
| 118 | putative protein | 1469 | homeobox-leucine zipper protein ATHB-12 |
| 119 | putative mitochondrial carrier protein | 1470 | amino acid permease I |
| 120 | putative transcription factor | 1471 | MAP kinase (ATMPK7) |
| 121 | MYB-related protein | 1472 | potassium channel protein AKT3 |
| 122 | myb-related transcription factor, putative | 1473 | cytochrome P450 monooxygenase (CYP91A2) |
| 123 | unknown protein | 1474 | putative transport protein |

TABLE 1-continued

SEQUENCE DESCRIPTIONS

| Seq ID | Description | Seq ID | Description |
|---|---|---|---|
| 124 | unknown protein | 1475 | putative protein |
| 125 | putative glycine-rich protein | 1476 | hypothetical protein |
| 126 | No function assigned by TIGR | 1477 | putative protein |
| 127 | unknown protein | 1478 | hypothetical protein |
| 128 | unknown protein | 1479 | receptor protein kinase-like protein |
| 129 | unknown protein | 1480 | serine/threonine protein kinase-like protein |
| 130 | unknown protein | 1481 | putative auxin-regulated protein |
| 131 | putative membrane channel protein | 1482 | amino acid transport protein AAP2 |
| 132 | putative protein | 1483 | unknown protein |
| 133 | unknown protein | 1484 | cold and ABA inducible protein kin1 |
| 134 | gamma glutamyl hydrolase, putative | 1485 | gamma-VPE (vacuolar processing enzyme) |
| 135 | 40S ribosomal protein S5 | 1486 | putative protein 1 photosystem II oxygen-evolving complex |
| 136 | DnaJ-like protein | 1487 | myrosinase-associated protein, putative |
| 137 | 40S ribosomal protein S26 | 1488 | transcription factor ATMYB4 |
| 138 | putative WRKY-type DNA binding protein | 1489 | H-protein promoter binding factor-2a |
| 139 | putative protein | 1490 | ammonium transporter, puitative |
| 140 | hypothetical protein | 1491 | putative zeta-carotene desaturase precursor |
| 141 | putative ubiquitin-conjugating enzyme | 1492 | high-affinity nitrate transporter NRT2 |
| 142 | peptidylprolyl isomerase ROC1 | 1493 | light induced protein like |
| 143 | glyceraldehyde-3-phosphate dehydrogenase C subunit (GapC) | 1494 | putative AT-hook DNA-binding protein |
| 144 | No function assigned by TIGR | 1495 | putative glycogenin |
| 145 | putative protein | 1496 | putative light repressible receptor protein kinase |
| 146 | putative thioredoxin | 1497 | serine/threonine kinase-like protein |
| 147 | thioredoxin h, putative | 1498 | putative peroxidase |
| 148 | thioredoxin-like | 1499 | cytochrome P450 monooxygenase (CYP83A1) |
| 149 | allene oxide synthase (emb|CAA73184.1) | 1500 | MYB-related transcription factor (CCA1) |
| 150 | anthranilate synthase component I-1 precursor (sp|P32068) | 1501 | Terminal flower1 (TFL1) |
| 151 | CELL DIVISION CONTROL PROTEIN 2 HOMOLOG A | 1502 | sulfate transporter ATST1 |
| 152 | protein kinase cdc2 homolog B | 1503 | RING-H2 finger protein RHA3b |
| 153 | ethylene responsive element binding factor 1 (frameshift !) | 1504 | lipoxygenase, putative |
| 154 | ethylene responsive element binding factor 2 (ATERF2) (sp|O80338) | 1505 | serine O-acetyltransferase (EC 2.3.1.30) Sat-52 (pir|S71207) |
| 155 | ethylene responsive element binding factor 5 (ATERF5) (sp|O80341) | 1506 | ferulate-5-hydroxylase (FAH1) |
| 156 | glucose-6-phosphate dehydrogenase | 1507 | En/Spm-like transposon protein, putative |
| 157 | photomorphogenesis represser (COP1) | 1508 | calmodulin-binding-like protein |
| 158 | unknown protein | 1509 | hypothetical protein |
| 159 | DNA (cytosine-5)- methyltransferase (DNA methyltransferase) (DNA metase) (sp|P34881) | 1510 | somatic embryogenesis receptor-like kinase-like protein |
| 160 | PROLIFERA | 1511 | putative giberellin beta-hydroxylase |
| 161 | putative photomorphogenesis represser protein | 1512 | putative pectinesterase |

TABLE 1-continued

SEQUENCE DESCRIPTIONS

| Seq ID | Description | Seq ID | Description |
|---|---|---|---|
| 162 | SNF1-like protein kinase (AKin11) | 1513 | putative protein |
| 163 | thioredoxin h | 1514 | unknown protein |
| 164 | thioredoxin | 1515 | ribosomal protein |
| 165 | Ca2+-dependent lipid-binding protein, putative | 1516 | low-temperature-induced 65 kD protein (sp|Q04980) |
| 166 | putative auxin-induced protein | 1517 | putative glucosyltransferase |
| 167 | putative bZIP transcription factor | 1518 | peroxidase (emb|CAA67551.1) |
| 168 | hypothetical protein | 1519 | ankyrin-like protein |
| 169 | putative AVR9 elicitor response protein | 1520 | ribosomal protein S11-like |
| 170 | putative serine/threonine protein kinase | 1521 | hypothetical protein |
| 171 | bZIP transcription factor ATB2 | 1522 | glycoprotein (EP1), putative |
| 172 | putative spliceosome associated protein | 1523 | calnexin-like protein |
| 173 | 3-hydroxyisobutyryl-coenzyme A hydrolase-like protein | 1524 | SRG1-like protein |
| 174 | putative protein | 1525 | ethylene response factor 1 (ERF1) |
| 175 | putative Mutator-like transposase | 1526 | transcriptional activator CBF1-like protein |
| 176 | putative protein | 1527 | xyloglucan endo-1,4-beta-D-glucanase (XTR-6) |
| 177 | unknown protein | 1528 | putative cinnamyl alcohol dehydrogenase |
| 178 | putative protein | 1529 | gibberellin 3 beta-hydroxylase, putative |
| 179 | putative protein | 1530 | auxin response transcription factor 3 (ETTIN/ARF3) |
| 180 | putative galactinol synthase | 1531 | No function assigned by TIGR |
| 181 | putative transcriptional regulator | 1532 | putative protein |
| 182 | nuclear matrix constituent protein 1 (NMCP1)-like | 1533 | similar to avrRpt2-induced protein 1 |
| 183 | putative DNA-binding protein RAV2 | 1534 | unknown protein |
| 184 | No function assigned by TIGR | 1535 | hypothetical protein |
| 185 | basic blue protein, 5' partial | 1536 | putative protein kinase |
| 186 | unknown protein | 1537 | respiratory burst oxidase-like protein |
| 187 | putative calcium-binding protein, calreticulin | 1538 | glucose-6-phosphate/phosphate-translocator precursor, putative |
| 188 | putative pyrophosphate-fructose-6-phosphate 1-phosphotransferase | 1539 | class 1 non-symbiotic hemoglobin (AHB1) |
| 189 | ribosomal protein L11, cytosolic | 1540 | endochitinase isolog |
| 190 | putative dTDP-glucose 4-6-dehydratase | 1541 | putative cytochrome P450 |
| 191 | 40S ribosomal protein S20-like protein | 1542 | 60S acidic ribosomal protein P0 |
| 192 | 60S ribosomal protein L24 | 1543 | putative protein |
| 193 | coatomer-like protein, epsilon subunit | 1544 | auxin-induced protein, putative |
| 194 | glycoprotein (EP1), putative | 1545 | unknown protein |
| 195 | putative SPL1-related protein | 1546 | hypothetical protein |
| 196 | unknown protein | 1547 | protein phosphatase 2C ABI2 (PP2C) (sp|O04719) |
| 197 | putative transport protein SEC61 beta-subunit | 1548 | peroxidase, prxr2 |
| 198 | unknown protein | 1549 | putative peroxidase ATP12a |
| 199 | putative cytochrome P450 | 1550 | putative beta-amylase |
| 200 | UTP-glucose glucosyltransferase-like protein | 1551 | putative acetone-cyanohydrin lyase |
| 201 | 60S ribosomal protein L23 | 1552 | fatty acid elongase 3-ketoacyl-CoA synthase 1 |
| 202 | 40S ribosomal protein S17 | 1553 | putative citrate synthase |
| 203 | 40S ribosomal protein S26 | 1554 | pEARLI 1-like protein |
| 204 | protein translation factor Sui1 homolog, putative | 1555 | putative MYB family transcription factor |

TABLE 1-continued

SEQUENCE DESCRIPTIONS

| Seq ID | Description | Seq ID | Description |
|---|---|---|---|
| 205 | unknown protein | 1556 | putative transcription factor MYB28 |
| 206 | gamma glutamyl hydrolase, putative | 1557 | RNA helicase-like protein |
| 207 | dTDP-glucose 4,6-dehydratase, putative | 1558 | snoRNA |
| 208 | extensin-like protein | 1559 | putative protein kinase |
| 209 | unknown protein | 1560 | growth regulator like protein |
| 210 | protein phosphatase 2C-like protein | 1561 | putative potassium transporter |
| 211 | ubiquitin-like protein | 1562 | putative protein |
| 212 | protein phosphatase 2C-like protein | 1563 | 60S ribosomal protein L14 |
| 213 | unknown protein | 1564 | unknown protein |
| 214 | putative RING zinc finger ankyrin protein | 1565 | putative RING-H2 zinc finger protein |
| 215 | unknown protein | 1566 | putative pollen surface protein |
| 216 | putative rubisco subunit binding-protein alpha subunit | 1567 | unknown protein |
| 217 | putative acetone-cyanohydrin lyase | 1568 | unknown protein |
| 218 | putative isoamylase | 1569 | unknown protein |
| 219 | putative protein | 1570 | putative Ca2+-ATPase |
| 220 | HSP associated protein like | 1571 | 1-aminocyclopropane-1-carboxylate synthase-like protein |
| 221 | 60S ribosomal protein L39 | 1572 | putative beta-glucosidase |
| 222 | unknown protein | 1573 | transcription factor ZAP1 |
| 223 | putative SF16 protein {Helianthus annuus} | 1574 | oligopeptide transporter, putative |
| 224 | unknown protein | 1575 | putative protein |
| 225 | thioredoxin | 1576 | putative glucosyltransferase |
| 226 | trehalose-6-phosphate phosphatase (AtTPPB) | 1577 | putative serine/threonine kinase |
| 227 | chlorophyll a/b-binding protein | 1578 | squalene epoxidase-like protein |
| 228 | class IV chitinase (CHIV) | 1579 | similar to 14 KD proline-rich protein DC2.15 precursor (sp|P14009); similar to ESTs emb|Z17709 and emb|Z47685 |
| 229 | chalcone synthase (naringenin-chalcone synthase) (testa 4 protein) (sp|P13114) | 1580 | unknown protein |
| 230 | unknown protein | 1581 | unknown protein |
| 231 | cinnamyl-alcohol dehydrogenase ELI3-2 | 1582 | hypothetical protein |
| 232 | farnesyl-pyrophosphate synthetase FPS2 | 1583 | 60S ribosomal protein L38 |
| 233 | phospholipid hydroperoxide glutathione peroxidase | 1584 | flavin-containing monooxygenase, putative |
| 234 | heat shock transcription factor HSF4 | 1585 | remorin |
| 235 | heat shock protein 101 | 1586 | unknown protein |
| 236 | 17.6 kDa heat shock protein (AA 1-156) | 1587 | putative protein |
| 237 | heat shock protein 17.6A | 1588 | lipoxygenase |
| 238 | heat-shock protein | 1589 | cold-regulated protein COR6.6 (KIN2) |
| 239 | HY5 | 1590 | Myb transcription factor homolog (ATR1) |
| 240 | putative auxin-induced protein, IAA12 | 1591 | putative protein |
| 241 | early auxin-induced protein, IAA19 | 1592 | unknown protein |
| 242 | auxin-inducible gene (IAA2) | 1593 | unknown protein |
| 243 | putative protein | 1594 | Ca2+-transporting ATPase-like protein |
| 244 | putative choline kinase | 1595 | protein phosphatase 2C (AtP2C-HA) |
| 245 | thymidylate kinase-like protein | 1596 | peroxidase ATP24a |
| 246 | CTP synthase like protein | 1597 | branched-chain alpha keto-acid dehydrogenase, putative |

TABLE 1-continued

SEQUENCE DESCRIPTIONS

| Seq ID | Description | Seq ID | Description |
|---|---|---|---|
| 247 | putative protein | 1598 | putative beta-ketoacyl-CoA synthase |
| 248 | putative amidase | 1599 | putative protein |
| 249 | 4-alpha-glucanotransferase | 1600 | putative beta-galactosidase |
| 250 | hypothetical protein | 1601 | putative protein |
| 251 | similar to auxin-induced protein | 1602 | 60S ribosomal protein L27 |
| 252 | putative protein | 1603 | putative annexin |
| 253 | putative protein | 1604 | NAC domain protein, putative |
| 254 | putative protein | 1605 | unknown protein |
| 255 | hyuC-like protein | 1606 | late embryogenesis abundant protein LEA like |
| 256 | putative tetracycline transporter protein | 1607 | unknown protein |
| 257 | similar to early nodulins | 1608 | putative protein |
| 258 | putative protein | 1609 | dehydrin Xero2 |
| 259 | putative peptidyl-prolyl cis-trans isomerase | 1610 | putative zinc finger protein |
| 260 | unknown protein | 1611 | unknown protein |
| 261 | unknown protein | 1612 | DnaJ-like protein |
| 262 | putative endochitinase | 1613 | putative inositol polyphosphate-5-phosphatase |
| 263 | putative ABC transporter | 1614 | putative cytochrome P450 |
| 264 | No function assigned by TIGR | 1615 | putative protein |
| 265 | CONSTANS-like B-box zinc finger protein | 1616 | unknown protein |
| 266 | unknown protein | 1617 | putative protein |
| 267 | unknown protein | 1618 | hypothetical protein |
| 268 | putative mitochondrial processing peptidase alpha subunit | 1619 | putative protein |
| 269 | putative pre-mRNA splicing factor | 1620 | sucrose-UDP glucosyltransferase |
| 270 | putative phosphatidylserine decarboxylase | 1621 | glucose-6-phosphate 1-dehydrogenase |
| 271 | unknown protein | 1622 | unknown protein |
| 272 | unknown protein | 1623 | mitochondrial chaperonin (HSP60) |
| 273 | unknown protein | 1624 | sucrose transport protein SUC1 |
| 274 | putative casein kinase I | 1625 | putative protein disulfide isomerase |
| 275 | unknown protein | 1626 | putative pollen-specific protein |
| 276 | 60S ribosomal protein L23A | 1627 | integral membrane protein, putative |
| 277 | putative mitochondrial dicarboxylate carrier protein | 1628 | rubredoxin, putative |
| 278 | enoyl-ACP reductase (enr-A) | 1629 | putative protein |
| 279 | putative isoamylase | 1630 | disease resistance protein RPS4, putative |
| 280 | formamidase-like protein | 1631 | putative peptide/amino acid transporter |
| 281 | reticuline oxidase-like protein | 1632 | peroxidase, putative |
| 282 | unknown protein | 1633 | ethylene receptor, putative (ETR2) |
| 283 | putative transketolase precursor | 1634 | protein phosphatase 2C (PP2C) |
| 284 | putative protein | 1635 | putative glutathione S-transferase |
| 285 | unknown protein | 1636 | homeodomain transcription factor (ATHB-7) |
| 286 | unknown protein | 1637 | putative nitrate transporter |
| 287 | unknown protein | 1638 | putative ribosomal protein L9, cytosolic |
| 288 | putative esterase D | 1639 | putative DNA-binding protein |
| 289 | predicted protein of unknown function | 1640 | beta-1,3-glucanase-like protein |
| 290 | unknown protein | 1641 | putative zinc transporter |
| 291 | putative indole-3-glycerol phosphate synthase | 1642 | transcription factor TINY |
| 292 | isopentenyl pyrophosphate:dimethyllallyl pyrophosphate isomerase | 1643 | putative aspartate kinase-homoserine dehydrogenase |
| 293 | kinase associated protein phosphatase | 1644 | ethylene reponse factor-like AP2 domain transcription factor |

TABLE 1-continued

SEQUENCE DESCRIPTIONS

| Seq ID | Description | Seq ID | Description |
|---|---|---|---|
| 294 | putative K+ channel, beta subunit | 1645 | peptide transporter-like protein |
| 295 | KNAT1 homeobox-like protein | 1646 | trehalose-6-phosphate synthase like protein |
| 296 | PSI type II chlorophyll a/b-binding protein, putative | 1647 | putative ribonuclease |
| 297 | transcription factor | 1648 | hypothetical protein |
| 298 | putative WD-40 repeat protein, MSI2 | 1649 | putative DNA-binding protein |
| 299 | WD-40 repeat protein (MSI3) | 1650 | nodulin-like protein |
| 300 | putative WD-40 repeat protein, MSI4 | 1651 | trehalose-6-phosphate phosphatase-like protein |
| 301 | unknown protein | 1652 | succinate dehydrogenase flavoprotein alpha subunit (emb|CAA05025.1) |
| 302 | hypothetical protein | 1653 | unknown protein |
| 303 | putative protein | 1654 | stress related protein, putative |
| 304 | No function assigned by TIGR | 1655 | putative chloroplast initiation factor 3 |
| 305 | polyphosphoinositide binding protein, putative | 1656 | putative protein |
| 306 | hypothetical protein | 1657 | hypothetical protein |
| 307 | unknown protein | 1658 | putative CCCH-type zinc finger protein |
| 308 | chloroplast ribosomal L1-like protein | 1659 | similar to harpin-induced protein hin1 from tobacco |
| 309 | cold-regulated protein cor15b precursor | 1660 | unknown protein |
| 310 | cyanohydrin lyase like protein | 1661 | unknown protein |
| 311 | putative replication protein A1 | 1662 | hypothetical protein |
| 312 | putative protein | 1663 | No function assigned by TIGR |
| 313 | possible apospory-associated like protein | 1664 | putative protein |
| 314 | DNA binding protein GT-1, putative | 1665 | putative glutathione S-transferase TSI-1 |
| 315 | AT-hook DNA-binding protein (AHP1) | 1666 | putative protein |
| 316 | putative phospholipase | 1667 | putative PTR2 family peptide transporter |
| 317 | chloroplast FtsH protease, putative | 1668 | receptor kinase-like protein |
| 318 | enoyl-CoA hydratase like protein | 1669 | putative sugar transport protein, ERD6 |
| 319 | berberine bridge enzyme-like protein | 1670 | putative protein |
| 320 | putative sugar transporter | 1671 | nodulin-like protein |
| 321 | unknown protein | 1672 | unknown protein |
| 322 | No function assigned by TIGR | 1673 | putative receptor-like protein kinase |
| 323 | hypothetical protein | 1674 | glutathione-conjugate transporter AtMRP4 |
| 324 | putative acidic ribosomal protein | 1675 | ascorbate oxidase-like protein |
| 325 | putative protein | 1676 | pathogenesis-related protein 1 precursor, 19.3K |
| 326 | unknown protein | 1677 | R2R3-MYB transcription factor |
| 327 | hypothetical protein | 1678 | hypothetical protein |
| 328 | putative protein | 1679 | putative chitinase |
| 329 | dihydroxypolyprenylbenzoate methyltransferase | 1680 | Mlo protein, putative |
| 330 | unknown protein | 1681 | putative WRKY-type DNA binding protein |
| 331 | myb-related protein | 1682 | putative acyl-CoA synthetase |
| 332 | No function assigned by TIGR | 1683 | putative pathogenesis-related protein |
| 333 | putative protein | 1684 | putative chitinase |
| 334 | putative disease resistance response protein | 1685 | germin precursor oxalate oxidase |
| 335 | hypothetical protein | 1686 | endoxyloglucan transferase, putative |
| 336 | No function assigned by TIGR | 1687 | putative protein |
| 337 | starch branching enzyme II | 1688 | putative cytochrome P450 |

TABLE 1-continued

SEQUENCE DESCRIPTIONS

| Seq ID | Description | Seq ID | Description |
|---|---|---|---|
| 338 | No function assigned by TIGR | 1689 | similar to Mlo proteins from *H. vulgare* |
| 339 | putative enolase (2-phospho-D-glycerate hydroylase) | 1690 | putative tropinone reductase |
| 340 | putative protein kinase | 1691 | extensin-like protein |
| 341 | HD-Zip protein, putative | 1692 | putative sarcosine oxidase |
| 342 | putative protein kinase | 1693 | putative protein |
| 343 | phenylalanyl-trna synthetase-like protein | 1694 | hypothetical protein |
| 344 | putative aconitase | 1695 | late embryogenesis-abundant protein, putative |
| 345 | NAM (no apical meristem) protein, putative | 1696 | beta-carotene hydroxylase |
| 346 | unknown protein | 1697 | putative calcium binding protein |
| 347 | putative phosphomannomutase | 1698 | unknown protein |
| 348 | putative farnesylated protein | 1699 | unknown protein |
| 349 | unknown protein | 1700 | predicted glycosyl transferase |
| 350 | water stress-induced protein, putative | 1701 | hypothetical protein |
| 351 | unknown protein | 1702 | hypothetical protein |
| 352 | unknown protein | 1703 | hypothetical protein |
| 353 | PEROXISOMAL MEMBRANE PROTEIN PMP22 | 1704 | putative protein |
| 354 | putative peroxisomal membrane carrier protein | 1705 | unknown protein |
| 355 | putative protein | 1706 | putative protein |
| 356 | unknown protein | 1707 | putative protein |
| 357 | putative protein | 1708 | serine/threonine kinase-like protein |
| 358 | putative protein | 1709 | No function assigned by TIGR |
| 359 | argininosuccinate synthase-like protein | 1710 | putative pectinesterase |
| 360 | 1-phosphatidylinositol-4,5-bisphosphate phosphodiesterase | 1711 | peroxidase like protein |
| 361 | putative JUN kinase activator protein | 1712 | No function assigned by TIGR |
| 362 | putative 60S ribosomal protein L35 | 1713 | phenylalanine ammonia lyase (PAL1) |
| 363 | nucleoid DNA-binding protein cnd41-like protein | 1714 | peroxidase (emb|CAA68212.1) |
| 364 | SigA binding protein | 1715 | putative AMP deaminase |
| 365 | hypothetical protein | 1716 | putative MYB family transcription factor |
| 366 | putative protein kinase | 1717 | DNA-directed RNA polymerase II, third largest subunit |
| 367 | unknown protein | 1718 | nucleotide pyrophosphatase-like protein |
| 368 | regulatory protein NPR1-like; transcription factor inhibitor I kappa B-like | 1719 | putative peroxidase |
| 369 | putative protein | 1720 | calcium sensor homolog (gb|AAC26110.1) |
| 370 | hypothetical protein | 1721 | putative GDSL-motif lipase/hydrolase |
| 371 | phosphoribosylanthranilate isomerase | 1722 | putative nonspecific lipid-transfer protein |
| 372 | phosphoribosylanthranilate isomerase | 1723 | acyl-carrier protein (ACP), putative |
| 373 | sterol glucosyltransferase, putative | 1724 | putative glycine dehydrogenase |
| 374 | putative gigantea protein | 1725 | AIG1 |
| 375 | putative MYB family transcription factor | 1726 | ACC synthase (AtACS-6) |
| 376 | hypothetical protein | 1727 | cyclin delta-3 |
| 377 | hypothetical protein | 1728 | putative RING zinc finger protein |
| 378 | predicted protein | 1729 | aldose 1-epimerase-like protein |
| 379 | cytochrome P450, putative | 1730 | putative phospholipase |
| 380 | putative Na+ dependent ileal bile acid transporter | 1731 | phosphoenolpyruvate carboxylase |
| 381 | unknown protein | 1732 | putative galactinol synthase |

TABLE 1-continued

SEQUENCE DESCRIPTIONS

| Seq ID | Description | Seq ID | Description |
|---|---|---|---|
| 382 | RING-H2 finger protein RHF1a | 1733 | unknown protein |
| 383 | putative protein | 1734 | putative protein |
| 384 | unknown protein | 1735 | 1-aminocyclopropane-1-carboxylate oxidase |
| 385 | putative protein | 1736 | thioredoxin (clone GIF1) (pir\|S58118) |
| 386 | putative auxin-regulated protein | 1737 | trehalose-6-phosphate phosphatase |
| 387 | hypothetical protein | 1738 | beta-1,3-glucanase 2 (BG2) (PR-2) |
| 388 | unknown protein | 1739 | putative S-adenosyl-L-methionine:trans-caffeoyl-Coenzyme A 3-O-methyltransferase |
| 389 | unknown protein | 1740 | disease resistance protein EDS1 |
| 390 | putative protein | 1741 | putative protein kinase |
| 391 | putative protein | 1742 | Gluthatione reductase, chloroplast precursor |
| 392 | unknown protein | 1743 | putative heat shock protein |
| 393 | histone H1 | 1744 | aspartate kinase |
| 394 | Argonaute (AGO1)-like protein | 1745 | putative major intrinsic (channel) protein |
| 395 | unknown protein | 1746 | matrix metalloproteinase, putative |
| 396 | putative protein with C-terminal RING finger | 1747 | putative GDSL-motif lipase/hydrolase |
| 397 | unknown protein | 1748 | putative protein |
| 398 | unknown protein | 1749 | DAG-like protein |
| 399 | unknown protein | 1750 | serine/threonine kinase-like protein |
| 400 | unknown protein | 1751 | formamidase-like protein |
| 401 | unknown protein | 1752 | CER2 |
| 402 | putative copper amine oxidase | 1753 | 26S proteasome subunit 4 |
| 403 | unknown protein | 1754 | pectinesterase like protein |
| 404 | unknown protein | 1755 | putative disease resistance protein |
| 405 | unknown protein | 1756 | putative RNA methyltransferase |
| 406 | putative protein | 1757 | unknown protein |
| 407 | putative protein | 1758 | HOMEOBOX PROTEIN KNOTTED-1 LIKE 4 (KNAT4) |
| 408 | unknown protein | 1759 | glycine-rich RNA-binding protein AtGRP2-like |
| 409 | unknown protein | 1760 | putative acetylornithine transaminase |
| 410 | putative protein | 1761 | putative Sec24-like COPII protein |
| 411 | putative protein | 1762 | putative berberine bridge enzyme |
| 412 | unknown protein | 1763 | putative GH3-like protein |
| 413 | serine/threonine kinase-like protein | 1764 | putative ABC transporter |
| 414 | alcohol dehydrogenase, putative | 1765 | putative reticuline oxidase-like protein |
| 415 | anthranilate phosphoribosyltransferase, chloroplast precursor (sp\|Q02166) | 1766 | pectate lyase-like protein |
| 416 | phytochrome C (sp\|P14714) | 1767 | protein disulfide-isomerase-like protein |
| 417 | putative phytochrome-associated protein 3 | 1768 | putative protein |
| 418 | receptor serine/threonine kinase PR5K | 1769 | putative membrane transporter |
| 419 | Ran-binding protein (atranbp1a) | 1770 | unknown protein |
| 420 | small Ras-like GTP-binding protein (gb\|AAB58478.1) | 1771 | unknown protein |
| 421 | sterol-C5-desaturase | 1772 | putative RING-H2 zinc finger protein |
| 422 | tryptophan synthase beta chain 1 precursor (sp\|P14671) | 1773 | unknown protein |
| 423 | thioredoxin f2 (gb\|AAD35004.1) | 1774 | unknown protein |
| 424 | No function assigned by TIGR | 1775 | unknown protein |
| 425 | putative WRKY DNA-binding protein | 1776 | MADS-box protein (AGL20) |
| 426 | putative protein | 1777 | amidophosphoribosyltransferase 2 precursor |

TABLE 1-continued

SEQUENCE DESCRIPTIONS

| Seq ID | Description | Seq ID | Description |
|---|---|---|---|
| 427 | unknown protein | 1778 | putative dihydrodipicolinate synthase |
| 428 | unknown protein | 1779 | hypothetical protein |
| 429 | 14-3-3 protein homolog RCI1 (pir\|S47969) | 1780 | ABA-responsive protein-like |
| 430 | unknown protein | 1781 | putative protein |
| 431 | putative CCCH-type zinc finger protein | 1782 | hypothetical protein |
| 432 | PINHEAD (gb\|AAD40098.1); translation initiation factor | 1783 | DNA-binding protein-like |
| 433 | plasma membrane proton ATPase (PMA) | 1784 | No function assigned by TIGR |
| 434 | CHLOROPHYLL A-B BINDING PROTEIN 4 PRECURSOR homolog | 1785 | transcription factor, putative |
| 435 | membrane related protein CP5, putative | 1786 | nitrate reductase, putative |
| 436 | ABC transporter (AtMRP2) | 1787 | putative protein |
| 437 | putative embryo-abundant protein | 1788 | putative protein |
| 438 | putative anthocyanidin-3-glucoside rhamnosyltransferase | 1789 | putative protein |
| 439 | putative lipid transfer protein | 1790 | putative protein |
| 440 | unknown protein | 1791 | unknown protein |
| 441 | unknown protein | 1792 | unknown protein |
| 442 | galactinol synthase, putative | 1793 | tryptophan synthase beta-subunit (TSB2) |
| 443 | putative protein | 1794 | hypothetical protein |
| 444 | putative protein | 1795 | putative protein |
| 445 | SCARECROW-like protein | 1796 | putative DNA-binding protein |
| 446 | unknown protein | 1797 | putative 40S ribosomal protein S10 |
| 447 | unknown protein | 1798 | putative protein |
| 448 | unknown protein | 1799 | putative cytochrome P450 |
| 449 | unknown protein | 1800 | putative protein |
| 450 | asparagine--tRNA ligase | 1801 | putative protein |
| 451 | putative protein | 1802 | putative glucosyltransferase |
| 452 | glutamate-1-semialdehyde 2,1-aminomutase 1 precursor (GSA 1) (glutamate-1-semialdehyde aminotransferase 1) (GSA-AT 1) (sp\|P42799) | 1803 | No function assigned by TIGR |
| 453 | hypothetical protein | 1804 | putative protein |
| 454 | putative serine protease-like protein | 1805 | putative protein |
| 455 | No function assigned by TIGR | 1806 | unknown protein |
| 456 | unknown protein | 1807 | glycine-rich RNA binding protein 7 |
| 457 | unknown protein | 1808 | dehydrin, putative |
| 458 | gamma-adaptin, putative | 1809 | putative endoxyloglucan glycosyltransferase |
| 459 | UDP rhamnose--anmocyanidin-3-glucoside rhamnosyltransferase-like protein | 1810 | glutamate decarboxylase 1 (GAD 1) (sp\|Q42521) |
| 460 | carbonate dehydratase-like protein | 1811 | delta 9 desaturase |
| 461 | putative microtubule-associated protein | 1812 | UDP-glucose glucosyltransferase |
| 462 | putative ribophorin I | 1813 | CARBONIC ANHYDRASE 2 |
| 463 | putative zinc finger protein | 1814 | response reactor 2 (ATRR2) |
| 464 | chloroplast FtsH protease, putative | 1815 | S-adenosyl-methionine-sterol-C-methyltransferase, putative |
| 465 | putative protein | 1816 | putative DNA-binding protein (RAV2-like) |
| 466 | unknown protein | 1817 | gamma glutamyl hydrolase, putative |
| 467 | putative LEA protein | 1818 | protein phosphatase-like |
| 468 | putative protein | 1819 | unknown protein |
| 469 | putative protein | 1820 | unknown protein |
| 470 | unknown protein | 1821 | unknown protein |

TABLE 1-continued

SEQUENCE DESCRIPTIONS

| Seq ID | Description | Seq ID | Description |
|---|---|---|---|
| 471 | putative purple acid phosphatase | 1822 | copper transport protein-like protein |
| 472 | unknown protein | 1823 | hypothetical protein |
| 473 | putative protein | 1824 | unknown protein |
| 474 | unknown protein | 1825 | putative peptide methionine sulfoxide reductase |
| 475 | chlorophyll binding protein, putative | 1826 | putative obtusifoliol 14-alpha demethylase |
| 476 | phosphoenolpyruvate carboxylase (PPC) | 1827 | glutamate dehydrogenase (EC 1.4.1.-) 1 (pir\|S71217) |
| 477 | chlorophyll a/b-binding protein-like | 1828 | unknown protein |
| 478 | AtAGP4 | 1829 | xyloglucan endo-1,4-beta-D-glucanase precursor |
| 479 | putative cryptochrome 2 apoprotein | 1830 | unknown protein |
| 480 | type 2 peroxiredoxin, putative | 1831 | SNF1 related protein kinase (ATSRPK1) |
| 481 | Atpm24.1 glutathione S transferase | 1832 | putative protein |
| 482 | delta tonoplast integral protein (delta-TIP) | 1833 | putative chloroplast nucleoid DNA binding protein |
| 483 | 20S proteasome subunit (PAA2) | 1834 | hypothetical protein |
| 484 | dormancy-associated protein, putative | 1835 | putative protein |
| 485 | putative cytidine deaminase | 1836 | putative thiamin biosynthesis protein |
| 486 | No function assigned by TIGR | 1837 | unknown protein |
| 487 | putative phospholipase D-gamma | 1838 | unknown protein |
| 488 | cell elongation protein, Dwarf1 | 1839 | putative RNA helicase |
| 489 | germin-like protein | 1840 | putative SF21 protein {Helianthus annuus} |
| 490 | hevein-like protein precursor (PR-4) | 1841 | unknown protein |
| 491 | rac-like GTP binding protein (ARAC5) | 1842 | NBS/LRR disease resistance protein, putative |
| 492 | phosphoprotein phosphatase, type 1 catalytic subunit | 1843 | hypothetical protein |
| 493 | ubiquitin-protein ligase UBC9 | 1844 | unknown protein |
| 494 | xyloglucan endotransglycosylase-related protein XTR-7 | 1845 | No function assigned by TIGR |
| 495 | cysteine synthase | 1846 | glycine-rich protein (AtGRP2) |
| 496 | putative villin 2 | 1847 | No function assigned by TIGR |
| 497 | glutathione S-transferase | 1848 | putative protein |
| 498 | 5-adenylylsulfate reductase | 1849 | putative glucosyltransferase |
| 499 | arginine decarboxylase | 1850 | hypothetical protein |
| 500 | ATHP2, putative | 1851 | hypothetical protein |
| 501 | ornithine carbamoyltransferase precursor | 1852 | putative protein |
| 502 | puative protein | 1853 | putative disease resistance protein |
| 503 | putative protein | 1854 | thaumatin, putative |
| 504 | unknown protein | 1855 | putative proline-rich protein |
| 505 | putative protein | 1856 | sterol-C-methyltransferase |
| 506 | putative protein | 1857 | superoxidase dismutase |
| 507 | unknown protein | 1858 | TINY-like protein |
| 508 | unknown protein | 1859 | calcium-dependent protein kinase, putative |
| 509 | unknown protein | 1860 | hypothetical protein |
| 510 | unknown protein | 1861 | putative protein kinase |
| 511 | hypothetical protein | 1862 | DNA-directed RNA polymerase (mitochondrial) |
| 512 | putative protein | 1863 | putaive DNA-binding protein |
| 513 | putative DnaJ protein | 1864 | late embryogenesis abundant M17 protein |
| 514 | plastocyanin | 1865 | putative protein |
| 515 | unknown protein | 1866 | delta-1-pyrroline-5-carboxylate synthetase |
| 516 | unknown protein | 1867 | putative 60s ribosomal protein L10 |
| 517 | unknown protein | 1868 | cytochrome P450 CYP86A1 |
| 518 | unknown protein | 1869 | putative tyrosine aminotransferase |

TABLE 1-continued

SEQUENCE DESCRIPTIONS

| Seq ID | Description | Seq ID | Description |
|---|---|---|---|
| 519 | unknown protein | 1870 | thionin |
| 520 | unknown protein | 1871 | No function assigned by TIGR |
| 521 | putative ATP-dependent RNA helicase | 1872 | APETALA2 protein |
| 522 | non-race specific disease resistance protein (NDR1) | 1873 | MADS-box protein (AGL3) |
| 523 | hypothetical protein | 1874 | putative monooxygenase |
| 524 | putative protein | 1875 | ZFP3 zinc finger protein |
| 525 | putative protein | 1876 | cell division protein FtsZ chloroplast homolog precursor (sp|Q42545) |
| 526 | putative protein | 1877 | calreticulin, putative |
| 527 | copper transport protein | 1878 | phosphoserine aminotransferase |
| 528 | putative protein | 1879 | 12-oxophytodienoate-10,11-reductase |
| 529 | unknown protein | 1880 | putative bHLH transcription factor |
| 530 | unknown protein | 1881 | pectin methylesterase (PMEU1), putative |
| 531 | unknown protein | 1882 | DNA-binding protein |
| 532 | putative protein kinase | 1883 | carnitine racemase like protein |
| 533 | unknown protein | 1884 | putative protein |
| 534 | putative protein | 1885 | endoxyloglucan transferase (dbj|BAA81669.1) |
| 535 | putative protein | 1886 | RMA1 RING zinc finger protein |
| 536 | hypothetical protein | 1887 | ammonium transporter |
| 537 | putative protein | 1888 | apyrase (gb|AAF00612.1) |
| 538 | putative AP2 domain transcription factor | 1889 | potassium uptake transporter-like protein |
| 539 | putative nitrilase | 1890 | putative ABC transporter |
| 540 | putative protein | 1891 | potassium transporter-like protein |
| 541 | putative tetrahydrofolate synthase | 1892 | integral membrane protein, putative |
| 542 | heat-shock protein | 1893 | putative protein |
| 543 | unknown protein | 1894 | pyruvate decarboxylase-1 (Pdc1) |
| 544 | unknown protein | 1895 | putative malate oxidoreductase |
| 545 | histone H4 | 1896 | putative histone H2B |
| 546 | hypothetical protein | 1897 | snoRNA |
| 547 | unknown protein | 1898 | symbiosis-related like protein |
| 548 | putative protein | 1899 | unknown protein |
| 549 | predicted protein | 1900 | unknown protein |
| 550 | putative dihydrolipoamide succinyltransferase | 1901 | hypothetical protein |
| 551 | actin 3 | 1902 | putative protein |
| 552 | putative CCCH-type zinc finger protein | 1903 | copper-binding protein-like |
| 553 | MAP kinase kinase 2 | 1904 | putative protein |
| 554 | ethylene-insensitive3-like1 (EIL1) | 1905 | unknown protein |
| 555 | histidine transport protein (PTR2-B) | 1906 | putative glyoxalase II |
| 556 | putative auxin-induced protein AUX2-11 | 1907 | No function assigned by TIGR |
| 557 | hydroxyacylglutathione hydrolase cytoplasmic (glyoxalase II) (GLX II) | 1908 | hypothetical protein |
| 558 | delta-8 sphingolipid desaturase | 1909 | flavanone 3-hydroxylase (FH3) |
| 559 | cellulose synthase catalytic subunit (Ath-A) | 1910 | putative laccase |
| 560 | nitrate transporter (NTL1) | 1911 | putative protein kinase |
| 561 | DNA-binding homeotic protein Athb-2 | 1912 | myb-related protein, 33.3K (pir|S71284) |
| 562 | hypothetical protein | 1913 | unknown protein |
| 563 | aspartate aminotransferase | 1914 | endo-xyloglucan transferase-like protein |
| 564 | 4-coumarate:CoA ligase 1 | 1915 | TMV resistance protein N-like |
| 565 | pyruvate dehydrogenase E1 beta subunit, putative | 1916 | putative xyloglucan endotransglycosylase |
| 566 | nucleotide diphosphate kinase Ia (emb|CAB58230.1) | 1917 | unknown protein |
| 567 | chloroplast Cpn21 protein | 1918 | proline transporter 2 |
| 568 | ATP dependent copper transporter | 1919 | resistance protein, putative |
| 569 | very-long-chain fatty acid condensing enzyme (CUT1) | 1920 | actin, putative |

TABLE 1-continued

SEQUENCE DESCRIPTIONS

| Seq ID | Description | Seq ID | Description |
|---|---|---|---|
| 570 | putative purine-rich single-stranded DNA-binding protein | 1921 | putative related to microbial divalent cation tolerance proteins |
| 571 | serine/threonine protein phosphatase (type 2A) | 1922 | unknown protein |
| 572 | isopentenyl diphosphate:dimethylallyl diphosphate isomerase (IPP2) | 1923 | putative glycosyl transferase |
| 573 | putative c2h2 zinc finger transcription factor | 1924 | unknown protein |
| 574 | putative 20S proteasome beta subunit PBC2 | 1925 | putative protein phosphatase 2C |
| 575 | nucleoside diphosphate kinase 3 (ndpk3) | 1926 | unknown protein |
| 576 | ras-related small GTP-binding protein | 1927 | serpin, putative |
| 577 | putative 4-coumarate:CoA ligase 2 | 1928 | cinnamyl-alcohol dehydrogenase CAD1 |
| 578 | transcription factor HBP-1b homolog (sp|P43273) | 1929 | putative protein import receptor |
| 579 | biotin synthase (Bio B) | 1930 | unknown protein |
| 580 | homeobox protein HAT22 | 1931 | unknown protein |
| 581 | putative preprotein translocase SECY protein | 1932 | putative protein |
| 582 | carbamoylphosphate synthetase, putative | 1933 | putative CDP-diacylglycerol--glycerol-3-phosphate 3-phosphatidyltransferase |
| 583 | putative protein kinase, ADK1 | 1934 | unknown protein |
| 584 | putative nuclear DNA-binding protein G2p | 1935 | putative LRR receptor-like protein kinase |
| 585 | hypothetical protein | 1936 | serine/threonine protein kinase, putative |
| 586 | hypothetical protein | 1937 | potassium transporter-like protein |
| 587 | unknown protein | 1938 | lactate dehydrogenase (LDH1) |
| 588 | unknown protein | 1939 | hypothetical protein |
| 589 | molybdopterin synthase (CNX2) | 1940 | unknown protein |
| 590 | putative ribosomal protein L6 | 1941 | putative thaumatin |
| 591 | unknown protein | 1942 | putative reticuline oxidase-like protein |
| 592 | En/Spm-like transposon protein | 1943 | uracil phosphoribosyltransferase, putative |
| 593 | putative protein | 1944 | transcription factor, putative |
| 594 | putative protein | 1945 | unknown protein |
| 595 | unknown protein | 1946 | unknown protein |
| 596 | hypothetical protein | 1947 | GATA transcription factor 4 |
| 597 | unknown protein | 1948 | unknown protein |
| 598 | unknown protein | 1949 | unknown protein |
| 599 | putative lysosomal acid lipase | 1950 | senescence-associated protein-like |
| 600 | unknown protein | 1951 | putative pollen allergen |
| 601 | unknown protein | 1952 | unknown protein |
| 602 | NifS-like aminotranfserase | 1953 | putative protein |
| 603 | actin 8 | 1954 | glycine-rich protein |
| 604 | hypothetical protein | 1955 | putative protein |
| 605 | putative protein | 1956 | 3-methyladenine DNA glycosylase, putative |
| 606 | heat-shock protein (At-hsc70-3) | 1957 | endoplasmic reticulum-type calcium-transporting ATPase 4 |
| 607 | putative protein disulfide isomerase precursor | 1958 | putative pectinesterase |
| 608 | adenosine nucleotide translocator | 1959 | cytochrome P450-like protein |
| 609 | photosystem II oxygen-evolving complex protein 3-like | 1960 | RNA-binding protein (cp33) |
| 610 | sedoheptulose-bisphosphatase precursor | 1961 | CONSTANS-like 1 |
| 611 | glutathione S-transferase (GST6) | 1962 | putative small heat shock protein |
| 612 | geranylgeranyl reductase | 1963 | hypothetical protein |
| 613 | hypothetical protein | 1964 | unknown protein |
| 614 | hypothetical protein | 1965 | cytochrome P450-like protein |

TABLE 1-continued

SEQUENCE DESCRIPTIONS

| Seq ID | Description | Seq ID | Description |
|---|---|---|---|
| 615 | phosphoribulokinase precursor | 1966 | cysteine proteinase inhibitor like protein |
| 616 | high mobility group protein (HMG1), putative | 1967 | nicotianamine synthase (dbj|BAA74589.1) |
| 617 | protease inhibitor II | 1968 | copper amine oxidase like protein (fragment2) |
| 618 | protease inhibitor II | 1969 | putative SCARECROW gene regulator |
| 619 | cytochrome P450 90A1 (sp|Q42569) | 1970 | unknown protein |
| 620 | unknown protein | 1971 | unknown protein |
| 621 | heat shock protein 90 | 1972 | putative alanine acetyl transferase |
| 622 | tubulin beta-9 chain | 1973 | unknown protein |
| 623 | putative ubiquitin carboxyl terminal hydrolase | 1974 | unknown protein |
| 624 | protein kinase | 1975 | unknown protein |
| 625 | DRE/CRT-binding protein DREB1C | 1976 | putative extensin |
| 626 | histidyl-tRNA synthetase | 1977 | putative protein kinase |
| 627 | splicing factor, putative | 1978 | putative protein kinase |
| 628 | glutamyl-tRNA synthetase | 1979 | NADPH-dependent codeinone reductase, putative |
| 629 | putative RING zinc finger protein | 1980 | peroxidase |
| 630 | phytochelatin synthase (gb|AAD41794.1) | 1981 | putative cytochrome P450 |
| 631 | putative C2H2-type zinc finger protein | 1982 | No function assigned by TIGR |
| 632 | putative ligand-gated ion channel protein | 1983 | putative zinc-finger protein (B-box zinc finger domain) |
| 633 | putative ribosomal-protein S6 kinase (ATPK6) | 1984 | putative tyrosine aminotransferase |
| 634 | MOLYBDOPTERIN BIOSYNTHESIS CNX1 PROTEIN | 1985 | hypothetical protein |
| 635 | temperature-sensitive omega-3 fatty acid desaturase, chloroplast precursor (sp|P48622) | 1986 | DNA binding protein |
| 636 | adenylosuccinate synthetase | 1987 | putative fatty acid elongase |
| 637 | putative 14-3-3 protein | 1988 | bZIP transcription factor-like protein |
| 638 | putative cytochrome P450 | 1989 | xyloglucan fucosyltransferase, putative |
| 639 | putative two-component response regulator 3 protein | 1990 | unknown protein |
| 640 | putative RING-H2 zinc finger protein ATL6 | 1991 | unknown protein |
| 641 | No function assigned by TIGR | 1992 | putative protein |
| 642 | small zinc finger-like protein | 1993 | myb factor, putative |
| 643 | hypothetical protein | 1994 | Myb-family transcription factor, putative |
| 644 | MAP kinase (ATMPK6) | 1995 | putative fructose bisphosphate aldolase |
| 645 | vacuolar ATP synthase, putative | 1996 | myrosinase-associated protein, putative |
| 646 | kinesin-like protein | 1997 | cytochrome P450 like protein |
| 647 | serine/threonine-specific protein kinase NAK | 1998 | similar to SOR1 from the fungus Cercospora nicotianae |
| 648 | No function assigned by TIGR | 1999 | similar to embryo-abundant protein GB:L47672 GI:1350530 [Picea glauca] |
| 649 | ACTIN 2/7 (sp|P53492) | 2000 | alcohol dehydrogenase |
| 650 | phosphoglycerate kinase, putative | 2001 | auxin response factor 1 |
| 651 | homeotic protein BEL1 homolog | 2002 | pathogenesis-related protein 1 precursor, 18.9K |
| 652 | proline iminopeptidase | 2003 | hypothetical protein |
| 653 | pasticcino 1 | 2004 | unknown protein |

TABLE 1-continued

SEQUENCE DESCRIPTIONS

| Seq ID | Description | Seq ID | Description |
|---|---|---|---|
| 654 | serine/threonine protein kinase | 2005 | zinc finger protein Zat12 |
| 655 | cytochrome P450 monooxygenase (CYP71B4) | 2006 | unknown protein |
| 656 | No function assigned by TIGR | 2007 | unknown protein |
| 657 | putative GDSL-motif lipase/hydrolase | 2008 | cyclin, putative |
| 658 | putative protein | 2009 | 2-dehydro-3-deoxyphosphoheptonate aldolase |
| 659 | unknown protein | 2010 | glutathione synthetase gsh2 |
| 660 | hypothetical protein | 2011 | heat shock protein 17 |
| 661 | putative glycosylation enzyme | 2012 | putative Na+-dependent inorganic phosphate cotransporter |
| 662 | No function assigned by TIGR | 2013 | No function assigned by TIGR |
| 663 | No function assigned by TIGR | 2014 | unknown protein |
| 664 | unknown protein | 2015 | putative protein |
| 665 | putative ABC transporter | 2016 | similar to RING-H2 finger protein RHC1a GB:AAC69854 GI:3790583 from [*Arabidopsis thaliana*] |
| 666 | nifU-like protein | 2017 | calcium-binding protein-like |
| 667 | putative receptor-like protein kinase | 2018 | putative protein |
| 668 | putative disease resistance protein | 2019 | putative aldehyde dehydrogenase |
| 669 | receptor-like protein kinase-like | 2020 | auxin-responsive GH3-like protein |
| 670 | ubiquitin activating enzyme 2 (gb|AAB37569.1) | 2021 | putative protein |
| 671 | No function assigned by TIGR | 2022 | Phosphoglycerate dehydrogenase-like protein |
| 672 | putative receptor-like protein kinase | 2023 | unknown protein |
| 673 | K+ transporter, AKT1 | 2024 | unknown protein |
| 674 | shaggy-like kinase beta | 2025 | PSI type III chlorophyll a/b-binding protein, putative |
| 675 | heat shock protein 70 | 2026 | putative protein |
| 676 | plasma membrane intrinsic protein 1a | 2027 | putative protein |
| 677 | HSP90-like protein | 2028 | glutaredoxin, putative |
| 678 | histone H1, putative | 2029 | hypothetical protein |
| 679 | unknown protein | 2030 | No function assigned by TIGR |
| 680 | dnaK-type molecular chaperone hsc70.1-like | 2031 | putative protein |
| 681 | gamma-glutamylcysteine synthetase | 2032 | jasmonate inducible protein, putative |
| 682 | peroxidase (ATP22a) | 2033 | putative polygalacuronase isoenzyme 1 beta subunit |
| 683 | putative serine carboxypeptidase precursor | 2034 | putative small heat shock protein |
| 684 | putative dioxygenase | 2035 | unknown protein |
| 685 | glucose transporter | 2036 | putative disease resistance protein |
| 686 | NOI protein, nitrate-induced | 2037 | putative protein |
| 687 | putative protein | 2038 | ethylene-responsive element binding factor, putative |
| 688 | putative protein | 2039 | putative protein |
| 689 | unknown protein | 2040 | Pollen-specific protein precursor like |
| 690 | putative photosystem I reaction center subunit II precursor | 2041 | putative protein |
| 691 | putative protein | 2042 | unknown protein |
| 692 | unknown protein | 2043 | EF-Hand containing protein-like |
| 693 | cobalamin biosynthesis protein | 2044 | unknown protein |
| 694 | adenine nucleotide translocase | 2045 | puative calcium-transporting ATPase |
| 695 | glutathione transferase, putative | 2046 | antifungal protein-like (PDF1.2) |

TABLE 1-continued

SEQUENCE DESCRIPTIONS

| Seq ID | Description | Seq ID | Description |
|---|---|---|---|
| 696 | putative 60S ribosomal protein L21 | 2047 | pathogenesis-related PR-1-like protein |
| 697 | cytochrome P450 like protein | 2048 | similar to Mlo proteins from *H. vulgare* |
| 698 | cytochrome b245 beta chain homolog RbohAp108, putative | 2049 | putative steroid sulfotransferase |
| 699 | RNA helicase, DRH1 | 2050 | trehalase-like protein |
| 700 | putative aldolase | 2051 | thioredoxin f1 |
| 701 | farnesyltransferase subunit A (FTA) | 2052 | unknown protein |
| 702 | No function assigned by TIGR | 2053 | alanine-glyoxylate aminotransferase |
| 703 | putative putative sister-chromatide cohesion protein | 2054 | integral membrane protein, putative |
| 704 | calcium-dependent protein kinase | 2055 | hypothetical protein |
| 705 | serine/threonine protein phosphatase type 2A, putative | 2056 | unknown protein |
| 706 | 40S ribosomal protein S28 (sp|P34789) | 2057 | hypothetical protein |
| 707 | RNA polymerase subunit | 2058 | unknown protein |
| 708 | DNA-damage-repair/toleration protein DRT102 | 2059 | unknown protein |
| 709 | putative C2H2-type zinc finger protein | 2060 | unknown protein |
| 710 | putative adenosine phosphosulfate kinase | 2061 | drought-induced-19-like 1 |
| 711 | lipase | 2062 | unknown protein |
| 712 | putative violaxanthin de-epoxidase precursor (U44133) | 2063 | putative protein |
| 713 | aromatic rich glycoprotein, putative | 2064 | putative protein |
| 714 | putative fumarase | 2065 | AIG2-like protein |
| 715 | flavonol synthase (FLS) (sp|Q96330) | 2066 | Lhca2 protein |
| 716 | response regulator 5, putative | 2067 | phytocyanin |
| 717 | sulfate transporter | 2068 | putative chlorophyll A-B binding protein |
| 718 | putative floral homeotic protein, AGL9 | 2069 | Lhcb3 chlorophyll a/b binding protein (gb|AAD28773.1) |
| 719 | putative ethylene-inducible protein | 2070 | luminal binding protein (dbj|BAA13948.1) |
| 720 | C-8,7 sterol isomerase | 2071 | hydroxypyruvate reductase (HPR) |
| 721 | TCH4 protein (gb|AAA92363.1) | 2072 | epoxide hydrolase (ATsEH) |
| 722 | hypothetical protein | 2073 | putative protein (fragment) |
| 723 | putative urease accessory protein | 2074 | unknown protein |
| 724 | molybdopterin synthase sulphurylase (gb|AAD18050.1) | 2075 | hypothetical protein |
| 725 | putative protein | 2076 | putative glucosyl transferase |
| 726 | NBD-like protein (gb|AAD20643.1) | 2077 | putative glucosyl transferase |
| 727 | AtHVA22c | 2078 | putative 3-methylcrotonyl-CoA carboxylase |
| 728 | unknown protein | 2079 | putative peroxidase |
| 729 | phytoene synthase (gb|AAB65697.1) | 2080 | acyl-CoA oxidase (gb|AAC13497.1) |
| 730 | protein kinase (AME2/AFC1) | 2081 | alternative oxidase 1a precursor |
| 731 | hypothetical protein | 2082 | putative transcription factor (MYB4) |
| 732 | cyclin-dependent protein kinase-like protein | 2083 | serine acetyltransferase |
| 733 | photosystem II stability/assembly factor HCF136 (sp|O82660) | 2084 | ATP-sulfurylase |
| 734 | hypothetical protein | 2085 | calreticulin (crt1) |
| 735 | DNA binding-like protein | 2086 | putative prohibitin 2 |

TABLE 1-continued

SEQUENCE DESCRIPTIONS

| Seq ID | Description | Seq ID | Description |
|---|---|---|---|
| 736 | putative protein | 2087 | putative monodehydroascorbate reductase |
| 737 | chorismate mutase | 2088 | branched-chain alpha-keto acid decarboxylase E1 beta subunit |
| 738 | putative LRR receptor protein kinase | 2089 | cytokinin oxidase-like protein |
| 739 | putative chalcone synthase | 2090 | putative receptor-like protein kinase |
| 740 | putative protein kinase | 2091 | unknown protein |
| 741 | replicase, putative | 2092 | hypothetical protein |
| 742 | putative cysteine proteinase | 2093 | No function assigned by TIGR |
| 743 | 60S ribosomal protein L36 | 2094 | putative APG protein |
| 744 | unknown protein | 2095 | glutathione S-transferase, putative |
| 745 | CLC-b chloride channel protein | 2096 | phytochrome-associated protein 1 (PAP1) |
| 746 | putative ribosomal protein S14 | 2097 | amidophosphoribosyltransferase |
| 747 | histone H2B like protein (emb|CAA69025.1) | 2098 | nonphototropic hypocotyl 1 |
| 748 | 60S ribosomal protein L2 | 2099 | 3-keto-acyl-CoA thiolase 2 (gb|AAC17877.1) |
| 749 | 60S ribosomal protein L15 homolog | 2100 | pEARLI 1 |
| 750 | ribosomal protein S27 | 2101 | glutathione reductase, cytosolic |
| 751 | ribosomal protein | 2102 | putative protein |
| 752 | 60S ribosomal protein L12 | 2103 | putative protein |
| 753 | 60s ribosomal protein L34 | 2104 | putative aldehyde oxidase |
| 754 | putative ribosomal protein S10 | 2105 | probable photosystem I chain XI precursor |
| 755 | drought-induced protein like | 2106 | photosystem II polypeptide, putative |
| 756 | blue copper-binding protein, 15K (lamin) | 2107 | photosystem II reaction center 6.1 KD protein |
| 757 | calmodulin-like protein | 2108 | 33 kDa polypeptide of oxygen-evolving complex (OEC) in photosystem II (emb|CAA75629.1) |
| 758 | putative protein | 2109 | 60S ribosomal protein L11B |
| 759 | No function assigned by TIGR | 2110 | extA (emb|CAA47807.1) |
| 760 | alpha-mannosidase, putative | 2111 | zinc finger protein OBP4-like |
| 761 | uncoupling protein (ucp/PUMP) | 2112 | sterol delta7 reductase |
| 762 | homeodomain-like protein | 2113 | putative RAS-related protein, RAB11C |
| 763 | ribosomal protein S18, putative | 2114 | glucosyltransferase like protein |
| 764 | similar to SOR1 from the fungus Cercospora nicotianae | 2115 | zinc finger protein (PMZ), putative |
| 765 | 60S ribosomal protein L13, BBC1 protein | 2116 | 6,7-dimethyl-8-ribityllumazine synthase precursor |
| 766 | 50S ribosomal protein L24, chloroplast precursor | 2117 | putative protein |
| 767 | putative ribosomal protein | 2118 | osmotin precursor |
| 768 | unknown protein | 2119 | No function assigned by TIGR |
| 769 | aspartate aminotransferase (AAT1) | 2120 | ferredoxin precursor isolog |
| 770 | potassium channel protein AtKC | 2121 | GH3 like protein |
| 771 | unknown protein | 2122 | non-specific lipid transfer protein |
| 772 | peroxisomal targeting signal type 2 receptor | 2123 | homeodomain transcription factor (HAT9) |
| 773 | putative protein | 2124 | putative cytochrome P450 monooxygenase |
| 774 | Ras-related GTP-binding protein (ARA-4) | 2125 | putative protein kinase |
| 775 | S-receptor kinase homolog 2 precursor | 2126 | putative protein |
| 776 | pathogenesis-related group 5 protein, putative | 2127 | glyceraldehyde-3-phosphate dehydrogenase |

TABLE 1-continued

SEQUENCE DESCRIPTIONS

| Seq ID | Description | Seq ID | Description |
| --- | --- | --- | --- |
| 777 | Nitrilase 4 (sp|P46011) | 2128 | putative protein disulfide-isomerase |
| 778 | biotin carboxyl carrier protein of acetyl-CoA carboxylase precursor (BCCP) (sp|Q42533) | 2129 | unknown protein |
| 779 | photosystem I reaction centre subunit psaN precursor (PSI-N) (sp|P49107) | 2130 | beta-1,3-glucanase class I precursor |
| 780 | 3(2),5-bisphosphate nucleotidase | 2131 | homeobox-leucine zipper protein HAT5 (HD-ZIP protein 5) (HD-ZIP protein ATHB-1) |
| 781 | high affinity Ca2+ antiporter | 2132 | putative cyclic nucleotide-regulated ion channel protein |
| 782 | putative cytoskeletal protein | 2133 | P II nitrogen sensing protein GLB I |
| 783 | putative peroxidase | 2134 | H-protein promoter binding factor-1 (gb|AAC24592.1) |
| 784 | respiratory burst oxidase protein | 2135 | GAST1-like protein |
| 785 | beta-glucosidase | 2136 | cytochrome P450 GA3 |
| 786 | calcium-dependent protein kinase (pir|S71196) | 2137 | putative protein |
| 787 | phosphoinositide specific phospholipase C | 2138 | Myb-related transcription factor-like protein |
| 788 | similarity to S-domain receptor-like protein kinase, Zea mays | 2139 | putative phloem-specific lectin |
| 789 | mitosis-specific cyclin 1b | 2140 | protein kinase-like protein |
| 790 | 4-coumarate:CoA ligase 3 | 2141 | unknown protein |
| 791 | transcription factor IIB (TFIIB) | 2142 | SCARECROW transcriptional regulator-like |
| 792 | unknown protein | 2143 | unknown protein |
| 793 | hypothetical protein | 2144 | unknown protein |
| 794 | hypothetical protein | 2145 | putative protein |
| 795 | sugar transporter like protein | 2146 | calnexin homolog |
| 796 | putative trypsin inhibitor | 2147 | PP1/PP2A phosphatases pleiotropic regulator PRL2 |
| 797 | unknown protein | 2148 | xyloglucan endotransglycosylase, putative |
| 798 | putative multispanning membrane protein | 2149 | putative calmodulin |
| 799 | receptor-like kinase, putative | 2150 | spermine synthase (ACL5) |
| 800 | putative inosine-5-monophosphate dehydrogenase | 2151 | snoRNA |
| 801 | inosine-5'-monophosphate dehydrogenase, putative | 2152 | photosystem I subunit V precursor, putative |
| 802 | amino acid permease 6 (emb|CAA65051.1) | 2153 | putative potassium transporter |
| 803 | NADPH-ferrihemoprotein reductase (ATR2) | 2154 | Homeodomain-like protein |
| 804 | putative WRKY-type DNA binding protein | 2155 | putative protein |
| 805 | putative ankyrin | 2156 | unknown protein |
| 806 | putative hexose transporter | 2157 | CALMODULIN-RELATED PROTEIN 2, TOUCH-INDUCED (TCH2) |
| 807 | aquaporin/MIP-like protein | 2158 | putative protein phosphatase 2C |
| 808 | Ser/Thr protein kinase isolog | 2159 | monosaccharide transport protein, STP4 |
| 809 | pectate lyase like protein | 2160 | hypothetical protein |
| 810 | putative 60S ribosomal protein L17 | 2161 | unknown protein |
| 811 | putative protein | 2162 | hypothetical protein |
| 812 | unknown protein | 2163 | putative protein kinase |
| 813 | phenylalanine ammonia-lyase | 2164 | putative serine/threonine protein kinase |
| 814 | putative cytochrome P450 monooxygenase | 2165 | jasmonate inducible protein, putative |
| 815 | ARR1 protein, putative | 2166 | similar to several small proteins (~100 aa) that are induced by heat, auxin, ethylene and wounding such as Phaseolus aureus indole-3-acetic acid |

TABLE 1-continued

SEQUENCE DESCRIPTIONS

| Seq ID | Description | Seq ID | Description |
|---|---|---|---|
| | | | induced protein ARG (SW: 32292) |
| 816 | putative bHLH transcription factor | 2167 | unknown protein |
| 817 | aminomethyltransferase-like precursor protein | 2168 | MYB-like protein |
| 818 | purple acid phosphatase precursor | 2169 | putative protein kinase |
| 819 | AP2 domain containing protein, putative | 2170 | unknown protein |
| 820 | ubiquitin-conjugating enzyme E2-21 kD 1 (ubiquitin-protein ligase 4) (ubiquitin carrier protein 4) (sp|P42748) | 2171 | CLC-d chloride channel protein |
| 821 | translation initiation factor | 2172 | cytochrome P450-like protein |
| 822 | putative VAMP-associated protein | 2173 | putative glutathione S-transferase |
| 823 | spermidine synthase, putative | 2174 | putative mandelonitrile lyase |
| 824 | putative protein | 2175 | hypothetical protein |
| 825 | unknown protein | 2176 | putative trypsin inhibitor |
| 826 | AtKAP alpha | 2177 | male sterility 2-like protein (emb|CAA68191.1) |
| 827 | glyceraldehyde-3-phosphate dehydrogenase, putative | 2178 | unknown protein |
| 828 | putative poly(A) binding protein | 2179 | unknown protein |
| 829 | alpha-tubulin, putative | 2180 | putative protein |
| 830 | serine/threonine-specific protein kinase ATPK64 (pir|S20918) | 2181 | putative peroxidase |
| 831 | putative aspartate-tRNA ligase | 2182 | putative thromboxane-A synthase |
| 832 | ras-related small GTP-binding protein RAB1c | 2183 | putative cytochrome P450 |
| 833 | cycloartenol synthase | 2184 | peroxidase ATP21a |
| 834 | No function assigned by TIGR | 2185 | unknown protein |
| 835 | cytochrome P450 | 2186 | putative glutathione S-transferase |
| 836 | GTPase AtRAB8 | 2187 | defender against cell death protein |
| 837 | 3-phosphoserine phosphatase | 2188 | AP2 domain containing protein, putative |
| 838 | transcription factor CRC | 2189 | actin depolymerizing factor-like protein |
| 839 | nuclear cap-binding protein; CBP20 (gb|AAD29697.1) | 2190 | putative calcium-dependent protein kinase (U90439) |
| 840 | chloroplast membrane protein (ALBINO3) | 2191 | phosphoribosylanthranilate transferase, putative |
| 841 | biotin holocarboxylase synthetase | 2192 | oligopeptide transporter, putative |
| 842 | expansin AtEx6 | 2193 | calmodulin-like protein |
| 843 | unknown protein | 2194 | putative protease inhibitor |
| 844 | mercaptopyruvate sulfurtransferase, putative | 2195 | MAP kinase |
| 845 | putative thiosulfate sulfurtransferase | 2196 | DNA binding protein MybSt1, putative |
| 846 | dihydrolipoamide S-acetyltransferase | 2197 | putative protein |
| 847 | auxin transport protein REH1, putative | 2198 | putative protein |
| 848 | putative auxin transport protein | 2199 | unknown protein |
| 849 | apyrase (Atapy1) | 2200 | unknown protein |
| 850 | root cap 1 (RCP1) | 2201 | unknown protein |
| 851 | hypothetical protein | 2202 | putative protein |
| 852 | putative protein | 2203 | unknown protein |
| 853 | predicted protein of unknown function | 2204 | unknown protein |
| 854 | hypothetical protein | 2205 | hypothetical protein |
| 855 | hypothetical protein | 2206 | uncharacterized protein |
| 856 | hypothetical protein | 2207 | putative protein |
| 857 | putative aldehyde dehydrogenase | 2208 | hypothetical protein |

TABLE 1-continued

SEQUENCE DESCRIPTIONS

| Seq ID | Description | Seq ID | Description |
|---|---|---|---|
| 858 | putative peroxidase | 2209 | peroxidase (emb|CAA66967.1) |
| 859 | UDP-glucose 4-epimerase-like protein | 2210 | putative flavonol 3-O-glucosyltransferase |
| 860 | indole-3-acetate beta-glucosyltransferase like protein | 2211 | putative flavonol 3-O-glucosyltransferase |
| 861 | putative beta-1,3-glucanase | 2212 | putative protein |
| 862 | disease resistance protein-like | 2213 | glycerol-3-phosphate acyltransferase |
| 863 | putative respiratory burst oxidase protein B | 2214 | putative beta-1,3-glucanase |
| 864 | ubiquitin-conjugating enzyme UBC3 | 2215 | putative ethylene response element binding protein (EREBP) |
| 865 | cytoplasmic aconitate hydratase | 2216 | putative CONSTANS-like B-box zinc finger protein |
| 866 | NADPH oxidoreductase, putative | 2217 | putative protein |
| 867 | PROTEIN TRANSPORT PROTEIN SEC61 GAMMA SUBUNIT-like | 2218 | unknown protein |
| 868 | putative protein | 2219 | putative trehalose-6-phosphate phosphatase (AtTPPA) |
| 869 | unknown protein | 2220 | putative protein |
| 870 | 60S acidic ribosomal protein P2 | 2221 | putative protein |
| 871 | No function assigned by TIGR | 2222 | unknown protein |
| 872 | 1,4-alpha-glucan branching enzyme protein soform SBE2.2 precursor | 2223 | unknown prptein |
| 873 | calcium binding protein (CaBP-22) | 2224 | unknown protein |
| 874 | putative phosphoglucomutase | 2225 | hypothetical protein |
| 875 | shaggy-like protein kinase etha (EC 2.7.1.-) | 2226 | putative metal-binding protein |
| 876 | pyruvate decarboxylase (gb|AAB16855.1) | 2227 | putative phosphoribosylglycinamide synthetase |
| 877 | hypothetical protein | 2228 | unknown protein |
| 878 | putative protein kinase | 2229 | putative protein |
| 879 | putative protein kinase | 2230 | unknown protein |
| 880 | putative leucine aminopeptidase | 2231 | unknown protein |
| 881 | probable cytochrome P450 | 2232 | putative beta-galactosidase |
| 882 | protein kinase 6-like protein | 2233 | putative protein kinase |
| 883 | arginine methyltransferase (pam1) | 2234 | putative protein |
| 884 | MYB96 transcription factor-like protein | 2235 | putative protein phosphatase 2C |
| 885 | putative protein | 2236 | putative growth regulator protein |
| 886 | metal ion transporter | 2237 | putative ABC transporter |
| 887 | No function assigned by TIGR | 2238 | chloride channel (emb|CAA70310.1) |
| 888 | flax rust resistance protein, putative | 2239 | adrenodoxin-like protein |
| 889 | fructose-2,6-bisphosphatase, putative | 2240 | NAM (no apical meristem)-like protein |
| 890 | exonuclease RRP41 | 2241 | putative transcription factor MYB41 |
| 891 | squamosa promoter binding protein-like 2 (emb|CAB56576.1) | 2242 | Myb DNA binding protein-like |
| 892 | putative squamosa-promoter binding protein | 2243 | AtMYB84 |
| 893 | O-acetylserine (thiol) lyase, putative | 2244 | photosystem II type I chlorophyll a/b binding protein |
| 894 | snoRNA | 2245 | putative aspartic proteinase |
| 895 | snoRNA | 2246 | jasmonate inducible protein, putative |
| 896 | ferredoxin-NADP+ reductase | 2247 | putative protein |
| 897 | H+-transporting ATP synthase chain 9-like protein | 2248 | No function assigned by TIGR |
| 898 | photosystem I subunit III precursor, putative | 2249 | putative phosphatidylserine synthase |

TABLE 1-continued

SEQUENCE DESCRIPTIONS

| Seq ID | Description | Seq ID | Description |
|---|---|---|---|
| 899 | photosystem I subunit VI precursor | 2250 | putative nicotianamine synthase |
| 900 | auxin-binding protein 1 precursor | 2251 | lysine and histidine specific transporter, putative |
| 901 | putative RAS superfamily GTP-binding protein | 2252 | putative protein |
| 902 | disease resistance protein-like | 2253 | putative protein |
| 903 | protein kinase like protein | 2254 | putative sugar transporter protein |
| 904 | glucuronosyl transferase-like protein | 2255 | 12S cruciferin seed storage protein |
| 905 | putative homeodomain transcription factor | 2256 | putative auxin-induced protein, IAA17/AXR3-1 |
| 906 | putative flavonol reductase | 2257 | putative cyclin D |
| 907 | putative protein | 2258 | farnesyl diphosphate synthase precursor (gb|AAB49290.1) |
| 908 | salt-tolerance protein | 2259 | putative potassium transport protein (TRH1) |
| 909 | 40S ribosomal protein S30 | 2260 | putative NPK1-related MAP kinase |
| 910 | putative bZIP transcription factor | 2261 | putative protein |
| 911 | putative protein | 2262 | putative ABC transporter |
| 912 | putative cinnamoyl CoA reductase | 2263 | putative DNA-directed RNA polymerase subunit |
| 913 | unknown protein | 2264 | putative small nuclear ribonucleoprotein E |
| 914 | putative RNA-binding protein | 2265 | unknown protein |
| 915 | phosphatidylinositol synthase (PIS1) | 2266 | reticuline oxidase-like protein |
| 916 | unknown protein | 2267 | putative 1-aminocyclopropane-1-carboxylate oxidase |
| 917 | hydroxyproline-rich glycoprotein homolog | 2268 | similar to Mlo proteins from *H. vulgare* |
| 918 | 50S ribosomal protein L15, chloroplast precursor | 2269 | long-chain-fatty-acid—CoA ligase-like protein |
| 919 | unknown protein | 2270 | putative protein |
| 920 | putative YME1 ATP-dependant protease | 2271 | chromatin remodelling complex ATPase chain ISWI-like protein |
| 921 | unknown protein | 2272 | hypothetical protein |
| 922 | putative ribosomal protein L28 | 2273 | latex-abundant protein, putative |
| 923 | unknown protein | 2274 | N-acetylornithine deacetylase-like protein, fragment |
| 924 | putative protein | 2275 | putative DNA-binding protein |
| 925 | protein ch-42 precursor, chloroplast | 2276 | putative anthranilate N-hydroxycinnamoyl/benzoyltransferase |
| 926 | protein serine/threonine kinase, putative | 2277 | putative DNA binding protein |
| 927 | beta-VPE | 2278 | cytochrome P450-like protein |
| 928 | putative vacuolar sorting receptor | 2279 | putative DNA-binding protein |
| 929 | putative translation initiation factor IF-2 | 2280 | putative peptide transporter |
| 930 | predicted protein of unknown function | 2281 | putative reticuline oxidase-like protein |
| 931 | putative protein | 2282 | thioredoxin, putative |
| 932 | hypothetical protein | 2283 | nodulin-like protein |
| 933 | hypothetical protein | 2284 | UDP-galactose transporter-like protein |
| 934 | phosphate transporter, putative | 2285 | putative fibrillin |
| 935 | No function assigned by TIGR | 2286 | unknown protein |
| 936 | beta subunit of protein farnesyl transferase ERA1 | 2287 | unknown protein |
| 937 | putative glutamate decarboxylase | 2288 | unknown protein |
| 938 | putative indole-3-acetate beta-glucosyltransferase | 2289 | hypothetical protein |
| 939 | putative receptor-like protein kinase | 2290 | glyceraldehyde 3-phosphate dehydrogenase A subunit (GapA) |
| 940 | UDP-galactose 4-epimerase-like protein | 2291 | predicted protein of unknown function |
| 941 | putative proliferating cell nuclear antigen, PCNA | 2292 | putative protein |
| 942 | ubiquitin conjugating enzyme E2 (UBC13) | 2293 | putative protein |

TABLE 1-continued

SEQUENCE DESCRIPTIONS

| Seq ID | Description | Seq ID | Description |
|---|---|---|---|
| 943 | cyclophilin (CYP2) | 2294 | myb-like protein |
| 944 | cystatin (emb|CAA03929.1) | 2295 | hypothetical protein |
| 945 | putative alcohol dehydrogenase | 2296 | putative U5 small nuclear ribonucleoprotein, an RNA helicase |
| 946 | acidic ribosomal protein p1 | 2297 | unknown protein |
| 947 | glutathione transferase AtGST 10 (emb|CAA10457.1) | 2298 | cinnamyl alcohol dehydrogenase-like protein |
| 948 | putative tropinone reductase | 2299 | hypothetical protein similar to extensin-like protein |
| 949 | ZIP4, a putative zinc transporter | 2300 | unknown protein |
| 950 | unknown protein | 2301 | putative chlorophyll a/b binding protein |
| 951 | putative protein | 2302 | probable plasma membrane intrinsic protein 1c |
| 952 | putative protein | 2303 | hexokinase (ATHXK2) |
| 953 | putative C2H2-type zinc finger protein | 2304 | calcium-dependent protein kinase |
| 954 | putative RING zinc finger protein | 2305 | 5'-adenylylphosphosulfate reductase, putative |
| 955 | putative microtubule-associated protein | 2306 | Erd1 protein precursor (sp|P42762) |
| 956 | unknown protein | 2307 | putative protein |
| 957 | putative protein | 2308 | putative protein |
| 958 | putative protein phosphatase-2c | 2309 | unknown protein |
| 959 | V-ATPase subunit G (vag2 gene) | 2310 | BCS1 protein-like protein |
| 960 | hypothetical protein | 2311 | putative protein |
| 961 | unknown protein | 2312 | putative protein |
| 962 | unknown protein | 2313 | putative protein kinase |
| 963 | unknown protein | 2314 | indoleacetic acid (IAA)-inducible gene (IAA7) |
| 964 | myrosinase-associated protein, putative | 2315 | ATP-dependent Clp protease regulatory subunit CLPX |
| 965 | hypothetical protein | 2316 | DNA-binding protein RAV1 |
| 966 | hypothetical protein | 2317 | putative protein |
| 967 | No function assigned by TIGR | 2318 | hypothetical protein |
| 968 | unknown protein | 2319 | unknown protein |
| 969 | hypothetical protein | 2320 | unknown protein |
| 970 | LAX1/AUX1-like permease | 2321 | putative protein |
| 971 | putative UDP-N-acetylglucosamine--dolichyl-phosphate N-acetylglucosaminephosphotransferase | 2322 | putative thioredoxin reductase |
| 972 | chorismate mutase CM2 | 2323 | unknown protein |
| 973 | inner mitochondrial membrane protein | 2324 | putative lectin |
| 974 | DEF (CLA1) protein | 2325 | No function assigned by TIGR |
| 975 | decoy | 2326 | beta-fructosidase |
| 976 | citrate synthase | 2327 | chlorophyll a/b-binding protein CP29 |
| 977 | myosin | 2328 | photosystem I subunit PSI-E-like protein |
| 978 | 40S ribosomal protein S19 | 2329 | peroxidase ATP8a |
| 979 | ripening-related protein-like | 2330 | putative fructose bisphosphate aldolase |
| 980 | putative signal peptidase I | 2331 | zinc finger protein ATZF1, putative |
| 981 | methionyl-tRNA synthetase (AtcpMetRS) | 2332 | DegP protease precursor |
| 982 | ribosomal protein precursor-like | 2333 | transcription factor-like protein |
| 983 | 50S ribosomal protein L21 chloroplast precursor (CL21) | 2334 | calcium-dependent protein kinase |
| 984 | putative MYB family transcription factor | 2335 | hypothetical protein |
| 985 | cyclophilin-like protein | 2336 | putative protein |
| 986 | hypothetical protein | 2337 | glucose-1-phosphate adenylyltransferase (APL3) |

TABLE 1-continued

SEQUENCE DESCRIPTIONS

| Seq ID | Description | Seq ID | Description |
|---|---|---|---|
| 987 | naringenin 3-dioxygenase like protein | 2338 | No function assigned by TIGR |
| 988 | WD-repeat protein-like protein | 2339 | putative Eukaryotic initiation factor 4A |
| 989 | putative serine carboxypeptidase II | 2340 | No function assigned by TIGR |
| 990 | prenyltransferase, putative | 2341 | unknown protein |
| 991 | putative ligand-gated ion channel protein | 2342 | beta tubulin 1, putative |
| 992 | clathrin adaptor medium chain protein MU1B, putative | 2343 | one helix protein (OHP) |
| 993 | No function assigned by TIGR | 2344 | No function assigned by TIGR |
| 994 | putative Tal 1-like non-LTR retroelement protein | 2345 | zinc finger protein 5, ZFP5 |
| 995 | putative 3-isopropylmalate dehydrogenase | 2346 | putative MYB family transcription factor |
| 996 | 3-isopropylmalate dehydratase, small subunit | 2347 | putative amino acid transporter protein |
| 997 | unknown protein | 2348 | putative potassium transporter |
| 998 | unknown protein | 2349 | protein kinase (AFC2) |
| 999 | unknown protein | 2350 | putative protein |
| 1000 | hypothetical protein | 2351 | No function assigned by TIGR |
| 1001 | putative protein | 2352 | putative ubiquitin-conjugating enzyme E2 |
| 1002 | No function assigned by TIGR | 2353 | unknown protein |
| 1003 | putative beta-glucosidase | 2354 | cytochrome P450 monooxygenase (CYP71B3) |
| 1004 | putative pectate lyase A11 | 2355 | putative myrosinase-binding protein |
| 1005 | putative beta-glucosidase | 2356 | putative vacuolar sorting receptor |
| 1006 | HD-Zip protein | 2357 | uridine diphosphate glucose epimerase |
| 1007 | putative ubiquitin conjugating enzyme | 2358 | shaggy related protein kinase, ASK-GAMMA |
| 1008 | homeobox-leucine zipper protein-like | 2359 | ankyrin repeat protein EMB506 |
| 1009 | cytochrome P450 like protein | 2360 | putative beta-alanine-pyruvate aminotransferase |
| 1010 | putative cysteine proteinase inhibitor B (cystatin B) | 2361 | putative alcohol dehydrogenase |
| 1011 | ethylene response sensor (ERS) | 2362 | putative receptor-like protein kinase |
| 1012 | putative SWH1 protein | 2363 | unknown protein |
| 1013 | putative glutathione S-transferase | 2364 | putative methylmalonate semi-aldehyde dehydrogenase |
| 1014 | putative protein | 2365 | hypothetical protein |
| 1015 | unknown protein | 2366 | unknown protein |
| 1016 | putative protein phosphatase 2C | 2367 | peroxidase ATP13a |
| 1017 | dnaJ protein homolog atj3 | 2368 | putative glutathione peroxidase |
| 1018 | ferredoxin | 2369 | squamosa promoter binding protein-like 7 |
| 1019 | hypothetical protein | 2370 | photosystem II core complex protein, putative |
| 1020 | putative sugar transport protein, ERD6 | 2371 | snoRNA |
| 1021 | putative DnaJ protein | 2372 | photosystem I subunit X precursor |
| 1022 | putative AP2 domain transcription factor | 2373 | MYB transcription factor (Atmyb2) |
| 1023 | putative protein | 2374 | putative PHD-type zinc finger protein |
| 1024 | putative cyclin-dependent kinase regulatory subunit | 2375 | nuclear RNA binding protein A-like protein |
| 1025 | putative tropinone reductase | 2376 | unknown protein |
| 1026 | signal response protein (GAI) | 2377 | unknown protein |
| 1027 | putative steroid sulfotransferase | 2378 | unknown protein |

TABLE 1-continued

SEQUENCE DESCRIPTIONS

| Seq ID | Description | Seq ID | Description |
|---|---|---|---|
| 1028 | hypothetical protein | 2379 | putative amino-cyclopropane-carboxylic acid oxidase (ACC oxidase) |
| 1029 | nucleic acid binding protein-like | 2380 | hypothetical protein |
| 1030 | putative protein | 2381 | indole-3-acetate beta-glucosyltransferase like protein |
| 1031 | blue copper binding protein | 2382 | predicted protein |
| 1032 | farnesylated protein (ATFP6) | 2383 | unknown protein |
| 1033 | unknown protein | 2384 | No function assigned by TIGR |
| 1034 | putative PCF2-like DNA binding protein | 2385 | putative photosystem I reaction center subunit IV |
| 1035 | teosinte branched1-like protein | 2386 | putative homeodomain transcription factor |
| 1036 | putative protein | 2387 | putative purple acid phosphatase precursor |
| 1037 | unknown protein | 2388 | No function assigned by TIGR |
| 1038 | unknown protein | 2389 | nitrate reductase 1 (NR1) |
| 1039 | 2-oxoglutarate dehydrogenase, E1 component | 2390 | putative casein kinase II beta subunit |
| 1040 | unknown protein | 2391 | pEARLI 1-like protein |
| 1041 | unknown protein | 2392 | putative protein |
| 1042 | CCAAT-binding transcription factor subunit A (CBF-A) | 2393 | No function assigned by TIGR |
| 1043 | hypothetical protein | 2394 | unknown protein |
| 1044 | putative growth regulator protein | 2395 | putative cell wall-plasma membrane disconnecting CLCT protein (AIR1A) |
| 1045 | putative presenilin | 2396 | unknown protein |
| 1046 | putative expansin | 2397 | scarecrow-like 11-like |
| 1047 | ribosomal-like protein | 2398 | putative anthocyanidin synthase |
| 1048 | unknown protein | 2399 | putative AP2 domain transcription factor |
| 1049 | unknown protein | 2400 | caffeoyl-CoA O-methyltransferase-like protein |
| 1050 | putative protein | 2401 | unknown protein |
| 1051 | putative protein | 2402 | putative protein kinase |
| 1052 | unknown protein | 2403 | cytochrome P450-like protein |
| 1053 | unknown protein | 2404 | putative MADS-box protein ANR1 |
| 1054 | unknown protein | 2405 | putative glutathione S-transferase |
| 1055 | unknown protein | 2406 | hypothetical protein |
| 1056 | unknown protein | 2407 | similar to gibberellin-regulated proteins |
| 1057 | putative protein | 2408 | unknown protein |
| 1058 | putative protein | 2409 | putative sensory transduction histidine kinase |
| 1059 | argininosuccinate lyase (AtArgH) | 2410 | similar to late embryogenesis abundant proteins |
| 1060 | disease resistance protein homolog | 2411 | unknown protein |
| 1061 | aldehyde dehydrogenase like protein | 2412 | putative protein |
| 1062 | GBF2, G-box binding factor | 2413 | putative ATP-dependent RNA helicase |
| 1063 | CDPK-related kinase | 2414 | putative protein |
| 1064 | endo-1,4-beta-glucanase | 2415 | putative sucrose synthetase |
| 1065 | putative serine protease | 2416 | beta-fructofuranosidase 1 |
| 1066 | serine/threonine-specific kinase lecRK1 precursor, lectin receptor-like | 2417 | putative indole-3-acetate beta-glucosyltransferase |
| 1067 | putative MAP kinase | 2418 | hypothetical protein |
| 1068 | RNase L inhibitor-like protein | 2419 | DNA-directed RNA polymerase II, third largest subunit |
| 1069 | No function assigned by TIGR | 2420 | putative transcription factor |
| 1070 | AP2 domain transcription factor | 2421 | homeobox-leucine zipper protein ATHB-5 (HD-zip protein ATHB-5) (sp|P46667) |
| 1071 | polygalacturonase isoenzyme 1 beta subunit, putative | 2422 | putative ftsH chloroplast protease |
| 1072 | putative lipid transfer protein | 2423 | replication protein A1-like |
| 1073 | putative protein kinase | 2424 | hypothetical protein |

TABLE 1-continued

SEQUENCE DESCRIPTIONS

| Seq ID | Description | Seq ID | Description |
|---|---|---|---|
| 1074 | putative protein | 2425 | unknown protein |
| 1075 | ATP-dependent RNA helicase like protein | 2426 | unknown protein |
| 1076 | putative cyclic nucleotide-regulated ion channel protein | 2427 | putative methionine aminopeptidase |
| 1077 | COP1 like protein | 2428 | unknown protein |
| 1078 | putative peroxidase | 2429 | fatty acid elongase-like protein (cer2-like) |
| 1079 | putative NAK-like ser/thr protein kinase | 2430 | unknown protein |
| 1080 | putative cytochrome C | 2431 | putative disease resistance response protein |
| 1081 | cytochrome c | 2432 | putative protein |
| 1082 | putative serine carboxypeptidase II | 2433 | unknown protein |
| 1083 | acyl-(acyl carrier protein) thioesterase | 2434 | putative protein |
| 1084 | DNA-binding factor, putative | 2435 | putative protein |
| 1085 | MAP3K delta-1 protein kinase | 2436 | unknown protein |
| 1086 | AtMlo-h1-like protein | 2437 | putative protein |
| 1087 | No function assigned by TIGR | 2438 | unknown protein |
| 1088 | putative expansin | 2439 | unknown protein |
| 1089 | defender against cell death protein, putative | 2440 | putative protein |
| 1090 | glycolate oxidase-like protein | 2441 | No function assigned by TIGR |
| 1091 | putative ATP-dependent RNA helicase | 2442 | MADS-box protein AGL14 |
| 1092 | putative protein | 2443 | No function assigned by TIGR |
| 1093 | putative HMG protein | 2444 | peptidylprolyl isomerase |
| 1094 | squalene monooxygenase 2 (squalene epoxidase 2) (SE 2) (sp|O65403) | 2445 | putative s-adenosylmethionine synthetase |
| 1095 | eukaryotic peptide chain release factor subunit 1, putative | 2446 | peroxidase |
| 1096 | auxin-induced protein-like | 2447 | ferrochelatase-I |
| 1097 | putative lipoamide dehydrogenase | 2448 | putative eukaryotic initiation factor 4, eIF4 |
| 1098 | putative protein | 2449 | drought-inducible cysteine proteinase RD21A precursor-like protein |
| 1099 | unknown protein | 2450 | unknown protein |
| 1100 | putative oligopeptide transporter | 2451 | unknown protein |
| 1101 | putative translation elongation factor ts | 2452 | No function assigned by TIGR |
| 1102 | putative CCAAT-binding transcription factor subunit | 2453 | No function assigned by TIGR |
| 1103 | putative ABC transporter | 2454 | salt-inducible like protein |
| 1104 | putative superoxide-generating NADPH oxidase flavocytochrome | 2455 | glucose-6-phosphate 1-dehydrogenase |
| 1105 | aspartate kinase-homoserine dehydrogenase-like protein | 2456 | 3-hydroxy-3-methylglutaryl CoA reductase (AA 1-592) |
| 1106 | putative bHLH transcription factor | 2457 | hypothetical protein |
| 1107 | putative geranylgeranyl transferase type I beta subunit | 2458 | putative protein |
| 1108 | putative ARP2/3 protein complex subunit p41 | 2459 | putative putative 60S ribosomal protein L17 |
| 1109 | sulphite reductase | 2460 | putative inorganic pyrophosphatase |
| 1110 | putative auxin-regulated protein | 2461 | putative gamma-glutamyltransferase |
| 1111 | transcription factor scarecrow-like 14, putative | 2462 | heat shock transcription factor-like protein |
| 1112 | unknown protein | 2463 | mitochondrial chaperonin hsp60 |
| 1113 | monooxygenase 2 (MO2) | 2464 | unknown protein |
| 1114 | putative amine oxidase | 2465 | putative zinc finger protein identical to T10M13.22 |
| 1115 | zinc finger protein, putative | 2466 | putative uridylyl transferase |
| 1116 | DNA-binding protein, putative | 2467 | nodulin-like protein |
| 1117 | putative protein | 2468 | putative B-box zinc finger protein |
| 1118 | putative protein | 2469 | No function assigned by TIGR |

TABLE 1-continued

SEQUENCE DESCRIPTIONS

| Seq ID | Description | Seq ID | Description |
|---|---|---|---|
| 1119 | Avr9 elicitor response like protein | 2470 | putative metalloproteinase |
| 1120 | putative protein | 2471 | putative cellular apoptosis susceptibility protein |
| 1121 | hypothetical protein | 2472 | hypothetical protein |
| 1122 | putative nucleotide-sugar dehydratase | 2473 | hypothetical protein |
| 1123 | UFD1 like protein | 2474 | scarecrow-like 13 (SCL13) |
| 1124 | putative trans-prenyltransferase | 2475 | putative nucleoside triphosphatase |
| 1125 | outward rectifying potassium channel KCO | 2476 | unknown protein |
| 1126 | unknown protein | 2477 | No function assigned by TIGR |
| 1127 | putative pectinacetylesterase | 2478 | hypothetical protein |
| 1128 | putative protein | 2479 | putative phospholipase |
| 1129 | No function assigned by TIGR | 2480 | putative snRNP protein |
| 1130 | unknown protein | 2481 | putative protein |
| 1131 | unknown protein | 2482 | putative lipase |
| 1132 | unknown protein | 2483 | putative nonsense-mediated mRNA decay protein |
| 1133 | protein phosphatase homolog (PPH1) | 2484 | No function assigned by TIGR |
| 1134 | unknown protein | 2485 | protochlorophyllide reductase precursor |
| 1135 | No function assigned by TIGR | 2486 | No function assigned by TIGR |
| 1136 | unknown protein | 2487 | trehalose-6-phosphate synthase, putative |
| 1137 | unknown protein | 2488 | unknown protein |
| 1138 | unknown protein | 2489 | germin-like protein |
| 1139 | putative protein | 2490 | plastid protein |
| 1140 | unknown protein | 2491 | putative protein |
| 1141 | putative ubiquinol--cytochrome-c reductase | 2492 | hypothetical protein |
| 1142 | unknown protein | 2493 | unknown protein |
| 1143 | contains similarity to high-glucose-regulated protein 8 GB:AAF08813 GI:6449083 from [Homo sapiens] | 2494 | unknown protein |
| 1144 | unknown protein | 2495 | histone deacetylase-like protein |
| 1145 | putative cis-Golgi SNARE protein | 2496 | unknown protein |
| 1146 | unknown protein | 2497 | unknown protein |
| 1147 | glutamate-1-semialdehyde aminotransferase | 2498 | putative protein |
| 1148 | No function assigned by TIGR | 2499 | putative protein |
| 1149 | hypothetical protein | 2500 | No function assigned by TIGR |
| 1150 | unknown protein | 2501 | putative zinc transporter ZIP2-like |
| 1151 | unknown protein | 2502 | unknown protein |
| 1152 | unknown protein | 2503 | putative ribosomal-protein S6 kinase (ATPK19) |
| 1153 | scarecrow-like 3 | 2504 | unknown protein |
| 1154 | putative proline-rich protein | 2505 | unknown protein |
| 1155 | cytochrome c oxidoreductase like protein | 2506 | 60S ribosomal protein L10A |
| 1156 | putative carboxymethylenebutenolidase | 2507 | putative protein |
| 1157 | unknown protein | 2508 | receptor protein kinase (IRK1), putative |
| 1158 | unknown protein | 2509 | putative nematode-resistance protein |
| 1159 | unknown protein | 2510 | tubulin alpha-5 chain-like protein |
| 1160 | unknown protein | 2511 | putative DNA-binding protein |
| 1161 | unknown protein | 2512 | unknown protein |
| 1162 | unknown protein | 2513 | putative RGA1, giberellin repsonse modulation protein |
| 1163 | auxin-induced protein (IAA20) | 2514 | non phototropic hypocotyl 1-like |
| 1164 | 50S ribosomal protein L4 | 2515 | RING-H2 finger protein RHA1b |

TABLE 1-continued

SEQUENCE DESCRIPTIONS

| Seq ID | Description | Seq ID | Description |
|---|---|---|---|
| 1165 | putative DNA topoisomerase III beta | 2516 | putative myb-protein |
| 1166 | No function assigned by TIGR | 2517 | hydroperoxide lyase (HPOL) like protein |
| 1167 | isp4 like protein | 2518 | serine/threonine-protein kinase, PK7 |
| 1168 | putative protein kinase | 2519 | putative vacuolar proton-ATPase subunit |
| 1169 | hypothetical protein | 2520 | putative polygalacturonase |
| 1170 | putative pyrophosphate--fructose-6-phosphate 1-phosphotransferase | 2521 | putative ribosomal protein L8 |
| 1171 | putative protein | 2522 | putative adenylate kinase |
| 1172 | putative protein | 2523 | germin-like protein (GLP10) |
| 1173 | putative protein | 2524 | putative chlorophyll a/b binding protein |
| 1174 | unknown protein | 2525 | chloroplast single subunit DNA-dependent RNA polymerase |
| 1175 | unknown protein | 2526 | putative protein |
| 1176 | putative protein | 2527 | hypothetical protein |
| 1177 | putative protein | 2528 | hypothetical protein |
| 1178 | unknown protein | 2529 | b-keto acyl reductase, putative |
| 1179 | unknown protein | 2530 | cellulose synthase catalytic subunit |
| 1180 | putative protein | 2531 | putative 1-aminocyclopropane-1-carboxylate oxidase |
| 1181 | brassinosteroid insensitive 1 gene (BRI1) | 2532 | S-linalool synthase, putative |
| 1182 | putative receptor protein kinase | 2533 | phosphoribosyl-ATP pyrophosphohydrolase (At-IE) |
| 1183 | vacuolar-type H+-translocating inorganic pyrophosphatase | 2534 | disease resistance RPP5 like protein (fragment) |
| 1184 | protein kinase-like protein | 2535 | putative protein |
| 1185 | glycyl tRNA synthetase, putative | 2536 | beta-galactosidase like protein |
| 1186 | subtilisin proteinase-like | 2537 | putative translation initiation factor eIF-2, gamma subunit |
| 1187 | hypothetical protein | 2538 | ankyrin like protein |
| 1188 | cytochrome P450-like protein | 2539 | histone H2A-like protein |
| 1189 | cytochrome p450 like protein | 2540 | putative protein |
| 1190 | putative protein kinase | 2541 | salt-tolerance zinc finger protein |
| 1191 | pectinesterase-like protein | 2542 | unknown protein |
| 1192 | putative receptor-like protein kinase | 2543 | putative protein |
| 1193 | peroxidase ATP17a-like protein | 2544 | fructose-bisphosphate aldolase |
| 1194 | No function assigned by TIGR | 2545 | peroxidase (emb|CAA66964.1) |
| 1195 | cellulose synthase catalytic subunit-like protein | 2546 | patatin-like protein |
| 1196 | RAS-related protein, RAB7 | 2547 | salt-inducible protein homolog |
| 1197 | putative aspartate aminotransferase | 2548 | hypothetical protein |
| 1198 | cyclophilin | 2549 | xyloglucan endo-transglycosylase-like protein |
| 1199 | putative SF2/ASF splicing modulator, Srp30 | 2550 | trihelix DNA-binding protein (GT2) |
| 1200 | putative cytochrome b5 | 2551 | ubiquitin-conjugating enzyme 16, putative |
| 1201 | glutamyl-tRNA reductase, putative | 2552 | homeobox protein |
| 1202 | putative MADS-box protein | 2553 | envelope Ca2+-ATPase |
| 1203 | ammonium transport protein (AMT1) | 2554 | snap25a |
| 1204 | No function assigned by TIGR | 2555 | putative annexin |
| 1205 | putative beta-ketoacyl-CoA synthase | 2556 | putative protein |
| 1206 | thaumatin-like protein | 2557 | homeodomain transcription factor (ATHB-14) |
| 1207 | putative methionine aminopeptidase | 2558 | heat shock protein, putative |

TABLE 1-continued

SEQUENCE DESCRIPTIONS

| Seq ID | Description | Seq ID | Description |
|---|---|---|---|
| 1208 | putative protein phosphatase 2C | 2559 | peroxidase ATP23a |
| 1209 | kinase-like protein | 2560 | p68 RNA helicase, putative |
| 1210 | receptor-associated kinase isolog | 2561 | potassium transporter, putative |
| 1211 | mitochondrial ribosomal protein S14 | 2562 | putative eukaryotic translation initiation factor 2 alpha subunit, eIF2 |
| 1212 | oleosin, 18.5K | 2563 | hypothetical protein |
| 1213 | chalcone isomerase | 2564 | carnitine racemase like protein |
| 1214 | putative cyclin-dependent kinase regulatory subunit | 2565 | No function assigned by TIGR |
| 1215 | putative thaumatin-like protein | 2566 | unknown protein |
| 1216 | putative two-component response regulator protein | 2567 | unknown protein |
| 1217 | TATA binding protein-associated factor, putative | 2568 | unknown protein |
| 1218 | predicted protein of unknown function | 2569 | serine/threonine kinase-like protein |
| 1219 | putative AP2 domain transcription factor | 2570 | peroxidase (emb|CAA66960.1) |
| 1220 | brassinosteroid receptor kinase, putative | 2571 | putative protein |
| 1221 | TINY-like protein | 2572 | hypothetical protein |
| 1222 | glucose-6-phosphate isomerase | 2573 | glycine-rich protein 2 (GRP2) |
| 1223 | putative protein | 2574 | unknown protein |
| 1224 | putative NAM (no apical meristem)-like protein | 2575 | berberine bridge enzyme-like protein |
| 1225 | unknown protein | 2576 | unknown protein |
| 1226 | putative nucleotide-binding protein | 2577 | putative WD-repeat protein |
| 1227 | bZIP transcription factor (POSF21) | 2578 | serine/threonine kinase-like protein |
| 1228 | ubiquitin activating enzyme-like protein | 2579 | serine/threonine kinase-like protein |
| 1229 | telomere repeat-binding protein | 2580 | Cu2+-transporting ATPase-like protein |
| 1230 | unknown protein | 2581 | translation initiation factor eIF4E |
| 1231 | mevalonate kinase | 2582 | O-methyltransferase-like protein |
| 1232 | putative protein | 2583 | translation initiation factor eIF3-like protein |
| 1233 | hypothetical protein | 2584 | No function assigned by TIGR |
| 1234 | disease resistance RPP5 like protein | 2585 | unknown protein |
| 1235 | putative protein | 2586 | hypothetical protein |
| 1236 | putative pectinesterase | 2587 | unknown protein |
| 1237 | Ttg1 protein (emb|CAB45372.1) | 2588 | unknown protein |
| 1238 | FUSCA PROTEIN FUS6 | 2589 | glycine-rich protein like |
| 1239 | NHE1 Na+/H+ exchanger | 2590 | putative disease resistance protein |
| 1240 | No function assigned by TIGR | 2591 | putative Na+/Ca2+ antiporter |
| 1241 | Phospholipase like protein | 2592 | putative hydroxymethylglutaryl-CoA lyase |
| 1242 | unknown protein | 2593 | putative phosphoribosylaminoimidazole carboxylase |
| 1243 | unknown protein | 2594 | SAR DNA-binding protein-like |
| 1244 | unknown protein | 2595 | response regulator, putative |
| 1245 | AUX1-like amino acid permease | 2596 | fibrillin precursor-like protein |
| 1246 | unknown protein | 2597 | beta-ketoacyl-CoA synthase (FIDDLEHEAD) |
| 1247 | putative C2H2-type zinc finger protein | 2598 | lectin like protein |
| 1248 | putative protein | 2599 | No function assigned by TIGR |
| 1249 | putative protein | 2600 | acidic endochitinase (dbj|BAA21861.1) |
| 1250 | putative glucosyltransferase | 2601 | unknown protein |
| 1251 | putative lipase | 2602 | hypothetical protein |
| 1252 | putative protein | 2603 | predicted OR23 protein of unknown function |
| 1253 | putative thioredoxin | 2604 | putative protein |
| 1254 | AIG2-like protein | 2605 | hypothetical protein |
| 1255 | short-chain alcohol dehydrogenase like protein | 2606 | glycerol-3-phosphate dehydrogenase |

TABLE 1-continued

SEQUENCE DESCRIPTIONS

| Seq ID | Description | Seq ID | Description |
|---|---|---|---|
| 1256 | hypothetical protein | 2607 | hypothetical protein |
| 1257 | putative protein | 2608 | tat-binding protein, putative |
| 1258 | putative protein | 2609 | putative protein |
| 1259 | glutathione peroxidase-like protein | 2610 | putative trehalose-6-phosphate phosphatase |
| 1260 | putative protein | 2611 | hypothetical protein |
| 1261 | putative disease resistance response protein | 2612 | putative flavonol 3-O-glucosyltransferase |
| 1262 | putative protein | 2613 | 60S ribosomal protein L30 |
| 1263 | senescence-associated protein (SAG29) | 2614 | putative auxin-induced protein |
| 1264 | glycolate oxidase, putative | 2615 | putative nonspecific lipid-transfer protein precursor |
| 1265 | extensin-like protein | 2616 | AtRer1A |
| 1266 | putative protein | 2617 | putative aquaporin (tonoplast intrinsic protein gamma) |
| 1267 | unknown protein | 2618 | hypothetical protein |
| 1268 | putative disease resistance protein | 2619 | putative alanine acetyl transferase |
| 1269 | putative receptor-like protein kinase | 2620 | putative NADP-dependent glyceraldehyde-3-phosphate dehydrogenase |
| 1270 | putative receptor-like protein kinase | 2621 | putative DNA binding protein |
| 1271 | basic chitinase | 2622 | putative cystathionine gamma-synthase |
| 1272 | putative pectin methylesterase | 2623 | unknown protein |
| 1273 | peroxidase ATP N | 2624 | malate oxidoreductase (malic enzyme) |
| 1274 | class 2 non-symbiotic hemoglobin | 2625 | unknown protein |
| 1275 | nitrate transporter | 2626 | cyclic nucleotide-gated cation channel |
| 1276 | Ca2+/H+-exchanging protein-like | 2627 | glyoxalase II, putative |
| 1277 | putative protein | 2628 | putative trypsin inhibitor |
| 1278 | hydroxynitrile lyase like protein | 2629 | unknown protein |
| 1279 | putative AP2 domain transcription factor | 2630 | unknown protein |
| 1280 | pectin methylesterase, putative | 2631 | unknown protein |
| 1281 | putative protein | 2632 | nucleosome assembly protein I-like protein |
| 1282 | beta-glucosidase-like protein | 2633 | membrane channel like protein |
| 1283 | CCAAT box binding factor/ transcription factor Hap2a | 2634 | anthocyanin2, putative |
| 1284 | putative fibrillin | 2635 | TWIN SISTER OF FT (TSF) |
| 1285 | xyloglucan endo-transglycosylase | 2636 | putative myb-related transcription factor |
| 1286 | putative 10 kd chaperonin | 2637 | hypothetical protein |
| 1287 | No function assigned by TIGR | 2638 | putative RING zinc finger protein |
| 1288 | serine/threonine protein kinase ATPK10 | 2639 | amino acid transport protein AAT1 |
| 1289 | putative lipase | 2640 | putative protein |
| 1290 | choline kinase GmCK2p-like protein | 2641 | putative protein |
| 1291 | putative sugar transport protein, ERD6 | 2642 | xanthine dehydrogenase |
| 1292 | MYB27 protein-like | 2643 | xanthine dehydrogenase-like protein |
| 1293 | DNA-binding protein, putative | 2644 | receptor protein kinase (IRK1), putative |
| 1294 | similar to cold acclimation protein WCOR413 [*Triticum aestivum*] | 2645 | dehydrin-like protein |
| 1295 | unknown protein | 2646 | unknown protein |
| 1296 | aquaporin (plasma membrane intrinsic protein 2B) | 2647 | aldehyde dehydrogenase homolog, putative |
| 1297 | No function assigned by TIGR | 2648 | Ran binding protein (AtRanBP1b) |
| 1298 | P-Protein-like protein | 2649 | putative squamosa-promoter binding protein |

TABLE 1-continued

SEQUENCE DESCRIPTIONS

| Seq ID | Description | Seq ID | Description |
|---|---|---|---|
| 1299 | No function assigned by TIGR | 2650 | putative protein |
| 1300 | putative cytochrome P450 monooxygenase | 2651 | kinesin like protein |
| 1301 | putative cytochrome P450 monooxygenase | 2652 | putative cellulose synthase |
| 1302 | putative thioredoxin | 2653 | calmodulin (cam2) |
| 1303 | stromal ascorbate peroxidase | 2654 | fibrillarin-like protein |
| 1304 | ethylene responsive element binding factor-like protein (AtERF6) | 2655 | putative transmembrane protein G5p |
| 1305 | auxin transport protein EIR1 (gb|AAC39513.1) | 2656 | putative peroxidase |
| 1306 | putative CONSTANS-like B-box zinc finger protein | 2657 | putative SNF1-related protein kinase |
| 1307 | putative protein kinase | 2658 | glutathione S-transferase, putative |
| 1308 | mitochondrial Lon protease homolog 1 precursor (sp|O64948) | 2659 | unknown protein |
| 1309 | putative protein | 2660 | hypothetical protein |
| 1310 | heme activated protein, putative | 2661 | putative protein |
| 1311 | putative cytochrome P450 | 2662 | phosphatidylinositol-4-phosphate 5-kinase isolog |
| 1312 | No function assigned by TIGR | 2663 | putative tyrosine decarboxylase |
| 1313 | putative lipase | 2664 | unknown protein |
| 1314 | putative protein | 2665 | SGP1 monomeric G-protein (emb|CAB54517.1) |
| 1315 | putative sugar transporter protein | 2666 | putative serine carboxypeptidase II |
| 1316 | putative sucrose transport protein, SUC2 | 2667 | putative L5 ribosomal proteiii |
| 1317 | putative protein | 2668 | putative glucosyltransferase |
| 1318 | putative protein | 2669 | flavonoid 3,5-hydroxylase like protein |
| 1319 | putative endochitinase | 2670 | putative protein |
| 1320 | putative acetone-cyanohydrin lyase | 2671 | putative protein |
| 1321 | putative protein | 2672 | putative Fe (II)/ascorbate oxidase |
| 1322 | calmodulin-like protein | 2673 | putative anthocyanin 5-aromatic acyltransferase |
| 1323 | hypothetical protein | 2674 | casein kinase I |
| 1324 | cysteine proteinase like protein | 2675 | putative 2,3-bisphosphoglycerate-independent phosphoglycerate mutase |
| 1325 | heat shock protein 17.6-II | 2676 | putative glutathione S-transferase TSI-1 |
| 1326 | heat shock protein 18 | 2677 | ATP-dependent RNA helicase |
| 1327 | Arabidopsis mitochondrion-localized small heat shock protein (AtHSP23.6-mito) | 2678 | putative cytochrome P450 |
| 1328 | unknown protein | 2679 | putative WD-40 repeat protein |
| 1329 | putative WRKY-type DNA binding protein | 2680 | No function assigned by TIGR |
| 1330 | No function assigned by TIGR | 2681 | No function assigned by TIGR |
| 1331 | hypothetical protein | 2682 | putative protein |
| 1332 | putative integral membrane protein nodulin | 2683 | putative extensin |
| 1333 | putative protein | 2684 | nodulin-26-like protein |
| 1334 | unknown protein | 2685 | RNA helicase (emb|CAA09212.1) |
| 1335 | 3-isopropylmalate dehydratase, small subunit | 2686 | predicted protein of unknown function |
| 1336 | unknown protein | 2687 | putative berberine bridge enzyme |
| 1337 | putative homeodomain transcription factor | 2688 | thioredoxin, putative |
| 1338 | unknown protein | 2689 | putative serine carboxypeptidase I |
| 1339 | putative protein | 2690 | cytochrome P450-like protein |

TABLE 1-continued

SEQUENCE DESCRIPTIONS

| Seq ID | Description | Seq ID | Description |
|---|---|---|---|
| 1340 | peroxidase ATP19a | 2691 | putative pyrophosphate-dependent phosphofructokinase alpha subunit |
| 1341 | putative Na+/H+-exchanging protein | 2692 | putative flavonol glucosyltransferase |
| 1342 | putative auxin-regulated protein | 2693 | peroxidase ATP20a (emb|CAA67338.1) |
| 1343 | unknown protein | 2694 | TOPP8 serine/threonine protein phosphatase type one |
| 1344 | unknown protein | 2695 | auxin regulated protein IAA18, putative |
| 1345 | putative trehalose-6-phosphate synthase | 2696 | putative WRKY-type DNA binding protein |
| 1346 | putative lectin | 2697 | putative glucan synthase |
| 1347 | Mlo protein-like | 2698 | squalene monooxygenase |
| 1348 | unknown protein | 2699 | putative proline-rich protein |
| 1349 | ethylene response factor, putative | 2700 | G2484-1 protein |
| 1350 | unknown protein | 2701 | heat shock protein 70 like protein |
| 1351 | unknown protein | 2702 | unknown protein |
| | | 2703 | unknown protein |

TABLE 2

ABIOTIC STRESS RESPONSIVE GENE REGULATORY SEQUENCES

| SEQ ID NO | REGULATORY REGION | SEQ ID NO | REGULATORY REGION | SEQ ID NO | REGULATORY REGION | SEQ ID NO | REGULATORY REGION |
|---|---|---|---|---|---|---|---|
| 1 | 2704 | 1353 | 4046 | 42 | 2745 | 1394 | 4087 |
| 2 | 2705 | 1354 | 4047 | 43 | NONE | 1395 | 4088 |
| 3 | 2706 | 1355 | 4048 | 44 | 2746 | 1396 | 4089 |
| 4 | 2707 | 1356 | 4049 | 45 | 2747 | 1397 | 4090 |
| 5 | 2708 | 1357 | 4050 | 46 | 2748 | 1398 | 4091 |
| 6 | 2709 | 1358 | 4051 | 47 | 2749 | 1399 | 4092 |
| 7 | 2710 | 1359 | 4052 | 48 | 2750 | 1400 | 4093 |
| 8 | 2711 | 1360 | 4053 | 49 | 2751 | 1401 | 4094 |
| 9 | 2712 | 1361 | 4054 | 50 | 2752 | 1402 | 4095 |
| 10 | 2713 | 1362 | 4055 | 51 | 2753 | 1403 | 4096 |
| 11 | 2714 | 1363 | 4056 | 52 | 2754 | 1404 | 4097 |
| 12 | 2715 | 1364 | 4057 | 53 | 2755 | 1405 | 4098 |
| 13 | 2716 | 1365 | 4058 | 54 | 2756 | 1406 | 4099 |
| 14 | 2717 | 1366 | 4059 | 55 | 2757 | 1407 | 4100 |
| 15 | 2718 | 1367 | 4060 | 56 | 2758 | 1408 | 4101 |
| 16 | 2719 | 1368 | 4061 | 57 | 2759 | 1409 | 4102 |
| 17 | 2720 | 1369 | 4062 | 58 | 2760 | 1410 | 4103 |
| 18 | 2721 | 1370 | 4063 | 59 | 2761 | 1411 | 4104 |
| 19 | 2722 | 1371 | 4064 | 60 | 2762 | 1412 | 4105 |
| 20 | 2723 | 1372 | 4065 | 61 | 2763 | 1413 | 4106 |
| 21 | 2724 | 1373 | 4066 | 62 | 2764 | 1414 | 4107 |
| 22 | 2725 | 1374 | 4067 | 63 | 2765 | 1415 | 4108 |
| 23 | 2726 | 1375 | 4068 | 64 | 2766 | 1416 | 4109 |
| 24 | 2727 | 1376 | 4069 | 65 | 2767 | 1417 | 4110 |
| 25 | 2728 | 1377 | 4070 | 66 | 2768 | 1418 | 4111 |
| 26 | 2729 | 1378 | 4071 | 67 | 2769 | 1419 | 4112 |
| 27 | 2730 | 1379 | 4072 | 68 | 2770 | 1420 | 4113 |
| 28 | 2731 | 1380 | 4073 | 69 | NONE | 1421 | 4114 |
| 29 | 2732 | 1381 | 4074 | 70 | 2771 | 1422 | 4115 |
| 30 | 2733 | 1382 | 4075 | 71 | 2772 | 1423 | 4116 |
| 31 | 2734 | 1383 | 4076 | 72 | 2773 | 1424 | 4117 |
| 32 | 2735 | 1384 | 4077 | 73 | 2774 | 1425 | 4118 |
| 33 | 2736 | 1385 | 4078 | 74 | 2775 | 1426 | 4119 |
| 34 | 2737 | 1386 | 4079 | 75 | 2776 | 1427 | 4120 |
| 35 | 2738 | 1387 | 4080 | 76 | 2777 | 1428 | 4121 |
| 36 | 2739 | 1388 | 4081 | 77 | 2778 | 1429 | 4122 |
| 37 | 2740 | 1389 | 4082 | 78 | 2779 | 1430 | 4123 |
| 38 | 2741 | 1390 | 4083 | 79 | 2780 | 1431 | 4124 |
| 39 | 2742 | 1391 | 4084 | 80 | 2781 | 1432 | NONE |
| 40 | 2743 | 1392 | 4085 | 81 | 2782 | 1433 | 4125 |
| 41 | 2744 | 1393 | 4086 | 82 | 2783 | 1434 | 4126 |

TABLE 2-continued

ABIOTIC STRESS RESPONSIVE GENE REGULATORY SEQUENCES

| SEQ ID NO | REGULATORY REGION | SEQ ID NO | REGULATORY REGION |
|---|---|---|---|
| 83 | 2784 | 1435 | 4127 |
| 84 | 2785 | 1436 | 4128 |
| 85 | 2786 | 1437 | 4129 |
| 86 | 2787 | 1438 | 4130 |
| 87 | 2788 | 1439 | 4131 |
| 88 | 2789 | 1440 | 4132 |
| 89 | 2790 | 1441 | 4133 |
| 90 | 2791 | 1442 | 4134 |
| 91 | 2792 | 1443 | 4135 |
| 92 | 2793 | 1444 | 4136 |
| 93 | 2794 | 1445 | 4137 |
| 94 | 2795 | 1446 | 4138 |
| 95 | 2796 | 1447 | 4139 |
| 96 | 2797 | 1448 | 4140 |
| 97 | 2798 | 1449 | 4141 |
| 98 | 2799 | 1450 | 4142 |
| 99 | 2800 | 1451 | 4143 |
| 100 | 2801 | 1452 | 4144 |
| 101 | 2802 | 1453 | 4145 |
| 102 | 2803 | 1454 | 4146 |
| 103 | 2804 | 1455 | 4147 |
| 104 | 2805 | 1456 | 4148 |
| 105 | 2806 | 1457 | 4149 |
| 106 | 2807 | 1458 | 4150 |
| 107 | 2808 | 1459 | 4151 |
| 108 | 2809 | 1460 | 4152 |
| 109 | 2810 | 1461 | 4153 |
| 110 | 2811 | 1462 | 4154 |
| 111 | 2812 | 1463 | 4155 |
| 112 | 2813 | 1464 | 4156 |
| 113 | 2814 | 1465 | 4157 |
| 114 | 2815 | 1466 | 4158 |
| 115 | 2816 | 1467 | 4159 |
| 116 | 2817 | 1468 | 4160 |
| 117 | 2818 | 1469 | 4161 |
| 118 | 2819 | 1470 | 4162 |
| 119 | 2820 | 1471 | 4163 |
| 120 | 2821 | 1472 | 4164 |
| 121 | 2822 | 1473 | 4165 |
| 122 | 2823 | 1474 | 4166 |
| 123 | 2824 | 1475 | 4167 |
| 124 | 2825 | 1476 | 4168 |
| 125 | 2826 | 1477 | 4169 |
| 126 | 2827 | 1478 | 4170 |
| 127 | 2828 | 1479 | 4171 |
| 128 | 2829 | 1480 | 4172 |
| 129 | 2830 | 1481 | 4173 |
| 130 | 2831 | 1482 | 4174 |
| 131 | 2832 | 1483 | 4175 |
| 132 | 2833 | 1484 | 4176 |
| 133 | 2834 | 1485 | 4177 |
| 134 | 2835 | 1486 | 4178 |
| 135 | 2836 | 1487 | 4179 |
| 136 | 2837 | 1488 | 4180 |
| 137 | 2838 | 1489 | 4181 |
| 138 | 2839 | 1490 | 4182 |
| 139 | 2840 | 1491 | 4183 |
| 140 | 2841 | 1492 | 4184 |
| 141 | 2842 | 1493 | 4185 |
| 142 | 2843 | 1494 | 4186 |
| 143 | 2844 | 1495 | 4187 |
| 144 | NONE | 1496 | 4188 |
| 145 | 2845 | 1497 | 4189 |
| 146 | 2846 | 1498 | 4190 |
| 147 | 2847 | 1499 | 4191 |
| 148 | 2848 | 1500 | 4192 |
| 149 | 2849 | 1501 | 4193 |
| 150 | 2850 | 1502 | 4194 |
| 151 | 2851 | 1503 | 4195 |
| 152 | 2852 | 1504 | 4196 |
| 153 | 2853 | 1505 | 4197 |
| 154 | 2854 | 1506 | 4198 |
| 155 | 2855 | 1507 | 4199 |
| 156 | 2856 | 1508 | 4200 |
| 157 | 2857 | 1509 | 4201 |
| 158 | 2858 | 1510 | 4202 |
| 159 | 2859 | 1511 | 4203 |
| 160 | 2860 | 1512 | 4204 |
| 161 | 2861 | 1513 | 4205 |
| 162 | 2862 | 1514 | 4206 |
| 163 | 2863 | 1515 | 4207 |
| 164 | 2864 | 1516 | 4208 |
| 165 | 2865 | 1517 | 4209 |
| 166 | 2866 | 1518 | 4210 |
| 167 | 2867 | 1519 | 4211 |
| 168 | 2868 | 1520 | 4212 |
| 169 | 2869 | 1521 | 4213 |
| 170 | 2870 | 1522 | 4214 |
| 171 | 2871 | 1523 | 4215 |
| 172 | 2872 | 1524 | 4216 |
| 173 | 2873 | 1525 | 4217 |
| 174 | 2874 | 1526 | 4218 |
| 175 | 2875 | 1527 | 4219 |
| 176 | 2876 | 1528 | 4220 |
| 177 | 2877 | 1529 | 4221 |
| 178 | 2878 | 1530 | 4222 |
| 179 | 2879 | 1531 | 4223 |
| 180 | 2880 | 1532 | 4224 |
| 181 | 2881 | 1533 | 4225 |
| 182 | 2882 | 1534 | 4226 |
| 183 | 2883 | 1535 | 4227 |
| 184 | 2884 | 1536 | 4228 |
| 185 | 2885 | 1537 | 4229 |
| 186 | 2886 | 1538 | 4230 |
| 187 | 2887 | 1539 | 4231 |
| 188 | 2888 | 1540 | 4232 |
| 189 | 2889 | 1541 | 4233 |
| 190 | 2890 | 1542 | 4234 |
| 191 | 2891 | 1543 | 4235 |
| 192 | 2892 | 1544 | 4236 |
| 193 | 2893 | 1545 | 4237 |
| 194 | 2894 | 1546 | 4238 |
| 195 | 2895 | 1547 | 4239 |
| 196 | 2896 | 1548 | 4240 |
| 197 | 2897 | 1549 | 4241 |
| 198 | 2898 | 1550 | 4242 |
| 199 | 2899 | 1551 | 4243 |
| 200 | 2900 | 1552 | 4244 |
| 201 | 2901 | 1553 | 4245 |
| 202 | 2902 | 1554 | 4246 |
| 203 | 2903 | 1555 | 4247 |
| 204 | 2904 | 1556 | 4248 |
| 205 | 2905 | 1557 | 4249 |
| 206 | 2906 | 1558 | NONE |
| 207 | 2907 | 1559 | 4250 |
| 208 | 2908 | 1560 | 4251 |
| 209 | 2909 | 1561 | 4252 |
| 210 | 2910 | 1562 | 4253 |
| 211 | 2911 | 1563 | 4254 |
| 212 | 2912 | 1564 | 4255 |
| 213 | 2913 | 1565 | 4256 |
| 214 | 2914 | 1566 | 4257 |
| 215 | 2915 | 1567 | 4258 |
| 216 | 2916 | 1568 | 4259 |
| 217 | 2917 | 1569 | 4260 |
| 218 | 2918 | 1570 | 4261 |
| 219 | 2919 | 1571 | 4262 |
| 220 | 2920 | 1572 | 4263 |
| 221 | 2921 | 1573 | 4264 |
| 222 | 2922 | 1574 | 4265 |
| 223 | 2923 | 1575 | 4266 |
| 224 | 2924 | 1576 | 4267 |
| 225 | 2925 | 1577 | 4268 |
| 226 | 2926 | 1578 | 4269 |
| 227 | 2927 | 1579 | 4270 |
| 228 | 2928 | 1580 | 4271 |

TABLE 2-continued

ABIOTIC STRESS RESPONSIVE GENE REGULATORY SEQUENCES

| SEQ ID NO | REGULATORY REGION | SEQ ID NO | REGULATORY REGION | SEQ ID NO | REGULATORY REGION | SEQ ID NO | REGULATORY REGION |
|---|---|---|---|---|---|---|---|
| 229 | 2929 | 1581 | 4272 | 302 | 3002 | 1654 | 4345 |
| 230 | 2930 | 1582 | 4273 | 303 | 3003 | 1655 | 4346 |
| 231 | 2931 | 1583 | 4274 | 304 | NONE | 1656 | 4347 |
| 232 | 2932 | 1584 | 4275 | 305 | 3004 | 1657 | 4348 |
| 233 | 2933 | 1585 | 4276 | 306 | 3005 | 1658 | 4349 |
| 234 | 2934 | 1586 | 4277 | 307 | 3006 | 1659 | 4350 |
| 235 | 2935 | 1587 | 4278 | 308 | 3007 | 1660 | 4351 |
| 236 | 2936 | 1588 | 4279 | 309 | 3008 | 1661 | 4352 |
| 237 | 2937 | 1589 | 4280 | 310 | 3009 | 1662 | 4353 |
| 238 | 2938 | 1590 | 4281 | 311 | 3010 | 1663 | NONE |
| 239 | 2939 | 1591 | 4282 | 312 | 3011 | 1664 | 4354 |
| 240 | 2940 | 1592 | 4283 | 313 | 3012 | 1665 | 4355 |
| 241 | 2941 | 1593 | 4284 | 314 | 3013 | 1666 | 4356 |
| 242 | 2942 | 1594 | 4285 | 315 | 3014 | 1667 | 4357 |
| 243 | 2943 | 1595 | 4286 | 316 | 3015 | 1668 | 4358 |
| 244 | 2944 | 1596 | 4287 | 317 | 3016 | 1669 | 4359 |
| 245 | 2945 | 1597 | 4288 | 318 | 3017 | 1670 | 4360 |
| 246 | 2946 | 1598 | 4289 | 319 | 3018 | 1671 | 4361 |
| 247 | 2947 | 1599 | 4290 | 320 | 3019 | 1672 | 4362 |
| 248 | 2948 | 1600 | 4291 | 321 | 3020 | 1673 | 4363 |
| 249 | 2949 | 1601 | 4292 | 322 | 3021 | 1674 | 4364 |
| 250 | 2950 | 1602 | 4293 | 323 | 3022 | 1675 | 4365 |
| 251 | 2951 | 1603 | 4294 | 324 | 3023 | 1676 | 4366 |
| 252 | 2952 | 1604 | 4295 | 325 | 3024 | 1677 | 4367 |
| 253 | 2953 | 1605 | 4296 | 326 | 3025 | 1678 | 4368 |
| 254 | 2954 | 1606 | 4297 | 327 | 3026 | 1679 | 4369 |
| 255 | 2955 | 1607 | 4298 | 328 | 3027 | 1680 | 4370 |
| 256 | 2956 | 1608 | 4299 | 329 | 3028 | 1681 | 4371 |
| 257 | 2957 | 1609 | 4300 | 330 | 3029 | 1682 | 4372 |
| 258 | 2958 | 1610 | 4301 | 331 | 3030 | 1683 | 4373 |
| 259 | 2959 | 1611 | 4302 | 332 | 3031 | 1684 | 4374 |
| 260 | 2960 | 1612 | 4303 | 333 | 3032 | 1685 | 4375 |
| 261 | 2961 | 1613 | 4304 | 334 | 3033 | 1686 | 4376 |
| 262 | 2962 | 1614 | 4305 | 335 | 3034 | 1687 | 4377 |
| 263 | 2963 | 1615 | 4306 | 336 | 3035 | 1688 | 4378 |
| 264 | 2964 | 1616 | 4307 | 337 | 3036 | 1689 | 4379 |
| 265 | 2965 | 1617 | 4308 | 338 | 3037 | 1690 | 4380 |
| 266 | 2966 | 1618 | 4309 | 339 | 3038 | 1691 | 4381 |
| 267 | 2967 | 1619 | 4310 | 340 | 3039 | 1692 | 4382 |
| 268 | 2968 | 1620 | 4311 | 341 | 3040 | 1693 | 4383 |
| 269 | 2969 | 1621 | 4312 | 342 | 3041 | 1694 | 4384 |
| 270 | 2970 | 1622 | 4313 | 343 | 3042 | 1695 | 4385 |
| 271 | 2971 | 1623 | 4314 | 344 | 3043 | 1696 | 4386 |
| 272 | 2972 | 1624 | 4315 | 345 | 3044 | 1697 | 4387 |
| 273 | 2973 | 1625 | 4316 | 346 | 3045 | 1698 | 4388 |
| 274 | 2974 | 1626 | 4317 | 347 | 3046 | 1699 | 4389 |
| 275 | 2975 | 1627 | 4318 | 348 | 3047 | 1700 | 4390 |
| 276 | 2976 | 1628 | 4319 | 349 | 3048 | 1701 | 4391 |
| 277 | 2977 | 1629 | 4320 | 350 | 3049 | 1702 | 4392 |
| 278 | 2978 | 1630 | 4321 | 351 | 3050 | 1703 | 4393 |
| 279 | 2979 | 1631 | 4322 | 352 | 3051 | 1704 | 4394 |
| 280 | 2980 | 1632 | 4323 | 353 | 3052 | 1705 | 4395 |
| 281 | 2981 | 1633 | 4324 | 354 | 3053 | 1706 | 4396 |
| 282 | 2982 | 1634 | 4325 | 355 | 3054 | 1707 | 4397 |
| 283 | 2983 | 1635 | 4326 | 356 | 3055 | 1708 | 4398 |
| 284 | 2984 | 1636 | 4327 | 357 | 3056 | 1709 | 4399 |
| 285 | 2985 | 1637 | 4328 | 358 | 3057 | 1710 | 4400 |
| 286 | 2986 | 1638 | 4329 | 359 | 3058 | 1711 | 4401 |
| 287 | 2987 | 1639 | 4330 | 360 | 3059 | 1712 | NONE |
| 288 | 2988 | 1640 | 4331 | 361 | 3060 | 1713 | 4402 |
| 289 | 2989 | 1641 | 4332 | 362 | 3061 | 1714 | 4403 |
| 290 | 2990 | 1642 | 4333 | 363 | 3062 | 1715 | 4404 |
| 291 | 2991 | 1643 | 4334 | 364 | 3063 | 1716 | 4405 |
| 292 | 2992 | 1644 | 4335 | 365 | 3064 | 1717 | 4406 |
| 293 | 2993 | 1645 | 4336 | 366 | 3065 | 1718 | 4407 |
| 294 | 2994 | 1646 | 4337 | 367 | 3066 | 1719 | 4408 |
| 295 | 2995 | 1647 | 4338 | 368 | 3067 | 1720 | 4409 |
| 296 | 2996 | 1648 | 4339 | 369 | 3068 | 1721 | 4410 |
| 297 | 2997 | 1649 | 4340 | 370 | 3069 | 1722 | 4411 |
| 298 | 2998 | 1650 | 4341 | 371 | 3070 | 1723 | 4412 |
| 299 | 2999 | 1651 | 4342 | 372 | 3071 | 1724 | 4413 |
| 300 | 3000 | 1652 | 4343 | 373 | 3072 | 1725 | 4414 |
| 301 | 3001 | 1653 | 4344 | 374 | 3073 | 1726 | 4415 |

TABLE 2-continued

ABIOTIC STRESS RESPONSIVE GENE REGULATORY SEQUENCES

| SEQ ID NO | REGULATORY REGION | SEQ ID NO | REGULATORY REGION |
|---|---|---|---|
| 375 | 3074 | 1727 | 4416 |
| 376 | 3075 | 1728 | 4417 |
| 377 | 3076 | 1729 | 4418 |
| 378 | 3077 | 1730 | 4419 |
| 379 | 3078 | 1731 | 4420 |
| 380 | 3079 | 1732 | 4421 |
| 381 | 3080 | 1733 | 4422 |
| 382 | 3081 | 1734 | 4423 |
| 383 | 3082 | 1735 | 4424 |
| 384 | 3083 | 1736 | 4425 |
| 385 | 3084 | 1737 | 4426 |
| 386 | 3085 | 1738 | 4427 |
| 387 | 3086 | 1739 | 4428 |
| 388 | 3087 | 1740 | 4429 |
| 389 | 3088 | 1741 | 4430 |
| 390 | 3089 | 1742 | 4431 |
| 391 | 3090 | 1743 | 4432 |
| 392 | 3091 | 1744 | 4433 |
| 393 | 3092 | 1745 | 4434 |
| 394 | 3093 | 1746 | 4435 |
| 395 | 3094 | 1747 | 4436 |
| 396 | 3095 | 1748 | 4437 |
| 397 | 3096 | 1749 | 4438 |
| 398 | 3097 | 1750 | 4439 |
| 399 | 3098 | 1751 | 4440 |
| 400 | 3099 | 1752 | 4441 |
| 401 | 3100 | 1753 | 4442 |
| 402 | 3101 | 1754 | 4443 |
| 403 | 3102 | 1755 | 4444 |
| 404 | 3103 | 1756 | 4445 |
| 405 | 3104 | 1757 | 4446 |
| 406 | 3105 | 1758 | 4447 |
| 407 | 3106 | 1759 | 4448 |
| 408 | 3107 | 1760 | 4449 |
| 409 | 3108 | 1761 | 4450 |
| 410 | 3109 | 1762 | 4451 |
| 411 | 3110 | 1763 | 4452 |
| 412 | 3111 | 1764 | 4453 |
| 413 | 3112 | 1765 | 4454 |
| 414 | 3113 | 1766 | 4455 |
| 415 | 3114 | 1767 | 4456 |
| 416 | 3115 | 1768 | 4457 |
| 417 | 3116 | 1769 | 4458 |
| 418 | 3117 | 1770 | 4459 |
| 419 | 3118 | 1771 | 4460 |
| 420 | 3119 | 1772 | 4461 |
| 421 | 3120 | 1773 | 4462 |
| 422 | 3121 | 1774 | 4463 |
| 423 | 3122 | 1775 | 4464 |
| 424 | 3123 | 1776 | 4465 |
| 425 | 3124 | 1777 | 4466 |
| 426 | 3125 | 1778 | 4467 |
| 427 | 3126 | 1779 | 4468 |
| 428 | 3127 | 1780 | 4469 |
| 429 | 3128 | 1781 | 4470 |
| 430 | 3129 | 1782 | 4471 |
| 431 | 3130 | 1783 | 4472 |
| 432 | 3131 | 1784 | NONE |
| 433 | 3132 | 1785 | 4473 |
| 434 | 3133 | 1786 | 4474 |
| 435 | 3134 | 1787 | 4475 |
| 436 | 3135 | 1788 | 4476 |
| 437 | 3136 | 1789 | 4477 |
| 438 | 3137 | 1790 | 4478 |
| 439 | 3138 | 1791 | 4479 |
| 440 | 3139 | 1792 | 4480 |
| 441 | 3140 | 1793 | 4481 |
| 442 | 3141 | 1794 | 4482 |
| 443 | 3142 | 1795 | 4483 |
| 444 | 3143 | 1796 | 4484 |
| 445 | 3144 | 1797 | 4485 |
| 446 | 3145 | 1798 | 4486 |
| 447 | 3146 | 1799 | 4487 |
| 448 | 3147 | 1800 | 4488 |
| 449 | 3148 | 1801 | 4489 |
| 450 | 3149 | 1802 | 4490 |
| 451 | 3150 | 1803 | NONE |
| 452 | 3151 | 1804 | 4491 |
| 453 | 3152 | 1805 | 4492 |
| 454 | 3153 | 1806 | 4493 |
| 455 | 3154 | 1807 | 4494 |
| 456 | 3155 | 1808 | 4495 |
| 457 | 3156 | 1809 | 4496 |
| 458 | 3157 | 1810 | 4497 |
| 459 | 3158 | 1811 | 4498 |
| 460 | 3159 | 1812 | 4499 |
| 461 | 3160 | 1813 | 4500 |
| 462 | 3161 | 1814 | 4501 |
| 463 | 3162 | 1815 | 4502 |
| 464 | 3163 | 1816 | 4503 |
| 465 | 3164 | 1817 | 4504 |
| 466 | 3165 | 1818 | 4505 |
| 467 | 3166 | 1819 | 4506 |
| 468 | 3167 | 1820 | 4507 |
| 469 | 3168 | 1821 | 4508 |
| 470 | 3169 | 1822 | 4509 |
| 471 | 3170 | 1823 | 4510 |
| 472 | 3171 | 1824 | 4511 |
| 473 | 3172 | 1825 | 4512 |
| 474 | 3173 | 1826 | 4513 |
| 475 | 3174 | 1827 | 4514 |
| 476 | 3175 | 1828 | 4515 |
| 477 | 3176 | 1829 | 4516 |
| 478 | 3177 | 1830 | 4517 |
| 479 | 3178 | 1831 | 4518 |
| 480 | 3179 | 1832 | 4519 |
| 481 | 3180 | 1833 | 4520 |
| 482 | 3181 | 1834 | 4521 |
| 483 | 3182 | 1835 | 4522 |
| 484 | 3183 | 1836 | 4523 |
| 485 | 3184 | 1837 | 4524 |
| 486 | 3185 | 1838 | 4525 |
| 487 | 3186 | 1839 | 4526 |
| 488 | 3187 | 1840 | 4527 |
| 489 | 3188 | 1841 | 4528 |
| 490 | 3189 | 1842 | 4529 |
| 491 | 3190 | 1843 | 4530 |
| 492 | 3191 | 1844 | 4531 |
| 493 | 3192 | 1845 | 4532 |
| 494 | 3193 | 1846 | 4533 |
| 495 | 3194 | 1847 | 4534 |
| 496 | 3195 | 1848 | 4535 |
| 497 | 3196 | 1849 | 4536 |
| 498 | 3197 | 1850 | 4537 |
| 499 | 3198 | 1851 | 4538 |
| 500 | 3199 | 1852 | 4539 |
| 501 | 3200 | 1853 | 4540 |
| 502 | 3201 | 1854 | 4541 |
| 503 | 3202 | 1855 | 4542 |
| 504 | 3203 | 1856 | 4543 |
| 505 | 3204 | 1857 | 4544 |
| 506 | 3205 | 1858 | 4545 |
| 507 | 3206 | 1859 | 4546 |
| 508 | 3207 | 1860 | 4547 |
| 509 | 3208 | 1861 | 4548 |
| 510 | 3209 | 1862 | 4549 |
| 511 | 3210 | 1863 | 4550 |
| 512 | 3211 | 1864 | 4551 |
| 513 | 3212 | 1865 | 4552 |
| 514 | 3213 | 1866 | 4553 |
| 515 | 3214 | 1867 | 4554 |
| 516 | 3215 | 1868 | 4555 |
| 517 | 3216 | 1869 | 4556 |
| 518 | 3217 | 1870 | 4557 |
| 519 | 3218 | 1871 | 4558 |
| 520 | 3219 | 1872 | 4559 |

TABLE 2-continued

ABIOTIC STRESS RESPONSIVE GENE REGULATORY SEQUENCES

| SEQ ID NO | REGULATORY REGION | SEQ ID NO | REGULATORY REGION |
|---|---|---|---|
| 521 | 3220 | 1873 | 4560 |
| 522 | 3221 | 1874 | 4561 |
| 523 | 3222 | 1875 | 4562 |
| 524 | 3223 | 1876 | 4563 |
| 525 | 3224 | 1877 | 4564 |
| 526 | 3225 | 1878 | 4565 |
| 527 | 3226 | 1879 | 4566 |
| 528 | 3227 | 1880 | 4567 |
| 529 | 3228 | 1881 | 4568 |
| 530 | 3229 | 1882 | 4569 |
| 531 | 3230 | 1883 | 4570 |
| 532 | 3231 | 1884 | 4571 |
| 533 | 3232 | 1885 | 4572 |
| 534 | 3233 | 1886 | 4573 |
| 535 | 3234 | 1887 | 4574 |
| 536 | 3235 | 1888 | 4575 |
| 537 | 3236 | 1889 | 4576 |
| 538 | 3237 | 1890 | 4577 |
| 539 | 3238 | 1891 | 4578 |
| 540 | 3239 | 1892 | 4579 |
| 541 | 3240 | 1893 | 4580 |
| 542 | 3241 | 1894 | 4581 |
| 543 | 3242 | 1895 | 4582 |
| 544 | 3243 | 1896 | 4583 |
| 545 | 3244 | 1897 | NONE |
| 546 | 3245 | 1898 | 4584 |
| 547 | 3246 | 1899 | 4585 |
| 548 | 3247 | 1900 | 4586 |
| 549 | 3248 | 1901 | 4587 |
| 550 | 3249 | 1902 | 4588 |
| 551 | 3250 | 1903 | 4589 |
| 552 | 3251 | 1904 | 4590 |
| 553 | 3252 | 1905 | 4591 |
| 554 | 3253 | 1906 | 4592 |
| 555 | 3254 | 1907 | NONE |
| 556 | 3255 | 1908 | 4593 |
| 557 | 3256 | 1909 | 4594 |
| 558 | 3257 | 1910 | 4595 |
| 559 | 3258 | 1911 | 4596 |
| 560 | 3259 | 1912 | 4597 |
| 561 | 3260 | 1913 | 4598 |
| 562 | 3261 | 1914 | 4599 |
| 563 | 3262 | 1915 | 4600 |
| 564 | 3263 | 1916 | 4601 |
| 565 | 3264 | 1917 | 4602 |
| 566 | 3265 | 1918 | 4603 |
| 567 | 3266 | 1919 | 4604 |
| 568 | 3267 | 1920 | 4605 |
| 569 | 3268 | 1921 | 4606 |
| 570 | 3269 | 1922 | 4607 |
| 571 | 3270 | 1923 | 4608 |
| 572 | 3271 | 1924 | 4609 |
| 573 | 3272 | 1925 | 4610 |
| 574 | 3273 | 1926 | 4611 |
| 575 | 3274 | 1927 | 4612 |
| 576 | 3275 | 1928 | 4613 |
| 577 | 3276 | 1929 | 4614 |
| 578 | 3277 | 1930 | 4615 |
| 579 | 3278 | 1931 | 4616 |
| 580 | 3279 | 1932 | 4617 |
| 581 | 3280 | 1933 | 4618 |
| 582 | 3281 | 1934 | 4619 |
| 583 | 3282 | 1935 | 4620 |
| 584 | 3283 | 1936 | 4621 |
| 585 | 3284 | 1937 | 4622 |
| 586 | 3285 | 1938 | 4623 |
| 587 | 3286 | 1939 | 4624 |
| 588 | 3287 | 1940 | 4625 |
| 589 | 3288 | 1941 | 4626 |
| 590 | 3289 | 1942 | 4627 |
| 591 | 3290 | 1943 | 4628 |
| 592 | 3291 | 1944 | 4629 |
| 593 | 3292 | 1945 | 4630 |
| 594 | 3293 | 1946 | 4631 |
| 595 | 3294 | 1947 | 4632 |
| 596 | 3295 | 1948 | 4633 |
| 597 | 3296 | 1949 | 4634 |
| 598 | 3297 | 1950 | 4635 |
| 599 | 3298 | 1951 | 4636 |
| 600 | 3299 | 1952 | 4637 |
| 601 | 3300 | 1953 | 4638 |
| 602 | 3301 | 1954 | 4639 |
| 603 | 3302 | 1955 | 4640 |
| 604 | 3303 | 1956 | 4641 |
| 605 | 3304 | 1957 | 4642 |
| 606 | 3305 | 1958 | 4643 |
| 607 | 3306 | 1959 | 4644 |
| 608 | 3307 | 1960 | 4645 |
| 609 | 3308 | 1961 | 4646 |
| 610 | 3309 | 1962 | 4647 |
| 611 | 3310 | 1963 | 4648 |
| 612 | 3311 | 1964 | 4649 |
| 613 | 3312 | 1965 | 4650 |
| 614 | 3313 | 1966 | 4651 |
| 615 | 3314 | 1967 | 4652 |
| 616 | 3315 | 1968 | 4653 |
| 617 | 3316 | 1969 | 4654 |
| 618 | 3317 | 1970 | 4655 |
| 619 | 3318 | 1971 | 4656 |
| 620 | 3319 | 1972 | 4657 |
| 621 | 3320 | 1973 | 4658 |
| 622 | 3321 | 1974 | 4659 |
| 623 | 3322 | 1975 | 4660 |
| 624 | 3323 | 1976 | 4661 |
| 625 | 3324 | 1977 | 4662 |
| 626 | 3325 | 1978 | 4663 |
| 627 | 3326 | 1979 | 4664 |
| 628 | 3327 | 1980 | 4665 |
| 629 | 3328 | 1981 | 4666 |
| 630 | 3329 | 1982 | 4667 |
| 631 | 3330 | 1983 | 4668 |
| 632 | 3331 | 1984 | 4669 |
| 633 | 3332 | 1985 | 4670 |
| 634 | 3333 | 1986 | 4671 |
| 635 | 3334 | 1987 | 4672 |
| 636 | 3335 | 1988 | 4673 |
| 637 | 3336 | 1989 | 4674 |
| 638 | 3337 | 1990 | 4675 |
| 639 | 3338 | 1991 | 4676 |
| 640 | 3339 | 1992 | 4677 |
| 641 | 3340 | 1993 | 4678 |
| 642 | 3341 | 1994 | 4679 |
| 643 | 3342 | 1995 | 4680 |
| 644 | 3343 | 1996 | 4681 |
| 645 | 3344 | 1997 | 4682 |
| 646 | 3345 | 1998 | 4683 |
| 647 | 3346 | 1999 | 4684 |
| 648 | 3347 | 2000 | 4685 |
| 649 | 3348 | 2001 | 4686 |
| 650 | 3349 | 2002 | 4687 |
| 651 | 3350 | 2003 | 4688 |
| 652 | 3351 | 2004 | 4689 |
| 653 | 3352 | 2005 | 4690 |
| 654 | 3353 | 2006 | 4691 |
| 655 | 3354 | 2007 | 4692 |
| 656 | 3355 | 2008 | 4693 |
| 657 | 3356 | 2009 | 4694 |
| 658 | 3357 | 2010 | 4695 |
| 659 | 3358 | 2011 | 4696 |
| 660 | 3359 | 2012 | 4697 |
| 661 | 3360 | 2013 | 4698 |
| 662 | 3361 | 2014 | 4699 |
| 663 | 3362 | 2015 | 4700 |
| 664 | 3363 | 2016 | 4701 |
| 665 | 3364 | 2017 | 4702 |
| 666 | 3365 | 2018 | 4703 |

TABLE 2-continued

ABIOTIC STRESS RESPONSIVE GENE REGULATORY SEQUENCES

| SEQ ID NO | REGULATORY REGION | SEQ ID NO | REGULATORY REGION |
|---|---|---|---|
| 667 | 3366 | 2019 | 4704 |
| 668 | 3367 | 2020 | 4705 |
| 669 | 3368 | 2021 | 4706 |
| 670 | 3369 | 2022 | 4707 |
| 671 | 3370 | 2023 | 4708 |
| 672 | 3371 | 2024 | 4709 |
| 673 | 3372 | 2025 | 4710 |
| 674 | 3373 | 2026 | 4711 |
| 675 | 3374 | 2027 | 4712 |
| 676 | 3375 | 2028 | 4713 |
| 677 | 3376 | 2029 | 4714 |
| 678 | 3377 | 2030 | NONE |
| 679 | 3378 | 2031 | 4715 |
| 680 | 3379 | 2032 | 4716 |
| 681 | 3380 | 2033 | 4717 |
| 682 | 3381 | 2034 | 4718 |
| 683 | 3382 | 2035 | 4719 |
| 684 | 3383 | 2036 | 4720 |
| 685 | 3384 | 2037 | 4721 |
| 686 | 3385 | 2038 | 4722 |
| 687 | 3386 | 2039 | 4723 |
| 688 | 3387 | 2040 | 4724 |
| 689 | 3388 | 2041 | 4725 |
| 690 | 3389 | 2042 | 4726 |
| 691 | 3390 | 2043 | 4727 |
| 692 | 3391 | 2044 | 4728 |
| 693 | 3392 | 2045 | 4729 |
| 694 | 3393 | 2046 | 4730 |
| 695 | 3394 | 2047 | 4731 |
| 696 | 3395 | 2048 | 4732 |
| 697 | 3396 | 2049 | 4733 |
| 698 | 3397 | 2050 | 4734 |
| 699 | 3398 | 2051 | 4735 |
| 700 | 3399 | 2052 | 4736 |
| 701 | 3400 | 2053 | 4737 |
| 702 | 3401 | 2054 | 4738 |
| 703 | 3402 | 2055 | 4739 |
| 704 | 3403 | 2056 | 4740 |
| 705 | 3404 | 2057 | 4741 |
| 706 | 3405 | 2058 | 4742 |
| 707 | 3406 | 2059 | 4743 |
| 708 | 3407 | 2060 | 4744 |
| 709 | 3408 | 2061 | 4745 |
| 710 | 3409 | 2062 | 4746 |
| 711 | 3410 | 2063 | 4747 |
| 712 | 3411 | 2064 | 4748 |
| 713 | 3412 | 2065 | 4749 |
| 714 | 3413 | 2066 | 4750 |
| 715 | 3414 | 2067 | 4751 |
| 716 | 3415 | 2068 | 4752 |
| 717 | 3416 | 2069 | 4753 |
| 718 | 3417 | 2070 | 4754 |
| 719 | 3418 | 2071 | 4755 |
| 720 | 3419 | 2072 | 4756 |
| 721 | 3420 | 2073 | 4757 |
| 722 | 3421 | 2074 | 4758 |
| 723 | 3422 | 2075 | 4759 |
| 724 | 3423 | 2076 | 4760 |
| 725 | 3424 | 2077 | 4761 |
| 726 | 3425 | 2078 | 4762 |
| 727 | 3426 | 2079 | 4763 |
| 728 | 3427 | 2080 | 4764 |
| 729 | 3428 | 2081 | 4765 |
| 730 | 3429 | 2082 | 4766 |
| 731 | 3430 | 2083 | 4767 |
| 732 | 3431 | 2084 | 4768 |
| 733 | 3432 | 2085 | 4769 |
| 734 | 3433 | 2086 | 4770 |
| 735 | 3434 | 2087 | 4771 |
| 736 | 3435 | 2088 | 4772 |
| 737 | 3436 | 2089 | 4773 |
| 738 | 3437 | 2090 | 4774 |
| 739 | 3438 | 2091 | 4775 |
| 740 | 3439 | 2092 | 4776 |
| 741 | 3440 | 2093 | 4777 |
| 742 | 3441 | 2094 | 4778 |
| 743 | 3442 | 2095 | 4779 |
| 744 | 3443 | 2096 | 4780 |
| 745 | 3444 | 2097 | 4781 |
| 746 | 3445 | 2098 | 4782 |
| 747 | 3446 | 2099 | 4783 |
| 748 | 3447 | 2100 | 4784 |
| 749 | 3448 | 2101 | 4785 |
| 750 | 3449 | 2102 | 4786 |
| 751 | 3450 | 2103 | 4787 |
| 752 | 3451 | 2104 | 4788 |
| 753 | 3452 | 2105 | 4789 |
| 754 | 3453 | 2106 | 4790 |
| 755 | 3454 | 2107 | 4791 |
| 756 | 3455 | 2108 | 4792 |
| 757 | 3456 | 2109 | 4793 |
| 758 | 3457 | 2110 | 4794 |
| 759 | 3458 | 2111 | 4795 |
| 760 | 3459 | 2112 | 4796 |
| 761 | 3460 | 2113 | 4797 |
| 762 | 3461 | 2114 | 4798 |
| 763 | 3462 | 2115 | 4799 |
| 764 | 3463 | 2116 | 4800 |
| 765 | 3464 | 2117 | 4801 |
| 766 | 3465 | 2118 | 4802 |
| 767 | 3466 | 2119 | 4803 |
| 768 | 3467 | 2120 | 4804 |
| 769 | 3468 | 2121 | 4805 |
| 770 | 3469 | 2122 | 4806 |
| 771 | 3470 | 2123 | 4807 |
| 772 | 3471 | 2124 | 4808 |
| 773 | 3472 | 2125 | 4809 |
| 774 | 3473 | 2126 | 4810 |
| 775 | 3474 | 2127 | 4811 |
| 776 | 3475 | 2128 | 4812 |
| 777 | 3476 | 2129 | 4813 |
| 778 | 3477 | 2130 | 4814 |
| 779 | 3478 | 2131 | 4815 |
| 780 | 3479 | 2132 | 4816 |
| 781 | 3480 | 2133 | 4817 |
| 782 | 3481 | 2134 | 4818 |
| 783 | 3482 | 2135 | 4819 |
| 784 | 3483 | 2136 | 4820 |
| 785 | 3484 | 2137 | 4821 |
| 786 | 3485 | 2138 | 4822 |
| 787 | 3486 | 2139 | 4823 |
| 788 | 3487 | 2140 | 4824 |
| 789 | 3488 | 2141 | 4825 |
| 790 | 3489 | 2142 | 4826 |
| 791 | 3490 | 2143 | 4827 |
| 792 | 3491 | 2144 | 4828 |
| 793 | 3492 | 2145 | 4829 |
| 794 | 3493 | 2146 | 4830 |
| 795 | 3494 | 2147 | 4831 |
| 796 | 3495 | 2148 | 4832 |
| 797 | 3496 | 2149 | 4833 |
| 798 | 3497 | 2150 | 4834 |
| 799 | 3498 | 2151 | NONE |
| 800 | 3499 | 2152 | 4835 |
| 801 | 3500 | 2153 | 4836 |
| 802 | 3501 | 2154 | 4837 |
| 803 | 3502 | 2155 | 4838 |
| 804 | 3503 | 2156 | 4839 |
| 805 | 3504 | 2157 | 4840 |
| 806 | 3505 | 2158 | 4841 |
| 807 | 3506 | 2159 | 4842 |
| 808 | 3507 | 2160 | 4843 |
| 809 | 3508 | 2161 | 4844 |
| 810 | 3509 | 2162 | 4845 |
| 811 | 3510 | 2163 | 4846 |
| 812 | 3511 | 2164 | 4847 |

TABLE 2-continued

ABIOTIC STRESS RESPONSIVE GENE REGULATORY SEQUENCES

| SEQ ID NO | REGULATORY REGION | SEQ ID NO | REGULATORY REGION |
|---|---|---|---|
| 813 | 3512 | 2165 | 4848 |
| 814 | 3513 | 2166 | 4849 |
| 815 | 3514 | 2167 | 4850 |
| 816 | 3515 | 2168 | 4851 |
| 817 | 3516 | 2169 | 4852 |
| 818 | 3517 | 2170 | 4853 |
| 819 | 3518 | 2171 | 4854 |
| 820 | 3519 | 2172 | 4855 |
| 821 | 3520 | 2173 | 4856 |
| 822 | 3521 | 2174 | 4857 |
| 823 | 3522 | 2175 | 4858 |
| 824 | 3523 | 2176 | 4859 |
| 825 | 3524 | 2177 | 4860 |
| 826 | 3525 | 2178 | 4861 |
| 827 | 3526 | 2179 | 4862 |
| 828 | 3527 | 2180 | 4863 |
| 829 | 3528 | 2181 | 4864 |
| 830 | 3529 | 2182 | 4865 |
| 831 | 3530 | 2183 | 4866 |
| 832 | 3531 | 2184 | 4867 |
| 833 | 3532 | 2185 | 4868 |
| 834 | 3533 | 2186 | 4869 |
| 835 | 3534 | 2187 | 4870 |
| 836 | 3535 | 2188 | 4871 |
| 837 | 3536 | 2189 | 4872 |
| 838 | 3537 | 2190 | 4873 |
| 839 | 3538 | 2191 | 4874 |
| 840 | 3539 | 2192 | 4875 |
| 841 | 3540 | 2193 | 4876 |
| 842 | 3541 | 2194 | 4877 |
| 843 | 3542 | 2195 | 4878 |
| 844 | 3543 | 2196 | 4879 |
| 845 | 3544 | 2197 | 4880 |
| 846 | 3545 | 2198 | 4881 |
| 847 | 3546 | 2199 | 4882 |
| 848 | 3547 | 2200 | 4883 |
| 849 | 3548 | 2201 | 4884 |
| 850 | 3549 | 2202 | 4885 |
| 851 | 3550 | 2203 | 4886 |
| 852 | 3551 | 2204 | 4887 |
| 853 | 3552 | 2205 | 4888 |
| 854 | 3553 | 2206 | 4889 |
| 855 | 3554 | 2207 | 4890 |
| 856 | 3555 | 2208 | 4891 |
| 857 | 3556 | 2209 | 4892 |
| 858 | 3557 | 2210 | 4893 |
| 859 | 3558 | 2211 | 4894 |
| 860 | 3559 | 2212 | 4895 |
| 861 | 3560 | 2213 | 4896 |
| 862 | 3561 | 2214 | 4897 |
| 863 | 3562 | 2215 | 4898 |
| 864 | 3563 | 2216 | 4899 |
| 865 | 3564 | 2217 | 4900 |
| 866 | 3565 | 2218 | 4901 |
| 867 | 3566 | 2219 | 4902 |
| 868 | 3567 | 2220 | 4903 |
| 869 | 3568 | 2221 | 4904 |
| 870 | 3569 | 2222 | 4905 |
| 871 | 3570 | 2223 | 4906 |
| 872 | 3571 | 2224 | 4907 |
| 873 | 3572 | 2225 | 4908 |
| 874 | 3573 | 2226 | 4909 |
| 875 | 3574 | 2227 | 4910 |
| 876 | 3575 | 2228 | 4911 |
| 877 | 3576 | 2229 | 4912 |
| 878 | 3577 | 2230 | 4913 |
| 879 | 3578 | 2231 | 4914 |
| 880 | 3579 | 2232 | 4915 |
| 881 | 3580 | 2233 | 4916 |
| 882 | 3581 | 2234 | 4917 |
| 883 | 3582 | 2235 | 4918 |
| 884 | 3583 | 2236 | 4919 |
| 885 | 3584 | 2237 | 4920 |
| 886 | 3585 | 2238 | 4921 |
| 887 | NONE | 2239 | 4922 |
| 888 | 3586 | 2240 | 4923 |
| 889 | 3587 | 2241 | 4924 |
| 890 | 3588 | 2242 | 4925 |
| 891 | 3589 | 2243 | 4926 |
| 892 | 3590 | 2244 | 4927 |
| 893 | 3591 | 2245 | 4928 |
| 894 | NONE | 2246 | 4929 |
| 895 | NONE | 2247 | 4930 |
| 896 | 3592 | 2248 | NONE |
| 897 | 3593 | 2249 | 4931 |
| 898 | 3594 | 2250 | 4932 |
| 899 | 3595 | 2251 | 4933 |
| 900 | 3596 | 2252 | 4934 |
| 901 | 3597 | 2253 | 4935 |
| 902 | 3598 | 2254 | 4936 |
| 903 | 3599 | 2255 | 4937 |
| 904 | 3600 | 2256 | 4938 |
| 905 | 3601 | 2257 | 4939 |
| 906 | 3602 | 2258 | 4940 |
| 907 | 3603 | 2259 | 4941 |
| 908 | 3604 | 2260 | 4942 |
| 909 | 3605 | 2261 | 4943 |
| 910 | 3606 | 2262 | 4944 |
| 911 | 3607 | 2263 | 4945 |
| 912 | 3608 | 2264 | 4946 |
| 913 | 3609 | 2265 | 4947 |
| 914 | 3610 | 2266 | 4948 |
| 915 | 3611 | 2267 | 4949 |
| 916 | 3612 | 2268 | 4950 |
| 917 | 3613 | 2269 | 4951 |
| 918 | 3614 | 2270 | 4952 |
| 919 | 3615 | 2271 | 4953 |
| 920 | 3616 | 2272 | 4954 |
| 921 | 3617 | 2273 | 4955 |
| 922 | 3618 | 2274 | 4956 |
| 923 | 3619 | 2275 | 4957 |
| 924 | 3620 | 2276 | 4958 |
| 925 | 3621 | 2277 | 4959 |
| 926 | 3622 | 2278 | 4960 |
| 927 | 3623 | 2279 | 4961 |
| 928 | 3624 | 2280 | 4962 |
| 929 | 3625 | 2281 | 4963 |
| 930 | 3626 | 2282 | 4964 |
| 931 | 3627 | 2283 | 4965 |
| 932 | 3628 | 2284 | 4966 |
| 933 | 3629 | 2285 | 4967 |
| 934 | 3630 | 2286 | 4968 |
| 935 | NONE | 2287 | 4969 |
| 936 | 3631 | 2288 | 4970 |
| 937 | 3632 | 2289 | 4971 |
| 938 | 3633 | 2290 | 4972 |
| 939 | 3634 | 2291 | 4973 |
| 940 | 3635 | 2292 | 4974 |
| 941 | 3636 | 2293 | 4975 |
| 942 | 3637 | 2294 | 4976 |
| 943 | 3638 | 2295 | 4977 |
| 944 | 3639 | 2296 | 4978 |
| 945 | 3640 | 2297 | 4979 |
| 946 | 3641 | 2298 | 4980 |
| 947 | 3642 | 2299 | 4981 |
| 948 | 3643 | 2300 | 4982 |
| 949 | 3644 | 2301 | 4983 |
| 950 | 3645 | 2302 | 4984 |
| 951 | 3646 | 2303 | 4985 |
| 952 | 3647 | 2304 | 4986 |
| 953 | 3648 | 2305 | 4987 |
| 954 | 3649 | 2306 | 4988 |
| 955 | 3650 | 2307 | 4989 |
| 956 | 3651 | 2308 | 4990 |
| 957 | 3652 | 2309 | 4991 |
| 958 | 3653 | 2310 | 4992 |

TABLE 2-continued

ABIOTIC STRESS RESPONSIVE
GENE REGULATORY SEQUENCES

| SEQ ID NO | REGULATORY REGION | SEQ ID NO | REGULATORY REGION |
|---|---|---|---|
| 959 | 3654 | 2311 | 4993 |
| 960 | 3655 | 2312 | 4994 |
| 961 | 3656 | 2313 | 4995 |
| 962 | 3657 | 2314 | 4996 |
| 963 | 3658 | 2315 | 4997 |
| 964 | 3659 | 2316 | 4998 |
| 965 | 3660 | 2317 | 4999 |
| 966 | 3661 | 2318 | 5000 |
| 967 | 3662 | 2319 | 5001 |
| 968 | 3663 | 2320 | 5002 |
| 969 | 3664 | 2321 | 5003 |
| 970 | 3665 | 2322 | 5004 |
| 971 | 3666 | 2323 | 5005 |
| 972 | 3667 | 2324 | 5006 |
| 973 | 3668 | 2325 | 5007 |
| 974 | 3669 | 2326 | 5008 |
| 975 | 3670 | 2327 | 5009 |
| 976 | 3671 | 2328 | 5010 |
| 977 | 3672 | 2329 | 5011 |
| 978 | 3673 | 2330 | 5012 |
| 979 | 3674 | 2331 | 5013 |
| 980 | 3675 | 2332 | 5014 |
| 981 | 3676 | 2333 | 5015 |
| 982 | 3677 | 2334 | 5016 |
| 983 | 3678 | 2335 | 5017 |
| 984 | 3679 | 2336 | 5018 |
| 985 | 3680 | 2337 | 5019 |
| 986 | 3681 | 2338 | 5020 |
| 987 | 3682 | 2339 | 5021 |
| 988 | 3683 | 2340 | NONE |
| 989 | 3684 | 2341 | 5022 |
| 990 | 3685 | 2342 | 5023 |
| 991 | 3686 | 2343 | 5024 |
| 992 | 3687 | 2344 | 5025 |
| 993 | 3688 | 2345 | 5026 |
| 994 | 3689 | 2346 | 5027 |
| 995 | 3690 | 2347 | 5028 |
| 996 | 3691 | 2348 | 5029 |
| 997 | 3692 | 2349 | 5030 |
| 998 | 3693 | 2350 | 5031 |
| 999 | 3694 | 2351 | 5032 |
| 1000 | 3695 | 2352 | 5033 |
| 1001 | 3696 | 2353 | 5034 |
| 1002 | 3697 | 2354 | 5035 |
| 1003 | 3698 | 2355 | 5036 |
| 1004 | 3699 | 2356 | 5037 |
| 1005 | 3700 | 2357 | 5038 |
| 1006 | 3701 | 2358 | 5039 |
| 1007 | 3702 | 2359 | 5040 |
| 1008 | 3703 | 2360 | 5041 |
| 1009 | 3704 | 2361 | 5042 |
| 1010 | 3705 | 2362 | 5043 |
| 1011 | 3706 | 2363 | 5044 |
| 1012 | 3707 | 2364 | 5045 |
| 1013 | 3708 | 2365 | 5046 |
| 1014 | 3709 | 2366 | 5047 |
| 1015 | 3710 | 2367 | 5048 |
| 1016 | 3711 | 2368 | 5049 |
| 1017 | 3712 | 2369 | 5050 |
| 1018 | 3713 | 2370 | 5051 |
| 1019 | 3714 | 2371 | NONE |
| 1020 | 3715 | 2372 | 5052 |
| 1021 | 3716 | 2373 | 5053 |
| 1022 | 3717 | 2374 | 5054 |
| 1023 | 3718 | 2375 | 5055 |
| 1024 | 3719 | 2376 | 5056 |
| 1025 | 3720 | 2377 | 5057 |
| 1026 | 3721 | 2378 | 5058 |
| 1027 | 3722 | 2379 | 5059 |
| 1028 | 3723 | 2380 | 5060 |
| 1029 | 3724 | 2381 | 5061 |
| 1030 | 3725 | 2382 | 5062 |
| 1031 | 3726 | 2383 | 5063 |
| 1032 | 3727 | 2384 | 5064 |
| 1033 | 3728 | 2385 | 5065 |
| 1034 | 3729 | 2386 | 5066 |
| 1035 | 3730 | 2387 | 5067 |
| 1036 | 3731 | 2388 | 5068 |
| 1037 | 3732 | 2389 | 5069 |
| 1038 | 3733 | 2390 | 5070 |
| 1039 | 3734 | 2391 | 5071 |
| 1040 | 3735 | 2392 | 5072 |
| 1041 | 3736 | 2393 | 5073 |
| 1042 | 3737 | 2394 | 5074 |
| 1043 | 3738 | 2395 | 5075 |
| 1044 | 3739 | 2396 | 5076 |
| 1045 | 3740 | 2397 | 5077 |
| 1046 | 3741 | 2398 | 5078 |
| 1047 | 3742 | 2399 | 5079 |
| 1048 | 3743 | 2400 | 5080 |
| 1049 | 3744 | 2401 | 5081 |
| 1050 | 3745 | 2402 | 5082 |
| 1051 | 3746 | 2403 | 5083 |
| 1052 | 3747 | 2404 | 5084 |
| 1053 | 3748 | 2405 | 5085 |
| 1054 | 3749 | 2406 | 5086 |
| 1055 | 3750 | 2407 | 5087 |
| 1056 | 3751 | 2408 | 5088 |
| 1057 | 3752 | 2409 | 5089 |
| 1058 | 3753 | 2410 | 5090 |
| 1059 | 3754 | 2411 | 5091 |
| 1060 | 3755 | 2412 | 5092 |
| 1061 | 3756 | 2413 | 5093 |
| 1062 | 3757 | 2414 | 5094 |
| 1063 | 3758 | 2415 | 5095 |
| 1064 | 3759 | 2416 | 5096 |
| 1065 | 3760 | 2417 | 5097 |
| 1066 | 3761 | 2418 | 5098 |
| 1067 | 3762 | 2419 | 5099 |
| 1068 | 3763 | 2420 | 5100 |
| 1069 | 3764 | 2421 | 5101 |
| 1070 | 3765 | 2422 | 5102 |
| 1071 | 3766 | 2423 | 5103 |
| 1072 | 3767 | 2424 | 5104 |
| 1073 | 3768 | 2425 | 5105 |
| 1074 | 3769 | 2426 | 5106 |
| 1075 | 3770 | 2427 | 5107 |
| 1076 | 3771 | 2428 | 5108 |
| 1077 | 3772 | 2429 | 5109 |
| 1078 | 3773 | 2430 | 5110 |
| 1079 | 3774 | 2431 | 5111 |
| 1080 | 3775 | 2432 | 5112 |
| 1081 | 3776 | 2433 | 5113 |
| 1082 | 3777 | 2434 | 5114 |
| 1083 | 3778 | 2435 | 5115 |
| 1084 | 3779 | 2436 | 5116 |
| 1085 | 3780 | 2437 | 5117 |
| 1086 | 3781 | 2438 | 5118 |
| 1087 | NONE | 2439 | 5119 |
| 1088 | 3782 | 2440 | 5120 |
| 1089 | 3783 | 2441 | 5121 |
| 1090 | 3784 | 2442 | 5122 |
| 1091 | 3785 | 2443 | NONE |
| 1092 | 3786 | 2444 | 5123 |
| 1093 | 3787 | 2445 | 5124 |
| 1094 | 3788 | 2446 | 5125 |
| 1095 | 3789 | 2447 | 5126 |
| 1096 | 3790 | 2448 | 5127 |
| 1097 | 3791 | 2449 | 5128 |
| 1098 | 3792 | 2450 | 5129 |
| 1099 | 3793 | 2451 | 5130 |
| 1100 | 3794 | 2452 | 5131 |
| 1101 | 3795 | 2453 | 5132 |
| 1102 | 3796 | 2454 | 5133 |
| 1103 | 3797 | 2455 | 5134 |
| 1104 | 3798 | 2456 | 5135 |

TABLE 2-continued

ABIOTIC STRESS RESPONSIVE GENE REGULATORY SEQUENCES

| SEQ ID NO | REGULATORY REGION | SEQ ID NO | REGULATORY REGION | SEQ ID NO | REGULATORY REGION | SEQ ID NO | REGULATORY REGION |
|---|---|---|---|---|---|---|---|
| 1105 | 3799 | 2457 | 5136 | 1178 | 3872 | 2530 | 5208 |
| 1106 | 3800 | 2458 | 5137 | 1179 | 3873 | 2531 | 5209 |
| 1107 | 3801 | 2459 | 5138 | 1180 | 3874 | 2532 | 5210 |
| 1108 | 3802 | 2460 | 5139 | 1181 | 3875 | 2533 | 5211 |
| 1109 | 3803 | 2461 | 5140 | 1182 | 3876 | 2534 | 5212 |
| 1110 | 3804 | 2462 | 5141 | 1183 | 3877 | 2535 | 5213 |
| 1111 | 3805 | 2463 | 5142 | 1184 | 3878 | 2536 | 5214 |
| 1112 | 3806 | 2464 | 5143 | 1185 | 3879 | 2537 | 5215 |
| 1113 | 3807 | 2465 | 5144 | 1186 | 3880 | 2538 | 5216 |
| 1114 | 3808 | 2466 | 5145 | 1187 | 3881 | 2539 | 5217 |
| 1115 | 3809 | 2467 | 5146 | 1188 | 3882 | 2540 | 5218 |
| 1116 | 3810 | 2468 | 5147 | 1189 | 3883 | 2541 | 5219 |
| 1117 | 3811 | 2469 | NONE | 1190 | 3884 | 2542 | 5220 |
| 1118 | 3812 | 2470 | 5148 | 1191 | 3885 | 2543 | 5221 |
| 1119 | 3813 | 2471 | 5149 | 1192 | 3886 | 2544 | 5222 |
| 1120 | 3814 | 2472 | 5150 | 1193 | 3887 | 2545 | 5223 |
| 1121 | 3815 | 2473 | 5151 | 1194 | 3888 | 2546 | 5224 |
| 1122 | 3816 | 2474 | 5152 | 1195 | 3889 | 2547 | 5225 |
| 1123 | 3817 | 2475 | 5153 | 1196 | 3890 | 2548 | 5226 |
| 1124 | 3818 | 2476 | 5154 | 1197 | 3891 | 2549 | 5227 |
| 1125 | 3819 | 2477 | 5155 | 1198 | 3892 | 2550 | 5228 |
| 1126 | 3820 | 2478 | 5156 | 1199 | 3893 | 2551 | 5229 |
| 1127 | 3821 | 2479 | 5157 | 1200 | 3894 | 2552 | 5230 |
| 1128 | 3822 | 2480 | 5158 | 1201 | 3895 | 2553 | 5231 |
| 1129 | 3823 | 2481 | 5159 | 1202 | 3896 | 2554 | 5232 |
| 1130 | 3824 | 2482 | 5160 | 1203 | 3897 | 2555 | 5233 |
| 1131 | 3825 | 2483 | 5161 | 1204 | 3898 | 2556 | 5234 |
| 1132 | 3826 | 2484 | 5162 | 1205 | 3899 | 2557 | 5235 |
| 1133 | 3827 | 2485 | 5163 | 1206 | 3900 | 2558 | 5236 |
| 1134 | 3828 | 2486 | 5164 | 1207 | 3901 | 2559 | 5237 |
| 1135 | 3829 | 2487 | 5165 | 1208 | 3902 | 2560 | 5238 |
| 1136 | 3830 | 2488 | 5166 | 1209 | 3903 | 2561 | 5239 |
| 1137 | 3831 | 2489 | 5167 | 1210 | 3904 | 2562 | 5240 |
| 1138 | 3832 | 2490 | 5168 | 1211 | 3905 | 2563 | 5241 |
| 1139 | 3833 | 2491 | 5169 | 1212 | 3906 | 2564 | 5242 |
| 1140 | 3834 | 2492 | 5170 | 1213 | 3907 | 2565 | 5243 |
| 1141 | 3835 | 2493 | 5171 | 1214 | 3908 | 2566 | 5244 |
| 1142 | 3836 | 2494 | 5172 | 1215 | 3909 | 2567 | 5245 |
| 1143 | 3837 | 2495 | 5173 | 1216 | 3910 | 2568 | 5246 |
| 1144 | 3838 | 2496 | 5174 | 1217 | 3911 | 2569 | 5247 |
| 1145 | 3839 | 2497 | 5175 | 1218 | 3912 | 2570 | 5248 |
| 1146 | 3840 | 2498 | 5176 | 1219 | 3913 | 2571 | 5249 |
| 1147 | 3841 | 2499 | 5177 | 1220 | 3914 | 2572 | 5250 |
| 1148 | 3842 | 2500 | 5178 | 1221 | 3915 | 2573 | 5251 |
| 1149 | 3843 | 2501 | 5179 | 1222 | 3916 | 2574 | 5252 |
| 1150 | 3844 | 2502 | 5180 | 1223 | 3917 | 2575 | 5253 |
| 1151 | 3845 | 2503 | 5181 | 1224 | 3918 | 2576 | 5254 |
| 1152 | 3846 | 2504 | 5182 | 1225 | 3919 | 2577 | 5255 |
| 1153 | 3847 | 2505 | 5183 | 1226 | 3920 | 2578 | 5256 |
| 1154 | 3848 | 2506 | 5184 | 1227 | 3921 | 2579 | 5257 |
| 1155 | 3849 | 2507 | 5185 | 1228 | 3922 | 2580 | 5258 |
| 1156 | 3850 | 2508 | 5186 | 1229 | 3923 | 2581 | 5259 |
| 1157 | 3851 | 2509 | 5187 | 1230 | 3924 | 2582 | 5260 |
| 1158 | 3852 | 2510 | 5188 | 1231 | 3925 | 2583 | 5261 |
| 1159 | 3853 | 2511 | 5189 | 1232 | 3926 | 2584 | 5262 |
| 1160 | 3854 | 2512 | 5190 | 1233 | 3927 | 2585 | 5263 |
| 1161 | 3855 | 2513 | 5191 | 1234 | 3928 | 2586 | 5264 |
| 1162 | 3856 | 2514 | 5192 | 1235 | 3929 | 2587 | 5265 |
| 1163 | 3857 | 2515 | 5193 | 1236 | 3930 | 2588 | 5266 |
| 1164 | 3858 | 2516 | 5194 | 1237 | 3931 | 2589 | 5267 |
| 1165 | 3859 | 2517 | 5195 | 1238 | 3932 | 2590 | 5268 |
| 1166 | 3860 | 2518 | 5196 | 1239 | 3933 | 2591 | 5269 |
| 1167 | 3861 | 2519 | 5197 | 1240 | 3934 | 2592 | 5270 |
| 1168 | 3862 | 2520 | 5198 | 1241 | 3935 | 2593 | 5271 |
| 1169 | 3863 | 2521 | 5199 | 1242 | 3936 | 2594 | 5272 |
| 1170 | 3864 | 2522 | 5200 | 1243 | 3937 | 2595 | 5273 |
| 1171 | 3865 | 2523 | 5201 | 1244 | 3938 | 2596 | 5274 |
| 1172 | 3866 | 2524 | 5202 | 1245 | 3939 | 2597 | 5275 |
| 1173 | 3867 | 2525 | 5203 | 1246 | 3940 | 2598 | 5276 |
| 1174 | 3868 | 2526 | 5204 | 1247 | 3941 | 2599 | NONE |
| 1175 | 3869 | 2527 | 5205 | 1248 | 3942 | 2600 | 5277 |
| 1176 | 3870 | 2528 | 5206 | 1249 | 3943 | 2601 | 5278 |
| 1177 | 3871 | 2529 | 5207 | 1250 | 3944 | 2602 | 5279 |

TABLE 2-continued

ABIOTIC STRESS RESPONSIVE GENE REGULATORY SEQUENCES

| SEQ ID NO | REGULATORY REGION | SEQ ID NO | REGULATORY REGION | SEQ ID NO | REGULATORY REGION | SEQ ID NO | REGULATORY REGION |
|---|---|---|---|---|---|---|---|
| 1251 | 3945 | 2603 | 5280 | 1324 | 4018 | 2676 | 5353 |
| 1252 | 3946 | 2604 | 5281 | 1325 | 4019 | 2677 | 5354 |
| 1253 | 3947 | 2605 | 5282 | 1326 | 4020 | 2678 | 5355 |
| 1254 | 3948 | 2606 | 5283 | 1327 | 4021 | 2679 | 5356 |
| 1255 | 3949 | 2607 | 5284 | 1328 | 4022 | 2680 | 5357 |
| 1256 | 3950 | 2608 | 5285 | 1329 | 4023 | 2681 | NONE |
| 1257 | 3951 | 2609 | 5286 | 1330 | NONE | 2682 | 5358 |
| 1258 | 3952 | 2610 | 5287 | 1331 | 4024 | 2683 | 5359 |
| 1259 | 3953 | 2611 | 5288 | 1332 | 4025 | 2684 | 5360 |
| 1260 | 3954 | 2612 | 5289 | 1333 | 4026 | 2685 | 5361 |
| 1261 | 3955 | 2613 | 5290 | 1334 | 4027 | 2686 | 5362 |
| 1262 | 3956 | 2614 | 5291 | 1335 | 4028 | 2687 | 5363 |
| 1263 | 3957 | 2615 | 5292 | 1336 | 4029 | 2688 | 5364 |
| 1264 | 3958 | 2616 | 5293 | 1337 | 4030 | 2689 | 5365 |
| 1265 | 3959 | 2617 | 5294 | 1338 | 4031 | 2690 | 5366 |
| 1266 | 3960 | 2618 | 5295 | 1339 | 4032 | 2691 | 5367 |
| 1267 | 3961 | 2619 | 5296 | 1340 | 4033 | 2692 | 5368 |
| 1268 | 3962 | 2620 | 5297 | 1341 | 4034 | 2693 | 5369 |
| 1269 | 3963 | 2621 | 5298 | 1342 | 4035 | 2694 | 5370 |
| 1270 | 3964 | 2622 | 5299 | 1343 | 4036 | 2695 | 5371 |
| 1271 | 3965 | 2623 | 5300 | 1344 | 4037 | 2696 | 5372 |
| 1272 | 3966 | 2624 | 5301 | 1345 | 4038 | 2697 | 5373 |
| 1273 | 3967 | 2625 | 5302 | 1346 | 4039 | 2698 | 5374 |
| 1274 | 3968 | 2626 | 5303 | 1347 | 4040 | 2699 | 5375 |
| 1275 | 3969 | 2627 | 5304 | 1348 | 4041 | 2700 | 5376 |
| 1276 | 3970 | 2628 | 5305 | 1349 | 4042 | 2701 | 5377 |
| 1277 | 3971 | 2629 | 5306 | 1350 | 4043 | 2702 | 5378 |
| 1278 | 3972 | 2630 | 5307 | 1351 | 4044 | 2703 | 5379 |
| 1279 | 3973 | 2631 | 5308 | 1352 | 4045 | | |
| 1280 | 3974 | 2632 | 5309 | | | | |
| 1281 | 3975 | 2633 | 5310 | | | | |
| 1282 | 3976 | 2634 | 5311 | | | | |
| 1283 | 3977 | 2635 | 5312 | | | | |
| 1284 | 3978 | 2636 | 5313 | | | | |
| 1285 | 3979 | 2637 | 5314 | | | | |
| 1286 | 3980 | 2638 | 5315 | | | | |
| 1287 | 3981 | 2639 | 5316 | | | | |
| 1288 | 3982 | 2640 | 5317 | | | | |
| 1289 | 3983 | 2641 | 5318 | | | | |
| 1290 | 3984 | 2642 | 5319 | | | | |
| 1291 | 3985 | 2643 | 5320 | | | | |
| 1292 | 3986 | 2644 | 5321 | | | | |
| 1293 | 3987 | 2645 | 5322 | | | | |
| 1294 | 3988 | 2646 | 5323 | | | | |
| 1295 | 3989 | 2647 | 5324 | | | | |
| 1296 | 3990 | 2648 | 5325 | | | | |
| 1297 | 3991 | 2649 | 5326 | | | | |
| 1298 | 3992 | 2650 | 5327 | | | | |
| 1299 | 3993 | 2651 | 5328 | | | | |
| 1300 | 3994 | 2652 | 5329 | | | | |
| 1301 | 3995 | 2653 | 5330 | | | | |
| 1302 | 3996 | 2654 | 5331 | | | | |
| 1303 | 3997 | 2655 | 5332 | | | | |
| 1304 | 3998 | 2656 | 5333 | | | | |
| 1305 | 3999 | 2657 | 5334 | | | | |
| 1306 | 4000 | 2658 | 5335 | | | | |
| 1307 | 4001 | 2659 | 5336 | | | | |
| 1308 | 4002 | 2660 | 5337 | | | | |
| 1309 | 4003 | 2661 | 5338 | | | | |
| 1310 | 4004 | 2662 | 5339 | | | | |
| 1311 | 4005 | 2663 | 5340 | | | | |
| 1312 | 4006 | 2664 | 5341 | | | | |
| 1313 | 4007 | 2665 | 5342 | | | | |
| 1314 | 4008 | 2666 | 5343 | | | | |
| 1315 | 4009 | 2667 | 5344 | | | | |
| 1316 | 4010 | 2668 | 5345 | | | | |
| 1317 | 4011 | 2669 | 5346 | | | | |
| 1318 | 4012 | 2670 | 5347 | | | | |
| 1319 | 4013 | 2671 | 5348 | | | | |
| 1320 | 4014 | 2672 | 5349 | | | | |
| 1321 | 4015 | 2673 | 5350 | | | | |
| 1322 | 4016 | 2674 | 5351 | | | | |
| 1323 | 4017 | 2675 | 5352 | | | | |

TABLE 3

COLD RESPONSIVE SEQUENCES

| SEQ ID NO: | AFFYMETRIX ID NO: |
|---|---|
| 1 | 11991_G_AT |
| 2 | 11992_AT |
| 3 | 11997_AT |
| 4 | 11998_AT |
| 5 | 12001_AT |
| 6 | 12006_S_AT |
| 7 | 12007_AT |
| 8 | 12009_AT |
| 9 | 12018_AT |
| 10 | 12022_AT |
| 11 | 12026_AT |
| 12 | 12031_AT |
| 13 | 12047_AT |
| 14 | 12051_AT |
| 15 | 12052_AT |
| 16 | 12053_AT |
| 17 | 12060_AT |
| 18 | 12072_AT |
| 19 | 12074_AT |
| 20 | 12102_AT |
| 21 | 12112_AT |
| 22 | 12117_AT |
| 23 | 12125_AT |
| 24 | 12130_AT |
| 25 | 12143_AT |
| 26 | 12145_S_AT |
| 27 | 12149_AT |
| 28 | 12156_AT |
| 29 | 12163_AT |
| 30 | 12166_I_AT |

TABLE 3-continued

COLD RESPONSIVE SEQUENCES

| SEQ ID NO: | AFFYMETRIX ID NO: |
|---|---|
| 31 | 12167_AT |
| 32 | 12169_I_AT |
| 33 | 12175_AT |
| 34 | 12176_AT |
| 35 | 12179_AT |
| 36 | 12187_AT |
|  | 15920_I_AT |
| 37 | 12195_AT |
| 38 | 12196_AT |
| 39 | 12198_AT |
| 40 | 12200_AT |
| 41 | 12202_AT |
| 42 | 12214_G_AT |
| 43 | 12219_AT |
| 44 | 12224_AT |
| 45 | 12226_AT |
| 46 | 12233_AT |
| 47 | 12240_AT |
| 48 | 12253_G_AT |
| 49 | 12256_AT |
| 50 | 12269_S_AT |
| 51 | 12270_AT |
| 52 | 12284_AT |
| 53 | 12287_S_AT |
|  | 17570_G_AT |
| 54 | 12293_AT |
| 55 | 12294_S_AT |
| 56 | 12300_AT |
| 57 | 12307_AT |
| 58 | 12312_AT |
| 59 | 12315_AT |
| 60 | 12324_I_AT |
| 61 | 12331_S_AT |
| 62 | 12336_AT |
| 63 | 12344_AT |
| 64 | 12348_AT |
| 65 | 12353_AT |
| 66 | 12359_S_AT |
| 67 | 12372_AT |
| 68 | 12374_I_AT |
|  | 12726_F_AT |
| 69 | 12390_AT |
| 70 | 12395_S_AT |
| 71 | 12405_AT |
| 72 | 12408_AT |
| 73 | 12410_G_AT |
| 74 | 12419_AT |
| 75 | 12427_AT |
| 76 | 12431_AT |
| 77 | 12436_AT |
| 78 | 12438_AT |
| 79 | 12443_S_AT |
| 80 | 12447_AT |
| 81 | 12450_S_AT |
| 82 | 12452_AT |
| 83 | 12474_AT |
| 84 | 12477_AT |
| 85 | 12491_AT |
| 86 | 12497_AT |
| 87 | 12500_S_AT |
| 88 | 12503_AT |
| 89 | 12515_AT |
| 90 | 12516_S_AT |
| 91 | 12523_AT |
| 92 | 12526_AT |
| 93 | 12527_AT |
| 94 | 12532_AT |
| 95 | 12534_G_AT |
| 96 | 12544_AT |
| 97 | 12549_S_AT |
| 98 | 12550_S_AT |
|  | 17103_S_AT |
| 99 | 12552_AT |
| 100 | 12555_S_AT |
| 101 | 12576_S_AT |
| 102 | 12581_S_AT |
|  | 16645_S_AT |
| 103 | 12587_AT |
| 104 | 12597_AT |
| 105 | 12602_AT |
| 106 | 12610_AT |
| 107 | 12631_AT |
| 108 | 12646_AT |
| 109 | 12649_AT |
| 110 | 12650_AT |
| 111 | 12653_AT |
| 112 | 12661_AT |
| 113 | 12666_AT |
| 114 | 12674_AT |
| 115 | 12675_S_AT |
| 116 | 12678_I_AT |
| 117 | 12681_S_AT |
| 118 | 12688_AT |
| 119 | 12702_AT |
| 120 | 12705_F_AT |
| 121 | 12736_F_AT |
| 122 | 12737_F_AT |
| 123 | 12758_AT |
| 124 | 12760_G_AT |
| 125 | 12762_R_AT |
| 126 | 12764_F_AT |
| 127 | 12766_AT |
|  | 15115_F_AT |
| 128 | 12767_AT |
| 129 | 12768_AT |
| 130 | 12772_AT |
| 131 | 12773_AT |
| 132 | 12776_AT |
| 133 | 12788_AT |
| 134 | 12793_AT |
| 135 | 12794_AT |
| 136 | 12802_AT |
| 137 | 12809_G_AT |
| 138 | 12812_AT |
| 139 | 12815_AT |
| 140 | 12816_AT |
| 141 | 12818_AT |
| 142 | 12824_S_AT |
| 143 | 12828_S_AT |
| 144 | 12842_S_AT |
| 145 | 12846_S_AT |
| 146 | 12858_AT |
| 147 | 12860_S_AT |
| 148 | 12861_S_AT |
| 149 | 12881_S_AT |
|  | 17600_S_AT |
| 150 | 12889_S_AT |
| 151 | 12901_S_AT |
| 152 | 12902_AT |
| 153 | 12904_S_AT |
| 154 | 12905_S_AT |
| 155 | 12908_S_AT |
| 156 | 12910_S_AT |
|  | 16385_S_AT |
| 157 | 12914_S_AT |
|  | 15783_S_AT |
|  | 17645_S_AT |
| 158 | 12916_S_AT |
| 159 | 12923_S_AT |
| 160 | 12926_S_AT |
| 161 | 12927_S_AT |
| 162 | 12931_S_AT |
| 163 | 12937_R_AT |
| 164 | 12941_G_AT |
| 165 | 12942_AT |
| 166 | 12947_AT |
| 167 | 12949_AT |
| 168 | 12953_AT |

TABLE 3-continued

COLD RESPONSIVE SEQUENCES

| SEQ ID NO: | AFFYMETRIX ID NO: |
|---|---|
| 169 | 12956_I_AT |
| 170 | 12959_AT |
| 171 | 12966_S_AT |
| 172 | 12975_AT |
| 173 | 12983_AT |
| 174 | 12984_AT |
| 175 | 12987_S_AT |
| 176 | 12994_S_AT |
| 177 | 13002_AT |
| 178 | 13009_I_AT |
| 179 | 13011_AT |
| 180 | 13018_AT |
| 181 | 13023_AT |
| 182 | 13024_AT |
| 183 | 13034_S_AT |
| 184 | 13046_G_AT |
| 185 | 13048_S_AT |
|  | 13495_S_AT |
| 186 | 13054_AT |
| 187 | 13067_S_AT |
| 188 | 13068_AT |
| 189 | 13073_S_AT |
| 190 | 13078_S_AT |
| 191 | 13079_AT |
| 192 | 13081_S_AT |
| 193 | 13083_AT |
| 194 | 13086_R_AT |
| 195 | 13087_AT |
| 196 | 13090_AT |
| 197 | 13092_S_AT |
|  | 16950_S_AT |
| 198 | 13098_AT |
| 199 | 13100_AT |
| 200 | 13103_AT |
| 201 | 13105_AT |
| 202 | 13107_S_AT |
| 203 | 13108_AT |
| 204 | 13109_AT |
| 205 | 13114_AT |
| 206 | 13118_F_AT |
| 207 | 13119_AT |
| 208 | 13120_AT |
| 209 | 13123_AT |
| 210 | 13128_AT |
| 211 | 13133_S_AT |
|  | 17430_S_AT |
| 212 | 13135_S_AT |
| 213 | 13139_AT |
| 214 | 13140_AT |
| 215 | 13143_AT |
| 216 | 13151_G_AT |
| 217 | 13160_AT |
| 218 | 13161_AT |
| 219 | 13162_AT |
| 220 | 13165_AT |
| 221 | 13166_AT |
| 222 | 13167_AT |
| 223 | 13179_AT |
| 224 | 13181_AT |
| 225 | 13185_AT |
| 226 | 13193_S_AT |
| 227 | 13213_S_AT |
|  | 16004_S_AT |
| 228 | 13219_S_AT |
|  | 20288_G_AT |
| 229 | 13220_S_AT |
|  | 13221_AT |
|  | 18929_S_AT |
| 230 | 13233_AT |
|  | 14301_S_AT |
| 231 | 13243_R_AT |
| 232 | 13254_S_AT |
| 233 | 13260_S_AT |
|  | 15660_S_AT |
| 234 | 13273_S_AT |
|  | 16105_S_AT |
| 235 | 13274_S_AT |
|  | 17077_S_AT |
| 236 | 13276_S_AT |
| 237 | 13278_F_AT |
| 238 | 13285_S_AT |
| 239 | 13288_S_AT |
|  | 17043_S_AT |
| 240 | 13292_S_AT |
| 241 | 13296_S_AT |
| 242 | 13297_S_AT |
| 243 | 13299_S_AT |
|  | 15166_S_AT |
| 244 | 13332_AT |
| 245 | 13347_AT |
| 246 | 13351_AT |
| 247 | 13352_AT |
| 248 | 13355_AT |
| 249 | 13404_AT |
| 250 | 13422_AT |
| 251 | 13459_AT |
| 252 | 13460_AT |
| 253 | 13461_S_AT |
| 254 | 13467_AT |
| 255 | 13488_AT |
| 256 | 13523_S_AT |
| 257 | 13529_AT |
| 258 | 13539_I_AT |
|  | 14631_S_AT |
| 259 | 13541_AT |
| 260 | 13542_AT |
| 261 | 13545_S_AT |
| 262 | 13552_AT |
| 263 | 13556_I_AT |
| 264 | 13561_AT |
| 265 | 13563_S_AT |
| 266 | 13567_AT |
| 267 | 13568_AT |
| 268 | 13571_AT |
| 269 | 13575_AT |
| 270 | 13576_AT |
| 271 | 13583_AT |
| 272 | 13598_AT |
| 273 | 13601_AT |
| 274 | 13604_AT |
| 275 | 13613_AT |
| 276 | 13616_S_AT |
|  | 16544_S_AT |
| 277 | 13617_AT |
| 278 | 13618_S_AT |
| 279 | 13619_AT |
| 280 | 13621_G_AT |
| 281 | 13623_R_AT |
| 282 | 13629_S_AT |
| 283 | 13631_AT |
| 284 | 13635_AT |
| 285 | 13646_AT |
| 286 | 13650_AT |
| 287 | 13653_AT |
| 288 | 13655_AT |
| 289 | 13656_AT |
| 290 | 13657_AT |
| 291 | 13666_S_AT |
|  | 17083_S_AT |
| 292 | 13667_S_AT |
| 293 | 13669_S_AT |
|  | 17074_S_AT |
| 294 | 13670_S_AT |
|  | 15206_S_AT |
| 295 | 13671_S_AT |
|  | 16805_S_AT |
| 296 | 13678_S_AT |
| 297 | 13688_S_AT |

TABLE 3-continued

COLD RESPONSIVE SEQUENCES

| SEQ ID NO: | AFFYMETRIX ID NO: |
|---|---|
| 298 | 13690_S_AT |
|  | 16065_S_AT |
| 299 | 13691_S_AT |
|  | 16117_S_AT |
| 300 | 13692_S_AT |
|  | 16118_S_AT |
| 301 | 13700_AT |
| 302 | 13704_S_AT |
| 303 | 13714_AT |
| 304 | 13715_AT |
| 305 | 13724_AT |
| 306 | 13748_AT |
| 307 | 13759_AT |
| 308 | 13767_AT |
| 309 | 13785_AT |
| 310 | 13803_AT |
| 311 | 13850_I_AT |
| 312 | 13876_AT |
| 313 | 13880_S_AT |
| 314 | 13883_AT |
| 315 | 13887_S_AT |
| 316 | 13895_AT |
| 317 | 13904_S_AT |
|  | 18722_S_AT |
| 318 | 13906_S_AT |
| 319 | 13908_S_AT |
|  | 18597_AT |
| 320 | 13923_AT |
| 321 | 13927_AT |
| 322 | 13932_AT |
| 323 | 13935_AT |
| 324 | 13940_AT |
| 325 | 13949_S_AT |
| 326 | 13954_G_AT |
| 327 | 13971_S_AT |
| 328 | 13973_AT |
| 329 | 13983_AT |
| 330 | 13985_S_AT |
| 331 | 13987_S_AT |
|  | 18738_F_AT |
| 332 | 13989_AT |
|  | 20674_S_AT |
| 333 | 14010_AT |
| 334 | 14013_AT |
| 335 | 14014_AT |
| 336 | 14019_AT |
| 337 | 14021_R_AT |
| 338 | 14025_S_AT |
|  | 18909_S_AT |
| 339 | 14027_AT |
| 340 | 14030_AT |
| 341 | 14044_AT |
| 342 | 14048_AT |
| 343 | 14056_AT |
| 344 | 14057_AT |
| 345 | 14058_AT |
| 346 | 14059_AT |
| 347 | 14061_AT |
| 348 | 14068_S_AT |
| 349 | 14072_AT |
| 350 | 14073_AT |
| 351 | 14074_AT |
| 352 | 14084_AT |
| 353 | 14095_S_AT |
| 354 | 14100_AT |
| 355 | 14101_AT |
| 356 | 14103_AT |
| 357 | 14105_AT |
| 358 | 14106_AT |
| 359 | 14121_AT |
| 360 | 14129_S_AT |
| 361 | 14133_S_AT |
| 362 | 14143_AT |
| 363 | 14145_AT |
| 364 | 14148_AT |
| 365 | 14186_AT |
| 366 | 14194_AT |
| 367 | 14196_AT |
| 368 | 14223_AT |
| 369 | 14234_AT |
| 370 | 14236_AT |
| 371 | 14251_F_AT |
| 372 | 14252_F_AT |
| 373 | 14270_AT |
| 374 | 14298_G_AT |
|  | 17581_G_AT |
| 375 | 14303_S_AT |
| 376 | 14312_AT |
| 377 | 14316_AT |
| 378 | 14339_AT |
| 379 | 14366_AT |
| 380 | 14369_AT |
| 381 | 14388_AT |
| 382 | 14392_G_AT |
| 383 | 14393_AT |
| 384 | 14421_AT |
| 385 | 14436_AT |
| 386 | 14448_AT |
| 387 | 14450_AT |
| 388 | 14454_AT |
| 389 | 14459_AT |
| 390 | 14478_AT |
| 391 | 14482_AT |
| 392 | 14485_AT |
| 393 | 14492_S_AT |
| 394 | 14505_AT |
| 395 | 14510_AT |
| 396 | 14511_AT |
| 397 | 14517_AT |
| 398 | 14519_AT |
| 399 | 14525_S_AT |
| 400 | 14527_AT |
| 401 | 14534_S_AT |
| 402 | 14538_R_AT |
| 403 | 14554_AT |
| 404 | 14558_AT |
| 405 | 14559_S_AT |
| 406 | 14566_AT |
| 407 | 14572_AT |
| 408 | 14579_AT |
| 409 | 14587_AT |
| 410 | 14591_AT |
| 411 | 14595_AT |
| 412 | 14602_AT |
| 413 | 14603_AT |
| 414 | 14605_AT |
| 415 | 14620_S_AT |
| 416 | 14626_S_AT |
| 417 | 14630_S_AT |
|  | 16559_S_AT |
| 418 | 14637_S_AT |
|  | 17122_S_AT |
| 419 | 14642_F_AT |
| 420 | 14650_S_AT |
|  | 15150_S_AT |
| 421 | 14654_S_AT |
| 422 | 14667_S_AT |
|  | 18299_S_AT |
| 423 | 14669_S_AT |
|  | 16136_S_AT |
| 424 | 14672_S_AT |
| 425 | 14679_S_AT |
| 426 | 14682_I_AT |
| 427 | 14689_AT |
| 428 | 14697_G_AT |
|  | 16902_AT |
| 429 | 14701_S_AT |
|  | 14734_S_AT |

TABLE 3-continued

COLD RESPONSIVE SEQUENCES

| SEQ ID NO: | AFFYMETRIX ID NO: |
|---|---|
| 430 | 14703_AT |
| 431 | 14711_S_AT |
| 432 | 14712_S_AT |
|  | 20530_S_AT |
| 433 | 14713_S_AT |
| 434 | 14715_S_AT |
| 435 | 14728_S_AT |
| 436 | 14731_S_AT |
| 437 | 14781_AT |
| 438 | 14797_S_AT |
| 439 | 14800_AT |
| 440 | 14809_AT |
| 441 | 14843_AT |
| 442 | 14847_AT |
| 443 | 14872_AT |
| 444 | 14886_AT |
| 445 | 14896_AT |
| 446 | 14900_AT |
| 447 | 14908_AT |
| 448 | 14912_AT |
| 449 | 14914_AT |
| 450 | 14942_AT |
| 451 | 14945_AT |
| 452 | 14955_AT |
| 453 | 14957_S_AT |
| 454 | 14958_AT |
| 455 | 14965_AT |
| 456 | 14974_AT |
| 457 | 14980_AT |
| 458 | 14981_AT |
| 459 | 14984_S_AT |
| 460 | 14995_AT |
| 461 | 15004_AT |
| 462 | 15009_AT |
| 463 | 15010_AT |
| 464 | 15024_AT |
| 465 | 15026_AT |
| 466 | 15036_R_AT |
| 467 | 15054_AT |
| 468 | 15056_AT |
| 469 | 15057_AT |
| 470 | 15066_AT |
| 471 | 15073_AT |
| 472 | 15081_AT |
| 473 | 15083_AT |
| 474 | 15091_AT |
| 475 | 15097_S_AT |
| 476 | 15101_S_AT |
| 477 | 15102_S_AT |
| 478 | 15107_S_AT |
| 479 | 15112_S_AT |
| 480 | 15116_F_AT |
| 481 | 15118_S_AT |
| 482 | 15122_S_AT |
| 483 | 15130_S_AT |
| 484 | 15131_S_AT |
| 485 | 15132_S_AT |
|  | 17585_S_AT |
| 486 | 15139_S_AT |
| 487 | 15143_S_AT |
| 488 | 15146_S_AT |
| 489 | 15159_S_AT |
|  | 15160_S_AT |
| 490 | 15162_S_AT |
| 491 | 15167_S_AT |
| 492 | 15171_S_AT |
| 493 | 15174_F_AT |
| 494 | 15178_S_AT |
| 495 | 15185_S_AT |
|  | 18023_S_AT |
| 496 | 15188_S_AT |
| 497 | 15193_S_AT |
| 498 | 15196_S_AT |
| 499 | 15197_S_AT |
| 500 | 15201_F_AT |
| 501 | 15213_S_AT |
| 502 | 15243_AT |
| 503 | 15256_AT |
| 504 | 15270_AT |
| 505 | 15319_AT |
| 506 | 15325_AT |
| 507 | 15337_AT |
| 508 | 15341_AT |
| 509 | 15343_AT |
| 510 | 15348_AT |
| 511 | 15350_AT |
| 512 | 15355_S_AT |
| 513 | 15367_AT |
| 514 | 15372_AT |
| 515 | 15379_AT |
| 516 | 15381_AT |
| 517 | 15383_AT |
| 518 | 15384_AT |
| 519 | 15385_AT |
| 520 | 15387_AT |
| 521 | 15410_AT |
| 522 | 15417_S_AT |
| 523 | 15422_AT |
| 524 | 15423_AT |
| 525 | 15431_AT |
| 526 | 15433_AT |
| 527 | 15452_AT |
| 528 | 15464_AT |
| 529 | 15468_AT |
| 530 | 15471_AT |
| 531 | 15472_AT |
| 532 | 15475_S_AT |
| 533 | 15485_AT |
| 534 | 15489_AT |
| 535 | 15490_AT |
| 536 | 15503_AT |
| 537 | 15505_AT |
| 538 | 15510_R_AT |
| 539 | 15512_AT |
| 540 | 15514_AT |
| 541 | 15515_R_AT |
| 542 | 15517_S_AT |
| 543 | 15518_AT |
| 544 | 15529_AT |
| 545 | 15534_F_AT |
| 546 | 15538_AT |
| 547 | 15541_AT |
| 548 | 15543_AT |
| 549 | 15544_AT |
| 550 | 15551_AT |
| 551 | 15574_S_AT |
| 552 | 15576_S_AT |
| 553 | 15577_S_AT |
| 554 | 15578_S_AT |
| 555 | 15583_S_AT |
| 556 | 15588_S_AT |
| 557 | 15595_S_AT |
| 558 | 15600_S_AT |
| 559 | 15602_F_AT |
| 560 | 15608_S_AT |
| 561 | 15613_S_AT |
| 562 | 15616_S_AT |
| 563 | 15618_S_AT |
| 564 | 15620_S_AT |
| 565 | 15627_S_AT |
| 566 | 15634_S_AT |
|  | 16125_S_AT |
|  | 18046_S_AT |
| 567 | 15637_S_AT |
| 568 | 15639_S_AT |
| 569 | 15642_S_AT |
| 570 | 15643_S_AT |
| 571 | 15651_F_AT |

TABLE 3-continued

COLD RESPONSIVE SEQUENCES

| SEQ ID NO: | AFFYMETRIX ID NO: |
|---|---|
| 572 | 15652_S_AT |
| 573 | 15665_S_AT |
| 574 | 15667_S_AT |
|  | 18610_S_AT |
| 575 | 15668_S_AT |
| 576 | 15671_S_AT |
| 577 | 15675_S_AT |
| 578 | 15679_S_AT |
| 579 | 15685_S_AT |
| 580 | 15687_F_AT |
| 581 | 15688_S_AT |
| 582 | 15689_S_AT |
| 583 | 15692_S_AT |
| 584 | 15694_S_AT |
| 585 | 15712_S_AT |
| 586 | 15808_AT |
| 587 | 15845_AT |
| 588 | 15848_AT |
| 589 | 15850_AT |
|  | 20406_G_AT |
| 590 | 15858_AT |
| 591 | 15862_AT |
| 592 | 15868_AT |
| 593 | 15878_AT |
| 594 | 15894_AT |
| 595 | 15900_AT |
| 596 | 15901_AT |
| 597 | 15902_AT |
| 598 | 15912_AT |
| 599 | 15913_AT |
| 600 | 15928_AT |
| 601 | 15940_AT |
| 602 | 15941_AT |
| 603 | 15945_AT |
| 604 | 15948_S_AT |
| 605 | 15956_AT |
| 606 | 15960_AT |
|  | 16466_S_AT |
| 607 | 15976_AT |
| 608 | 15978_AT |
| 609 | 15986_S_AT |
| 610 | 15990_AT |
| 611 | 16009_S_AT |
| 612 | 16015_AT |
| 613 | 16019_AT |
| 614 | 16024_AT |
| 615 | 16034_AT |
| 616 | 16036_I_AT |
|  | 18729_AT |
| 617 | 16039_S_AT |
| 618 | 16040_AT |
| 619 | 16042_S_AT |
| 620 | 16047_AT |
| 621 | 16049_S_AT |
| 622 | 16051_S_AT |
| 623 | 16055_S_AT |
| 624 | 16059_S_AT |
| 625 | 16062_S_AT |
| 626 | 16066_S_AT |
| 627 | 16069_S_AT |
| 628 | 16074_S_AT |
| 629 | 16076_S_AT |
| 630 | 16077_S_AT |
|  | 17579_S_AT |
| 631 | 16079_S_AT |
| 632 | 16084_S_AT |
|  | 17998_S_AT |
| 633 | 16087_S_AT |
| 634 | 16089_S_AT |
| 635 | 16090_S_AT |
| 636 | 16102_S_AT |
| 637 | 16103_S_AT |
| 638 | 16108_S_AT |
| 639 | 16112_S_AT |

TABLE 3-continued

COLD RESPONSIVE SEQUENCES

| SEQ ID NO: | AFFYMETRIX ID NO: |
|---|---|
| 640 | 16134_S_AT |
| 641 | 16137_S_AT |
| 642 | 16138_S_AT |
| 643 | 16140_S_AT |
| 644 | 16143_S_AT |
| 645 | 16145_S_AT |
| 646 | 16148_S_AT |
| 647 | 16151_S_AT |
| 648 | 16155_S_AT |
| 649 | 16158_F_AT |
| 650 | 16160_F_AT |
| 651 | 16162_S_AT |
| 652 | 16168_S_AT |
| 653 | 16169_S_AT |
| 654 | 16171_S_AT |
| 655 | 16172_S_AT |
| 656 | 16184_AT |
| 657 | 16192_AT |
| 658 | 16222_AT |
| 659 | 16242_AT |
| 660 | 16244_AT |
| 661 | 16250_AT |
| 662 | 16286_AT |
| 663 | 16288_AT |
| 664 | 16294_S_AT |
| 665 | 16296_AT |
| 666 | 16297_AT |
| 667 | 16325_AT |
| 668 | 16346_S_AT |
| 669 | 16357_AT |
| 670 | 16380_AT |
| 671 | 16382_AT |
| 672 | 16393_S_AT |
| 673 | 16402_S_AT |
| 674 | 16411_S_AT |
| 675 | 16442_S_AT |
| 676 | 16446_AT |
| 677 | 16448_G_AT |
| 678 | 16453_S_AT |
| 679 | 16457_S_AT |
| 680 | 16465_AT |
|  | 16916_S_AT |
| 681 | 16470_S_AT |
|  | 18735_S_AT |
| 682 | 16481_S_AT |
| 683 | 16486_AT |
| 684 | 16487_AT |
| 685 | 16488_AT |
| 686 | 16496_S_AT |
| 687 | 16499_AT |
| 688 | 16510_AT |
| 689 | 16511_AT |
| 690 | 16512_S_AT |
|  | 18085_R_AT |
| 691 | 16514_AT |
| 692 | 16516_AT |
| 693 | 16517_AT |
| 694 | 16526_AT |
| 695 | 16528_AT |
| 696 | 16531_S_AT |
| 697 | 16535_S_AT |
| 698 | 16537_S_AT |
| 699 | 16538_S_AT |
| 700 | 16543_S_AT |
| 701 | 16550_S_AT |
| 702 | 16554_S_AT |
| 703 | 16567_S_AT |
| 704 | 16571_S_AT |
| 705 | 16576_F_AT |
| 706 | 16577_S_AT |
| 707 | 16579_S_AT |
| 708 | 16580_S_AT |
| 709 | 16583_S_AT |
| 710 | 16584_S_AT |

TABLE 3-continued

COLD RESPONSIVE SEQUENCES

| SEQ ID NO: | AFFYMETRIX ID NO: |
|---|---|
|  | 18706_S_AT |
| 711 | 16593_S_AT |
| 712 | 16595_S_AT |
| 713 | 16598_S_AT |
| 714 | 16604_S_AT |
| 715 | 16605_S_AT |
| 716 | 16610_S_AT |
| 717 | 16611_S_AT |
| 718 | 16614_S_AT |
| 719 | 16617_S_AT |
| 720 | 16618_S_AT |
| 721 | 16620_S_AT |
| 722 | 16621_S_AT |
| 723 | 16631_S_AT |
| 724 | 16634_S_AT |
| 725 | 16635_S_AT |
| 726 | 16636_S_AT |
| 727 | 16639_S_AT |
| 728 | 16640_S_AT |
| 729 | 16650_S_AT |
| 730 | 16652_S_AT |
| 731 | 16654_AT |
| 732 | 16672_AT |
| 733 | 16673_AT |
| 734 | 16687_S_AT |
| 735 | 16747_AT |
| 736 | 16753_AT |
| 737 | 16768_AT |
| 738 | 16777_AT |
| 739 | 16784_AT |
| 740 | 16807_AT |
| 741 | 16811_AT |
| 742 | 16845_AT |
| 743 | 16894_AT |
| 744 | 16899_AT |
| 745 | 16911_AT |
| 746 | 16920_AT |
| 747 | 16921_AT |
| 748 | 16924_S_AT |
| 749 | 16926_S_AT |
| 750 | 16931_S_AT |
| 751 | 16934_S_AT |
| 752 | 16937_AT |
| 753 | 16938_AT |
| 754 | 16942_AT |
| 755 | 16943_S_AT |
|  | 18231_AT |
| 756 | 16949_S_AT |
| 757 | 16952_S_AT |
| 758 | 16956_AT |
| 759 | 16962_S_AT |
| 760 | 16965_S_AT |
| 761 | 16970_S_AT |
|  | 18010_S_AT |
| 762 | 16977_AT |
| 763 | 16984_AT |
| 764 | 16996_S_AT |
| 765 | 16997_AT |
| 766 | 17000_AT |
| 767 | 17005_AT |
| 768 | 17010_S_AT |
| 769 | 17017_S_AT |
| 770 | 17031_S_AT |
| 771 | 17033_S_AT |
| 772 | 17053_S_AT |
| 773 | 17055_S_AT |
| 774 | 17063_S_AT |
| 775 | 17068_S_AT |
| 776 | 17070_S_AT |
| 777 | 17075_S_AT |
| 778 | 17084_S_AT |
| 779 | 17087_S_AT |
| 780 | 17092_S_AT |
| 781 | 17095_S_AT |

TABLE 3-continued

COLD RESPONSIVE SEQUENCES

| SEQ ID NO: | AFFYMETRIX ID NO: |
|---|---|
| 782 | 17096_S_AT |
| 783 | 17102_S_AT |
| 784 | 17105_S_AT |
| 785 | 17109_S_AT |
| 786 | 17110_S_AT |
| 787 | 17113_S_AT |
| 788 | 17115_S_AT |
| 789 | 17116_S_AT |
| 790 | 17123_S_AT |
| 791 | 17129_S_AT |
| 792 | 17132_AT |
| 793 | 17166_AT |
| 794 | 17206_AT |
| 795 | 17207_AT |
| 796 | 17215_AT |
| 797 | 17237_AT |
| 798 | 17247_AT |
| 799 | 17254_AT |
| 800 | 17286_AT |
| 801 | 17288_S_AT |
| 802 | 17292_AT |
| 803 | 17300_AT |
| 804 | 17303_S_AT |
| 805 | 17318_AT |
| 806 | 17319_AT |
| 807 | 17322_AT |
| 808 | 17323_AT |
| 809 | 17332_S_AT |
| 810 | 17374_AT |
| 811 | 17381_AT |
| 812 | 17388_AT |
| 813 | 17392_S_AT |
| 814 | 17405_AT |
| 815 | 17415_AT |
| 816 | 17418_S_AT |
| 817 | 17420_AT |
| 818 | 17423_S_AT |
| 819 | 17426_AT |
| 820 | 17427_AT |
| 821 | 17429_S_AT |
| 822 | 17431_AT |
| 823 | 17439_G_AT |
| 824 | 17457_AT |
| 825 | 17458_AT |
| 826 | 17462_S_AT |
| 827 | 17463_AT |
| 828 | 17465_AT |
| 829 | 17466_S_AT |
| 830 | 17475_AT |
| 831 | 17479_AT |
| 832 | 17482_S_AT |
| 833 | 17495_S_AT |
| 834 | 17508_S_AT |
| 835 | 17522_S_AT |
| 836 | 17523_S_AT |
| 837 | 17537_S_AT |
| 838 | 17538_S_AT |
| 839 | 17539_S_AT |
| 840 | 17546_S_AT |
|  | 18694_S_AT |
| 841 | 17557_S_AT |
| 842 | 17560_S_AT |
| 843 | 17562_AT |
| 844 | 17564_S_AT |
|  | 19361_S_AT |
| 845 | 17565_S_AT |
| 846 | 17568_AT |
| 847 | 17573_AT |
| 848 | 17577_G_AT |
| 849 | 17578_AT |
| 850 | 17596_AT |
| 851 | 17627_AT |
| 852 | 17631_AT |
| 853 | 17632_AT |

TABLE 3-continued

COLD RESPONSIVE SEQUENCES

| SEQ ID NO: | AFFYMETRIX ID NO: |
|---|---|
| 854 | 17672_AT |
| 855 | 17675_AT |
| 856 | 17677_AT |
| 857 | 17732_AT |
| 858 | 17743_AT |
| 859 | 17748_AT |
| 860 | 17782_AT |
| 861 | 17823_S_AT |
| 862 | 17841_AT |
| 863 | 17849_S_AT |
| 864 | 17852_G_AT |
| 865 | 17857_AT |
| 866 | 17865_AT |
| 867 | 17882_AT |
| 868 | 17885_AT |
| 869 | 17900_S_AT |
| 870 | 17910_AT |
| 871 | 17911_AT |
| 872 | 17916_AT |
| 873 | 17917_S_AT |
| 874 | 17918_AT |
| 875 | 17921_S_AT |
| 876 | 17922_AT |
| 877 | 17926_S_AT |
| 878 | 17933_AT |
| 879 | 17935_AT |
| 880 | 17956_I_AT |
| 881 | 17966_AT |
| 882 | 17967_AT |
| 883 | 17970_I_AT |
| 884 | 17978_S_AT |
|     | 20635_S_AT |
| 885 | 17986_S_AT |
| 886 | 17993_AT |
| 887 | 18001_AT |
| 888 | 18003_AT |
| 889 | 18004_AT |
| 890 | 18005_AT |
| 891 | 18029_G_AT |
|     | 18030_I_AT |
| 892 | 18040_S_AT |
| 893 | 18045_AT |
| 894 | 18064_R_AT |
| 895 | 18065_R_AT |
| 896 | 18074_AT |
| 897 | 18076_S_AT |
| 898 | 18077_AT |
| 899 | 18081_AT |
| 900 | 18154_S_AT |
|     | 18365_S_AT |
| 901 | 18165_AT |
| 902 | 18174_AT |
| 903 | 18176_AT |
| 904 | 18194_I_AT |
| 905 | 18197_AT |
| 906 | 18198_AT |
| 907 | 18213_AT |
| 908 | 18219_AT |
| 909 | 18221_AT |
| 910 | 18222_AT |
| 911 | 18226_S_AT |
| 912 | 18232_AT |
| 913 | 18237_AT |
| 914 | 18241_AT |
| 915 | 18257_AT |
| 916 | 18258_S_AT |
| 917 | 18269_S_AT |
| 918 | 18274_S_AT |
| 919 | 18275_AT |
| 920 | 18278_AT |
| 921 | 18282_AT |
| 922 | 18283_AT |
| 923 | 18290_AT |
| 924 | 18291_AT |
| 925 | 18306_AT |
| 926 | 18316_AT |
| 927 | 18317_AT |
| 928 | 18327_S_AT |
| 929 | 18337_S_AT |
| 930 | 18339_AT |
| 931 | 18347_S_AT |
| 932 | 18383_AT |
| 933 | 18390_AT |
| 934 | 18439_S_AT |
| 935 | 18465_S_AT |
| 936 | 18487_AT |
| 937 | 18508_S_AT |
| 938 | 18512_AT |
| 939 | 18543_AT |
| 940 | 18544_AT |
| 941 | 18552_AT |
| 942 | 18555_AT |
| 943 | 18556_AT |
| 944 | 18561_AT |
| 945 | 18567_AT |
| 946 | 18573_AT |
| 947 | 18580_AT |
| 948 | 18581_AT |
| 949 | 18584_AT |
| 950 | 18587_S_AT |
| 951 | 18588_AT |
| 952 | 18591_AT |
| 953 | 18592_S_AT |
| 954 | 18600_AT |
| 955 | 18601_S_AT |
| 956 | 18607_S_AT |
| 957 | 18611_AT |
| 958 | 18616_AT |
| 959 | 18622_G_AT |
| 960 | 18623_AT |
| 961 | 18628_AT |
| 962 | 18631_AT |
| 963 | 18635_AT |
| 964 | 18636_AT |
| 965 | 18638_AT |
| 966 | 18652_AT |
| 967 | 18657_AT |
| 968 | 18659_AT |
| 969 | 18660_S_AT |
| 970 | 18667_AT |
| 971 | 18675_AT |
| 972 | 18684_AT |
| 973 | 18686_S_AT |
| 974 | 18688_S_AT |
| 975 | 18693_S_AT |
| 976 | 18698_S_AT |
| 977 | 18705_AT |
| 978 | 18707_AT |
| 979 | 18708_AT |
| 980 | 18726_S_AT |
| 981 | 18727_AT |
| 982 | 18732_I_AT |
| 983 | 18736_AT |
| 984 | 18750_F_AT |
| 985 | 18754_AT |
| 986 | 18778_AT |
| 987 | 18806_S_AT |
| 988 | 18823_S_AT |
| 989 | 18829_AT |
| 990 | 18835_AT |
| 991 | 18844_AT |
| 992 | 18859_AT |
| 993 | 18864_AT |
| 994 | 18866_AT |
| 995 | 18880_AT |
| 996 | 18883_G_AT |
| 997 | 18885_AT |
| 998 | 18886_AT |

TABLE 3-continued

COLD RESPONSIVE SEQUENCES

| SEQ ID NO: | AFFYMETRIX ID NO: |
|---|---|
| 999 | 18887_AT |
| 1000 | 18888_AT |
| 1001 | 18889_AT |
| 1002 | 18892_S_AT |
| 1003 | 18901_AT |
| 1004 | 18911_AT |
| 1005 | 18917_I_AT |
| 1006 | 18939_AT |
| 1007 | 18947_I_AT |
| 1008 | 18950_AT |
| 1009 | 18951_S_AT |
| 1010 | 18954_AT |
| 1011 | 18956_AT |
| 1012 | 18959_AT |
| 1013 | 18966_AT |
| 1014 | 18974_AT |
| 1015 | 18976_AT |
| 1016 | 18980_AT |
| 1017 | 18989_S_AT |
| 1018 | 18994_AT |
| 1019 | 19030_AT |
| 1020 | 19039_AT |
| 1021 | 19049_AT |
| 1022 | 19083_AT |
| 1023 | 19115_AT |
| 1024 | 19117_S_AT |
| 1025 | 19122_AT |
| 1026 | 19125_S_AT |
| 1027 | 19127_AT |
| 1028 | 19130_AT |
| 1029 | 19144_AT |
| 1030 | 19157_S_AT |
| 1031 | 19178_AT |
| 1032 | 19190_G_AT |
| 1033 | 19198_AT |
| 1034 | 19202_AT |
| 1035 | 19209_S_AT |
| 1036 | 19211_AT |
| 1037 | 19218_AT |
| 1038 | 19222_AT |
| 1039 | 19226_G_AT |
| 1040 | 19229_AT |
| 1041 | 19230_AT |
| 1042 | 19232_S_AT |
| 1043 | 19285_AT |
| 1044 | 19326_AT |
| 1045 | 19332_AT |
| 1046 | 19346_AT |
| 1047 | 19347_AT |
| 1048 | 19362_AT |
| 1049 | 19363_AT |
| 1050 | 19364_AT |
| 1051 | 19367_AT |
| 1052 | 19373_AT |
| 1053 | 19381_AT |
| 1054 | 19382_AT |
| 1055 | 19384_AT |
| 1056 | 19401_AT |
| 1057 | 19406_AT |
| 1058 | 19413_AT |
| 1059 | 19416_AT |
| 1060 | 19426_S_AT |
| 1061 | 19439_AT |
| 1062 | 19441_S_AT |
| 1063 | 19442_AT |
| 1064 | 19448_S_AT |
| 1065 | 19454_AT |
| 1066 | 19462_S_AT |
| 1067 | 19464_AT |
| 1068 | 19470_AT |
| 1069 | 19483_AT |
| 1070 | 19489_S_AT |
| 1071 | 19513_AT |
| 1072 | 19548_AT |
| 1073 | 19562_AT |
| 1074 | 19563_S_AT |
| 1075 | 19567_AT |
| 1076 | 19581_AT |
| 1077 | 19589_S_AT |
| 1078 | 19595_S_AT |
| 1079 | 19606_AT |
| 1080 | 19623_AT |
| 1081 | 19624_AT |
| 1082 | 19627_S_AT |
| 1083 | 19636_AT |
| 1084 | 19652_AT |
| 1085 | 19655_AT |
| 1086 | 19657_S_AT |
| 1087 | 19658_AT |
| 1088 | 19660_AT |
| 1089 | 19665_S_AT |
| 1090 | 19667_AT |
| 1091 | 19671_AT |
| 1092 | 19677_AT |
| 1093 | 19686_AT |
| 1094 | 19689_AT |
| 1095 | 19690_S_AT |
| 1096 | 19695_AT |
| 1097 | 19698_AT |
| 1098 | 19700_S_AT |
| 1099 | 19708_AT |
| 1100 | 19717_AT |
| 1101 | 19726_S_AT |
| 1102 | 19744_AT |
| 1103 | 19752_S_AT |
| 1104 | 19759_AT |
| 1105 | 19782_AT |
| 1106 | 19803_S_AT |
| 1107 | 19828_AT |
| 1108 | 19831_I_AT |
| 1109 | 19833_S_AT |
| 1110 | 19834_AT |
| 1111 | 19836_AT |
| 1112 | 19841_AT |
| 1113 | 19845_G_AT |
| 1114 | 19854_AT |
| 1115 | 19855_AT |
| 1116 | 19866_AT |
| 1117 | 19867_AT |
| 1118 | 19870_S_AT |
| 1119 | 19871_AT |
| 1120 | 19872_AT |
| 1121 | 19875_S_AT |
| 1122 | 19876_AT |
| 1123 | 19879_S_AT |
| 1124 | 19881_AT |
| 1125 | 19897_S_AT |
| 1126 | 19903_AT |
| 1127 | 19905_AT |
| 1128 | 19906_AT |
| 1129 | 19907_AT |
| 1130 | 19910_AT |
| 1131 | 19913_AT |
| 1132 | 19920_S_AT |
| 1133 | 19932_AT |
| 1134 | 19939_AT |
| 1135 | 19945_AT |
| 1136 | 19947_AT |
| 1137 | 19951_AT |
| 1138 | 19956_AT |
| 1139 | 19962_AT |
| 1140 | 19963_AT |
| 1141 | 19969_AT |
| 1142 | 19970_S_AT |
| 1143 | 19971_AT |
| 1144 | 19972_AT |
| 1145 | 19981_AT |
| 1146 | 19990_AT |

TABLE 3-continued

COLD RESPONSIVE SEQUENCES

| SEQ ID NO: | AFFYMETRIX ID NO: |
|---|---|
| 1147 | 19996_AT |
| 1148 | 20003_S_AT |
| 1149 | 20009_S_AT |
| 1150 | 20013_AT |
| 1151 | 20018_AT |
| 1152 | 20024_S_AT |
| 1153 | 20027_AT |
| 1154 | 20045_AT |
| 1155 | 20047_AT |
| 1156 | 20048_AT |
| 1157 | 20050_AT |
| 1158 | 20051_AT |
| 1159 | 20058_AT |
| 1160 | 20067_AT |
| 1161 | 20068_AT |
| 1162 | 20069_AT |
| 1163 | 20093_I_AT |
| 1164 | 20099_AT |
| 1165 | 20100_AT |
| 1166 | 20113_S_AT |
| 1167 | 20117_AT |
| 1168 | 20123_AT |
| 1169 | 20127_S_AT |
| 1170 | 20129_AT |
| 1171 | 20150_AT |
| 1172 | 20154_AT |
| 1173 | 20156_AT |
| 1174 | 20165_AT |
| 1175 | 20173_AT |
| 1176 | 20178_S_AT |
| 1177 | 20183_AT |
| 1178 | 20188_AT |
| 1179 | 20189_AT |
| 1180 | 20197_AT |
| 1181 | 20210_G_AT |
| 1182 | 20213_AT |
| 1183 | 20229_AT |
| 1184 | 20232_S_AT |
| 1185 | 20255_AT |
| 1186 | 20257_AT |
| 1187 | 20262_AT |
| 1188 | 20275_AT |
| 1189 | 20278_S_AT |
| 1190 | 20282_S_AT |
| 1191 | 20284_AT |
| 1192 | 20293_AT |
| 1193 | 20294_AT |
| 1194 | 20312_S_AT |
| 1195 | 20315_I_AT |
| 1196 | 20330_S_AT |
| 1197 | 20331_AT |
| 1198 | 20350_S_AT |
| 1199 | 20354_S_AT |
| 1200 | 20355_AT |
| 1201 | 20360_AT |
| 1202 | 20363_AT |
| 1203 | 20369_S_AT |
| 1204 | 20378_G_AT |
| 1205 | 20383_AT |
| 1206 | 20384_AT |
| 1207 | 20387_AT |
| 1208 | 20393_AT |
| 1209 | 20396_AT |
| 1210 | 20399_AT |
| 1211 | 20409_G_AT |
| 1212 | 20412_S_AT |
| 1213 | 20413_AT |
| 1214 | 20439_AT |
| 1215 | 20440_AT |
| 1216 | 20444_AT |
| 1217 | 20445_AT |
| 1218 | 20449_AT |
| 1219 | 20456_AT |
| 1220 | 20462_AT |
| 1221 | 20471_AT |
| 1222 | 20474_AT |
| 1223 | 20495_S_AT |
| 1224 | 20499_AT |
| 1225 | 20501_AT |
| 1226 | 20511_AT |
| 1227 | 20515_S_AT |
| 1228 | 20516_AT |
| 1229 | 20517_AT |
| 1230 | 20518_AT |
| 1231 | 20520_S_AT |
| 1232 | 20536_S_AT |
| 1233 | 20538_S_AT |
| 1234 | 20539_S_AT |
| 1235 | 20558_AT |
| 1236 | 20561_AT |
| 1237 | 20567_AT |
| 1238 | 20571_AT |
| 1239 | 20582_S_AT |
| 1240 | 20586_I_AT |
| 1241 | 20590_AT |
| 1242 | 20592_AT |
| 1243 | 20594_AT |
| 1244 | 20608_S_AT |
| 1245 | 20612_S_AT |
| 1246 | 20616_AT |
| 1247 | 20620_G_AT |
| 1248 | 20637_AT |
| 1249 | 20643_AT |
| 1250 | 20649_AT |
| 1251 | 20651_AT |
| 1252 | 20654_S_AT |
| 1253 | 20670_AT |
| 1254 | 20684_AT |
| 1255 | 20685_AT |
| 1256 | 20693_AT |
| 1257 | 20701_S_AT |
| 1258 | 20704_AT |
| 1259 | 20705_AT |
| 1260 | 20715_AT |
| 1261 | 20719_AT |

TABLE 4

| 2X UP IN COLD, ONLY | | | | | |
|---|---|---|---|---|---|
| 11997_at | 12688_at | 13274_s_at | 14145_at | 15083_at | 15639_s_at |
| 11998_at | 12701_i_at | 13278_f_at | 14170_at | 15084_at | 15641_s_at |
| 12018_at | 12702_at | 13279_s_at | 14186_at | 15096_at | 15660_s_at |
| 12031_at | 12719_f_at | 13285_s_at | 14196_at | 15101_s_at | 15665_s_at |
| 12047_at | 12726_f_at | 13288_s_at | 14227_at | 15105_s_at | 15687_f_at |
| 12051_at | 12736_f_at | 13292_s_at | 14234_at | 15112_s_at | 15694_at |
| 12053_at | 12754_g_at | 13297_s_at | 14250_r_at | 15115_f_at | 15712_s_at |
| 12060_at | 12762_r_at | 13299_s_at | 14270_at | 15116_f_at | 15783_s_at |
| 12072_at | 12766_at | 13332_at | 14298_g_at | 15122_s_at | 15808_at |
| 12074_at | 12767_at | 13351_at | 14303_s_at | 15126_s_at | 15837_at |
| 12102_at | 12768_at | 13352_at | 14312_at | 15131_s_at | 15850_at |
| 12112_at | 12773_at | 13422_at | 14339_at | 15132_s_at | 15862_at |
| 12117_at | 12788_at | 13435_at | 14388_at | 15137_s_at | 15868_at |
| 12130_at | 12802_at | 13461_s_at | 14393_at | 15144_s_at | 15878_at |
| 12145_s_at | 12860_s_at | 13467_at | 14511_at | 15148_s_at | 15901_at |
| 12151_at | 12861_s_at | 13488_at | 14525_s_at | 15153_s_at | 15912_at |
| 12163_at | 12879_s_at | 13495_s_at | 14527_at | 15159_s_at | 15920_i_at |
| 12175_at | 12891_at | 13539_i_at | 14534_s_at | 15160_s_at | 15941_at |
| 12187_at | 12914_s_at | 13542_at | 14554_at | 15166_s_at | 15945_at |
| 12195_at | 12927_s_at | 13575_at | 14566_at | 15174_f_at | 15960_at |
| 12219_at | 12947_at | 13577_s_at | 14579_at | 15197_s_at | 15990_at |
| 12256_at | 12956_i_at | 13617_at | 14591_at | 15270_at | 16001_at |
| 12269_s_at | 12966_s_at | 13634_s_at | 14595_at | 15319_at | 16009_s_at |
| 12307_at | 12974_at | 13656_at | 14600_at | 15325_at | 16010_s_at |
| 12315_at | 12987_s_at | 13671_s_at | 14631_s_at | 15337_at | 16034_at |
| 12336_at | 12994_s_at | 13691_s_at | 14635_s_at | 15341_at | 16036_i_at |
| 12349_s_at | 12998_at | 13700_at | 14679_s_at | 15343_at | 16039_s_at |
| 12353_at | 13002_at | 13704_s_at | 14691_at | 15355_s_at | 16040_at |
| 12359_s_at | 13018_at | 13709_s_at | 14697_g_at | 15367_at | 16042_s_at |
| 12390_at | 13023_at | 13715_at | 14709_at | 15379_at | 16047_at |
| 12395_s_at | 13046_g_at | 13785_at | 14711_s_at | 15381_at | 16049_s_at |
| 12431_at | 13054_at | 13803_at | 14728_s_at | 15410_at | 16051_s_at |
| 12436_at | 13086_r_at | 13812_s_at | 14731_s_at | 15417_s_at | 16062_s_at |
| 12443_s_at | 13087_at | 13825_s_at | 14797_s_at | 15422_at | 16079_s_at |
| 12447_at | 13100_at | 13850_i_at | 14809_at | 15433_at | 16087_s_at |
| 12452_at | 13109_at | 13904_s_at | 14843_at | 15451_at | 16090_s_at |
| 12477_at | 13119_at | 13908_s_at | 14847_at | 15452_at | 16117_s_at |
| 12503_at | 13120_at | 13927_at | 14872_at | 15453_s_at | 16118_s_at |
| 12516_s_at | 13128_at | 13971_s_at | 14886_at | 15472_at | 16137_s_at |
| 12532_at | 13134_s_at | 13985_s_at | 14896_at | 15489_at | 16155_s_at |
| 12544_at | 13140_at | 14013_at | 14897_at | 15490_at | 16162_s_at |
| 12561_at | 13143_at | 14019_at | 14900_at | 15503_at | 16184_at |
| 12602_at | 13167_at | 14021_r_at | 14956_s_at | 15510_r_at | 16192_at |
| 12610_at | 13172_s_at | 14028_at | 14958_at | 15517_s_at | 16222_at |
| 12631_at | 13178_at | 14048_at | 14965_at | 15518_at | 16244_at |
| 12647_s_at | 13179_at | 14058_at | 14984_s_at | 15544_at | 16250_at |
| 12650_at | 13181_at | 14059_at | 15004_at | 15588_s_at | 16260_at |
| 12656_at | 13187_i_at | 14064_at | 15010_at | 15600_s_at | 16286_at |
| 12674_at | 13209_s_at | 14073_at | 15036_r_at | 15605_s_at | 16296_at |
| 12675_s_at | 13219_s_at | 14105_at | 15040_g_at | 15613_s_at | 16297_at |
| 12676_s_at | 13221_at | 14106_at | 15046_s_at | 15614_s_at | 16342_at |
| 12681_at | 13243_r_at | 14126_s_at | 15057_at | 15616_s_at | 16367_i_at |
| 12686_s_at | 13260_s_at | 14140_at | 15073_at | 15633_s_at | 16411_s_at |
| 16442_s_at | 17077_s_at | 17978_s_at | 18885_at | 19689_at | 20412_s_at |
| 16465_at | 17102_s_at | 17999_at | 18887_at | 19698_at | 20413_at |
| 16466_s_at | 17109_s_at | 18001_at | 18888_at | 19700_s_at | 20432_at |
| 16468_at | 17113_s_at | 18004_at | 18889_at | 19707_s_at | 20433_at |
| 16486_at | 17123_s_at | 18012_s_at | 18901_at | 19708_at | 20456_at |
| 16487_at | 17128_s_at | 18040_s_at | 18907_s_at | 19713_at | 20462_at |
| 16488_at | 17129_s_at | 18176_at | 18917_i_at | 19718_at | 20471_at |
| 16489_at | 17132_at | 18194_i_at | 18939_at | 19744_at | 20511_at |
| 16496_s_at | 17166_at | 18197_at | 18947_i_at | 19836_at | 20515_s_at |
| 16499_at | 17206_at | 18198_at | 18949_at | 19839_at | 20517_at |
| 16511_at | 17237_at | 18213_at | 18954_at | 19840_s_at | 20518_at |
| 16517_at | 17300_at | 18219_at | 18959_at | 19845_g_at | 20529_at |
| 16538_s_at | 17319_at | 18222_at | 18974_at | 19854_at | 20536_s_at |
| 16554_s_at | 17322_at | 18231_at | 18976_at | 19855_at | 20538_s_at |
| 16571_s_at | 17332_s_at | 18232_at | 18980_at | 19860_at | 20539_s_at |
| 16576_f_at | 17381_at | 18241_at | 18989_s_at | 19866_at | 20576_at |
| 16595_s_at | 17388_at | 18269_s_at | 19019_i_at | 19871_at | 20582_s_at |
| 16605_s_at | 17392_s_at | 18272_at | 19049_at | 19875_s_at | 20586_i_at |
| 16610_s_at | 17408_at | 18282_at | 19083_at | 19879_s_at | 20608_s_at |
| 16620_s_at | 17424_at | 18298_at | 19130_at | 19881_at | 20649_at |
| 16621_s_at | 17429_s_at | 18316_at | 19156_s_at | 19913_at | 20651_at |
| 16635_s_at | 17457_at | 18317_at | 19178_at | 19939_at | 20684_at |
| 16636_s_at | 17458_at | 18331_s_at | 19190_g_at | 19945_at | 20685_at |
| 16638_s_at | 17466_s_at | 18347_s_at | 19199_at | 19947_at | 20699_at |

TABLE 4-continued

2X UP IN COLD, ONLY

| | | | | | |
|---|---|---|---|---|---|
| 16650_s_at | 17477_s_at | 18383_at | 19202_at | 19951_at | 20705_at |
| 16672_at | 17482_s_at | 18390_at | 19209_s_at | 19956_at | 20715_at |
| 16673_at | 17538_s_at | 18455_at | 19211_at | 19971_at | |
| 16687_s_at | 17546_s_at | 18465_s_at | 19218_at | 19976_at | |
| 16747_at | 17562_at | 18544_at | 19229_at | 19998_at | |
| 16753_at | 17581_g_at | 18555_at | 19322_at | 20003_s_at | |
| 16768_at | 17627_at | 18556_at | 19326_at | 20015_at | |
| 16805_s_at | 17631_at | 18560_at | 19359_s_at | 20027_at | |
| 16807_at | 17632_at | 18561_at | 19367_at | 20051_at | |
| 16845_at | 17645_s_at | 18571_at | 19384_at | 20068_at | |
| 16847_at | 17672_at | 18588_at | 19389_at | 20093_i_at | |
| 16896_s_at | 17675_at | 18597_at | 19397_at | 20117_at | |
| 16899_at | 17677_at | 18601_s_at | 19406_at | 20150_at | |
| 16902_at | 17693_at | 18611_at | 19426_s_at | 20156_at | |
| 16911_at | 17732_at | 18623_at | 19441_s_at | 20165_at | |
| 16914_s_at | 17743_at | 18635_at | 19442_at | 20257_at | |
| 16943_s_at | 17748_at | 18659_at | 19470_at | 20262_at | |
| 16956_at | 17775_at | 18660_s_at | 19489_s_at | 20275_at | |
| 16996_s_at | 17782_at | 18673_at | 19562_at | 20282_s_at | |
| 17010_s_at | 17841_at | 18694_s_at | 19577_at | 20288_g_at | |
| 17016_s_at | 17852_g_at | 18705_at | 19589_s_at | 20293_at | |
| 17032_s_at | 17900_s_at | 18708_at | 19597_s_at | 20315_i_at | |
| 17033_s_at | 17901_at | 18738_f_at | 19611_s_at | 20330_s_at | |
| 17043_s_at | 17911_at | 18750_f_at | 19624_at | 20360_at | |
| 17050_s_at | 17921_s_at | 18778_at | 19657_s_at | 20363_at | |
| 17055_s_at | 17922_at | 18829_at | 19667_at | 20369_s_at | |
| 17068_s_at | 17933_at | 18835_at | 19671_at | 20384_at | |
| 17071_s_at | 17967_at | 18866_at | 19677_at | 20393_at | |
| 17075_s_at | 17970_i_at | 18875_s_at | 19686_at | 20396_at | |

TABLE 5

2X UP COLD 3 HR, ONLY

12117_at
12145_s_at
12151_at
12163_at
12187_at
12256_at
12315_at
12349_s_at
12353_at
12359_s_at
12544_at
12602_at
12610_at
12676_s_at
12686_s_at
12701_i_at
12702_at
12719_f_at
12736_f_at
12754_g_at
12766_at
12767_at
12768_at
12773_at
12788_at
12879_s_at
12891_at
12947_at
12966_s_at
12974_at
12994_s_at
13002_at
13100_at
13140_at
13167_at
13172_s_at
13179_at
13187_i_at
13219_s_at
13260_s_at
13278_f_at
13279_s_at
13285_s_at
13288_s_at
13292_s_at
13297_s_at
13351_at
13352_at
13435_at
13467_at
13488_at
13495_s_at
13656_at
13671_s_at
13691_s_at
13785_at
13803_at
13825_s_at
13904_s_at
14013_at
14021_r_at
14028_at
14064_at
14126_s_at
14145_at
14170_at
14196_at
14250_r_at
14298_g_at
14303_s_at
14339_at
14527_at
14534_s_at
14554_at
14595_at
14635_s_at
14679_s_at
14691_at

TABLE 5-continued

2X UP COLD 3 HR, ONLY

14697_g_at
14709_at
14728_s_at
14809_at
14896_at
14965_at
14984_s_at
15046_s_at
15083_at
15096_at
15105_s_at
15115_f_at
15116_f_at
15122_s_at
15126_s_at
15131_s_at
15132_s_at
15137_s_at
15153_s_at
15159_s_at
15160_s_at
15197_s_at
15355_s_at
15379_at
15417_s_at
15422_at
15451_at
15452_at
15453_s_at
15489_at
15518_at
15588_s_at
15613_s_at
15614_s_at
15616_s_at
15639_s_at
15641_s_at
15660_s_at
15687_f_at
15694_s_at
15862_at
15868_at
15878_at
15901_at
16034_at
16039_s_at
16040_at
16042_s_at
16047_at
16062_s_at
16087_s_at
16117_s_at
16118_s_at
16162_s_at
16184_at
16222_at
16250_at
16411_s_at
16442_s_at
16465_at
16486_at
16488_at
16489_at
16517_at
16571_s_at
16605_s_at
16610_s_at
16620_s_at
16636_s_at
16650_s_at
16805_s_at
16845_at
16899_at
16914_s_at
16943_s_at
16996_s_at
17010_s_at

TABLE 5-continued

2X UP COLD 3 HR, ONLY

17043_s_at
17068_s_at
17109_s_at
17128_s_at
17237_at
17319_at
17392_s_at
17429_s_at
17477_s_at
17538_s_at
17581_g_at
17627_at
17672_at
17693_at
17782_at
17841_at
17900_s_at
17933_at
17978_s_at
18001_at
18012_s_at
18198_at
18219_at
18241_at
18269_s_at
18272_at
18282_at
18298_at
18383_at
18556_at
18588_at
18601_s_at
18611_at
18694_s_at
18708_at
18738_f_at
18778_at
18829_at
18835_at
18866_at
18875_s_at
18888_at
18907_s_at
18917_i_at
18939_at
18974_at
19190_g_at
19199_at
19202_at
19211_at
19384_at
19406_at
19426_s_at
19442_at
19470_at
19577_at
19597_s_at
19624_at
19657_s_at
19667_at
19845_g_at
19855_at
19866_at
19945_at
19951_at
19998_at
20003_s_at
20015_at
20051_at
20093_i_at
20117_at
20288_g_at
20360_at
20369_s_at
20384_at
20462_at
20471_at

TABLE 5-continued

2X UP COLD 3 HR, ONLY

| | |
|---|---|
| 20515_s_at | 5 |
| 20538_s_at | |
| 20576_at | |
| 20608_s_at | |
| 20651_at | |
| 20685_at | |
| 20705_at | 10 |

TABLE 6

2X DOWN COLD, ONLY

| | | | | | |
|---|---|---|---|---|---|
| 11991_g_at | 12450_s_at | 12881_s_at | 13151_g_at | 13621_g_at | 14056_at |
| 11992_at | 12474_at | 12889_s_at | 13160_at | 13623_r_at | 14057_at |
| 12001_at | 12491_at | 12901_s_at | 13161_at | 13629_s_at | 14061_at |
| 12006_s_at | 12497_at | 12902_at | 13162_at | 13631_at | 14067_at |
| 12007_at | 12500_s_at | 12904_s_at | 13165_at | 13635_at | 14068_s_at |
| 12009_at | 12515_at | 12905_s_at | 13166_at | 13646_at | 14072_at |
| 12022_at | 12521_at | 12908_s_at | 13185_at | 13650_at | 14074_at |
| 12023_s_at | 12523_at | 12910_s_at | 13193_s_at | 13652_at | 14075_at |
| 12026_at | 12526_at | 12916_s_at | 13211_s_at | 13653_at | 14083_at |
| 12037_at | 12527_at | 12923_s_at | 13213_s_at | 13655_at | 14084_at |
| 12052_at | 12534_g_at | 12926_s_at | 13219_s_at | 13657_at | 14089_at |
| 12125_at | 12549_s_at | 12931_s_at | 13233_at | 13666_s_at | 14095_s_at |
| 12143_at | 12550_s_at | 12937_r_at | 13236_s_at | 13667_s_at | 14096_at |
| 12149_at | 12552_at | 12941_g_at | 13239_s_at | 13669_at | 14100_at |
| 12156_at | 12555_s_at | 12942_at | 13241_s_at | 13670_s_at | 14101_at |
| 12166_i_at | 12556_at | 12949_at | 13254_s_at | 13672_s_at | 14103_at |
| 12167_at | 12575_s_at | 12953_at | 13266_s_at | 13678_s_at | 14121_at |
| 12169_i_at | 12576_s_at | 12958_at | 13273_s_at | 13679_at | 14129_s_at |
| 12176_at | 12581_s_at | 12959_at | 13275_f_at | 13688_s_at | 14133_s_at |
| 12179_at | 12587_at | 12966_s_at | 13276_s_at | 13690_s_at | 14143_at |
| 12196_at | 12597_at | 12975_at | 13278_f_at | 13691_s_at | 14148_at |
| 12198_at | 12606_at | 12983_at | 13280_s_at | 13692_s_at | 14162_at |
| 12200_at | 12609_at | 12984_at | 13285_s_at | 13714_at | 14194_at |
| 12202_at | 12646_at | 13002_at | 13296_s_at | 13724_at | 14208_at |
| 12212_at | 12649_at | 13009_i_at | 13347_at | 13748_at | 14217_at |
| 12214_g_at | 12653_at | 13011_at | 13355_at | 13751_at | 14223_at |
| 12224_at | 12661_at | 13014_at | 13361_at | 13759_at | 14235_at |
| 12226_at | 12666_at | 13024_at | 13404_at | 13767_at | 14236_at |
| 12233_at | 12678_i_at | 13034_s_at | 13406_at | 13789_at | 14251_f_at |
| 12240_at | 12705_f_at | 13041_s_at | 13459_at | 13876_at | 14252_f_at |
| 12253_g_at | 12736_f_at | 13048_s_at | 13460_at | 13880_s_at | 14285_at |
| 12270_at | 12737_f_at | 13067_s_at | 13464_at | 13883_at | 14301_s_at |
| 12278_at | 12758_at | 13068_at | 13523_s_at | 13887_s_at | 14316_at |
| 12284_at | 12760_g_at | 13073_s_at | 13529_at | 13895_at | 14366_at |
| 12287_s_at | 12764_f_at | 13078_s_at | 13541_at | 13906_s_at | 14369_at |
| 12293_at | 12765_at | 13079_at | 13545_s_at | 13919_at | 14392_g_at |
| 12294_s_at | 12772_at | 13081_s_at | 13550_at | 13923_at | 14421_at |
| 12300_at | 12776_at | 13083_at | 13552_at | 13932_at | 14431_at |
| 12312_at | 12784_at | 13090_at | 13556_i_at | 13935_at | 14436_at |
| 12315_at | 12793_at | 13092_s_at | 13561_at | 13940_at | 14448_at |
| 12324_i_at | 12794_at | 13098_at | 13563_s_at | 13949_s_at | 14450_at |
| 12331_s_at | 12795_at | 13103_at | 13567_at | 13954_g_at | 14454_at |
| 12344_at | 12809_g_at | 13105_at | 13568_at | 13973_at | 14459_at |
| 12348_at | 12812_at | 13107_s_at | 13571_at | 13983_at | 14478_at |
| 12353_at | 12815_at | 13108_at | 13576_at | 13989_at | 14482_at |
| 12372_at | 12816_at | 13114_at | 13583_at | 14010_at | 14485_at |
| 12374_i_at | 12818_at | 13118_f_at | 13598_at | 14014_at | 14492_s_at |
| 12405_at | 12824_s_at | 13123_at | 13601_at | 14015_s_at | 14505_at |
| 12408_at | 12828_s_at | 13124_at | 13604_at | 14016_s_at | 14510_at |
| 12410_g_at | 12842_s_at | 13133_s_at | 13613_at | 14025_s_at | 14517_at |
| 12419_at | 12846_s_at | 13135_s_at | 13616_s_at | 14027_at | 14519_at |
| 12427_at | 12858_at | 13139_at | 13618_s_at | 14030_at | 14534_s_at |
| 19438_at | 12869_s_at | 13146_s_at | 13619_at | 14044_at | 14538_r_at |
| 14558_at | 15047_at | 15512_at | 15940_at | 16357_at | 16894_at |
| 14559_s_at | 15054_at | 15514_at | 15948_s_at | 16380_at | 16899_at |
| 14572_at | 15056_at | 15515_r_at | 15956_at | 16382_at | 16920_at |
| 14584_at | 15058_s_at | 15529_at | 15976_at | 16385_s_at | 16921_at |
| 14587_at | 15063_at | 15534_f_at | 15978_at | 16393_s_at | 16924_s_at |
| 14595_at | 15066_at | 15538_at | 15986_s_at | 16402_s_at | 16926_s_at |
| 14602_at | 15081_at | 15541_at | 16004_s_at | 16417_s_at | 16931_s_at |
| 14603_at | 15091_at | 15543_at | 16015_at | 16442_s_at | 16934_s_at |

TABLE 6-continued

2X DOWN COLD, ONLY

| | | | | | |
|---|---|---|---|---|---|
| 14605_at | 15097_s_at | 15551_at | 16017_at | 16446_at | 16937_at |
| 14620_s_at | 15102_s_at | 15574_s_at | 16019_at | 16448_g_at | 16938_at |
| 14626_s_at | 15107_s_at | 15576_s_at | 16024_at | 16453_s_at | 16942_at |
| 14630_s_at | 15118_s_at | 15577_s_at | 16031_at | 16457_s_at | 16949_s_at |
| 14637_s_at | 15127_s_at | 15578_s_at | 16055_s_at | 16470_s_at | 16950_s_at |
| 14640_s_at | 15130_s_at | 15581_s_at | 16059_s_at | 16481_s_at | 16952_s_at |
| 14642_f_at | 15132_s_at | 15583_s_at | 16065_s_at | 16510_at | 16962_s_at |
| 14650_s_at | 15133_s_at | 15591_s_at | 16066_s_at | 16512_s_at | 16965_s_at |
| 14654_s_at | 15139_s_at | 15595_s_at | 16069_s_at | 16514_at | 16970_s_at |
| 14667_s_at | 15143_s_at | 15602_f_at | 16074_s_at | 16516_at | 16977_at |
| 14668_s_at | 15146_s_at | 15606_s_at | 16076_s_at | 16523_s_at | 16984_at |
| 14669_s_at | 15150_s_at | 15608_s_at | 16077_s_at | 16526_at | 16989_at |
| 14672_s_at | 15161_s_at | 15616_s_at | 16084_s_at | 16528_at | 16993_at |
| 14673_s_at | 15162_s_at | 15618_s_at | 16089_s_at | 16531_s_at | 16997_at |
| 14675_s_at | 15167_s_at | 15620_s_at | 16102_s_at | 16535_s_at | 17000_at |
| 14679_s_at | 15170_s_at | 15627_s_at | 16103_s_at | 16537_s_at | 17005_at |
| 14681_g_at | 15171_s_at | 15634_s_at | 16105_s_at | 16543_s_at | 17010_s_at |
| 14682_i_at | 15178_s_at | 15637_s_at | 16108_s_at | 16544_s_at | 17017_s_at |
| 14689_at | 15182_s_at | 15642_s_at | 16112_s_at | 16550_s_at | 17031_s_at |
| 14701_s_at | 15185_s_at | 15643_s_at | 16117_s_at | 16559_s_at | 17040_s_at |
| 14703_at | 15188_s_at | 15646_s_at | 16118_s_at | 16567_s_at | 17053_s_at |
| 14712_s_at | 15193_s_at | 15651_f_at | 16125_s_at | 16577_s_at | 17056_s_at |
| 14713_s_at | 15196_s_at | 15652_s_at | 16127_s_at | 16579_s_at | 17063_s_at |
| 14715_s_at | 15201_f_at | 15667_s_at | 16134_s_at | 16580_s_at | 17070_s_at |
| 14734_s_at | 15206_s_at | 15668_s_at | 16136_s_at | 16583_s_at | 17074_s_at |
| 14781_at | 15207_s_at | 15670_s_at | 16138_s_at | 16584_s_at | 17084_s_at |
| 14800_at | 15213_s_at | 15671_s_at | 16140_s_at | 16593_s_at | 17085_s_at |
| 14856_s_at | 15243_at | 15675_s_at | 16143_s_at | 16598_s_at | 17087_s_at |
| 14882_at | 15256_at | 15679_s_at | 16144_s_at | 16603_s_at | 17092_s_at |
| 14908_at | 15348_at | 15685_s_at | 16145_s_at | 16604_s_at | 17095_s_at |
| 14912_at | 15350_at | 15688_s_at | 16148_s_at | 16611_s_at | 17096_s_at |
| 14914_at | 15372_at | 15689_s_at | 16151_s_at | 16614_s_at | 17097_s_at |
| 14924_at | 15383_at | 15692_s_at | 16158_f_at | 16617_s_at | 17103_s_at |
| 14942_at | 15384_at | 15775_at | 16160_f_at | 16618_s_at | 17105_s_at |
| 14945_at | 15385_at | 15776_at | 16168_s_at | 16620_s_at | 17110_s_at |
| 14955_at | 15387_at | 15845_at | 16169_s_at | 16631_s_at | 17115_s_at |
| 14957_s_at | 15406_at | 15848_at | 16171_s_at | 16634_s_at | 17116_s_at |
| 14974_at | 15423_at | 15858_at | 16172_s_at | 16639_s_at | 17119_s_at |
| 14980_at | 15431_at | 15866_s_at | 16222_at | 16640_s_at | 17122_s_at |
| 14981_at | 15464_at | 15894_at | 16232_s_at | 16652_s_at | 17207_at |
| 14995_at | 15468_at | 15900_at | 16242_at | 16654_at | 17215_at |
| 15009_at | 15471_at | 15901_at | 16288_at | 16777_at | 17247_at |
| 15018_at | 15475_s_at | 15902_at | 16294_s_at | 16784_at | 17254_at |
| 15024_at | 15485_at | 15913_at | 16325_at | 16811_at | 17286_at |
| 15026_at | 15505_at | 15928_at | 16346_s_at | 16893_at | 17288_s_at |
| 17292_at | 17910_at | 18337_s_at | 18823_s_at | 19382_at | 19897_s_at |
| 17303_s_at | 17916_at | 18339_at | 18844_at | 19401_at | 19903_at |
| 17305_at | 17917_s_at | 18365_s_at | 18859_at | 19402_at | 19905_at |
| 17318_at | 17918_at | 18402_at | 18864_at | 19406_at | 19906_at |
| 17323_at | 17926_s_at | 18439_s_at | 18880_at | 19413_at | 19907_at |
| 17374_at | 17935_at | 18487_at | 18883_g_at | 19416_at | 19910_at |
| 17405_at | 17956_i_at | 18508_s_at | 18886_at | 19429_at | 19920_at |
| 17415_at | 17961_at | 18512_at | 18892_s_at | 19432_s_at | 19932_s_at |
| 17418_s_at | 17966_at | 18543_at | 18909_s_at | 19439_at | 19951_at |
| 17420_at | 17978_s_at | 18552_at | 18911_at | 19448_s_at | 19962_at |
| 17423_s_at | 17986_s_at | 18567_at | 18913_s_at | 19454_at | 19963_at |
| 17426_at | 17993_at | 18573_at | 18916_s_at | 19462_s_at | 19969_at |
| 17427_at | 17998_s_at | 18580_at | 18921_g_at | 19464_at | 19970_s_at |
| 17430_s_at | 18003_at | 18581_at | 18950_at | 19469_at | 19972_at |
| 17431_at | 18005_at | 18584_at | 18951_s_at | 19483_at | 19981_at |
| 17439_g_at | 18010_s_at | 18587_s_at | 18956_at | 19484_s_at | 19990_at |
| 17442_i_at | 18013_r_at | 18590_at | 18966_at | 19513_at | 19996_at |
| 17449_s_at | 18023_s_at | 18591_at | 18972_at | 19548_at | 19999_s_at |
| 17462_s_at | 18029_g_at | 18592_s_at | 18994_at | 19563_s_at | 20009_s_at |
| 17463_at | 18030_i_at | 18600_at | 19030_at | 19567_at | 20013_at |
| 17465_at | 18045_at | 18601_s_at | 19039_at | 19581_at | 20017_at |
| 17475_at | 18046_s_at | 18607_s_at | 19068_i_at | 19595_s_at | 20018_at |
| 17479_at | 18059_i_at | 18610_s_at | 19108_at | 19606_at | 20024_s_at |
| 17495_s_at | 18064_r_at | 18611_at | 19115_at | 19623_at | 20045_at |
| 17508_s_at | 18065_r_at | 18616_at | 19117_s_at | 19627_s_at | 20047_at |
| 17522_s_at | 18074_at | 18622_g_at | 19122_at | 19636_at | 20048_at |
| 17523_s_at | 18076_at | 18628_at | 19125_s_at | 19641_at | 20050_at |
| 17529_s_at | 18077_at | 18631_at | 19127_at | 19652_at | 20051_at |
| 17537_s_at | 18078_at | 18636_at | 19135_at | 19655_at | 20058_at |
| 17539_s_at | 18081_at | 18638_at | 19144_at | 19658_at | 20067_at |
| 17543_s_at | 18083_r_at | 18652_at | 19157_s_at | 19660_at | 20069_at |
| 17555_s_at | 18085_r_at | 18657_at | 19158_at | 19665_s_at | 20099_at |

TABLE 6-continued

2X DOWN COLD, ONLY

| | | | | | |
|---|---|---|---|---|---|
| 17557_s_at | 18091_at | 18667_at | 19177_at | 19667_at | 20100_at |
| 17560_s_at | 18154_s_at | 18675_at | 19192_at | 19690_s_at | 20113_s_at |
| 17564_s_at | 18165_at | 18684_at | 19198_at | 19695_at | 20123_at |
| 17565_s_at | 18174_at | 18686_s_at | 19222_at | 19717_at | 20127_s_at |
| 17568_at | 18221_at | 18688_s_at | 19226_g_at | 19726_s_at | 20129_at |
| 17570_g_at | 18226_s_at | 18693_s_at | 19227_at | 19752_s_at | 20133_i_at |
| 17573_at | 18230_at | 18698_s_at | 19230_at | 19759_at | 20152_at |
| 17577_g_at | 18237_at | 18706_s_at | 19232_s_at | 19782_at | 20154_at |
| 17578_at | 18255_at | 18707_at | 19263_at | 19789_s_at | 20173_at |
| 17579_s_at | 18257_at | 18726_s_at | 19285_at | 19803_s_at | 20178_s_at |
| 17585_s_at | 18258_s_at | 18727_at | 19332_at | 19828_at | 20183_at |
| 17596_at | 18274_s_at | 18732_i_at | 19346_at | 19831_i_at | 20188_at |
| 17600_s_at | 18275_at | 18735_s_at | 19347_at | 19833_s_at | 20189_at |
| 17823_s_at | 18278_at | 18736_at | 19361_s_at | 19834_at | 20197_at |
| 17840_s_at | 18283_at | 18738_f_at | 19362_at | 19835_at | 20200_at |
| 17849_s_at | 18290_at | 18747_f_at | 19363_at | 19841_at | 20210_g_at |
| 17857_at | 18291_at | 18754_at | 19364_at | 19867_at | 20213_at |
| 17865_at | 18299_s_at | 18782_at | 19365_s_at | 19870_s_at | 20229_at |
| 17882_at | 18300_at | 18789_at | 19373_at | 19871_at | 20232_s_at |
| 17885_at | 18306_at | 18806_s_at | 19379_at | 19872_at | 20255_at |
| 17902_s_at | 18327_s_at | 18814_at | 19381_at | 19876_at | 20278_s_at |
| 20284_at | 20693_at | | | | |
| 20288_g_at | 20701_s_at | | | | |
| 20294_at | 20704_at | | | | |
| 20312_s_at | 20707_s_at | | | | |
| 20331_at | 20719_at | | | | |
| 20335_s_at | | | | | |
| 20350_s_at | | | | | |
| 20354_s_at | | | | | |
| 20355_at | | | | | |
| 20369_s_at | | | | | |
| 20378_g_at | | | | | |
| 20383_at | | | | | |
| 20385_s_at | | | | | |
| 20387_at | | | | | |
| 20399_at | | | | | |
| 20409_g_at | | | | | |
| 20420_at | | | | | |
| 20429_s_at | | | | | |
| 20439_at | | | | | |
| 20440_at | | | | | |
| 20444_at | | | | | |
| 20445_at | | | | | |
| 20449_at | | | | | |
| 20474_at | | | | | |
| 20480_s_at | | | | | |
| 20495_s_at | | | | | |
| 20499_at | | | | | |
| 20501_at | | | | | |
| 20516_at | | | | | |
| 20520_s_at | | | | | |
| 20530_s_at | | | | | |
| 20538_s_at | | | | | |
| 20547_at | | | | | |
| 20558_at | | | | | |
| 20561_at | | | | | |
| 20567_at | | | | | |
| 20571_at | | | | | |
| 20590_at | | | | | |
| 20592_at | | | | | |
| 20594_at | | | | | |
| 20608_s_at | | | | | |
| 20612_s_at | | | | | |
| 20616_at | | | | | |
| 20620_g_at | | | | | |
| 20635_s_at | | | | | |
| 20637_at | | | | | |
| 20643_at | | | | | |
| 20654_s_at | | | | | |
| 20670_at | | | | | |
| 20674_s_at | | | | | |
| 20684_at | | | | | |
| 20685_at | | | | | |
| 20689_s_at | | | | | |

TABLE 7

SALINE STRESS RESPONSIVE SEQUENCES

| SEQ ID NO: | AFFYMETRIX ID NO: |
|---|---|
| 2227 | 12011_S_AT |
| 2228 | 12153_AT |
| 2229 | 12180_AT |
| 2230 | 12186_AT |
| 2231 | 12216_AT |
| 2232 | 12265_AT |
| 2233 | 12335_AT |
| 2234 | 12449_S_AT |
| 2235 | 12470_AT |
| 2236 | 12479_AT |
| 2237 | 12487_AT |
| 2238 | 12493_G_AT |
| 2239 | 12562_AT |
| 2240 | 12685_AT |
| 2241 | 12704_F_AT |
| 2242 | 12709_F_AT |
| 2243 | 12734_F_AT |
| 2244 | 12739_S_AT |
| 2245 | 12750_S_AT |
| 2246 | 12761_S_AT |
| 2247 | 12813_AT |
| 2248 | 12845_S_AT |
| 2249 | 12946_AT |
| 2250 | 13003_S_AT |
| 2251 | 13052_S_AT |
| 2252 | 13094_AT |
| 2253 | 13142_AT |
| 2254 | 13172_S_AT 17880_S_AT |
| 2255 | 13198_I_AT |
| 2256 | 13209_S_AT 16165_S_AT |
| 2257 | 13229_S_AT |
| 2258 | 13253_F_AT |
| 2259 | 13344_S_AT |
| 2260 | 13370_AT |
| 2261 | 13387_AT |
| 2262 | 13408_S_AT |
| 2263 | 13429_AT |
| 2264 | 13472_AT |
| 2265 | 13526_AT |
| 2266 | 13569_AT |
| 2267 | 13614_AT |
| 2268 | 13686_S_AT |
| 2269 | 13718_AT |
| 2270 | 13719_AT |
| 2271 | 13902_AT |
| 2272 | 13918_AT |
| 2273 | 13944_AT |
| 2274 | 13964_AT |
| 2275 | 13993_S_AT |
| 2276 | 14000_AT |
| 2277 | 14003_AT |
| 2278 | 14032_AT |
| 2279 | 14043_AT |
| 2280 | 14070_AT |
| 2281 | 14267_AT |
| 2282 | 14269_AT |
| 2283 | 14418_AT |
| 2284 | 14427_AT |
| 2285 | 14501_AT |
| 2286 | 14544_AT |
| 2287 | 14546_S_AT |
| 2288 | 14570_AT |
| 2289 | 14596_AT |
| 2290 | 14729_S_AT |
| 2291 | 14874_AT |
| 2292 | 14888_AT |
| 2293 | 14951_AT |
| 2294 | 14952_AT |
| 2295 | 14959_AT |
| 2296 | 14979_AT |
| 2297 | 15006_AT |
| 2298 | 15042_AT |

TABLE 7-continued

SALINE STRESS RESPONSIVE SEQUENCES

| SEQ ID NO: | AFFYMETRIX ID NO: |
|---|---|
| 2299 | 15049_AT |
| 2300 | 15062_AT |
| 2301 | 15108_S_AT |
| 2302 | 15147_S_AT |
| 2303 | 15175_S_AT |
| 2304 | 15176_S_AT |
| 2305 | 15186_S_AT 18696_S_AT |
| 2306 | 15192_S_AT |
| 2307 | 15208_S_AT |
| 2308 | 15324_AT |
| 2309 | 15371_AT |
| 2310 | 15424_AT |
| 2311 | 15463_AT |
| 2312 | 15465_AT |
| 2313 | 15497_S_AT |
| 2314 | 15589_S_AT |
| 2315 | 15636_S_AT |
| 2316 | 15663_S_AT |
| 2317 | 15770_AT |
| 2318 | 15792_AT |
| 2319 | 15855_AT |
| 2320 | 15860_AT |
| 2321 | 15891_AT |
| 2322 | 15898_AT |
| 2323 | 15909_AT |
| 2324 | 15965_AT |
| 2325 | 15969_S_AT |
| 2326 | 15975_S_AT |
| 2327 | 15995_S_AT |
| 2328 | 15998_S_AT 18090_S_AT |
| 2329 | 16028_AT |
| 2330 | 16050_AT |
| 2331 | 16060_S_AT |
| 2332 | 16067_S_AT |
| 2333 | 16072_S_AT |
| 2334 | 16088_F_AT |
| 2335 | 16273_AT |
| 2336 | 16314_AT |
| 2337 | 16413_S_AT |
| 2338 | 16414_AT |
| 2339 | 16426_AT |
| 2340 | 16436_AT |
| 2341 | 16455_AT |
| 2342 | 16502_AT |
| 2343 | 16548_S_AT |
| 2344 | 16568_S_AT |
| 2345 | 16582_S_AT |
| 2346 | 16589_S_AT |
| 2347 | 16594_S_AT |
| 2348 | 16613_S_AT |
| 2349 | 16651_S_AT |
| 2350 | 16668_AT |
| 2351 | 16820_AT |
| 2352 | 16987_S_AT |
| 2353 | 16995_AT |
| 2354 | 17039_S_AT |
| 2355 | 17273_AT |
| 2356 | 17278_AT |
| 2357 | 17433_AT |
| 2358 | 17467_AT |
| 2359 | 17566_AT |
| 2360 | 17595_S_AT |
| 2361 | 17744_S_AT |
| 2362 | 17758_AT |
| 2363 | 17864_AT |
| 2364 | 17868_AT |
| 2365 | 17876_AT |
| 2366 | 17894_AT |
| 2367 | 17942_S_AT |
| 2368 | 18008_R_AT |
| 2369 | 18027_AT |
| 2370 | 18053_S_AT |

TABLE 7-continued

SALINE STRESS RESPONSIVE SEQUENCES

| SEQ ID NO: | AFFYMETRIX ID NO: |
|---|---|
| 2371 | 18062_AT |
| 2372 | 18082_AT |
| 2373 | 18121_S_AT |
| 2374 | 18240_S_AT |
| 2375 | 18248_S_AT |
| 2376 | 18264_AT |
| 2377 | 18276_AT |
| 2378 | 18287_AT |
| 2379 | 18310_AT |
| 2380 | 18367_S_AT |
| 2381 | 18506_AT |
| 2382 | 18605_S_AT |
| 2383 | 18618_S_AT |
| 2384 | 18626_AT |
| 2385 | 18666_S_AT |
| 2386 | 18834_AT |
| 2387 | 18847_AT |
| 2388 | 18896_AT |
| 2389 | 18899_S_AT |
| 2390 | 18973_AT |
| 2391 | 18983_S_AT |
| 2392 | 18988_AT |
| 2393 | 18998_S_AT |
| 2394 | 19065_AT |
| 2395 | 19119_I_AT |
|  | 19121_AT |
| 2396 | 19207_AT |
| 2397 | 19220_AT |
| 2398 | 19284_AT |
| 2399 | 19315_AT |
| 2400 | 19348_AT |
| 2401 | 19403_S_AT |
| 2402 | 19437_S_AT |
| 2403 | 19502_AT |
| 2404 | 19609_AT |
| 2405 | 19645_AT |
| 2406 | 19742_AT |
| 2407 | 19863_AT |
| 2408 | 19873_AT |
| 2409 | 19891_AT |
| 2410 | 20004_S_AT |
| 2411 | 20053_AT |
| 2412 | 20138_AT |
| 2413 | 20193_AT |
| 2414 | 20199_AT |
| 2415 | 20220_AT |
| 2416 | 20239_G_AT |
| 2417 | 20297_AT |
| 2418 | 20324_S_AT |
| 2419 | 20353_AT |
| 2420 | 20362_AT |
| 2421 | 20389_AT |
| 2422 | 20546_AT |
| 2423 | 20600_AT |
| 2424 | 20623_AT |
| 2425 | 20629_AT |
| 2426 | 20648_S_AT |
| 2427 | 20668_AT |

TABLE 8

2X UP IN SALT, ONLY

| | | | | |
|---|---|---|---|---|
| 12037_at | 14570_at | 16190_at | 18506_at | 20648_s_at |
| 12137_at | 14578_s_at | 16196_at | 18605_s_at | 20678_at |
| 12153_at | 14596_at | 16273_at | 18626_at | 20686_at |
| 12186_at | 14646_s_at | 16314_at | 18666_s_at | 20707_s_at |
| 12216_at | 14662_f_at | 16413_s_at | 18747_f_at | |
| 12268_at | 14668_s_at | 16414_at | 18782_at | |
| 12449_s_at | 14729_s_at | 16417_s_at | 18834_at | |
| 12470_at | 14874_at | 16455_at | 18847_at | |

TABLE 8-continued

2X UP IN SALT, ONLY

| | | | |
|---|---|---|---|
| 12476_at | 14888_at | 16548_s_at | 18913_s_at |
| 12487_at | 14918_at | 16582_s_at | 18973_at |
| 12493_g_at | 14952_at | 16589_s_at | 18988_at |
| 12609_at | 14959_at | 16594_s_at | 18998_s_at |
| 12685_at | 14986_at | 16613_s_at | 19065_at |
| 12704_f_at | 15006_at | 16651_s_at | 19068_i_at |
| 12709_f_at | 15042_at | 16668_at | 19123_at |
| 12734_f_at | 15047_at | 16690_g_at | 19177_at |
| 12739_s_at | 15062_at | 16762_at | 19220_at |
| 12750_s_at | 15063_at | 16820_at | 19284_at |
| 12761_s_at | 15108_s_at | 16873_i_at | 19288_at |
| 12819_at | 15133_s_at | 16987_s_at | 19315_at |
| 12845_s_at | 15147_s_at | 16989_at | 19437_s_at |
| 12946_at | 15170_s_at | 16995_at | 19484_at |
| 13142_at | 15175_s_at | 17039_s_at | 19502_at |
| 13198_i_at | 15182_s_at | 17040_s_at | 19503_at |
| 13229_s_at | 15190_s_at | 17400_s_at | 19592_at |
| 13275_f_at | 15192_s_at | 17425_s_at | 19645_at |
| 13344_s_at | 15324_at | 17433_at | 19742_at |
| 13370_at | 15392_at | 17467_at | 19835_at |
| 13408_s_at | 15424_at | 17490_s_at | 19873_at |
| 13464_at | 15467_at | 17529_s_at | 19891_at |
| 13472_at | 15497_s_at | 17543_s_at | 19992_at |
| 13526_at | 15581_s_at | 17566_at | 20004_s_at |
| 13614_at | 15623_f_at | 17595_s_at | 20053_at |
| 13652_at | 15636_s_at | 17744_s_at | 20133_i_at |
| 13679_s_at | 15646_s_at | 17758_at | 20138_at |
| 13751_at | 15670_s_at | 17855_at | 20190_at |
| 13918_at | 15770_at | 17864_at | 20199_at |
| 13919_at | 15775_at | 17876_at | 20200_at |
| 13944_at | 15778_at | 18008_r_at | 20297_at |
| 13964_at | 15792_at | 18013_r_at | 20324_s_at |
| 13987_s_at | 15855_at | 18024_s_at | 20335_s_at |
| 13993_s_at | 15891_at | 18027_at | 20353_at |
| 14000_at | 15909_at | 18053_s_at | 20362_at |
| 14032_at | 15923_at | 18078_at | 20385_s_at |
| 14043_at | 15969_s_at | 18082_at | 20389_at |
| 14052_at | 15975_s_at | 18090_s_at | 20402_s_at |
| 14067_at | 15995_s_at | 18091_at | 20450_at |
| 14070_at | 15998_s_at | 18121_s_at | 20468_at |
| 14269_at | 16017_at | 18264_at | 20489_at |
| 14285_at | 16050_at | 18276_at | 20546_at |
| 14427_at | 16067_s_at | 18300_at | 20569_s_at |
| 14501_at | 16072_s_at | 18367_s_at | 20600_at |
| 14540_at | 16165_s_at | 18471_at | 20623_at |

TABLE 9

2X UP SALT, 3 HR ONLY

| | | | |
|---|---|---|---|
| 12037_at | 15042_at | 16987_s_at | 20004_s_at |
| 12137_at | 15047_at | 16989_at | 20053_at |
| 12153_at | 15062_at | 17039_s_at | 20133_i_at |
| 12186_at | 15063_at | 17040_s_at | 20138_at |
| 12216_at | 15108_s_at | 17425_s_at | 20190_at |
| 12268_at | 15133_s_at | 17433_at | 20199_at |
| 12470_at | 15147_s_at | 17490_s_at | 20200_at |
| 12476_at | 15170_s_at | 17543_s_at | 20220_at |
| 12487_at | 15175_s_at | 17744_s_at | 20362_at |
| 12493_g_at | 15182_s_at | 17864_at | 20385_s_at |
| 12609_at | 15190_s_at | 17876_at | 20389_at |
| 12685_at | 15192_s_at | 18008_r_at | 20489_at |
| 12704_f_at | 15324_at | 18013_r_at | 20546_at |
| 12709_f_at | 15424_at | 18024_s_at | 20623_at |
| 12734_f_at | 15467_at | 18027_at | 20648_s_at |
| 12739_s_at | 15497_s_at | 18053_s_at | 20678_at |
| 12750_s_at | 15623_f_at | 18078_at | 20707_s_at |
| 12819_at | 15636_s_at | 18082_at | |
| 12946_at | 15646_s_at | 18090_s_at | |
| 13142_at | 15670_s_at | 18091_at | |
| 13229_s_at | 15770_at | 18121_s_at | |
| 13275_f_at | 15775_at | 18264_at | |
| 13370_at | 15778_at | 18276_at | |
| 13408_s_at | 15792_at | 18367_s_at | |

TABLE 9-continued

2X UP SALT, 3 HR ONLY

| | | |
|---|---|---|
| 13464_at | 15855_at | 18471_at |
| 13472_at | 15891_at | 18506_at |
| 13614_at | 15909_at | 18605_s_at |
| 13652_at | 15923_at | 18626_at |
| 13679_s_at | 15969_s_at | 18666_s_at |
| 13918_at | 15975_s_at | 18747_f_at |
| 13919_at | 15995_s_at | 18782_at |
| 13944_at | 15998_s_at | 18834_at |
| 13987_s_at | 16017_at | 18847_at |
| 13993_s_at | 16050_at | 18913_s_at |
| 14000_at | 16067_at | 18973_at |
| 14032_at | 16072_s_at | 18988_at |
| 14043_at | 16165_s_at | 19065_at |
| 14052_at | 16196_at | 19068_i_at |
| 14067_at | 16273_at | 19123_at |
| 14269_at | 16314_at | 19177_at |
| 14285_at | 16414_at | 19220_at |
| 14501_at | 16417_s_at | 19288_at |
| 14540_at | 16455_at | 19315_at |
| 14570_at | 16548_s_at | 19437_s_at |
| 14596_at | 16582_at | 19484_s_at |
| 14668_s_at | 16589_s_at | 19502_at |
| 14729_s_at | 16594_s_at | 19503_at |
| 14888_at | 16613_s_at | 19592_at |
| 14918_at | 16651_s_at | 19645_at |
| 14952_at | 16668_at | 19742_at |
| 14959_at | 16762_at | 19835_at |
| 14986_at | 16820_at | 19873_at |
| 15006_at | 16873_i_at | 19891_at |

TABLE 10

2X DOWN SALT, ONLY

| | | |
|---|---|---|
| 12011_s_at | 16046_s_at | 20239_g_at |
| 12180_at | 16060_at | 20433_at |
| 12265_at | 16088_f_at | 20629_at |
| 12335_at | 16150_s_at | 20668_at |
| 12479_at | 16166_s_at | |
| 12562_at | 16316_at | |
| 12656_at | 16340_at | |
| 12813_at | 16367_i_at | |
| 13003_s_at | 16426_at | |
| 13052_s_at | 16427_at | |
| 13094_at | 16436_at | |
| 13178_at | 16489_at | |
| 13253_f_at | 16502_at | |
| 13387_at | 16568_s_at | |
| 13429_at | 16638_s_at | |
| 13472_at | 16646_s_at | |
| 13569_at | 17273_at | |
| 13686_s_at | 17278_at | |
| 13718_at | 17567_at | |
| 13719_at | 17868_at | |
| 13902_at | 17880_s_at | |
| 14003_at | 17894_at | |
| 14144_at | 17901_at | |
| 14267_at | 17942_s_at | |
| 14418_at | 17960_at | |
| 14544_at | 17999_at | |
| 14546_s_at | 18062_at | |
| 14636_s_at | 18240_s_at | |
| 14951_at | 18248_s_at | |
| 14956_s_at | 18267_at | |
| 14979_at | 18279_s_at | |
| 14990_at | 18287_at | |
| 15040_g_at | 18310_at | |
| 15049_at | 18351_s_at | |
| 15115_f_at | 18455_at | |
| 15137_s_at | 18560_at | |
| 15148_s_at | 18571_at | |
| 15176_s_at | 18618_s_at | |
| 15208_s_at | 18896_at | |
| 15371_at | 18899_s_at | |

TABLE 10-continued

2X DOWN SALT, ONLY

| | |
|---|---|
| 15453_s_at | 18967_s_at |
| 15463_at | 18983_s_at |
| 15465_at | 19119_i_at |
| 15589_s_at | 19121_at |
| 15663_s_at | 19207_at |
| 15860_at | 19348_at |
| 15898_at | 19403_s_at |
| 15931_at | 19609_at |
| 15965_at | 19742_at |
| 15970_s_at | 19826_at |
| 15972_s_at | 19863_at |
| 16005_s_at | 19883_at |
| 16028_at | 20193_at |

TABLE 11

OSMOTIC STRESS RESPONSIVE SEQUENCES

| SEQ ID NO: | AFFYMETRIX ID NO: |
|---|---|
| 2428 | 11994_AT |
| 2429 | 12028_AT |
| 2430 | 12033_AT |
| 2431 | 12039_AT |
| 2432 | 12068_AT |
| 2433 | 12096_AT |
| 2434 | 12110_AT |
| 2435 | 12114_AT |
| 2436 | 12135_AT |
| 2437 | 12139_AT |
| 2438 | 12189_AT |
| 2439 | 12191_AT |
| 2440 | 12211_AT |
| 2441 | 12223_S_AT |
| 2442 | 12366_S_AT |
| | 12869_S_AT |
| 2443 | 12381_AT |
| 2444 | 12406_S_AT |
| 2445 | 12412_AT |
| 2446 | 12453_AT |
| 2447 | 12571_S_AT |
| 2448 | 12662_AT |
| 2449 | 12746_I_AT |
| 2450 | 12774_AT |
| 2451 | 12787_AT |
| 2452 | 12847_AT |
| 2453 | 12848_AT |
| 2454 | 12895_AT |
| 2455 | 12911_S_AT |
| 2456 | 12920_AT |
| | 12921_S_AT |
| 2457 | 13027_AT |
| 2458 | 13059_AT |
| 2459 | 13075_I_AT |
| 2460 | 13180_S_AT |
| 2461 | 13255_I_AT |
| 2462 | 13270_AT |
| | 18167_S_AT |
| 2463 | 13283_S_AT |
| 2464 | 13382_AT |
| 2465 | 13386_S_AT |
| 2466 | 13433_AT |
| 2467 | 13482_AT |
| 2468 | 13732_AT |
| 2469 | 13733_I_AT |
| 2470 | 13842_AT |
| 2471 | 13860_S_AT |
| 2472 | 13868_AT |
| 2473 | 13901_AT |
| 2474 | 13933_AT |
| 2475 | 13995_AT |
| 2476 | 14062_AT |
| 2477 | 14118_I_AT |

TABLE 11-continued

OSMOTIC STRESS RESPONSIVE SEQUENCES

| SEQ ID NO: | AFFYMETRIX ID NO: |
|---|---|
| 2478 | 14141_AT |
| 2479 | 14310_AT |
| 2480 | 14354_AT |
| 2481 | 14476_AT |
| 2482 | 14513_S_AT |
| 2483 | 14568_S_AT |
| 2484 | 14604_AT |
| 2485 | 14634_S_AT |
| 2486 | 14660_S_AT |
| 2487 | 14666_S_AT |
| 2488 | 14686_S_AT |
|  | 17464_AT |
| 2489 | 14726_S_AT |
| 2490 | 14848_S_AT |
| 2491 | 14873_AT |
| 2492 | 14883_AT |
| 2493 | 15082_AT |
| 2494 | 15121_S_AT |
|  | 16014_S_AT |
| 2495 | 15168_S_AT |
| 2496 | 15271_AT |
| 2497 | 15338_AT |
| 2498 | 15418_AT |
| 2499 | 15429_AT |
| 2500 | 15548_AT |
| 2501 | 15666_S_AT |
| 2502 | 15672_S_AT |
| 2503 | 15680_S_AT |
| 2504 | 15867_AT |
| 2505 | 15918_AT |
| 2506 | 15999_S_AT |
| 2507 | 16303_AT |
| 2508 | 16363_AT |
| 2509 | 16440_S_AT |
| 2510 | 16458_S_AT |
| 2511 | 16475_AT |
| 2512 | 16513_S_AT |
| 2513 | 16529_AT |
| 2514 | 16547_S_AT |
| 2515 | 16553_F_AT |
| 2516 | 16563_S_AT |
| 2517 | 16629_S_AT |
| 2518 | 16797_AT |
| 2519 | 16814_AT |
| 2520 | 16832_AT |
| 2521 | 16976_S_AT |
| 2522 | 17007_AT |
| 2523 | 17037_S_AT |
| 2524 | 17054_S_AT |
| 2525 | 17257_S_AT |
|  | 18725_S_AT |
| 2526 | 17270_AT |
| 2527 | 17275_I_AT |
| 2528 | 17376_AT |
| 2529 | 17378_AT |
| 2530 | 17468_AT |
| 2531 | 17481_AT |
| 2532 | 17511_S_AT |
| 2533 | 17519_S_AT |
| 2534 | 17815_S_AT |
| 2535 | 17897_AT |
| 2536 | 17923_S_AT |
| 2537 | 17934_AT |
| 2538 | 17937_S_AT |
| 2539 | 17944_AT |
| 2540 | 17958_AT |
| 2541 | 18216_AT |
| 2542 | 18227_AT |
| 2543 | 18284_AT |
| 2544 | 18301_S_AT |
| 2545 | 18312_S_AT |
| 2546 | 18326_S_AT |
| 2547 | 18369_AT |
| 2548 | 18411_AT |

TABLE 11-continued

OSMOTIC STRESS RESPONSIVE SEQUENCES

| SEQ ID NO: | AFFYMETRIX ID NO: |
|---|---|
| 2549 | 18533_AT |
| 2550 | 18576_S_AT |
| 2551 | 18599_AT |
| 2552 | 18640_AT |
| 2553 | 18672_S_AT |
| 2554 | 18720_S_AT |
| 2555 | 18768_AT |
| 2556 | 18877_AT |
| 2557 | 18942_AT |
| 2558 | 18945_AT |
| 2559 | 18960_AT |
| 2560 | 18965_AT |
| 2561 | 19060_AT |
| 2562 | 19164_G_AT |
| 2563 | 19266_AT |
| 2564 | 19366_S_AT |
| 2565 | 19369_AT |
| 2566 | 19371_AT |
| 2567 | 19386_AT |
| 2568 | 19412_AT |
| 2569 | 19427_S_AT |
| 2570 | 19622_G_AT |
| 2571 | 19681_AT |
| 2572 | 19819_S_AT |
| 2573 | 19961_S_AT |
| 2574 | 20002_AT |
| 2575 | 20034_I_AT |
| 2576 | 20062_AT |
| 2577 | 20136_AT |
| 2578 | 20223_AT |
| 2579 | 20235_I_AT |
| 2580 | 20401_AT |
| 2581 | 20407_AT |
| 2582 | 20470_AT |
| 2583 | 20626_AT |
| 2584 | 20631_S_AT |
| 2585 | 20647_AT |

TABLE 12

2X UP IN MANNITOL, ONLY

| | |
|---|---|
| 12039_at | 16832_at |
| 12068_at | 16993_at |
| 12139_at | 17037_s_at |
| 12212_at | 17054_s_at |
| 12278_at | 17083_s_at |
| 12366_s_at | 17097_s_at |
| 12453_at | 17119_s_at |
| 12556_at | 17270_at |
| 12575_s_at | 17305_at |
| 12746_i_at | 17376_at |
| 12848_at | 17378_at |
| 12869_s_at | 17449_s_at |
| 12920_at | 17481_at |
| 12921_s_at | 17533_s_at |
| 13041_s_at | 17832_s_at |
| 13059_at | 17923_s_at |
| 13241_s_at | 17944_at |
| 13255_i_at | 18059_f_at |
| 13270_at | 18216_at |
| 13382_at | 18230_at |
| 13406_at | 18255_at |
| 13433_at | 18284_at |
| 13550_at | 18301_s_at |
| 13672_s_at | 18312_s_at |
| 13716_at | 18326_s_at |
| 13842_at | 18599_at |
| 13933_at | 18672_s_at |
| 13995_at | 18720_s_at |
| 14062_at | 18768_at |

TABLE 12-continued

2X UP IN MANNITOL, ONLY

| | |
|---|---|
| 14075_at | 18814_at |
| 14162_at | 18877_at |
| 14208_at | 18921_g_at |
| 14217_at | 18960_at |
| 14235_at | 19060_at |
| 14310_at | 19182_at |
| 14431_at | 19192_at |
| 14513_s_at | 19266_at |
| 14584_at | 19369_at |
| 14604_at | 19386_at |
| 14673_s_at | 19402_at |
| 14856_s_at | 19412_at |
| 15207_s_at | 19432_s_at |
| 15338_at | 19469_at |
| 15406_at | 19622_g_at |
| 15418_at | 19819_s_at |
| 15591_s_at | 19826_at |
| 15666_s_at | 20152_at |
| 15680_s_at | 20223_at |
| 15866_s_at | 20235_i_at |
| 15918_at | 20365_s_at |
| 16340_at | 20470_at |
| 16553_f_at | 20537_at |
| 16797_at | 20547_at |

TABLE 13

2X UP IN MANNITOL, 3 HR ONLY

| | |
|---|---|
| 12039_at | 17449_s_at |
| 12068_at | 17481_at |
| 12139_at | 17533_s_at |
| 12212_at | 17923_s_at |
| 12278_at | 17944_at |
| 12366_s_at | 18059_i_at |
| 12453_at | 18216_at |
| 12556_at | 18230_at |
| 12575_s_at | 18255_at |
| 12746_i_at | 18301_s_at |
| 12848_at | 18312_s_at |
| 12869_s_at | 18326_s_at |
| 12920_at | 18599_at |
| 12921_s_at | 18720_s_at |
| 13041_s_at | 18768_at |
| 13059_at | 18814_at |
| 13241_s_at | 18877_at |
| 13382_at | 18921_g_at |
| 13406_at | 18960_at |
| 13433_at | 19060_at |
| 13550_at | 19192_at |
| 13672_s_at | 19266_at |
| 13933_at | 19369_at |
| 13995_at | 19386_at |
| 14062_at | 19402_at |
| 14075_at | 19412_at |
| 14162_at | 19432_s_at |
| 14217_at | 19469_at |
| 14310_at | 19622_g_at |
| 14431_at | 19819_s_at |
| 14513_s_at | 20152_at |
| 14584_at | 20223_at |
| 14604_at | 20235_i_at |
| 14673_s_at | 20365_s_at |
| 14856_s_at | 20470_at |
| 15207_s_at | 20537_at |
| 15338_at | |
| 15418_at | |
| 15591_s_at | |
| 15866_s_at | |
| 15918_at | |
| 16340_at | |
| 16553_f_at | |
| 16797_at | |
| 16832_at | |

TABLE 13-continued

2X UP IN MANNITOL, 3 HR ONLY

17037_s_at

17054_s_at

17083_s_at

17097_s_at

17270_at

17305_at

17376_at

17378_at

TABLE 14

2X DOWN IN MANNITOL, ONLY

| | | |
|---|---|---|
| 12028_at | 14897_at | 17958_at |
| 12033_at | 14918_at | 18012_s_at |
| 12110_at | 15082_at | 18227_at |
| 12114_at | 15084_at | 18272_at |
| 12189_at | 15098_s_at | 18331_s_at |
| 12191_at | 15105_s_at | 18369_at |
| 12211_at | 15121_s_at | 18411_at |
| 12223_s_at | 15126_s_at | 18533_at |
| 12268_at | 15168_s_at | 18576_s_at |
| 12345_at | 15271_at | 18640_at |
| 12381_at | 15429_at | 18696_s_at |
| 12406_s_at | 15548_at | 18945_at |
| 12412_at | 15672_s_at | 18949_at |
| 12522_at | 15753_at | 18953_at |
| 12571_s_at | 15867_at | 18965_at |
| 12662_at | 15999_s_at | 19164_g_at |
| 12787_at | 16001_at | 19322_at |
| 12847_at | 16021_s_at | 19366_s_at |
| 12895_at | 16190_at | 19371_at |
| 12911_s_at | 16260_at | 19397_at |
| 13027_at | 16303_at | 19427_s_at |
| 13075_i_at | 16363_at | 19681_at |
| 13221_at | 16458_s_at | 19707_s_at |
| 13262_s_at | 16468_at | 19839_at |
| 13283_s_at | 16475_at | 19961_s_at |
| 13386_s_at | 16513_s_at | 19976_at |
| 13447_s_at | 16529_at | 19998_at |
| 13482_at | 16563_s_at | 20002_at |
| 13634_s_at | 16690_g_at | 20034_i_at |
| 13709_s_at | 16814_at | 20136_at |
| 13732_at | 16847_at | 20382_s_at |
| 13733_i_at | 16927_s_at | 20407_at |
| 13812_s_at | 16976_at | 20529_at |
| 13825_s_at | 17007_at | 20626_at |
| 13860_s_at | 17014_s_at | 20631_s_at |
| 13868_at | 17016_s_at | 20647_at |
| 13901_at | 17071_s_at | 20699_at |
| 14052_at | 17090_s_at | |
| 14224_at | 17257_s_at | |
| 14244_s_at | 17275_i_at | |
| 14254_s_at | 17424_at | |
| 14256_f_at | 17464_at | |
| 14354_at | 17468_at | |
| 14476_at | 17511_s_at | |
| 14568_s_at | 17519_s_at | |
| 14634_s_at | 17525_s_at | |
| 14646_s_at | 17645_s_at | |
| 14660_s_at | 17741_at | |
| 14686_s_at | 17815_s_at | |
| 14726_s_at | 17897_at | |
| 14848_s_at | 17899_at | |
| 14873_at | 17934_at | |
| 14883_at | 17937_s_at | |

TABLE 15

COLD & OSOMOTIC STRESS RESPONSIVE SEQUENCES

| SEQ ID NO: | AFFYMETRIX ID NO: |
|---|---|
| 1699 | 12040_AT |
| 1700 | 12048_AT |
| 1701 | 12054_S_AT |
| 1702 | 12077_AT |
| 1703 | 12107_I_AT |
| 1704 | 12113_AT |
| 1705 | 12154_AT |
| 1706 | 12171_AT |
| 1707 | 12212_AT |
| 1708 | 12278_AT |
| 1709 | 12317_AT |
| 1710 | 12325_AT |
| 1711 | 12333_AT |
| 1712 | 12345_AT |
| 1713 | 12349_S_AT |
|  | 14254_S_AT |
|  | 14256_F_AT |
| 1714 | 12356_AT |
| 1715 | 12380_AT |
| 1716 | 12392_AT |
| 1717 | 12460_S_AT |
| 1718 | 12556_AT |
| 1719 | 12575_S_AT |
| 1720 | 12686_S_AT |
| 1721 | 12701_I_AT |
| 1722 | 12754_G_AT |
| 1723 | 12782_R_AT |
| 1724 | 12784_AT |
| 1725 | 12879_S_AT |
| 1726 | 12891_AT |
|  | 16817_S_AT |
| 1727 | 12898_G_AT |
| 1728 | 12974_AT |
| 1729 | 12998_AT |
| 1730 | 13041_S_AT |
| 1731 | 13124_AT |
| 1732 | 13134_S_AT |
| 1733 | 13144_AT |
| 1734 | 13147_AT |
| 1735 | 13152_S_AT |
| 1736 | 13187_I_AT |
|  | 16981_S_AT |
| 1737 | 13192_S_AT |
|  | 17525_S_AT |
| 1738 | 13212_S_AT |
| 1739 | 13215_S_AT |
|  | 16649_S_AT |
| 1740 | 13241_S_AT |
| 1741 | 13246_AT |
| 1742 | 13262_S_AT |
| 1743 | 13286_S_AT |
| 1744 | 13324_AT |
| 1745 | 13340_S_AT |
| 1746 | 13361_AT |
| 1747 | 13406_AT |
| 1748 | 13441_S_AT |
| 1749 | 13513_AT |
| 1750 | 13550_AT |
| 1751 | 13573_AT |
| 1752 | 13577_S_AT |
| 1753 | 13606_AT |
| 1754 | 13609_AT |
| 1755 | 13625_S_AT |
| 1756 | 13626_AT |
| 1757 | 13634_S_AT |
| 1758 | 13672_S_AT |
|  | 18916_S_AT |
| 1759 | 13709_S_AT |
| 1760 | 13736_AT |
| 1761 | 13775_AT |
| 1762 | 13810_AT |
| 1763 | 13812_S_AT |
| 1764 | 13825_S_AT |
| 1765 | 14015_S_AT |

TABLE 15-continued

COLD & OSOMOTIC STRESS RESPONSIVE SEQUENCES

| SEQ ID NO: | AFFYMETRIX ID NO: |
|---|---|
|  | 14016_S_AT |
| 1766 | 14029_AT |
| 1767 | 14036_AT |
| 1768 | 14051_AT |
| 1769 | 14060_AT |
| 1770 | 14064_AT |
| 1771 | 14066_AT |
| 1772 | 14075_AT |
| 1773 | 14094_S_AT |
|  | 19999_S_AT |
| 1774 | 14096_AT |
| 1775 | 14104_AT |
| 1776 | 14123_S_AT |
| 1777 | 14126_S_AT |
| 1778 | 14131_AT |
| 1779 | 14136_AT |
| 1780 | 14139_AT |
|  | 14140_AT |
| 1781 | 14162_AT |
|  | 14217_AT |
| 1782 | 14178_AT |
| 1783 | 14201_AT |
| 1784 | 14208_AT |
| 1785 | 14235_AT |
| 1786 | 14242_S_AT |
| 1787 | 14431_AT |
| 1788 | 14480_AT |
| 1789 | 14497_AT |
| 1790 | 14553_AT |
| 1791 | 14584_AT |
| 1792 | 14600_AT |
| 1793 | 14673_S_AT |
|  | 19432_S_AT |
| 1794 | 14681_G_AT |
| 1795 | 14699_AT |
| 1796 | 14751_AT |
| 1797 | 14762_AT |
| 1798 | 14828_S_AT |
| 1799 | 14856_S_AT |
| 1800 | 14882_AT |
| 1801 | 14897_AT |
| 1802 | 14978_AT |
| 1803 | 14985_S_AT |
| 1804 | 15031_AT |
| 1805 | 15084_AT |
| 1806 | 15096_AT |
| 1807 | 15105_S_AT |
| 1808 | 15110_S_AT |
| 1809 | 15111_S_AT |
| 1810 | 15120_S_AT |
| 1811 | 15126_S_AT |
| 1812 | 15142_S_AT |
| 1813 | 15144_S_AT |
| 1814 | 15184_S_AT |
| 1815 | 15198_S_AT |
| 1816 | 15203_S_AT |
| 1817 | 15207_S_AT |
| 1818 | 15240_AT |
| 1819 | 15366_AT |
| 1820 | 15398_AT |
| 1821 | 15406_AT |
| 1822 | 15448_AT |
| 1823 | 15466_AT |
| 1824 | 15481_AT |
| 1825 | 15484_AT |
| 1826 | 15549_AT |
| 1827 | 15591_S_AT |
| 1828 | 15606_S_AT |
| 1829 | 15614_S_AT |
|  | 16927_S_AT |
| 1830 | 15629_S_AT |
| 1831 | 15633_S_AT |
| 1832 | 15641_S_AT |
|  | 18012_S_AT |

TABLE 15-continued

COLD & OSOMOTIC STRESS RESPONSIVE SEQUENCES

| SEQ ID NO: | AFFYMETRIX ID NO: |
|---|---|
| 1833 | 15720_AT |
| 1834 | 15815_S_AT |
| 1835 | 15817_AT |
| 1836 | 15837_AT |
| 1837 | 15841_AT |
| 1838 | 15866_S_AT |
|  | 18255_AT |
| 1839 | 15872_AT |
|  | 18331_S_AT |
| 1840 | 15892_AT |
| 1841 | 15933_AT |
| 1842 | 15947_AT |
| 1843 | 15959_S_AT |
| 1844 | 16001_AT |
| 1845 | 16052_AT |
| 1846 | 16161_S_AT |
| 1847 | 16204_AT |
| 1848 | 16232_S_AT |
| 1849 | 16252_AT |
| 1850 | 16260_AT |
| 1851 | 16266_AT |
| 1852 | 16299_AT |
| 1853 | 16365_AT |
| 1854 | 16468_AT |
| 1855 | 16477_AT |
| 1856 | 16491_AT |
| 1857 | 16523_S_AT |
| 1858 | 16566_S_AT |
| 1859 | 16570_S_AT |
| 1860 | 16688_AT |
| 1861 | 16840_AT |
| 1862 | 16847_AT |
| 1863 | 16893_AT |
| 1864 | 16896_S_AT |
| 1865 | 16898_S_AT |
| 1866 | 16912_S_AT |
| 1867 | 16980_AT |
| 1868 | 16993_AT |
| 1869 | 17008_AT |
| 1870 | 17012_S_AT |
| 1871 | 17014_S_AT |
| 1872 | 17016_S_AT |
| 1873 | 17032_S_AT |
| 1874 | 17050_S_AT |
|  | 17051_S_AT |
| 1875 | 17071_S_AT |
| 1876 | 17090_S_AT |
|  | 18690_S_AT |
| 1877 | 17097_S_AT |
| 1878 | 17104_S_AT |
| 1879 | 17119_S_AT |
| 1880 | 17160_AT |
| 1881 | 17305_AT |
| 1882 | 17424_AT |
| 1883 | 17449_S_AT |
| 1884 | 17452_G_AT |
| 1885 | 17540_S_AT |
| 1886 | 17552_S_AT |
| 1887 | 17571_AT |
| 1888 | 17589_AT |
| 1889 | 17641_G_AT |
| 1890 | 17741_AT |
|  | 18098_AT |
| 1891 | 17766_AT |
| 1892 | 17873_S_AT |
| 1893 | 17904_AT |
| 1894 | 17920_S_AT |
| 1895 | 17925_AT |
| 1896 | 17943_AT |
| 1897 | 18059_I_AT |
| 1898 | 18230_AT |
| 1899 | 18263_AT |
| 1900 | 18272_AT |
| 1901 | 18540_AT |

TABLE 15-continued

COLD & OSOMOTIC STRESS RESPONSIVE SEQUENCES

| SEQ ID NO: | AFFYMETRIX ID NO: |
|---|---|
| 1902 | 18608_AT |
| 1903 | 18647_AT |
| 1904 | 18662_S_AT |
| 1905 | 18664_AT |
| 1906 | 18695_S_AT |
| 1907 | 18704_AT |
| 1908 | 18814_AT |
| 1909 | 18907_S_AT |
| 1910 | 18921_G_AT |
| 1911 | 18924_AT |
| 1912 | 18949_AT |
|  | 19707_S_AT |
| 1913 | 18995_AT |
| 1914 | 19017_AT |
| 1915 | 19034_AT |
| 1916 | 19063_AT |
| 1917 | 19142_AT |
| 1918 | 19158_AT |
| 1919 | 19180_AT |
| 1920 | 19187_AT |
| 1921 | 19192_AT |
| 1922 | 19195_AT |
| 1923 | 19199_AT |
| 1924 | 19231_AT |
| 1925 | 19263_AT |
| 1926 | 19308_AT |
| 1927 | 19322_AT |
| 1928 | 19365_S_AT |
| 1929 | 19372_AT |
| 1930 | 19389_AT |
| 1931 | 19392_AT |
| 1932 | 19397_AT |
| 1933 | 19400_AT |
| 1934 | 19402_AT |
| 1935 | 19458_AT |
| 1936 | 19469_AT |
| 1937 | 19473_AT |
| 1938 | 19597_S_AT |
| 1939 | 19710_S_AT |
| 1940 | 19830_AT |
| 1941 | 19839_AT |
| 1942 | 19840_S_AT |
| 1943 | 19853_AT |
| 1944 | 19860_AT |
| 1945 | 19880_AT |
| 1946 | 19889_AT |
| 1947 | 19898_AT |
| 1948 | 19914_AT |
| 1949 | 19924_AT |
| 1950 | 19949_AT |
| 1951 | 19976_AT |
| 1952 | 19998_AT |
| 1953 | 20030_AT |
| 1954 | 20151_AT |
| 1955 | 20152_AT |
| 1956 | 20187_AT |
| 1957 | 20214_I_AT |
| 1958 | 20269_AT |
| 1959 | 20271_AT |
| 1960 | 20273_AT |
| 1961 | 20299_AT |
| 1962 | 20323_AT |
| 1963 | 20429_S_AT |
| 1964 | 20457_AT |
| 1965 | 20480_S_AT |
| 1966 | 20529_AT |
| 1967 | 20547_AT |
| 1968 | 20555_S_AT |
| 1969 | 20699_AT |

TABLE 16

2X UP IN MANNITOL & COLD, ONLY

| | |
|---|---|
| 12345_at | 17066_s_at |
| 12784_at | 17540_s_at |
| 13153_r_at | 17567_at |
| 13212_s_at | 17766_at |
| 13215_s_at | 17904_at |
| 13246_at | 17920_s_at |
| 13262_s_at | 17943_at |
| 13361_at | 18263_at |
| 13625_s_at | 18351_s_at |
| 13764_at | 18662_s_at |
| 13810_at | 18670_g_at |
| 14015_s_at | 18695_s_at |
| 14016_s_at | 18704_at |
| 14060_at | 18729_at |
| 14096_at | 18995_at |
| 14123_s_at | 19158_at |
| 14139_at | 19473_at |
| 14219_at | 19710_s_at |
| 14248_at | 19883_at |
| 14254_s_at | 19889_at |
| 14256_f_at | 20030_at |
| 14609_at | 20269_at |
| 14636_s_at | 20271_at |
| 14681_g_at | 20299_at |
| 14699_at | 20429_s_at |
| 14704_s_at | 20438_at |
| 14828_s_at | 20480_s_at |
| 14882_at | |
| 15110_s_at | |
| 15184_s_at | |
| 15448_at | |
| 15629_s_at | |
| 15720_at | |
| 15846_at | |
| 15947_at | |
| 16161_s_at | |
| 16365_at | |
| 16427_at | |
| 16566_s_at | |
| 16570_s_at | |
| 16649_s_at | |
| 16688_at | |
| 16712_at | |
| 16817_s_at | |
| 16840_at | |
| 16893_at | |
| 16912_s_at | |
| 16916_s_at | |
| 16927_s_at | |
| 16981_s_at | |
| 17012_s_at | |
| 17014_s_at | |
| 17051_s_at | |

TABLE 17

2X DOWN COLD & MANNITOL, ONLY

| | | |
|---|---|---|
| 12040_at | 14553_at | 17873_s_at |
| 12048_at | 14612_at | 17925_at |
| 12054_s_at | 14751_at | 18098_at |
| 12077_at | 14762_at | 18540_at |
| 12107_i_at | 14978_at | 18608_at |
| 12113_at | 14985_s_at | 18647_at |
| 12154_at | 15031_at | 18664_at |
| 12171_at | 15096_at | 18690_s_at |
| 12317_at | 15111_s_at | 18725_s_at |
| 12325_at | 15120_s_at | 18924_at |
| 12333_at | 15142_s_at | 19017_at |
| 12356_at | 15198_s_at | 19034_at |
| 12380_at | 15203_s_at | 19063_at |
| 12392_at | 15240_at | 19141_at |
| 12460_s_at | 15366_at | 19142_at |
| 12686_s_at | 15392_at | 19180_at |
| 12701_i_at | 15398_at | 19187_at |
| 12782_r_at | 15466_at | 19195_at |
| 12879_s_at | 15481_at | 19199_at |
| 12898_g_at | 15484_at | 19231_at |
| 12974_at | 15549_at | 19308_at |
| 12998_at | 15623_f_at | 19372_at |
| 13144_at | 15815_s_at | 19392_at |
| 13147_at | 15817_at | 19400_at |
| 13152_s_at | 15841_at | 19458_at |
| 13192_s_at | 15892_at | 19597_s_at |
| 13286_s_at | 15933_at | 19762_at |
| 13324_at | 15959_s_at | 19830_at |
| 13340_s_at | 16052_at | 19853_at |
| 13441_s_at | 16204_at | 19869_at |
| 13513_at | 16252_at | 19880_at |
| 13573_at | 16266_at | 19898_at |
| 13606_at | 16299_at | 19914_at |
| 13609_at | 16477_at | 19924_at |
| 13626_at | 16491_at | 19949_at |
| 13736_at | 16561_s_at | 20151_at |
| 13775_at | 16645_s_at | 20187_at |
| 14029_at | 16898_s_at | 20214_i_at |
| 14036_at | 16980_at | 20273_at |
| 14051_at | 17008_at | 20323_at |
| 14064_at | 17104_s_at | 20457_at |
| 14066_at | 17160_at | 20555_s_at |
| 14094_s_at | 17317_at | |
| 14104_at | 17400_s_at | |
| 14126_s_at | 17452_g_at | |
| 14131_at | 17477_s_at | |
| 14136_at | 17500_s_at | |
| 14178_at | 17552_s_at | |
| 14192_at | 17571_at | |
| 14201_at | 17572_s_at | |
| 14242_s_at | 17589_at | |
| 14480_at | 17641_g_at | |
| 14497_at | 17855_at | |

TABLE 18

COLD & SALINE STRESS RESPONSIVE SEQUENCES

| SEQ ID NO: | AFFYMETRIX ID NO: |
|---|---|
| 1970 | 12021_AT |
| 1971 | 12037_AT |
| 1972 | 12094_AT |
| 1973 | 12098_AT |
| 1974 | 12128_AT |
| 1975 | 12148_AT |
| 1976 | 12151_AT |
| 1977 | 12357_S_AT |
| 1978 | 12394_AT |
| 1979 | 12472_S_AT |
| 1980 | 12475_AT |
| 1981 | 12482_S_AT |
| 1982 | 12490_AT |
| 1983 | 12505_S_AT |
| 1984 | 12531_AT |
| 1985 | 12540_S_AT |
| 1986 | 12541_AT |
| 1987 | 12577_AT |
| 1988 | 12594_AT |
| 1989 | 12629_AT |
| 1990 | 12642_AT |
| 1991 | 12656_AT |
| 1992 | 12660_AT |
| 1993 | 12712_F_AT |
| 1994 | 12725_R_AT |
| 1995 | 12745_AT |
| 1996 | 12777_I_AT |
| 1997 | 12790_S_AT |
| 1998 | 12798_AT |

TABLE 18-continued

COLD & SALINE STRESS RESPONSIVE SEQUENCES

| SEQ ID NO: | AFFYMETRIX ID NO: |
|---|---|
| 1999 | 12801_AT |
| 2000 | 12855_F_AT |
| 2001 | 12887_S_AT |
| 2002 | 12933_R_AT |
| 2003 | 12951_AT |
| 2004 | 13005_AT |
| 2005 | 13015_S_AT |
| 2006 | 13115_AT |
| 2007 | 13178_AT |
| 2008 | 13228_AT |
| 2009 | 13236_S_AT |
|  | 16646_S_AT |
| 2010 | 13266_S_AT |
|  | 15211_S_AT |
| 2011 | 13275_F_AT |
| 2012 | 13335_AT |
| 2013 | 13362_S_AT |
| 2014 | 13428_AT |
| 2015 | 13464_AT |
| 2016 | 13480_AT |
| 2017 | 13538_AT |
| 2018 | 13544_AT |
| 2019 | 13549_AT |
| 2020 | 13565_AT |
| 2021 | 13580_AT |
| 2022 | 13588_AT |
| 2023 | 13649_AT |
| 2024 | 13652_AT |
| 2025 | 13679_S_AT |
| 2026 | 13696_AT |
| 2027 | 13702_S_AT |
| 2028 | 13751_AT |
| 2029 | 13919_AT |
| 2030 | 13943_AT |
| 2031 | 13950_S_AT |
| 2032 | 14050_AT |
| 2033 | 14055_S_AT |
|  | 16166_S_AT |
| 2034 | 14067_AT |
| 2035 | 14078_AT |
| 2036 | 14110_I_AT |
| 2037 | 14144_AT |
| 2038 | 14232_AT |
| 2039 | 14285_AT |
| 2040 | 14346_AT |
| 2041 | 14432_AT |
| 2042 | 14468_AT |
| 2043 | 14479_AT |
| 2044 | 14524_S_AT |
| 2045 | 14608_AT |
| 2046 | 14621_AT |
| 2047 | 14635_S_AT |
|  | 17128_S_AT |
| 2048 | 14640_S_AT |
| 2049 | 14643_S_AT |
| 2050 | 14663_S_AT |
| 2051 | 14668_S_AT |
| 2052 | 14688_S_AT |
|  | 18279_S_AT |
| 2053 | 14737_S_AT |
| 2054 | 14768_AT |
| 2055 | 14875_AT |
| 2056 | 14911_S_AT |
|  | 17056_S_AT |
| 2057 | 14924_AT |
| 2058 | 14956_S_AT |
|  | 15148_S_AT |
|  | 18673_AT |
| 2059 | 14964_AT |
| 2060 | 15022_AT |
| 2061 | 15040_G_AT |
| 2062 | 15047_AT |
| 2063 | 15063_AT |
| 2064 | 15085_S_AT |
| 2065 | 15123_S_AT |
| 2066 | 15133_S_AT |
| 2067 | 15137_S_AT |
| 2068 | 15153_S_AT |
| 2069 | 15170_S_AT |
| 2070 | 15172_S_AT |
| 2071 | 15182_S_AT |
| 2072 | 15190_S_AT |
| 2073 | 15241_S_AT |
| 2074 | 15389_AT |
| 2075 | 15453_S_AT |
| 2076 | 15495_AT |
| 2077 | 15496_AT |
| 2078 | 15519_S_AT |
| 2079 | 15562_AT |
| 2080 | 15580_S_AT |
| 2081 | 15582_S_AT |
| 2082 | 15638_S_AT |
|  | 18751_F_AT |
| 2083 | 15646_S_AT |
| 2084 | 15647_S_AT |
| 2085 | 15654_S_AT |
| 2086 | 15655_S_AT |
| 2087 | 15658_S_AT |
| 2088 | 15670_S_AT |
| 2089 | 15775_AT |
| 2090 | 15798_AT |
| 2091 | 15930_AT |
| 2092 | 15931_AT |
| 2093 | 15949_S_AT |
| 2094 | 16017_AT |
| 2095 | 16053_I_AT |
| 2096 | 16078_S_AT |
| 2097 | 16086_S_AT |
| 2098 | 16120_S_AT |
| 2099 | 16126_S_AT |
| 2100 | 16150_S_AT |
| 2101 | 16159_S_AT |
| 2102 | 16230_AT |
| 2103 | 16306_AT |
| 2104 | 16367_I_AT |
| 2105 | 16417_S_AT |
|  | 18083_R_AT |
| 2106 | 16418_S_AT |
| 2107 | 16423_AT |
| 2108 | 16449_S_AT |
| 2109 | 16484_S_AT |
| 2110 | 16489_AT |
| 2111 | 16565_S_AT |
| 2112 | 16596_S_AT |
| 2113 | 16600_S_AT |
| 2114 | 16603_S_AT |
| 2115 | 16638_S_AT |
| 2116 | 16642_S_AT |
| 2117 | 16763_AT |
| 2118 | 16914_S_AT |
| 2119 | 16968_AT |
| 2120 | 16983_AT |
| 2121 | 16989_AT |
| 2122 | 17002_AT |
| 2123 | 17015_S_AT |
| 2124 | 17040_S_AT |
|  | 18913_S_AT |
| 2125 | 17232_AT |
| 2126 | 17380_AT |
| 2127 | 17394_S_AT |
|  | 20640_S_AT |
| 2128 | 17398_AT |
| 2129 | 17448_AT |
| 2130 | 17485_S_AT |
| 2131 | 17490_S_AT |
| 2132 | 17499_S_AT |
| 2133 | 17505_S_AT |
| 2134 | 17516_S_AT |

TABLE 18-continued

COLD & SALINE STRESS RESPONSIVE SEQUENCES

| SEQ ID NO: | AFFYMETRIX ID NO: |
|---|---|
| 2135 | 17529_S_AT |
| 2136 | 17543_S_AT |
| 2137 | 17593_R_AT |
|  | 19858_S_AT |
| 2138 | 17609_AT |
| 2139 | 17698_AT |
| 2140 | 17836_AT |
| 2141 | 17886_AT |
| 2142 | 17896_AT |
| 2143 | 17901_AT |
| 2144 | 17902_S_AT |
| 2145 | 17913_S_AT |
| 2146 | 17924_AT |
| 2147 | 17954_S_AT |
| 2148 | 17960_AT |
| 2149 | 17991_G_AT |
|  | 18967_S_AT |
| 2150 | 17999_AT |
| 2151 | 18057_I_AT |
| 2152 | 18078_AT |
| 2153 | 18091_AT |
| 2154 | 18168_S_AT |
| 2155 | 18252_AT |
| 2156 | 18267_AT |
| 2157 | 18300_AT |
| 2158 | 18308_I_AT |
| 2159 | 18328_AT |
| 2160 | 18354_AT |
| 2161 | 18402_AT |
| 2162 | 18416_AT |
| 2163 | 18455_AT |
| 2164 | 18459_AT |
| 2165 | 18571_AT |
| 2166 | 18604_AT |
|  | 19181_S_AT |
| 2167 | 18644_AT |
| 2168 | 18745_F_AT |
|  | 19611_S_AT |
| 2169 | 18782_AT |
| 2170 | 18881_AT |
| 2171 | 18904_S_AT |
| 2172 | 18914_S_AT |
| 2173 | 18963_AT |
| 2174 | 19068_I_AT |
| 2175 | 19078_AT |
| 2176 | 19171_AT |
| 2177 | 19177_AT |
| 2178 | 19394_AT |
| 2179 | 19411_AT |
| 2180 | 19415_AT |
| 2181 | 19466_S_AT |
| 2182 | 19484_S_AT |
| 2183 | 19549_S_AT |
| 2184 | 19592_AT |
| 2185 | 19633_AT |
| 2186 | 19641_AT |
| 2187 | 19669_AT |
| 2188 | 19672_AT |
| 2189 | 19684_AT |
| 2190 | 19692_AT |
| 2191 | 19746_AT |
| 2192 | 19835_AT |
| 2193 | 19848_S_AT |
| 2194 | 19892_AT |
| 2195 | 19904_AT |
| 2196 | 19936_AT |
| 2197 | 19974_S_AT |
| 2198 | 19994_AT |
| 2199 | 20005_S_AT |
| 2200 | 20022_AT |
| 2201 | 20032_AT |
| 2202 | 20044_AT |
| 2203 | 20049_AT |
| 2204 | 20081_AT |

TABLE 18-continued

COLD & SALINE STRESS RESPONSIVE SEQUENCES

| SEQ ID NO: | AFFYMETRIX ID NO: |
|---|---|
| 2205 | 20133_I_AT |
| 2206 | 20155_S_AT |
| 2207 | 20163_S_AT |
| 2208 | 20200_AT |
| 2209 | 20296_S_AT |
| 2210 | 20336_AT |
| 2211 | 20341_AT |
| 2212 | 20372_AT |
| 2213 | 20385_S_AT |
| 2214 | 20433_AT |
| 2215 | 20489_AT |
| 2216 | 20525_AT |
| 2217 | 20543_AT |
| 2218 | 20565_AT |
| 2219 | 20570_AT |
| 2220 | 20576_AT |
| 2221 | 20577_AT |
| 2222 | 20609_AT |
| 2223 | 20646_AT |
| 2224 | 20672_AT |
| 2225 | 20707_S_AT |
| 2226 | 20720_AT |

TABLE 19

2X UP IN SALT & COLD, ONLY

12004_at
12098_at
12148_at
12251_at
12357_s_at
12394_at
12457_at
12505_s_at
12522_at
12541_at
12594_at
12606_at
12697_at
12745_at
12781_at
12798_at
12855_f_at
12945_at
12951_at
13005_at
13015_s_at
13115_at
13146_s_at
13335_at
13447_s_at
13480_at
13544_at
13549_at
13580_at
13649_at
13943_at
13950_s_at
14110_i_at
14144_at
14224_at
14432_at
14468_at
14479_at
14524_s_at
14640_s_at
14643_s_at
14735_s_at
14737_s_at
14768_at

TABLE 19-continued

2X UP IN SALT & COLD, ONLY

14784_at
14924_at
15064_at
15127_s_at
15186_s_at
15189_s_at
15255_at
15389_at
15482_at
15495_at
15496_at
15519_s_at
15580_s_at
15582_s_at
15776_at
15798_at
15910_at
15931_at
15937_at
15949_s_at
15972_s_at
16048_at
16086_s_at
16120_s_at
16126_s_at
16150_s_at
16159_s_at
16230_at
16306_at
16418_s_at
16423_at
16449_s_at
16565_at
16603_s_at
16763_at
16968_at
16983_at
17002_at
17015_s_at
17019_s_at
17078_s_at
17232_at
17317_at
17394_s_at
17516_s_at
17585_s_at
17609_at
17698_at
17836_at
17896_at
17899_at
17902_s_at
17960_at
17963_at
18168_s_at
18252_at
18267_at
18308_i_at
18354_at
18402_at
18459_at
18484_at
18745_f_at
18904_s_at
18914_s_at
18929_s_at
18946_at
18963_at
19078_at
19137_at
19141_at
19411_at
19641_at
19672_at
19684_at
19692_at
19746_at
19762_at
19869_at
19894_at
19904_at
19936_at
19994_at
20005_s_at
20031_at
20044_at
20382_s_at
20406_g_at
20421_at
20525_at
20543_at
20565_at
20570_at
20640_s_at
20646_at
20720_at

TABLE 20

2X DOWN IN COLD & SALT, ONLY

| | | |
|---|---|---|
| 12021_at | 15123_s_at | 19394_at |
| 12094_at | 15153_s_at | 19415_at |
| 12128_at | 15172_s_at | 19466_s_at |
| 12151_at | 15190_s_at | 19549_s_at |
| 12332_s_at | 15211_s_at | 19592_at |
| 12472_s_at | 15241_s_at | 19633_at |
| 12475_at | 15437_at | 19669_at |
| 12482_s_at | 15562_at | 19848_s_at |
| 12490_at | 15638_s_at | 19858_s_at |
| 12531_at | 15647_s_at | 19878_at |
| 12540_s_at | 15654_s_at | 19892_at |
| 12577_at | 15655_s_at | 19974_s_at |
| 12629_at | 15658_s_at | 20022_at |
| 12642_at | 15695_s_at | 20032_at |
| 12660_at | 15846_at | 20049_at |
| 12676_s_at | 15930_at | 20081_at |
| 12712_f_at | 16053_i_at | 20155_s_at |
| 12725_r_at | 16078_s_at | 20163_s_at |
| 12777_i_at | 16229_at | 20296_s_at |
| 12790_s_at | 16465_at | 20336_at |
| 12801_at | 16484_s_at | 20341_at |
| 12887_s_at | 16596_s_at | 20365_s_at |
| 12933_r_at | 16600_s_at | 20372_at |
| 13153_r_at | 16642_s_at | 20489_at |
| 13228_at | 16914_s_at | 20491_at |
| 13362_s_at | 17027_s_at | 20576_at |
| 13428_at | 17066_s_at | 20577_at |
| 13538_at | 17083_s_at | 20609_at |
| 13565_at | 17128_s_at | 20672_at |
| 13588_at | 17380_at | |
| 13696_at | 17398_at | |
| 13702_s_at | 17448_at | |
| 13716_at | 17485_at | |
| 13764_at | 17490_s_at | |
| 14050_at | 17499_s_at | |
| 14055_s_at | 17505_s_at | |
| 14069_at | 17514_s_at | |
| 14078_at | 17593_r_at | |
| 14232_at | 17886_at | |
| 14346_at | 17913_s_at | |
| 14608_at | 17924_at | |
| 14609_at | 17954_s_at | |
| 14621_at | 17991_g_at | |
| 14635_s_at | 18057_i_at | |
| 14663_s_at | 18069_at | |
| 14688_s_at | 18328_at | |
| 14691_at | 18416_at | |
| 14704_s_at | 18604_at | |
| 14875_at | 18644_at | |
| 14911_s_at | 18881_at | |

TABLE 20-continued

2X DOWN IN COLD & SALT, ONLY

| | |
|---|---|
| 14964_at | 19171_at |
| 15022_at | 19181_s_at |
| 15085_s_at | 19182_at |

TABLE 21

OSMOTIC & SALINE STRESS RESPONSIVE SEQUENCES

| SEQ ID NO: | AFFYMETRIX ID NO: |
|---|---|
| 2586 | 12126_S_AT |
| 2587 | 12137_AT |
| 2588 | 12227_AT |
| 2589 | 12239_AT |
| 2590 | 12268_AT |
| 2591 | 12369_AT |
| 2592 | 12476_AT |
| 2593 | 12484_G_AT |
| 2594 | 12494_AT |
| 2595 | 12644_AT |
| 2596 | 12645_AT |
| 2597 | 12796_S_AT |
| 2598 | 12819_AT |
| 2599 | 12841_AT |
| 2600 | 12852_S_AT |
| | 19455_S_AT |
| 2601 | 13084_AT |
| 2602 | 13171_AT |
| 2603 | 13174_R_AT |
| 2604 | 13596_AT |
| 2605 | 13807_AT |
| 2606 | 13977_AT |
| 2607 | 13999_AT |
| 2608 | 14052_AT |
| 2609 | 14293_AT |
| 2610 | 14335_AT |
| 2611 | 14486_AT |
| 2612 | 14506_AT |
| 2613 | 14518_AT |
| 2614 | 14540_AT |
| 2615 | 14578_S_AT |
| 2616 | 14646_S_AT |
| 2617 | 14662_F_AT |
| | 15962_S_AT |
| 2618 | 14901_AT |
| 2619 | 14918_AT |
| 2620 | 14986_AT |
| 2621 | 15053_S_AT |
| 2622 | 15179_S_AT |
| 2623 | 15252_G_AT |
| 2624 | 15280_AT |
| 2625 | 15467_AT |
| 2626 | 15607_S_AT |
| 2627 | 15625_S_AT |
| 2628 | 15703_I_AT |
| 2629 | 15827_AT |
| 2630 | 15863_AT |
| 2631 | 15923_AT |
| 2632 | 15946_S_AT |
| 2633 | 16005_S_AT |
| 2634 | 16073_F_AT |
| 2635 | 16114_S_AT |
| 2636 | 16127_S_AT |
| | 18744_F_AT |
| 2637 | 16190_AT |
| 2638 | 16196_AT |
| 2639 | 16236_G_AT |
| | 19531_AT |
| 2640 | 16310_AT |
| 2641 | 16316_AT |
| 2642 | 16334_S_AT |
| 2643 | 16335_AT |
| 2644 | 16340_AT |

TABLE 21-continued

OSMOTIC & SALINE STRESS RESPONSIVE SEQUENCES

| SEQ ID NO: | AFFYMETRIX ID NO: |
|---|---|
| 2645 | 16450_S_AT |
| 2646 | 16500_AT |
| 2647 | 16524_AT |
| 2648 | 16533_AT |
| 2649 | 16690_G_AT |
| 2650 | 16762_AT |
| 2651 | 16819_AT |
| 2652 | 16873_I_AT |
| 2653 | 16972_AT |
| 2654 | 16991_AT |
| 2655 | 17099_S_AT |
| 2656 | 17339_AT |
| 2657 | 17397_S_AT |
| 2658 | 17419_AT |
| 2659 | 17460_AT |
| 2660 | 17554_S_AT |
| 2661 | 17939_AT |
| 2662 | 18013_R_AT |
| | 18178_S_AT |
| 2663 | 18024_S_AT |
| 2664 | 18032_I_AT |
| 2665 | 18054_AT |
| 2666 | 18151_AT |
| 2667 | 18281_AT |
| 2668 | 18445_AT |
| 2669 | 18520_AT |
| 2670 | 18583_AT |
| 2671 | 18663_S_AT |
| 2672 | 18753_S_AT |
| 2673 | 18876_AT |
| 2674 | 18938_G_AT |
| 2675 | 18971_AT |
| 2676 | 18977_AT |
| 2677 | 18981_AT |
| 2678 | 19099_AT |
| 2679 | 19196_AT |
| 2680 | 19376_AT |
| 2681 | 19409_AT |
| 2682 | 19503_AT |
| 2683 | 19826_AT |
| 2684 | 19847_S_AT |
| 2685 | 19930_AT |
| 2686 | 19992_AT |
| 2687 | 20096_AT |
| 2688 | 20108_AT |
| 2689 | 20256_S_AT |
| 2690 | 20290_S_AT |
| 2691 | 20298_AT |
| 2692 | 20305_AT |
| 2693 | 20322_AT |
| 2694 | 20333_AT |
| 2695 | 20402_S_AT |
| 2696 | 20424_AT |
| 2697 | 20446_S_AT |
| 2698 | 20450_AT |
| 2699 | 20468_AT |
| 2700 | 20569_S_AT |
| 2701 | 20639_AT |
| 2702 | 20678_AT |
| 2703 | 20686_AT |

TABLE 22

2X UP IN SALT & MANNITOL, ONLY

| | |
|---|---|
| 12126_s_at | 17548_s_at |
| 12227_at | 17554_s_at |
| 12369_at | 17961_at |
| 12521_at | 18032_i_at |
| 12644_at | 18054_at |
| 12645_at | 18151_at |

TABLE 22-continued

2X UP IN SALT & MANNITOL, ONLY

| | |
|---|---|
| 12724_f_at | 18167_s_at |
| 12795_at | 18281_at |
| 12796_s_at | 18520_at |
| 12841_at | 18663_s_at |
| 12852_s_at | 18744_f_at |
| 12958_at | 18753_s_at |
| 13014_at | 18789_at |
| 13174_r_at | 18876_at |
| 13211_s_at | 18909_s_at |
| 13596_at | 18938_g_at |
| 13640_at | 18977_at |
| 13789_at | 19099_at |
| 13977_at | 19108_at |
| 13999_at | 19135_at |
| 14069_at | 19227_at |
| 14083_at | 19376_at |
| 14089_at | 19429_at |
| 14293_at | 19455_s_at |
| 14675_s_at | 19531_at |
| 15053_s_at | 19789_s_at |
| 15058_s_at | 19878_at |
| 15252_g_at | 20017_at |
| 15280_at | 20096_at |
| 15437_at | 20256_s_at |
| 15607_s_at | 20290_s_at |
| 15625_s_at | 20305_at |
| 15827_at | 20322_at |
| 15863_at | 20333_at |
| 15880_at | 20420_at |
| 16005_s_at | 20424_at |
| 16031_at | 20689_s_at |
| 16073_f_at | |
| 16316_at | |
| 16334_s_at | |
| 16335_at | |
| 16450_s_at | |
| 16500_at | |
| 16524_at | |
| 16533_at | |
| 16597_s_at | |
| 16819_at | |
| 17085_s_at | |
| 17099_s_at | |
| 17339_at | |
| 17419_at | |
| 17442_i_at | |
| 17514_s_at | |

TABLE 23

2X DOWN IN MANNITOL & SALT, ONLY

| | |
|---|---|
| 12239_at | 20108_at |
| 12251_at | 20298_at |
| 12476_at | 20421_at |
| 12484_g_at | 20432_at |
| 12494_at | 20446_s_at |
| 12561_at | 20639_at |
| 12647_s_at | |
| 12719_f_at | |
| 12819_at | |
| 12841_at | |
| 13084_at | |
| 13171_at | |
| 13172_s_at | |
| 13435_at | |
| 13807_at | |
| 14250_r_at | |
| 14335_at | |
| 14486_at | |
| 14506_at | |
| 14518_at | |
| 14901_at | |
| 15046_s_at | |

TABLE 23-continued

2X DOWN IN MANNITOL & SALT, ONLY

| |
|---|
| 15179_s_at |
| 15451_at |
| 15703_i_at |
| 15946_s_at |
| 16014_s_at |
| 16114_s_at |
| 16310_at |
| 16342_at |
| 16712_at |
| 16762_at |
| 16972_at |
| 16991_at |
| 17397_s_at |
| 17408_at |
| 17460_at |
| 17775_at |
| 17939_at |
| 18445_at |
| 18583_at |
| 18751_f_at |
| 18971_at |
| 18981_at |
| 19156_s_at |
| 19196_at |
| 19359_s_at |
| 19409_at |
| 19503_at |
| 19713_at |
| 19718_at |
| 19847_s_at |
| 19930_at |

TABLE 24

COLD, OSMOTIC & SALINE RESPONSIVE SEQUENCES

| SEQ ID NO: | AFFYMETRIX ID NO: |
|---|---|
| 1262 | 12004_AT |
| 1263 | 12023_S_AT |
| 1264 | 12078_AT |
| 1265 | 12115_AT |
| 1266 | 12118_AT |
| 1267 | 12150_AT |
| 1268 | 12251_AT |
| 1269 | 12271_S_AT |
| 1270 | 12276_AT |
| 1271 | 12332_S_AT |
| | 13211_S_AT |
| 1272 | 12338_AT |
| 1273 | 12400_AT |
| 1274 | 12430_AT |
| 1275 | 12457_AT |
| 1276 | 12521_AT |
| 1277 | 12522_AT |
| 1278 | 12530_AT |
| 1279 | 12536_S_AT |
| 1280 | 12538_AT |
| 1281 | 12561_AT |
| 1282 | 12574_AT |
| | 19019_I_AT |
| 1283 | 12595_AT |
| 1284 | 12606_AT |
| 1285 | 12609_AT |
| 1286 | 12622_AT |
| 1287 | 12630_AT |
| 1288 | 12647_S_AT |
| 1289 | 12676_S_AT |
| 1290 | 12697_AT |
| 1291 | 12698_AT |
| 1292 | 12719_F_AT |
| 1293 | 12724_F_AT |
| | 15871_S_AT |

TABLE 24-continued

COLD, OSMOTIC & SALINE RESPONSIVE SEQUENCES

| SEQ ID NO: | AFFYMETRIX ID NO: |
|---|---|
|  | 16597_S_AT |
| 1294 | 12749_AT |
| 1295 | 12765_AT |
| 1296 | 12769_AT |
| 1297 | 12781_AT |
| 1298 | 12785_AT |
| 1299 | 12792_S_AT |
| 1300 | 12795_AT |
| 1301 | 12805_S_AT |
| 1302 | 12857_AT |
| 1303 | 12883_S_AT |
| 1304 | 12909_S_AT |
|  | 16539_S_AT |
| 1305 | 12932_S_AT |
|  | 15605_S_AT |
| 1306 | 12945_AT |
| 1307 | 12958_AT |
| 1308 | 12964_AT |
| 1309 | 12968_AT |
| 1310 | 12972_AT |
| 1311 | 12989_S_AT |
| 1312 | 13004_AT |
| 1313 | 13014_AT |
| 1314 | 13025_AT |
| 1315 | 13036_AT |
| 1316 | 13099_S_AT |
| 1317 | 13136_AT |
| 1318 | 13146_S_AT |
|  | 13239_S_AT |
| 1319 | 13153_R_AT |
| 1320 | 13159_AT |
| 1321 | 13176_AT |
| 1322 | 13217_S_AT |
|  | 17500_S_AT |
| 1323 | 13225_S_AT |
|  | 15997_S_AT |
| 1324 | 13230_S_AT |
|  | 15972_S_AT |
| 1325 | 13279_S_AT |
|  | 17477_S_AT |
| 1326 | 13280_S_AT |
|  | 20301_S_AT |
| 1327 | 13282_S_AT |
|  | 17027_S_AT |
| 1328 | 13426_AT |
| 1329 | 13432_AT |
| 1330 | 13435_AT |
| 1331 | 13447_S_AT |
| 1332 | 13474_AT |
| 1333 | 13511_AT |
| 1334 | 13546_AT |
| 1335 | 13547_S_AT |
| 1336 | 13548_AT |
| 1337 | 13555_AT |
| 1338 | 13587_AT |
| 1339 | 13595_AT |
| 1340 | 13610_S_AT |
| 1341 | 13627_AT |
| 1342 | 13640_AT |
| 1343 | 13645_AT |
| 1344 | 13647_AT |
| 1345 | 13706_S_AT |
|  | 19701_S_AT |
| 1346 | 13716_AT |
|  | 18228_AT |
| 1347 | 13725_AT |
| 1348 | 13764_AT |
| 1349 | 13771_AT |
| 1350 | 13789_AT |
| 1351 | 13916_AT |
| 1352 | 13965_S_AT |
| 1353 | 13967_AT |
| 1354 | 14028_AT |
| 1355 | 14039_AT |
| 1356 | 14046_AT |
| 1357 | 14049_AT |
| 1358 | 14069_AT |
| 1359 | 14077_AT |
| 1360 | 14080_AT |
| 1361 | 14083_AT |
| 1362 | 14089_AT |
| 1363 | 14090_I_AT |
| 1364 | 14097_AT |
| 1365 | 14116_AT |
| 1366 | 14151_AT |
|  | 14219_AT |
| 1367 | 14170_AT |
| 1368 | 14172_AT |
| 1369 | 14192_AT |
| 1370 | 14224_AT |
| 1371 | 14227_AT |
| 1372 | 14244_S_AT |
|  | 14245_AT |
|  | 14645_S_AT |
|  | 15974_G_AT |
| 1373 | 14248_AT |
| 1374 | 14250_R_AT |
| 1375 | 14367_AT |
| 1376 | 14381_AT |
| 1377 | 14384_AT |
| 1378 | 14398_S_AT |
| 1379 | 14487_AT |
| 1380 | 14582_AT |
| 1381 | 14597_AT |
| 1382 | 14609_AT |
| 1383 | 14612_AT |
|  | 19267_S_AT |
| 1384 | 14614_AT |
| 1385 | 14636_S_AT |
| 1386 | 14644_S_AT |
|  | 14658_S_AT |
|  | 14659_S_AT |
|  | 15964_S_AT |
| 1387 | 14675_S_AT |
| 1388 | 14691_AT |
|  | 14709_AT |
| 1389 | 14704_S_AT |
|  | 15846_AT |
| 1390 | 14705_I_AT |
| 1391 | 14733_S_AT |
| 1392 | 14735_S_AT |
| 1393 | 14779_AT |
| 1394 | 14784_AT |
| 1395 | 14923_AT |
| 1396 | 14947_AT |
| 1397 | 14950_AT |
| 1398 | 14990_AT |
| 1399 | 14998_AT |
| 1400 | 15005_S_AT |
| 1401 | 15018_AT |
| 1402 | 15045_AT |
| 1403 | 15046_S_AT |
| 1404 | 15052_AT |
| 1405 | 15058_S_AT |
| 1406 | 15064_AT |
| 1407 | 15088_S_AT |
| 1408 | 15098_S_AT |
| 1409 | 15103_S_AT |
| 1410 | 15109_S_AT |
| 1411 | 15124_S_AT |
| 1412 | 15127_S_AT |
| 1413 | 15145_S_AT |
| 1414 | 15154_S_AT |
| 1415 | 15161_S_AT |
| 1416 | 15189_S_AT |
| 1417 | 15214_S_AT |
| 1418 | 15255_AT |
| 1419 | 15356_AT |

TABLE 24-continued

COLD, OSMOTIC & SALINE RESPONSIVE SEQUENCES

| SEQ ID NO: | AFFYMETRIX ID NO: |
|---|---|
| 1420 | 15357_AT |
| 1421 | 15364_AT |
| 1422 | 15392_AT |
| 1423 | 15403_S_AT |
| 1424 | 15437_AT |
| 1425 | 15451_AT |
| 1426 | 15476_AT |
| 1427 | 15482_AT |
| 1428 | 15483_S_AT |
| 1429 | 15521_S_AT |
| 1430 | 15522_I_AT |
| 1431 | 15531_I_AT |
| 1432 | 15573_AT |
| 1433 | 15581_S_AT |
| 1434 | 15586_S_AT |
| 1435 | 15594_S_AT |
| 1436 | 15609_S_AT |
| 1437 | 15611_S_AT |
| 1438 | 15621_F_AT |
| 1439 | 15623_F_AT |
| 1440 | 15669_S_AT |
| 1441 | 15695_S_AT |
| 1442 | 15702_S_AT |
| 1443 | 15753_AT |
| 1444 | 15761_AT |
| 1445 | 15776_AT |
| 1446 | 15778_AT |
| 1447 | 15839_AT |
| 1448 | 15842_AT |
| 1449 | 15857_S_AT |
| 1450 | 15859_AT |
| 1451 | 15880_AT |
| 1452 | 15886_AT |
| 1453 | 15906_S_AT |
| 1454 | 15910_AT |
| 1455 | 15937_AT |
| 1456 | 15957_AT |
| 1457 | 15970_S_AT |
| 1458 | 15985_AT |
| 1459 | 16010_S_AT |
| | 16011_S_AT |
| | 17078_S_AT |
| 1460 | 16021_S_AT |
| 1461 | 16031_AT |
| 1462 | 16038_S_AT |
| 1463 | 16045_S_AT |
| 1464 | 16046_S_AT |
| 1465 | 16048_AT |
| 1466 | 16061_S_AT |
| 1467 | 16082_S_AT |
| 1468 | 16111_F_AT |
| 1469 | 16115_S_AT |
| 1470 | 16141_S_AT |
| 1471 | 16144_S_AT |
| 1472 | 16163_S_AT |
| 1473 | 16173_S_AT |
| 1474 | 16229_AT |
| 1475 | 16298_AT |
| 1476 | 16301_S_AT |
| 1477 | 16322_AT |
| 1478 | 16342_AT |
| 1479 | 16351_AT |
| 1480 | 16412_S_AT |
| 1481 | 16422_AT |
| 1482 | 16427_AT |
| 1483 | 16438_AT |
| 1484 | 16474_S_AT |
| 1485 | 16482_S_AT |
| 1486 | 16485_S_AT |
| | 18052_S_AT |
| 1487 | 16493_AT |
| 1488 | 16534_S_AT |
| 1489 | 16555_S_AT |
| 1490 | 16561_S_AT |

TABLE 24-continued

COLD, OSMOTIC & SALINE RESPONSIVE SEQUENCES

| SEQ ID NO: | AFFYMETRIX ID NO: |
|---|---|
| | 17572_S_AT |
| 1491 | 16592_S_AT |
| 1492 | 16615_S_AT |
| 1493 | 16637_S_AT |
| 1494 | 16692_AT |
| 1495 | 16712_AT |
| 1496 | 16789_AT |
| 1497 | 16818_S_AT |
| 1498 | 16971_S_AT |
| 1499 | 17018_S_AT |
| 1500 | 17019_S_AT |
| 1501 | 17029_S_AT |
| 1502 | 17041_S_AT |
| 1503 | 17047_S_AT |
| 1504 | 17066_S_AT |
| 1505 | 17085_S_AT |
| 1506 | 17089_S_AT |
| 1507 | 17179_AT |
| 1508 | 17180_AT |
| 1509 | 17228_AT |
| 1510 | 17252_AT |
| 1511 | 17317_AT |
| 1512 | 17338_AT |
| 1513 | 17384_AT |
| 1514 | 17387_S_AT |
| 1515 | 17400_S_AT |
| 1516 | 17407_S_AT |
| 1517 | 17408_AT |
| 1518 | 17413_S_AT |
| 1519 | 17416_AT |
| 1520 | 17425_S_AT |
| 1521 | 17440_I_AT |
| 1522 | 17442_I_AT |
| 1523 | 17473_AT |
| 1524 | 17484_AT |
| 1525 | 17514_S_AT |
| 1526 | 17520_S_AT |
| 1527 | 17533_S_AT |
| 1528 | 17548_S_AT |
| | 19614_AT |
| 1529 | 17549_S_AT |
| 1530 | 17555_S_AT |
| 1531 | 17567_AT |
| 1532 | 17654_AT |
| 1533 | 17693_AT |
| 1534 | 17697_AT |
| 1535 | 17722_AT |
| 1536 | 17752_AT |
| 1537 | 17755_AT |
| 1538 | 17775_AT |
| 1539 | 17832_S_AT |
| 1540 | 17840_S_AT |
| 1541 | 17843_S_AT |
| 1542 | 17855_AT |
| 1543 | 17860_AT |
| 1544 | 17869_AT |
| 1545 | 17888_AT |
| 1546 | 17899_AT |
| 1547 | 17929_S_AT |
| 1548 | 17930_S_AT |
| 1549 | 17932_S_AT |
| 1550 | 17936_S_AT |
| | 18670_G_AT |
| 1551 | 17957_AT |
| 1552 | 17961_AT |
| 1553 | 17962_AT |
| 1554 | 17963_AT |
| 1555 | 17971_S_AT |
| 1556 | 17975_AT |
| | 18742_F_AT |
| 1557 | 18016_R_AT |
| 1558 | 18069_AT |
| 1559 | 18122_AT |
| 1560 | 18140_AT |

TABLE 24-continued

COLD, OSMOTIC & SALINE RESPONSIVE SEQUENCES

| SEQ ID NO: | AFFYMETRIX ID NO: |
|---|---|
| 1561 | 18199_AT |
| 1562 | 18224_S_AT |
| 1563 | 18225_AT |
| 1564 | 18235_AT |
| 1565 | 18259_S_AT |
| 1566 | 18265_AT |
| 1567 | 18270_AT |
| 1568 | 18280_AT |
| 1569 | 18289_AT |
| 1570 | 18296_AT |
| 1571 | 18298_AT |
| 1572 | 18314_I_AT |
| 1573 | 18318_AT |
| 1574 | 18325_AT |
| 1575 | 18351_S_AT |
| 1576 | 18471_AT |
| 1577 | 18482_S_AT |
| 1578 | 18484_AT |
| 1579 | 18560_AT |
| 1580 | 18564_AT |
| 1581 | 18590_AT |
| 1582 | 18594_AT |
| 1583 | 18595_AT |
| 1584 | 18596_AT |
| 1585 | 18629_S_AT |
| 1586 | 18637_AT |
| 1587 | 18661_AT |
| 1588 | 18668_AT |
| 1589 | 18699_I_AT |
| 1590 | 18747_F_AT |
| | 18789_AT |
| 1591 | 18761_AT |
| 1592 | 18833_AT |
| 1593 | 18875_S_AT |
| 1594 | 18894_AT |
| 1595 | 18936_AT |
| 1596 | 18946_AT |
| 1597 | 18953_AT |
| 1598 | 18955_AT |
| 1599 | 18972_AT |
| 1600 | 19008_S_AT |
| 1601 | 19108_AT |
| 1602 | 19123_AT |
| 1603 | 19135_AT |
| 1604 | 19137_AT |
| 1605 | 19141_AT |
| 1606 | 19152_AT |
| 1607 | 19156_S_AT |
| 1608 | 19182_AT |
| 1609 | 19186_S_AT |
| 1610 | 19214_AT |
| 1611 | 19216_AT |
| 1612 | 19227_AT |
| 1613 | 19243_AT |
| 1614 | 19288_AT |
| 1615 | 19359_S_AT |
| 1616 | 19368_AT |
| 1617 | 19379_AT |
| 1618 | 19380_S_AT |
| 1619 | 19398_AT |
| 1620 | 19421_AT |
| 1621 | 19424_AT |
| 1622 | 19429_AT |
| 1623 | 19430_AT |
| 1624 | 19450_AT |
| 1625 | 19457_AT |
| 1626 | 19467_AT |
| 1627 | 19516_AT |
| 1628 | 19545_AT |
| 1629 | 19564_AT |
| 1630 | 19577_AT |
| 1631 | 19593_AT |
| 1632 | 19602_AT |
| 1633 | 19618_AT |
| 1634 | 19638_AT |
| 1635 | 19640_AT |
| 1636 | 19646_S_AT |
| 1637 | 19656_S_AT |
| 1638 | 19670_AT |
| 1639 | 19696_AT |
| 1640 | 19713_AT |
| 1641 | 19718_AT |
| 1642 | 19722_S_AT |
| 1643 | 19749_AT |
| 1644 | 19755_AT |
| 1645 | 19762_AT |
| 1646 | 19789_S_AT |
| 1647 | 19815_AT |
| 1648 | 19843_AT |
| 1649 | 19869_AT |
| 1650 | 19878_AT |
| 1651 | 19883_AT |
| 1652 | 19894_AT |
| 1653 | 19926_AT |
| 1654 | 19944_AT |
| 1655 | 19968_AT |
| 1656 | 19977_AT |
| 1657 | 19982_AT |
| 1658 | 19987_AT |
| 1659 | 19991_AT |
| 1660 | 20015_AT |
| 1661 | 20017_AT |
| 1662 | 20031_AT |
| 1663 | 20040_AT |
| 1664 | 20042_S_AT |
| 1665 | 20060_AT |
| | 20438_AT |
| 1666 | 20089_AT |
| 1667 | 20118_AT |
| 1668 | 20144_AT |
| 1669 | 20149_AT |
| 1670 | 20179_AT |
| 1671 | 20190_AT |
| 1672 | 20194_AT |
| 1673 | 20219_AT |
| 1674 | 20245_S_AT |
| 1675 | 20263_AT |
| 1676 | 20308_S_AT |
| 1677 | 20335_S_AT |
| 1678 | 20338_AT |
| 1679 | 20345_AT |
| 1680 | 20365_S_AT |
| 1681 | 20382_S_AT |
| 1682 | 20390_S_AT |
| 1683 | 20395_AT |
| 1684 | 20420_AT |
| 1685 | 20421_AT |
| 1686 | 20432_AT |
| 1687 | 20437_AT |
| 1688 | 20442_I_AT |
| 1689 | 20463_S_AT |
| 1690 | 20491_AT |
| 1691 | 20537_AT |
| 1692 | 20573_AT |
| 1693 | 20636_AT |
| 1694 | 20638_AT |
| 1695 | 20641_AT |
| 1696 | 20658_S_AT |
| 1697 | 20689_S_AT |
| 1698 | 20698_S_AT |

TABLE 25

2X UP IN COLD, SALT & MANNITOL

| | | | |
|---|---|---|---|
| 12023_s_at | 14733_s_at | 17047_s_at | 19640_at |
| 12332_s_at | 14923_at | 17179_at | 19646_at |
| 12530_at | 14990_at | 17180_at | 19656_s_at |
| 12536_s_at | 15005_s_at | 17252_at | 19701_s_at |
| 12574_at | 15018_at | 17384_at | 19843_at |
| 12595_at | 15052_at | 17407_s_at | 19944_at |
| 12698_at | 15088_at | 17484_at | 19982_at |
| 12749_at | 15098_s_at | 17520_s_at | 19987_at |
| 12765_at | 15103_s_at | 17555_s_at | 19991_at |
| 12769_at | 15145_s_at | 17572_s_at | 20042_s_at |
| 12785_at | 15154_s_at | 17722_at | 20060_at |
| 12857_at | 15161_s_at | 17752_at | 20118_at |
| 12964_at | 15214_s_at | 17840_s_at | 20144_at |
| 12972_at | 15356_at | 17843_at | 20149_at |
| 12989_s_at | 15521_at | 17860_at | 20179_at |
| 13004_at | 15573_at | 17929_s_at | 20194_at |
| 13025_at | 15586_s_at | 17936_s_at | 20245_s_at |
| 13036_at | 15609_s_at | 17962_at | 20390_s_at |
| 13099_s_at | 15611_s_at | 18052_s_at | 20437_at |
| 13136_at | 15621_f_at | 18069_at | 20463_s_at |
| 13176_at | 15669_s_at | 18122_at | 20491_at |
| 13220_s_at | 15695_s_at | 18199_at | 20641_at |
| 13225_at | 15753_at | 18259_s_at | 20658_s_at |
| 13230_s_at | 15761_at | 18280_at | |
| 13239_s_at | 15857_s_at | 18289_at | |
| 13426_at | 15871_s_at | 18314_i_at | |
| 13474_at | 15964_s_at | 18318_at | |
| 13548_at | 15970_s_at | 18325_at | |
| 13555_at | 15974_g_at | 18482_s_at | |
| 13595_at | 15997_s_at | 18590_at | |
| 13627_at | 16011_s_at | 18594_at | |
| 13645_at | 16021_s_at | 18595_at | |
| 13647_at | 16038_s_at | 18596_at | |
| 13706_s_at | 16046_s_at | 18629_s_at | |
| 13965_s_at | 16082_s_at | 18661_at | |
| 13967_at | 16111_f_at | 18668_at | |
| 14080_at | 16115_s_at | 18699_i_at | |
| 14090_i_at | 16127_s_at | 18722_s_at | |
| 14097_at | 16141_s_at | 18936_at | |
| 14116_at | 16144_s_at | 18953_at | |
| 14151_at | 16163_s_at | 18955_at | |
| 14172_at | 16236_g_at | 18972_at | |
| 14192_at | 16301_s_at | 19008_s_at | |
| 14244_s_at | 16322_at | 19152_at | |
| 14245_at | 16422_at | 19186_s_at | |
| 14367_at | 16474_s_at | 19214_at | |
| 14398_s_at | 16482_s_at | 19368_at | |
| 14582_at | 16485_s_at | 19379_at | |
| 14614_at | 16555_s_at | 19380_s_at | |
| 14644_s_at | 16561_s_at | 19421_at | |
| 14645_at | 16592_s_at | 19545_at | |
| 14658_at | 16637_s_at | 19614_at | |
| 14659_at | 17041_s_at | 19638_at | |

TABLE 26

2X DOWN IN COLD, MANNITOL & SALT, ONLY

| | | | |
|---|---|---|---|
| 12078_at | 15189_s_at | 17869_at | 20015_at |
| 12115_at | 15357_at | 17888_at | 20040_at |
| 12118_at | 15364_at | 17930_s_at | 20089_at |
| 12150_at | 15403_s_at | 17932_s_at | 20190_at |
| 12271_s_at | 15476_at | 17957_at | 20219_at |
| 12276_at | 15483_s_at | 17963_at | 20263_at |
| 12338_at | 15522_i_at | 17971_s_at | 20301_s_at |
| 12400_at | 15531_i_at | 17975_at | 20308_at |
| 12430_at | 15594_s_at | 18016_r_at | 20338_at |
| 12538_at | 15702_s_at | 18140_at | 20345_at |
| 12622_at | 15778_at | 18224_s_at | 20395_at |
| 12630_at | 15839_at | 18225_at | 20442_i_at |
| 12792_s_at | 15842_at | 18228_at | 20537_at |
| 12805_s_at | 15859_at | 18235_at | 20573_at |
| 12883_at | 15872_at | 18265_at | 20636_at |
| 12909_s_at | 15880_at | 18270_at | 20638_at |
| 12932_s_at | 15886_at | 18296_at | 20698_s_at |
| 12968_at | 15906_s_at | 18298_at | |
| 13159_at | 15957_at | 18471_at | |
| 13217_s_at | 15985_at | 18564_at | |
| 13279_s_at | 16045_s_at | 18637_at | |
| 13282_s_at | 16061_s_at | 18742_f_at | |
| 13432_at | 16173_s_at | 18761_at | |
| 13511_at | 16298_at | 18833_at | |
| 13546_at | 16351_at | 18875_s_at | |
| 13547_s_at | 16412_s_at | 18894_at | |
| 13587_at | 16438_at | 18946_at | |
| 13610_s_at | 16493_at | 19123_at | |
| 13640_at | 16534_s_at | 19216_at | |
| 13725_at | 16539_s_at | 19243_at | |
| 13771_at | 16615_s_at | 19267_s_at | |
| 13916_at | 16692_at | 19288_at | |
| 14028_at | 16789_at | 19398_at | |
| 14039_at | 16818_s_at | 19424_at | |
| 14046_at | 16971_at | 19430_at | |
| 14049_at | 17018_s_at | 19450_at | |
| 14077_at | 17029_at | 19457_at | |
| 14170_at | 17089_s_at | 19467_at | |
| 14227_at | 17228_at | 19516_at | |
| 14248_at | 17338_at | 19564_at | |
| 14381_at | 17387_s_at | 19577_at | |
| 14384_at | 17413_s_at | 19593_at | |
| 14487_at | 17416_at | 19602_at | |
| 14597_at | 17425_s_at | 19618_at | |
| 14705_i_at | 17440_i_at | 19670_at | |
| 14709_at | 17473_at | 19696_at | |
| 14779_at | 17533_s_at | 19722_s_at | |
| 14947_at | 17549_s_at | 19749_at | |
| 14950_at | 17654_at | 19755_at | |
| 14998_at | 17693_at | 19815_at | |
| 15045_at | 17697_at | 19926_at | |
| 15109_s_at | 17755_at | 19968_at | |
| 15124_s_at | 17832_s_at | 19977_at | |

TABLE 27

2X ROOT SPECIFIC (COLD, SALINE & OSMOTIC STRESSES)

| | | | |
|---|---|---|---|
| 11997_at | 14069_at | 16052_at | 18327_s_at |
| 12004_at | 14072_at | 16053_i_at | 18597_at |
| 12051_at | 14073_at | 16105_s_at | 18607_s_at |
| 12072_at | 14097_at | 16161_s_at | 18636_at |
| 12150_at | 14139_at | 16165_s_at | 18663_s_at |
| 12151_at | 14235_at | 16298_at | 18782_at |
| 12166_i_at | 14250_r_at | 16334_s_at | 18885_at |
| 12219_at | 14578_s_at | 16422_at | 18888_at |
| 12315_at | 14582_at | 16427_at | 18942_at |
| 12332_s_at | 14640_s_at | 16440_s_at | 18955_at |
| 12374_i_at | 14643_s_at | 16442_s_at | 19060_at |
| 12482_s_at | 14644_s_at | 16468_at | 19108_at |
| 12515_at | 14658_s_at | 16488_at | 19135_at |
| 12522_at | 14659_s_at | 16511_at | 19137_at |
| 12538_at | 14711_s_at | 16529_at | 19195_at |
| 12571_s_at | 14900_at | 16553_f_at | 19263_at |
| 12574_at | 14924_at | 16568_s_at | 19376_at |
| 12609_at | 14990_at | 16914_at | 19406_at |
| 12678_i_at | 15018_at | 16965_s_at | 19432_s_at |
| 12698_at | 15022_at | 16981_at | 19835_at |
| 12749_at | 15107_s_at | 16989_at | 19836_at |
| 12760_g_at | 15116_f_at | 17033_s_at | 19840_s_at |
| 12765_at | 15120_s_at | 17066_s_at | 19841_at |
| 12768_at | 15124_s_at | 17085_s_at | 19843_at |
| 12769_at | 15131_s_at | 17252_at | 19926_at |
| 12772_at | 15132_s_at | 17376_at | 19972_at |
| 12777_i_at | 15137_s_at | 17378_at | 19977_at |
| 12958_at | 15184_s_at | 17388_at | 19991_at |
| 12989_s_at | 15188_s_at | 17415_at | 20034_i_at |
| 13015_s_at | 15208_s_at | 17429_s_at | 20042_s_at |
| 13134_s_at | 15252_g_at | 17463_at | 20189_at |

TABLE 27-continued

2X ROOT SPECIFIC (COLD, SALINE & OSMOTIC STRESSES)

| | | | |
|---|---|---|---|
| 13146_s_at | 15343_at | 17485_s_at | 20194_at |
| 13172_s_at | 15389_at | 17490_s_at | 20200_at |
| 13178_at | 15392_at | 17567_at | 20214_i_at |
| 13179_at | 15448_at | 17585_s_at | 20239_g_at |
| 13187_i_at | 15503_at | 17595_s_at | 20262_at |
| 13211_s_at | 15531_i_at | 17840_s_at | 20269_at |
| 13239_s_at | 15594_s_at | 17860_at | 20294_at |
| 13273_s_at | 15609_s_at | 17880_s_at | 20312_s_at |
| 13297_s_at | 15623_f_at | 17894_at | 20382_s_at |
| 13549_at | 15639_s_at | 17896_at | 20396_at |
| 13604_at | 15670_s_at | 17899_at | 20432_at |
| 13629_s_at | 15680_s_at | 17911_at | 20444_at |
| 13706_s_at | 15859_at | 17935_at | 20446_s_at |
| 13714_at | 15900_at | 17961_at | 20480_s_at |
| 13751_at | 15923_at | 18024_s_at | 20586_i_at |
| 13895_at | 15962_s_at | 18122_at | 20612_s_at |
| 13933_at | 15964_s_at | 18222_at | 20672_at |
| 13967_at | 15965_at | 18224_s_at | 20686_at |
| 13985_s_at | 15975_s_at | 18252_at | 20689_s_at |
| 14028_at | 15985_at | 18255_at | |
| 14030_at | 16001_at | 18269_s_at | |
| 14058_at | 16048_at | 18270_at | |

TABLE 28

2X LEAF SPECIFIC (COLD, SALINE & OSMOTIC STRESSES)

| | |
|---|---|
| 12169_i_at | 16136_s_at |
| 12186_at | 16172_s_at |
| 12187_at | 16316_at |
| 12211_at | 16385_s_at |
| 12212_at | 16455_at |
| 12214_g_at | 16485_s_at |
| 12270_at | 16512_s_at |
| 12645_at | 16547_s_at |
| 12754_g_at | 16548_s_at |
| 12774_at | 16629_s_at |
| 12793_at | 16673_at |
| 12796_s_at | 16899_at |
| 12910_s_at | 17010_s_at |
| 12916_s_at | 17018_s_at |
| 12953_at | 17054_s_at |
| 13090_at | 17095_s_at |
| 13124_at | 17097_s_at |
| 13335_at | 17273_at |
| 13550_at | 17394_s_at |
| 13567_at | 17420_at |
| 13568_at | 17449_s_at |
| 13596_at | 17600_s_at |
| 13614_at | 17843_s_at |
| 13678_s_at | 17913_s_at |
| 13719_at | 17966_at |
| 14014_at | 18003_at |
| 14096_at | 18081_at |
| 14118_i_at | 18560_at |
| 14369_at | 18588_at |
| 14478_at | 18626_at |
| 14513_s_at | 18644_at |
| 14540_at | 18666_s_at |
| 14596_at | 18742_f_at |
| 14733_s_at | 18977_at |
| 14986_at | 18994_at |
| 15045_at | 19227_at |
| 15097_s_at | 19373_at |
| 15098_s_at | 19834_at |
| 15145_s_at | 19867_at |
| 15153_s_at | 19998_at |
| 15154_s_at | 20062_at |
| 15182_at | 20199_at |
| 15203_s_at | 20256_s_at |
| 15372_at | 20284_at |
| 15521_s_at | 20437_at |

TABLE 28-continued

2X LEAF SPECIFIC (COLD, SALINE & OSMOTIC STRESSES)

| | |
|---|---|
| 15581_s_at | 20442_i_at |
| 15621_f_at | 20450_at |
| 15642_s_at | 20468_at |
| 15776_at | 20547_at |
| 15910_at | 20635_s_at |
| 16017_at | |
| 16046_s_at | |
| 16115_s_at | |

TABLE 29

2X TRANSCRIPTION (COLD, SALINE & OSMOTIC STRESSES)

| | | |
|---|---|---|
| 12068_at | 15665_s_at | 19836_at |
| 12166_i_at | 15679_s_at | 19860_at |
| 12374_i_at | 15720_at | 19866_at |
| 12392_at | 15871_s_at | 19898_at |
| 12431_at | 16072_s_at | 20262_at |
| 12450_s_at | 16073_f_at | 20335_s_at |
| 12503_at | 16105_s_at | 20362_at |
| 12536_s_at | 16111_f_at | 20424_at |
| 12540_s_at | 16127_at | 20437_at |
| 12541_at | 16534_s_at | 20456_at |
| 12587_at | 16582_s_at | 20515_s_at |
| 12594_at | 16589_s_at | 20635_s_at |
| 12595_at | 16747_at | |
| 12704_f_at | 17019_s_at | |
| 12705_f_at | 17129_s_at | |
| 12709_f_at | 17160_at | |
| 12712_f_at | 17520_at | |
| 12719_f_at | 17538_s_at | |
| 12724_f_at | 17555_s_at | |
| 12725_r_at | 17609_at | |
| 12726_f_at | 17896_at | |
| 12734_f_at | 17971_s_at | |
| 12736_f_at | 17975_at | |
| 12737_f_at | 17978_s_at | |
| 12812_at | 18121_s_at | |
| 12949_at | 18167_s_at | |
| 12951_at | 18197_at | |
| 12966_s_at | 18222_at | |
| 13023_at | 18318_at | |
| 13034_s_at | 18576_s_at | |
| 13087_at | 18629_s_at | |
| 13270_at | 18738_f_at | |
| 13273_s_at | 18742_f_at | |
| 13432_at | 18744_f_at | |
| 13555_at | 18745_f_at | |
| 13688_s_at | 18747_f_at | |
| 13714_at | 18750_f_at | |
| 13965_s_at | 18751_f_at | |
| 13987_s_at | 18789_at | |
| 14003_at | 18834_at | |
| 14144_at | 18942_at | |
| 14178_at | 19083_at | |
| 14223_at | 19202_at | |
| 14235_at | 19209_s_at | |
| 14303_s_at | 19232_s_at | |
| 14393_at | 19315_at | |
| 14553_at | 19489_s_at | |
| 14781_at | 19611_s_at | |
| 15046_s_at | 19646_s_at | |
| 15053_s_at | 19707_s_at | |
| 15214_s_at | 19722_s_at | |
| 15510_r_at | 19744_at | |
| 15638_s_at | 19755_at | |

TABLE 30

2X PHOSPHATES (COLD, SALINE & OSMOTIC STRESSES)

| | |
|---|---|
| 12470_at | |
| 12556_at | |
| 13128_at | |
| 13135_s_at | |
| 13180_s_at | |
| 13192_s_at | |
| 13193_s_at | |
| 13587_at | |
| 13995_at | |
| 14335_at | |
| 15073_at | |
| 15171_s_at | |
| 15240_at | |
| 15586_s_at | |
| 15641_s_at | |
| 15651_f_at | |
| 15990_at | |
| 16232_s_at | |
| 16576_f_at | |
| 16753_at | |
| 17423_s_at | |
| 17525_s_at | |
| 17537_s_at | |
| 17929_s_at | |
| 17954_s_at | |
| 18012_s_at | |
| 18308_i_at | |
| 18616_at | |
| 18847_at | |
| 18936_at | |
| 18980_at | |
| 19243_at | |
| 19263_at | |
| 19638_at | |
| 19883_at | |
| 19932_at | |
| 20333_at | |
| 20393_at | |
| 20570_at | |

TABLE 31

2X KINASES (COLD, SALINE & OSMOTIC STRESSES)

| | | |
|---|---|---|
| 12253_g_at | 16059_s_at | 20144_at |
| 12270_at | 16087_s_at | 20219_at |
| 12271_s_at | 16088_f_at | 20223_at |
| 12276_at | 16125_s_at | 20232_s_at |
| 12278_at | 16137_s_at | 20235_i_at |
| 12284_at | 16140_s_at | 20282_s_at |
| 12300_at | 16143_s_at | 20298_at |
| 12307_at | 16144_s_at | 20396_at |
| 12353_at | 16160_f_at | 20439_at |
| 12357_s_at | 16171_s_at | 20462_at |
| 12390_at | 16357_at | |
| 12394_at | 16412_s_at | |

TABLE 31-continued

2X KINASES (COLD, SALINE & OSMOTIC STRESSES)

| | |
|---|---|
| 12395_s_at | 16568_s_at |
| 12408_at | 16570_s_at |
| 12452_at | 16571_s_at |
| 12477_at | 16584_s_at |
| 12490_at | 16651_s_at |
| 12497_at | 16652_s_at |
| 12532_at | 16672_at |
| 12697_at | 16818_s_at |
| 12901_s_at | 16840_at |
| 12902_at | 17068_s_at |
| 12958_at | 17122_s_at |
| 12959_at | 17252_at |
| 13068_at | 17323_at |
| 13246_at | 17475_at |
| 13324_at | 17752_at |
| 13332_at | 17921_s_at |
| 13362_s_at | 17933_at |
| 13370_at | 17935_at |
| 13550_at | 18013_r_at |
| 14030_at | 18046_s_at |
| 14048_at | 18122_at |
| 14194_at | 18176_at |
| 14196_at | 18316_at |
| 14217_at | 18455_at |
| 14459_at | 18459_at |
| 14603_at | 18482_s_at |
| 14637_s_at | 18543_at |
| 14686_s_at | 18706_s_at |
| 15005_s_at | 18782_at |
| 15175_s_at | 18924_at |
| 15270_at | 19117_s_at |
| 15475_s_at | 19437_s_at |
| 15497_s_at | 19442_at |
| 15577_s_at | 19458_at |
| 15616_s_at | 19464_at |
| 15633_s_at | 19469_at |
| 15634_s_at | 19562_at |
| 15668_s_at | 19655_at |
| 15680_s_at | 19749_at |
| 15798_at | 19854_at |
| 16034_at | 19904_at |

SEQUENCE LISTING (5379 sequences)

SEQ ID NO: 1 - DNA, 636 bp, Arabidopsis thaliana
atgaggaaaacaccatctctcggagcggaactgctctgctcgtattctctctctgatccatctccatcaccatctccgttctccagtgaaatggagattccggaggggacaccaaaagattcagaaaaggccatcgaacaagatacagtatcatcaattggggtaaagaaacctccagtggactctccagccactactaatgctgctagcggtcgacttgtttatgtccggagaagagtggaggttgacacatccaaagccgctgctagcactactaatccgaatccgcctcctactaaggcaccaccccagataccttcatcacccgcacaggcacaggcacaggaaccaacccctaccagccataagttagactgggaagagcgttaccttcatcttcaaatgcttcttaacaagcttaatcaatctgatcggaccgatcatgttcagaatatgtttcctctgttattagtgctttggtcactttcctccgccgagcttagcaagcatgctgttgacttggaaaagaggtctattcagttctctctcgaggaagcgagagagatgcagcgcgtagcagctttaaacgtgttaggaaggtctgtgaatagtataaaatctacatcaaatgagtga

SEQ ID NO: 2 - DNA, 1623 bp, Arabidopsis thaliana
atgggtgatatgcaagttggtgttgccactattgacgataagggtttttatggtttgatggaggatacacaagtaaaggcggtggcttcatcgaacccgagcttgcaagtgtcggtttcttttggtaggtttgagaatgattcactttcatgggagaagttctcagctttctctccaaataagtacttggaggaagttggcaagtgtgctactccaggatcagttgctcaaaagaaggcttattttgaagctcattataagaagattgctgagaggaaagctgagattatagatcaggagaaactaatggacgagaacgcatcttttagatctattgtttcagatcaggagagtgtggaatgcgaaaatggcggggtggtggtagagtctgaggttgataatggttgtaatgggcaattatcttgtgatgaagataagcatgtgactgacattactgctaaagtgaatcaagtgagtattgatgagagtaatgaagaaactattgttgtcaaggaatgtcaaagctcggttgatacggtgaaagacgaagtcaaggacagtgtggatagtccagtattggagaaagcagaggagattgctcttgaggaagagaagatagaaatggtcgtccatgtgcaggagagatcagaagaggttttacaagaggatgagaaagaagagacagaagtaagagaagaagtgagagacgacatttcattacaaaatgatactgtggatgcaaatgaaacgacgaagaaggtggtgaagaaagagaaaaagcctaatctaatcaagaagaatgatggaaatgtgcggattaatcctacgagaggctctcttaagcctaatcaggtggggggaaaaccggaaactaacaaaactgtaacgagtaggaaaactccaccgagcaaggagatgaaaaacatgatgaaagcaacaaagaaaccagcagcaccaatgtcaaaatccccacaagggtttgcaactccaagagtgtacaagccagctccaacaaaaacttcattgtctacatctcactcttcgttgaagaaggaaaaggtctcgcctttactgagtaaaaaacaaaccgctccaaagtcattgcatatctctatgaatctggatccacctgcttccgatcctactgctcttccaagcactagaaaatcattgatcatggagcgaatgggagataaagacattgtcaaacgtgcattcaaatcatttcaaaagagtttcgacttcaagtcttctgtcgacgggctaaacacagcagtaaagcagaatcctgcaaagccaacaattattccgtcagtagctactcgtcagaaggaaaatggcaggcctacaaaagcaagtagcatggagaagagaagtggtactaccgcctatcgttctccatctcatggactcaaaagcaatgaaaccgctgagaaacaacaaaaggagatttccaagtctggtgcaagacctttagagaagacacgcttgcagaagaacccaaaggcaggagtgattgatgccaaaacgcggagggactctcttaatccgaaagcaaaacctgtgcagggttctcttccaatgcggaccgtatcgaaaagctctttagacaaagtgttatga

SEQ ID NO: 3 - DNA, 1401 bp, Arabidopsis thaliana
ttggtggagatgatgagatcagagaatcatctaagacaagcttcgaagcatcggaacaacaattttccggtgaagttagagatcattgaagattctcttgaagaagaacacgctcctctcaacaaacgatccaagctatggagcaatggaacaagtgtctctaagtttagtctacttgaagagccaagtcctttggggttgagtttaaaaaagagcccatcttttcaagaactgattgagatgaaactttctcaaagtggtgatgactcaaattcggttaagaaagaaagttttggttttggtggtgtaggaaccgttgagaagcttaaagcttctaactttcctgctactattctcaggattggtcaatgggagtataagtcaaggtatgaaggtgatttggtggcgaaatgttactttgcaaaacataaacttgtgtgggaagtgttggaacaaggtcttaagagcaagattgagattcagtggtctgatattatggctttgaaggctaatttgccagaggatgaacctggaaccctgactattgtgctggctaggcggccattgtttttcagagaaactaatccgcagcctagaaaacatactttgtggcaggcgacatcggattttactgatggtcaagctagcatgaacaggcaacattttctgcagtgtcccccagggattatgaacaaacattttgagaagcttgttcaatgtgatcatcgcttgttctgtctaagccggcagccagagataaacttggccgcaccgttctttgattcacgactatctatatttgaggatccctcagtgtctggatctcataatattgcatctcctgttggggctcagtcatcatcagaacatgtgtctctatctcatgacgcactatcgcctagctcagtgatggatgctcgtgcaatcgaaggagttggtggttccattgattcgaggaatacaaacggttggagtcagataaaaatgcctggactacaccaatctatctcgatgaacgatttccttacgtttttgtcagatcaagcttgtgaaaacaaccaagagtttgaggaaatgaaacagttactgctaagtgacaacactcaaaccgatccatctgatgagaagtctgtcatgtcaaaggtgaattctttctgcaacctcttgcaatctgctgcaaactcacagctcaatatcgaaactgctgataccgaaagagttgttggggtcgataacaatagacacatgcccgaaggaggcaaaagagttgttgaccctgcttcaagcagcaagccactacaagggatgtcaaggaaagactcattcagtgatttgctggtgcaccttcctcgaatcacatcactcccaaagttcttgttcaacatttcagaagaagactag

SEQ ID NO: 4 - DNA, 444 bp, Arabidopsis thaliana
atgaagcatctcatccgccgcctctctagagtcgccgactcatcctccgaattctccatccgccgttccacctcctccttccgcaaccgtcgcggtcaccatcgtctccacgcgccgccgcctccgtggtcaatatgtccagctagaagagtcaacaccgtccccgctggtcacgtacctgtctacgtcggcgaggagatggagaggttcgtggttagcgcagagcttatgaaccacccgatcttcgttggtttgctaaaccgatccgctcaagaatacggttacgctcagaaaggagttcttcatatcccttgccacgtcatcgtgtttgagcgcgtggtggaaacgctccggttgggagggtttgaagggtccggtgatctagagaatcttgtggcttcgttgctctccggtgatgagttgatacctgaaactacagagtag

SEQ ID NO: 5 - DNA, 4677 bp, Arabidopsis thaliana
atggcaccgaggtcaagcaaagggaaatcaaacaacaaagggaaaggaggagataagaagaagagagacgataaactgttggctccgagtctggttgaaatcacagtcaccactccgtacgaaactcaagtgatactcaagggagtttctactgacaaaatcattgacgtgagaaggcttttagcatctcacgttgagacttgccatttcaccaactattctctctcccataaggtgaaggggcataaattgaatgacaacatccaagtactttccctcaagccttgttttctccgcatgattccagaggagtatctagaggaaagtcaggcgttgactcaggtacggagagtcatcgacattgtagcatgcaccaccaggttcttctccaaatctcccaacaaatccatcgttgccggcaatgccaatccgacaccggcgccggacggcctcgacatggtcgctatccacaccacacccaaactttctcagttctacgagttcttctccattcaccacctatctcctccgattcttcatttgaagaaagttgatggtgaagaagctggagagaagcgtgatggtgactattttggacttaaggttaagatttgcaatggcaaggttatacatgtgattgcttctgtaaaagggttcttcgccgttggaaaacagctctcacattgtcattccattgttgatttgctccagaatgtcagcaatgcttttgccaaggcatatgaatctttaatgaaagctttcactgatcggaataaggtggctgattttggcaacctcccgtttggattacgctcaaacacatggcttgtaccttctcctgtttctgagtctgcttctcctttaccaacagaggatgaacattggggcgggaatggtggaggtcaggggagaaatggtgaatatgatcatcgaccttgggcggctgagttttctgtattagctacgcttccttgcaagactgaggaggagagagttattcgagataagaaagcttttttgcttcatagccagtttattgatacctcagtgcaaagagctgttagagccatttgcaacgtgatggatactaatcaacaaacaagtgggactactgacttacctgctggctcgatccttcttgaggatcatgttggagatttgtctattgttgtaaaacgtgatatagccagccttgactcaaagcctgaagctacatttcaaaatgatgcatttgttctatcatccgaggaacttgctgaaaggaatttgctaaaagggattacagctgatgagagtgtgattgttcatactataaccagtgaagaaaaaaatatccaggatactccggctttaggcaaagttattgtaagacagtgtggatatactgcggtggtaaatgtcaagggtcaaactcagaaggcaatgtctgatttccgtgatattttaatcgatgacctgccggatggaggagctaatgctcttaaccttaacagcttacgggtagagtttcacaggccccatagtgttggaacatctgtagagaaccagcccacacagcttgattgggatgatttagaatcttatagatgtattatacaggagttagtaaaaattaacttaacaaagttagaagaaacaagggtatcttctgtaagacccatcagatgggaactcggttctacctgggttcagcatctacagaagaaagaaacagacgtctgtggaaagcctgcaactaatgatgaaactgaactttcagttaaaggcttgggaaaacaatttaaagatctaaagagcaaaagtaagaaatcagaaaatataagtgccgtgaatgaaaaagataccagactgcacgagttaaatgaggaggatgatctagggcagaaaagcattgatggactctttactgaactgaaggaactgctttctgaagaagctttctctcgcctaaaagaaactggaactggtctccatttaaagtcaaaagaagagcttaccaatatggcatatggttactatgatgaaattgctttgccaaggctggtagcagatttcgggtcactggagctttctccagttgatggtcgcactttgactgatttcatgcatataagaggactccaaatgcgttctctaggacatgtggctaaacttgctgagaaacttcctcatatacagtccctctgtattcatgagatgattacaagagctttcaagcatcttcttagggcggttattgcatctgttaataatatggcagagctacctgtggcggttggtttagaactagtttcaagagattttgacttcgattctccaaatcctttcatgagctctgacattattggattggtacctgtgtgcaagcatgtgctgtgtatttcatctgacggaaggacactcttggagtcatcaaaacttgctcttgacaaaggaaaactagatgatgctgtgagctatggaacaaaggcattagtcaagatgattgctgtctgtgggccttatcatagaaatactgcatgtgcgtacagtcttctcgcagttgtactataccacactggcgattttaaccaggcaacaatatatcagcagaaggctctagatataaatgagagagaacttggtctcgaccatcccgacactatgaaaagctatggggatctttctgtattttactatcgtcttcaacattttgaattggcactaaaatatgtgaaccgggcgttgtttcttcttcacttcacttgtgggctatctcacccaaatactgctgccacatatatcaatgtggctatgatggaaaaagaagtagggaatgatcatctagctctaaggtacctgcatgaagctctaaagagcaataaaagattgctaggagctgaccatattcagactgcggcaagctatcatgcaatagcagtggctctctctttcatggaagcacattcattgagtgtgcaacatgaacaaactacacttcagatacttactgcaaaacttggagcagatgaccttcgtacacaggatgctgctgcatggctcgaatattttgaatcaagagccatagagcagcaggaagcaggccgaaatggaatcccaaagcctgatgcttccatcgcgagcaaaggccaccttagtgtatcagatctcctggactatataagttctgatccagacactaagggaaatgttgctcacaggaaacatcggcgtgccaggatattacaggtcaatgataaggttgcatcagctgatgatgacgcccatagagttgcttcacagattgacattgttacatggaacaatgtggcagaagcggatgtcactaagagtaggagcgaagtaaatgatcctgatacagttgttgataagaccaatattgagacaggtgatattgtagtacacaggctaaatgtagacaggcaaactgtggaagagtcaactttagacgagggctggcaagaggcatactcaaaggggagatccggaaatggtgctggaaggaaatccagacaaaggcagcctgatcttatgaaaaagagaatgttgcttaataaacatcacaacaggaatcaggatgttcagcaacagaatatatattctcccttgcagaaaacaagcaaaggaccctccctctctaagtcatcaccccgtagggctctaaagaatgcagagatagatgtcagtacaaatacaactaaaccacagttaaaggcttctggtgctgctgctgtgaccagtactactttggcctcaaagtctctctcatacaaagaggttgctttggcaccaccaggtacagttctgaagccaatgttagaaaaattagaactgaatttggagagaactgaaactcagatatacaggacttcaagtgcgtcatctggagaagaaagcaagtccgacactgtaatgttggatttgccaatcgaaggcacagagcttcactgtgagaaacaagaatcacaagaaagtgctgagtcagtggaaaacttaacgtcagagtctgaaggggatctggggtcctatcgtgggaaaaaaacttctgatataagccggacaaagctatcagcctccgcagagccttacaaccctggaggtttcttggttattgatctgcaaagctcagcagcaacaataggcagctacccaattatggttgcagaccctatttcctgggctgtagtttcatgtgggattcactcaccaccatattatagtgctattcactcaaatggagttgggacgccaagaagcatgaatccagatgcaccagagtttgttccgagaagatccttgcagaatagctctcaacatgcaggtgaagatgcaagtgtatccgtcgactccagcagttgcctaaaggctgagaaagatgcagttgatttgaagaagcgagagcttgccagcttcatagtaaagtcatcacagaaagaggttccggctgctcttagcaaaacgagccccgaagctgagtcaggaggtacctccgaaaaggatagtgcagtaaccgagatagtttatagtagagaagaggagaatggagcgaatgcaaatgagacaaatggaggtgaagggtttgtgattgtggcaaagaaaaggagaaggaagaacaaggtgcgacttacaaatgttgcggctgggctgtaccatcaaccgtcgtcagtttgtgcatga

SEQ ID NO: 6 - DNA, 795 bp, Arabidopsis thaliana
atggagaaagaagaaggagaaacaacaacaacgatcggcgttgttccggcggcgccggcgaaattaccgactccgatatattctctgagcttttgggaggtcacggcagcttccggcgtcgttttagggtttattttgggtcttgtttgcgtttatctcacaatgcctcaatctgattacagctttctcaagctacctcgtaatctcgaagatcttcagattcttagagataatcttgagatatacacaagtgattacacagttcaagttcttgttggatattgtctggtgtacgtttttatgcagacgttcatgattcctggaactgtgttcatgtctttgcttgctggtgctctctttggagttgtcaaaggaatggctcttgttgtctccactgcaacagctggtgcttcctcttgttatttcctctctaagctcattggtagacctttactcttctcgctttggcctgacaagctcgtattcttccaagatcaggttgcgagaagaaaagatcggttgctgaattatatgctgttcttgaggctaacaccaacattgcctaacactttcattaatgttgcttctccaattgttgatgttccttatcatatcttcttcctagctacattcatcggtctgattcctgctgcatttgtcactgtccgggctgggcttgctcttggagagctaaaatcattgggagatctctatgacttcagctccatggcgactctgtgtctcattggtgtgctctctgtgactccaaccctaattggcaagaaacaagcatag

SEQ ID NO: 7 - DNA, 885 bp, Arabidopsis thaliana
atgttcagaagaaggaatgctcaccaactcgacaatgatgattctcaacaagataacaaggttagagaattgaaatccgcgataggaccattatcgggacatagtttagttttctgctctgatgcttccttgaggagatttctagatgctcgtaattgggatgtggaaaaagccaagaaaatgatccaagagactcttaaatggagatcaacttataaacctcaagagatccgttggaatcaagtagcacatgaaggtgagaccggaaaagcttcaagagctagttttcatgatcgacaaggtagagtagtgcttataatgagaccagccatgcagaactcaacatcacaagaaggtaatatcaggcatttggtgtatcttcttgaaaatgcaatcataaatcttcccaagggacaaaaacaaatgtcttggctcattgatttcactggttggtctatggctgttaatcctcctatgaaaacaacacgcgaaatcattcacattctacagaactattaccctgagagactcggtatcgcctttctctacaatccaccaagactcttccaagcagtctacagggctgctaagtacttcttggacccacgtacagctgaaaaggtgaaatttgtgtacccaaaagacaaagcaagtgatgaactgatgacgacacattttgacgttgagaatctccccaaggaattcggaggtgaagcaacactagagtatgatcatgaagatttctcacgacaaatgtatgaagacgatctcaaaaccgcaaaatactggggactagaggggaagcactatccgaaaacaaacggtttctctccatccgatgttgttcctgagccggcgatagaaatcgcatcagcagctagctga

SEQ ID NO: 8 - DNA, 861 bp, Arabidopsis thaliana
atggcagagatgtataataacatgggacctcaaccggggatgccaagacctccaggaaaccctgagcctggtccatttggtaatcctttcactggagctggctcgggttttatccgtggtggtttgggagcgtatggggagagaattttaggatcgagctctgagtatgttcagagcaatataagccggtacttctctgatccgcaatactatttccaagtgaatgatcaatatgtgaggaataaactgaaggttgttctgtttcctttcctacaccggccatttaattgtactattgtgggttctgcttcaaaccctcagggacactggaccagaatatctgaaccagttggtggtaggctctcatacaagcctccaatatatgatatcaatgctccagacttgtacattccctttatggcatttggtacctacgttgttcttgctggtctttcattgggacttaatggaaagtttacaccggaagctttgaattggctgtttgtgaaaggattggttggttggtttttgcaagtaatgctcctgaaagtaacacttctatcacttggtagtggagaggcaccattactagatattgtggcatacggagggtatgcttttgctggtctgtgtcttgcgggctttgccaaaataatgtggggatactcgtactacgcgttgatgccatggacttgtctatgcactgggattttcttggtgaagacgatgaaacgtgttctgtttgctgaagtaagaagttacgattcgagcaaacatcactaccttcttctgtttttagccttggtccagttcccacttttgatatggcttggtaacattagtgttaattggcttctttga

SEQ ID NO: 9 - DNA, 1329 bp, Arabidopsis thaliana
atgagcagcagcagcgatactcatgccggagaatctcgtcatcgccgtaacccgatccggtggctactcggtttcggtttcttcgtacaaggattcagaggattcccatggcttggagccaatttcttcctcacagaacagctccgtgttaatccttcagtgcttcagcttcttcaaaactcagccaatcttccaatggtcgctaaacccatctacggcgtcgtttcagactctgtctacttctttggccaacatcgaatcccatacatcgccgttggagctttgttacaagcaatctcatggctagctatagcattcttgtcaagatccaatgtatcaatcttagctttatcgatatatcttctccttagtaatctcggtgcttccttagtagaagtagcgaatgatgctattgttgctgaatccggaaagcaaaaaacctcagagacgcaatccggtgagctaccgtcatttgtttggatggtttcttctcttggtggaatcttaggtaaccttttaggtggtattgctatcaaaacgttttcagctcagtcaacgtttcttgtgtttgggatcttggctcttcttcagttcttggtaactataaacatcagagaaaagtctcttaatcttccggaaaatccatcaccagctggtggtattaggaaacatctctctgatctttcgcatgtgttgaggaagcccgagatttcttattcgatagcttggatcgcggtatcaaccgctgtggttccggttttgacagggactatgtttttttaccaaacaaagtttctgaagattgatgcatcacttttagggatctccaaggtgtttggtcaaattgcaatgcttctttggggttttgcatataatcgttggctaaaagctatgcggccgaggaaactgctgacagccattcaggtgacgatagctttctttgtgatatccgatctcttgtttgtgaaaggcgtgtaccgggatttgggagtgtcggactctgtatatgtactcttcttttctggattcttggaaactctattttacttcaagattctgccgtttactgtcttgatggctcgtctctgtcctcctggatgtgaagggtctctcatggcatttgtcatgtcagccattgctcttgcattcatagttagcggatatcttggaatcgttcttgcatcgtttgtcggtgtaacagaggatgatttctcggggtttactcgcggactcgctatagaagcgtgctgcgttgggattccgttgatcttaacttcttggatatatgatgaagcggaaacaaaagagaagagtaaaaagatagagtga

SEQ ID NO: 10 - DNA, 1104 bp, Arabidopsis thaliana
atggcggtttatcatctccttctctcgagcccaccttcgcttcttcttctccctccttctcctcgccgccctaacctcaccttaatccgccgtatcccagctcatcctcgcctcggaaactcgaccagcttgctttcttcttcgtcaccggtaattcggaaaattctggttcgtagcactctccgggaagaccaacccatcgcctctgactccgagagtagtcctactctactgatcggtgaagattctgctgcttttgaattagggaaacagaagcttgtttcctgggtttatttcggtgttgtccttggagttgttctctttatcctcaatgttgtttggatcgataattccaccggtttcggaaaatcattcatcgacgccgtctctaacatctccggctcaccggaggttgctatgttaatgcttatccttatatttgcaattgtacatagtggtttagctagtctaagggatataggagagaaacttataggtgaacgagcatttcgtgttttgtttgctggaatctctcttcctttagctatgagcaccattgtttactttataaaccatagatatgatgggtcacagttatggcagcttcagggtgttcctggagtccatgaagctatttgggtcgctaattttgtatccttcttctttctctatccttcaaccttcaatcttctggaggtagcagctgttgacaaaccgaagatgcatctctgggagaccggcatcatgagaatcactcgacatcctcagatggttggacaaatcgtttggtgtttagcacatactctctggatcggaaacacagtagctgcatcagcttctctcggtttgattgcacaccatttgtttggggcgtggaatggagacaggagattggcaaaaagatatggagaggattttgaaagcatcaagaagagaacaagtgtgattccatttgctgccattttcgaaggacggcaagttttacctgaggattactacaaagaatttgtcaggttgccatatcttgcaatcactgcgttaacggttggggcatattttgctcacccgctaatgcaaggtgcaagctttaggcttcattggtaa

SEQ ID NO: 11 - DNA, 1158 bp, Arabidopsis thaliana
cgatggctatggagatttctcttcctttcgttggatcatccatggccttaaggtagggaaaatcaaggaacagcgtttctaggattagtcgtgttggattctcttcggtctcggctgtacatgtacccagaaggatgtttatgcagctgtctggatttggttcggtcttgacgcttctggattttcctagtttagcggcgccggttcctcagatgaaggaacctgaagtgatcaggtaaggcgtttaccaaaaaaccttaaaacgtcaacgaaaaatatccgatcgccggcgttctggtctatcattgtttgctttccttgaagatcccgaaacccaaaaaatgtcacaaggatggttttcgatgggcgggagtagcaccgtagatcagcagcagcaatcgggttcgtctctgcttgcggattggaattcttacgcagcctctagagatttcgaggaaagcggcggaagcttcggctttgatatcgaatccgccgttagatctgccaatgacactgtttcgggcaccttcagtgtgtaatttcaggaatcttcttttgtttctctgataaaattcttgttcttctgttgtttttgcaatgtacctgaatttgatgactacagggtttcaaaaggagttagagatattccagggagcttgcagtcagcaacaagtagtatgccttcaggaaaagcgctcatgtatttcggtttacttctcgcaagtggtgttttcttcatcttcattgccttcacaatgtttcttccagtcatggtgcttatgccacagaaatttgccatttgtttcacccttggatgtggattcatcattggatccttcttcgcacttcgtggccctaaaaatcagctcgcacacatgtcttcgatggaggtatgttacactgttctattgtgtgtctgtcatgccttaaatccaagagtgattccttcaaccctaggtttcattgctaccatggttggtaccatatacgtatcaatggttctccacagctacattctctcggtgctcttctcagtgttacaggtacttgcgctggtttactactgtatatcctacttccctggtggatcatcaggcatgaggttcctcagttctgctctcacctcatctgcgctaagagttttcgggagataagctt

SEQ ID NO: 12 - DNA, 711 bp, Arabidopsis thaliana
atggctggagttgtgcgattaacgacgacgtcggttcaagccattcgtgtctcctcgtccttcagctcctttgccaccgctcttaatcctctgcaaccttgcttacctccaaactcgaatctgaattccgacaagagattgcgtcttctctcatcttctccttcctgctcgtcttctcattaccacccatcttctggtctcggaagccatctcccccttagacgacccaagagccaagtggttcgtgtcaaggtagatgaaaatgtagccgagacagagccaccgaaatggtgggagaggaatgctccaaacatggtcgatattcattctactgaagagttcttgagcgctttaagcggtgcgggtgaaagattagttattgtagagttttatggaacttggtgtgcttcttgcagagcattgttcccaaagctttgcaagacagcggtggaacatcccgatatagtgttccttaaagtaaactttgatgagaataaaccgatgtgcaagagtttgaacgtgagagtgcttccttttttccacttttaccgtggagctgatggtcagcttgagtcattctcatgttctcttgctaaggtaaagaaggctatttcggtttcaccttttccgcaactagagcttggcataacgcttcaaacaaagagaactacttcgttgttctttttcgataggatctatcaaatattatag

SEQ ID NO: 13 - DNA, 3501 bp, Arabidopsis thaliana
atggaggtagagaaatccaagtataggagcgaagatttggatgtggtggaggaggaggctgatttgaagaagagtcggcgagatcgtgatcggagtaatgagcggaagaaggataagggttcagagaagcgtcgagagaaggataggcggaagaaacgagttaagagtagtgattctgaagatgattacgatagagatgatgatgaagagagggagaagcgtaaggagaaggagagggagcggagacggagggataaggatagggtgaagagacggtctgagagaaggaagagtagtgattctgaagatgacgttgaagaagaggatgagagggataaacgcagagtgaatgagaaggagagagggcatcgagaacatgagagagatagaggcaaagataggaaaagggatagagagagggaagagaggaaggataaagaaagagaaagggagaaggatagagagaggagagaacgggaacgggaagagcgggagaaggagagagttaaagaaagagaaaggcgggaacgggaagatggagagagggataggagagagcgtgagaaagaaaggggtagtaggaggaaccgggaaagggaaaggtcaagagaggtgggcaatgaagagagtgatgatgatgtcaagcgtgacttgaaacgtagaagaaaagagggcggtgaacggaaggagaaagagcgtgaaaagagtgttggcagatctagcaggcatgaagatagtccaaagagaaagagtgtcgaggataatggggaaaagaaagagaagaaaacgcgagaagaagaactagaggatgagcagaagaagttggatgaggaagtggaaaaacgaaggagaagagtccaggagtggcaagaattgaagaggaagaaggaggaagctgaaagtgaaagtaagggtgatgcggatggtaatgagcccaaggccggtaaggcttggactcttgaaggagaatctgatgatgaagaaggccatccggaagaaaaatcagaaacagaaatggatgttgatgaagagactaaacctgaaaatgatggagatgctaagatggtagacttggagaatgagacagctgctactgtctctgagagtggaggtgatggagctgtagatgaagaggaaattgatcctttagatgcttttatgaatactatggtattacctgaggttgagaagttttgcaatggtgctcctcccccagcagtgaacgatggtactttggattctaaaatgaatgggaaggaaagtggtgaccggccaaagaaaggttttaataaggcccttggtaggataattcaaggtgaagattctgattctgattattcagaaccaaagaatgatgatgatccaagtttagacgaagacgatgaggagttcatgaagagagtaaagaagacaaaagctgagaagttgtcccttgttgaccactcaaaaatagagtatgaacctttccggaagaacttctatatcgaagtgaaggatatctctaggatgacacaagaagaagttaacacttacagaaaggaattggagctgaaagttcatggaaaggatgttccaagacccataaagttttggcaccagactgggctaaccagcaaaattttggatactatgaagaagcttaattatgaaaagccaatgcctattcaaacacaagcactccctatcatcatgagcggtcgagactgcattggggttgcaaaaaccggttcaggtaaaacccttggttttgttttgccaatgctgaggcatattaaagatcagcctcccgttgaagctggtgatgggccaattggtcttgtaatggcacctactagggagcttgttcagcagattcacagcgatatcagaaagttttctaagccattgggtataagatgcgtccctgtgtatggaggatcaggagttgcccagcaaattagtgaacttaagcgaggtactgagattgttgtgtgcactcctgggagaatgattgatatcctttgcacaagcagtgggaaaatcactaatctgcgaagagtcacatttttggtaatggatgaagctgatcgtatgtttgacatgggttttgagcctcaaattactcgtattattcagaacattcgaccggaacgccaaactgtgcttttttctgccacttttccacgccaagttgaaactttggcacgtaaagtcttgaacaagcctgtagaaatacaggtcggtggaaggagtgttgtgaataaggatataactcagttagttgaagtcagaccggagagtgataggttccttagacttctggaacttcttggggaatggtctgagaaagggaaaattctggtctttgttcagtcgcaggaaaaatgtgatgccttgtatagggatatgattaaatctagttacccttgtctgtctcttcacgggggtaaggatcagaccgatcgtgaatcaactatatctgattttaagaacgatgtctgcaatttgttgattgccacaagtgttgctgctaggggtctagatgtgaaagagcttgagttggttgtaaactttgatgcgccgaaccactatgaagattatgtgcatcgcgttggcaggacaggcagggcagggcgtaagggctgtgctgtgacatttatctccgaggatgatgcaaaatatgcaccagatttagtcaaggccctggagctttctgagcagccagttcctgatgatctgaaagcacttgctgatggtttcatggtgaaagtgaaacagggtattgagcaagctcatggaactggctatggtggtagtggctttaaattcaacgaagaggaggaagaagttagaaaagcagcaaagaaagcacaagcaaaggagtatggctttgaggaagacaagtctgactcagaagatgagaatgatgtagtaagaaaggcaggtggtggtgagatctcacagcagcaggctacttttgctcagatagccgccattgctgctgctgccaaagctgctgctgctgctccagtgagtgctcctgtgacagctaaccaattactggcaaatggtggcgggcttgctgccatgccaggtgtccttccggttactgttcctacccttcctagtgaaggggcaggccgtgctgcagccatggttgctgccatgaatctgcaacataatctggcaaagattcaagctgatgcaatgcctgagcactatgaagcagaacttgaaatcaatgacttcccacaaaatgctcgttggaaggtcacccataaagaaactttgggtccaatatcagagtggactggagctgctattaccaccaggggtcagttttatcctacaggacgtataccgggacctggggaacggaagctgtacttattcattgaagggcctagcgaaaaatcagttaagcacgcaaaagctgaactcaagcgtgttcttgaagacattacgaatcaggccatgtcctcacttcctggaggagcatccgggagatactcagtcctttaa

SEQ ID NO: 14 - DNA, 765 bp, Arabidopsis thaliana
atggcgatcgaggatcaagagaacacaatccgtgaaatcaaacctaagaacagaagaatcatgggagctggtggtccggaggaagaggagaaccggtggccgccatggttgaaacctttgcttaaagagcaattctttgttcattgcaagtttcatggagactctcataagagtgaatgcaatatgtattgcttagactgcaccaatggcccactttgctctctttgtcttgctcatcacaaggatcatcgcaccattcagataaggagatcttcttatcatgatgttataagggtgaatgagatacaaaagtatcttgatataggtgggatccaaacctatgtgatcaatagtgctaaagtcgtcttcctgaatgagaggcctcagcctaggcctgggaaaggagtgaccaatacctgcaaggtttgctatcgtagcctcgttgatgatagcttccgcttctgctctcttggctgcaagtttcacctaacttctccttgcatttcagtaaactcttttctgatacttactttctctatgtttttgggaaatgaaatcaagattgctggaacatcaagaggctttgaaaagggaagggagaacctgctaatggaaacagaggattcaagtagcagcattgcaattgggaagaacattacaaatctccagagtttcagcccatcaacacctccacttactacatctagtaactgcagaatcgtcaagcgaagaaagggaattcctcaccgatctccaatgggataa

SEQ ID NO: 15 - DNA, 339 bp, Arabidopsis thaliana
atggagctttatactgcaaattgtctgtccaccgaaaacaaacctactcttgagctttcaaaactagtcaaagacgagaaaagctcggtgaaaacgaacagcgaaaacacccttacacttgtgaatcatggtgcaaagatgtggcaagagaacagggaaaaatgggtgggagatcaatctcgacaaagaaaaaacactgcaaaggatcagattataagctggtctactacatatgaagatcttctctcaactcatgaacctttctctgagtcgattcctttacccgagatggtggactttcttgtcgatatttggtacgatgaaggcctttacgattag

SEQ ID NO: 16 - DNA, 2310 bp, Arabidopsis thaliana
atgtccatcttgcctcctccgattatccaaggtcacaattcgtcttctccttcttcagattcctctctaaaccctagctctgagcatggcaacaactcttcttcttctctctctcctcttccctcctctcctccttcccggatctcttcttccaccggaactcgattctccggacattctgaatcctctcacaatttctccggtggctctagggaaccgagtgttgcagctgaggagggacatagccgtggatcttccaaagagatgacacaaaatggagcagggaaggagagtttttccccacctaatgcagataagcgtgaccattttcgatatgatggtcgaaggaataggtctagagggagaggtactggagctgctggttcttcttcttctcaattgcagcataattccggaccttttaattctcctagaggcggtgtttcgcatcataatccaactggtagaagagctaatatgataagtgggaatcatttactgaattttcagtatgatccgatttcgcaaccgcaatctaggggtcctcctccgcctcaaagaaggcaacaatataaggggaggccttttaacaaggatttgtttcttaaggccaattataagtttgttgtgttggacactggagatcattctcctgattcaatggatcctgataaaatgctgcagtgggatgatattatttgtgtaaggtattctactccgtctcctgtccagtgtccgatttgcttggagtatcctctatgtccgcagattacttcctgtgggcatattttctgtttcccgtgtattctacagtacctgttgactggtgttgataaccacaaggtggactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcagtctgttgatggtcagcacattatccttcacactttgaatgtgaagtgccttctgcatcactatggaagctatgactttcttccaccaagattgagtggaaagatactggaaatggaaaccattacccaatcagaagcgataaggagacgctaccgctttttaagtcatttttctttatcaactacacttcagattgatatgaaggaatccttgcctcctgatgcatttgctccatttatacatgaaattaagaagcgtgagaagcagcggaaagaacgtgcttggaaggatcgaaaaaataaaatcaaagctgaagtagctgcagctgcagagcttgtaccattgatggccagttttgggcagtcgtcttctagtgatgactttcccccattttccttggatgactttgaagctctgggaaactctgccccaatatcatcaagccctccaaacattggagagagaagttccttctcacatgtgacaaggctcggtttcgcagctggtcacgactccccaaacctgaataacgagccaacaaacgttcaaagcagcagcagcagcagtgaagtctcaaacgcaaccacaggtgcaagaaacacaaacataacatcctttgcgagtgtagcttcaagaacaacaacaccaatggcaccaaccgtcaaagagcccggtaagagagggaagaaacagagccgagtacttctatcgacaactagtgtacgccgttactga

SEQ ID NO: 17 - DNA, 954 bp, Arabidopsis thaliana
atgggagaggagcatccgagaaagcggtctagacaacattttgaagcggaggcgagaaacgtatcgttgtttgaatcccctcaatgcgaaacctccaagtggtatttcagcagggaagagattgagcgtttctctccatccagaaaagatgggattgatcttgtgaaggagtcgtttttacggtcttcgtattgcaccttcctgcaaagacttggcatgaagcttcatgtgtcccaggttacaatatcatgtgcaatggtgatgtgccacaggttttacatgcgccaatctcatgcaaaaaatgactggcagacaatagcgacttccagtctgttcctcgcttgcaaagctgaagatgagccatgtcaactgtccagtgtcgttgtagcgtcttatgaaataatttatgagtgggatccttctgcctcaattagaatccatcaaactgagtgttatcatgaatttaaagaaattattttgtccggggaaagtcttctgctgagcacaagtgctttccatttagacattgaacttccctacaaacctctggctgcggctttgaatagactgaacgcttggcctgaccttgcaacagctgcatggaattttgtgcatgactggattcgaaccacactatgcttgcagtacaaaccccatgttattgcaacagccactgtgcacctagctgctacgtttcagaatgcgaaagtaggcagcaggagagattggtggttggagtttggagttacaactaagctattaaaagaggtaatccaggagatgtgcacactgatagaagtggacagaaggaggaatatgccacctccacctccacctccaagaagagagttaagttgggcaatacctgcagccgtaaagccggtccatatggctagagcttatccgtttcacagctaccctttgcagtcctatagacaggctggcatctggtga

SEQ ID NO: 18 - DNA, 1011 bp, Arabidopsis thaliana
atgggtggcggcggaggtatgttacgcgccgccggtcgtgcgatgacgaggaccggtgtagccaacggtggtattcaagatccctttgcttcttcatcatcatcgtccacgtcgtctccggctggaaacgcctctgtttcgcatgtccagaaacagagatcttcttcttctgggtcgaataatctgacgtattccgcggcttctgggttgttgttgaatcttccggtggctgcaacctccggatggagcggcggcggtcctttttcctttgttaattctggaggttatgatgattttgagtgggtttctgaggaagaagatgattctctgtttggctctgttccttctgttgatgaagtccaagatgctgtttctgctctccagcaggttttcgatgctagttcatattcccagctggttagagacaaatacgagtgctatccggaaaatggtggtggaaaccagagccctatagccacagggatggttcatcaagttccttcattcgggtcggattcggactggatggagccatcaatgcatttatgccattcaagaacgttaaagcctcatgcttatgatcaggtttacaatgcttttgacctactacgaaccgaaccatctgtccagaaaatggtagtatcattgtcgtctgacaaagcagtttgggaggcggtgatgaacaacgatgtggtgcgagagattagggacttgtacaacaatggcataagtcaagatgaggaaaattcagaagacacccctagggagaataacgcagcaacggatttcataaagtgggtatttgacaacacaatggttaaggccacggaagtgtttgtgaaaataacaaaggtcgtgaccgagctcttcaattgttacaatggtgatggtgttaacaacaaggggaaagatgccaaattcaacaattggctcgaggaaaagctgaccacttcggtcctgctatccatcatcgttatgctggtcgtgatggtatcccgagcctgcaactag

SEQ ID NO: 19 - DNA, 1647 bp, Arabidopsis thaliana
atggaagctgctcttgctgcatgcgctcttccatcgctccgaattctcaatacgaaacctcgtttcagatgttccttctccaatccaagcctacccatttctcctaattcccttatcacccgcaaatcaagtcgattcacaaccgcagtatcatcaccaccatcatcatcagccgctacgtcaacgaattctccaccggaacctgaagccctattcgaacccgggtcggataagttcgattggtacgctaattggtacccagtgatgccaatttgcgatcttgacaagaaggttcctcatgggaagaaagttatggggattgatttggttgtttggtgggataggaacgagaagcaatggaaagtgatggatgacacgtgtcctcatcgtcttgctcctttgtctgatggaaggattgatcaatgggggaggttgcaatgtgtttatcatggatggtgctttaatggttccggtgactgtaaactcattcctcaagctcctcctgatggtcctccgcatatggtttatatggaacataaagtcaaagtctttggttgtatcaatgattattttggtaatgcaaatcaggtccacactttcaagcaagcttgtgtagctgtttacccgagtactgtgcagcatgagatcatttggttttggccaaacagtgatccaaagtacaaaaacattattgaaaccaacaagcctccttacattccagagttagaagacccatcattcactaagttgatggggaatcgtgatattccttacgggtatctattggcttttacatcatttcaactatgtgtgattcttcttgcagagaagattgacagagaaggggggaaaccactcgaaatcaacgttaaaaaactagacaacaaagggttcttttcaaaacaagaatggggttattctaattttattgcaccatgtgtgtatcgctcttccacagaccctctaccagagcaggaacatgagtatcccgcaccagctgcttctgacaaggcggcattgtcaaagcggagattgtctttgatctttatatgtattccggtcagtccaggtcgtagtaggctgatatggacgttcccgaggaattttggtgtatttattgataagattgtccctagatgggtgtttcacattggtcaaaatacgattctagactcagatttgcacctccttcatgtagaggagcggaagatactggagagaggccctgaaaactggcaaaaagcttgctttatcccaacaaaatcagacgctaatgtggttacattcaggagatggtttaacaagtacagcgaggctcgagtcgattggagaggaaagtttgatccatttcttcttcctcctacgcctccccgagaacagctcttcgacaggtattggtcgcatgttgagaactgcagcagctgcaagaaagctcacaaatatctcaatgcgctagaggtgatcttacaaatcgcatccgttgctatgatcggagtcatggcggtgttgaagcaaacgacaatgtcgaatgtggctagaattgcagtgcttgtggcggctgttttaagttttgcagcttcaaagtggctatcacacttcatctacaagacattccattaccatgactacaaccatgctgttgtttga

SEQ ID NO: 20 - DNA, 828 bp, Arabidopsis thaliana
atggcgtttcttctccccaatctctctccttctttccttcttccgaccggaaaatcactcaaagagaaacccatttccaaccaagctttatcatcatcatcatcatcgtccaatagctacgagtttgaagaagatagtctctctccactttctctctttagcgtccaggctcctcctcctgttcgaggtgcgcaggttaagaccaaaccaagtgcgcaggataagtaccagcacggcagcaaagatgacttctacatcaatctcggtttagctgtacgtacccttcgcgaagatttgcctctcctcttcaccaaagatctcaattacgacatttacagggatgatataacattagtggatccaatgaacacgttctctgggattgacaactacaaattgatcttctgggcacttagatttcatggcaagattctcttcagggatatctcacttgagatcttcagggtttggcaaccatcagagaacatgattctcatcaggtggaatcttaaaggtgtacctagagtcccatgggaggcaaagggagagtttcagggtacttctcgctataaactcgaccgaaatggcaaaatctatgagcataaggtcgataacttggccttcaacttccctcaccagctcaaacctgccacttctgttttggatatggtcaccgcttgccctgcaagtcccaatccaactttcatgtttggcgccatggattcatactcatcttcttggattgagttctacaaagcagtgcaaaggacactagacaagcaagaagagcaaatgcttgtgcaagaccatttcgtcccatgctcataa

SEQ ID NO: 21 - DNA, 750 bp, Arabidopsis thaliana
atgggttcaatctctttatccaattctatgcccataactcgacttccactacttacatcactctatcatcaaagcttccttccgatttcttcttcatctttctctcttcttcctctctctaatcgtcgtcgctcctccactttttcaccgtcaatcaccgtctctgccttcttcgctgctcctgccagcgttaataataataactctgttccggcaaaaaatggaggttacacagttggggatttcatgactccgagacagaatttgcacgttgttaagccctctacgtcggtcgatgatgcgttggaacttctggttgagaagaaagtcacgggattgcctgtaattgacgataattggacactggttggtgttgtttctgattacgatttgcttgcattggactccatctctgtcaaaatgatacaaacttgttccctgatgtcgacagtacctggaaagactattgtttgtttcatttgcatgaatttccttggaatgaggtttacttatataatgcttgaattctcttttggccagacgtttaacgaactacagaaactgatcagtaagacatatggaaaagttgttggagacttgatgacaccgtctcctctcgttgtccgtgattctaccaatttagaagatgcagccaggttgcttctggaaacaaagttccgaagattacccgttgttgatgctgatggaaaactggtaagcatcccaattcttcttctttctgcagtttga

SEQ ID NO: 22 - DNA, 1050 bp, Arabidopsis thaliana
atgacctttctaaaaatgaaaagcctttctttcttcttcaccatcctcctctctctctcgaccctcttcaccatctccaacgcacggaagtttaatgtcggaggcagtggcgcgtgggttacaaacccacctgaaaactacgaatcttggtctggcaaaaaccgtttccttgttcacgacactctctattttagctacgctaagggagctgactcggtgctagaggtgaacaaggctgattacgacgcttgtaatacaaagaatccgatcaaaagagtggacgatggagattctgagatctctcttgatcgttatggtccgttttacttcatcagtggcaatgaagataactgtaagaagggtcaaaagcttaatgtcgttgtcatatctgctaggattccatcaacggctcagtctcctcacgccgctgcaccgggaagctctacgccgggatcaatgactccgccgggaggagcccactcgcctaaatcttcctcccctgtttctccgacgacttctcctccgggatcgactactccgcctggaggagctcactcgcctaaatcttcatcagctgtctctccggcgacttctcctccaggatcaatggcgcctaaatccggctcccctgtttctccgacgacttcaccaccggcaccacctaaatccacgtcccctgtttccccatcctctgctccgatgacttcaccgccggcaccaatggcacctaaatcatcttcaactattcctccgtcttctgctccgatgacttcaccacctggatcaatggcacctaaatcttcatcccctgtttcaaactcacccaccgtttctccatcgttggctccgggaggctctacttcttcttcaccgtcagattctccgtcaggctcggcgatgggtccttcaggagatggtccatcagccgctggtgatatctctacgccggctggagctccagggcagaaaaaatcgtcggcgaatggtatgaccgttatgtcgattactacggttttaagtttggttttgaccatctttctgtcagcttaa

SEQ ID NO: 23 - DNA, 321 bp, Arabidopsis thaliana
atgaatactgacataactgccttggagaaggcacaatacccagtggttgatcggaatcctgcttttactaaagtcgtcggcaatttcaggactctcgattacctccgtttctctactatcaccggcatctccgtcaccgtcggctatctctctgggattaagcctgggattaagggaccgtcgatggttactggaggattgatcgggctcatgggaggtttcatgtatgcgtaccagaactctgccggtagactcatggggtttttccctaatgatggtgaagttgctagttaccagaagcgtggtggtttctccaaatga

SEQ ID NO: 24 - DNA, 429 bp, Arabidopsis thaliana
atgggagtagtactgatcgatggatcaacggtacgatcttttgtagacgacgaagagcaattcaaaaaaagcgtcgacgagaggttcgcagctctggatctgaacaaagacggcgttttatcgcgatcggagctacgaaaagcgtttgaatcgatgaggctacttgaatcgcactttggcgttgatgtggtgactcctcaggacgagctgacgaacctctacgattcgatcttcgagaaattcgatacggatcaaagcggttctgtggatctggaggagtttagatcggagatgaagaagatcgtgcttgcgattgctgatgggcttggatcttgtccgattacgatggtgttagatgatgatgatgataatttcttgaaaaaagctgcggatttggaagcttccaagcttgagaaagcttcttcgtaa

SEQ ID NO: 25 - DNA, 480 bp, Arabidopsis thaliana
atgaaggaggacgatgcattgccgacgacgacgacgactggtacggcgacgggaacagctatggcgaattcgaagaaggaaagctctgactcggtcttgtttggaagaggtcgatataagttctgggcgtttgctgcgattttgcttttggctttttggtcgatgtttactggcaccgtcactctccggttatctaccgggaatctgaaccggttatcggaagatctagggattccgaactacgataatctcgacgttctggaaatggaggagagagagaaagtggtgaagcatatgtgggatgtgtatactaatagtcgtcggatcaaattgcctagattttggcaagaggcttttgttgctgcttatgaagaactcactagtgatgtgcctggggttagagaagctgctattggtgaaatcgccaagatgtcggcgcggtcgatcactcttgatccacctccttctagatcaaggtga

SEQ ID NO: 26 - DNA, 486 bp, Arabidopsis thaliana
atgaacacaaacgatcatggccttctcttcttgaccttaatcttcgtcttttctcttgtttacttcccctacttagtcatatccgacacaccatgtccctacccgtgttatccaacgccgcctattggtggtggctcctccacaccttccatgactcaaccaccaccatatcctcctccaggcgttaactaccctactccagctgggaatttaccaaattaccctcctccggttgggaatatacctaactacccttctccaccgtatggtggcggagacagtagtggcagcagcttctatggccctccaccgccgaatgctattttgccgtacttcccttactactttagaaaacctcctcaccaaacggatcaaacgtcctcgtcttcacacgtggcggttccagggaaatggacggtgaggatcgtagccgtggcaaatcttgtggttgttggagttctcggtaacattctgtttataacttaa

SEQ ID NO: 27 - DNA, 984 bp, Arabidopsis thaliana
atggggaaatacataagaaagagcaaaatcgacggagctggagctggagctggtggtggaggtggaggcggaggtggaggtgaatcctctattgctttaatggatgttgtttcaccttcttcctcttcttcacttggtgttttaactcgagctaaatctctagctcttcaacaacaacaacaacgctgtcttcttcaaaaaccctcttctccttcttcgttaccaccgacttctgcttctcctaatccaccgtcaaagcagaagatgaagaagaagcagcagcagatgaacgattgtggttcgtatcttcagctacggagtcgtcggcttcagaagaaaccaccaattgttgtgattcgttctactaaacggaggaaacagcaacggaggaatgagacatgcggaagaaaccctaaccctaggagtaatttggattcgattcgtggtgatgggtctaggtctgattctgtttctgaaagtgttgtctttggtaaagacaaggatttgatttctgaaatcaataaagatccaacctttggccaaaatttcttcgaccttgaagaagaacacactcaaagcttcaacaggaccacaagggaatccacaccatgcagtttgataagaaggcctgaaatcatgacaaccccgggatcgtctacaaagcttaacatttgtgtaagtgaaagcaaccagagagaagacagtttgtcacgcagccatcgtcgccgaccaactacacctgaaatggacgagtttttctcgggtgctgaagaagaacaacagaagcaattcattgagaagtatgtgtttcctcgtttcatctgttctgttcttttggttatgagtttccagtttgttctgttcttctcttttggtcttgtgtctctaatggtttctgtcaactctttcttcaggtacaactttgatcctgtgaacgaacaaccactaccaggacggtttgaatggacgaaggtagatgattag

SEQ ID NO: 28 - DNA, 186 bp, Arabidopsis thaliana
atgaagaagacttcggtggtcacgcagctttgctccaggacgagacacagtatctcgcgcttgagctgctccgtgaagaagtttagcagaacgtacctttcatggtttctccaatttacgatgtgcccttcatgcttttgttttctgaagatgggaactagcattggtagattttcatttttctga

SEQ ID NO: 29 - DNA, 1248 bp, Arabidopsis thaliana
atgtgttcacgtgaaaccggtgaaggcgcgatcagacaggcgcgggccgataatcgtggttttgaacgcgcgtttacgagaattgcgttagccaattgtattcatcatcatcatcgtcatcatcgttgggaaacccaaaaactccggcgtctgtttaccgctatcatcattcttccgggaagaggaaaaggtttcttcgatcgtcgaagagattctttggacaagtcccctccttcctggttcaatcttcgattcagctctcttttaatttttttggtaacctcctcctctgcatctactgttttcgatttggaaatagattggttttgggaagctgctatgttatttgagaggcttaccaagaaaccaccttcgcttgttgatctttgcgtaaggaaagcgattgataatgtaaagtacattggatatgttggtggggttgattttcagctccttgagcagattctgcaacactgtacactagaacagctgaagcacatagaggatgctactgacgacacagatcttagtccaatcaccgataagttttggaagggattctataagaagcactatggagaagaggacatgaaggatcttatagaggacctggagtggaataaagtaaatgatttcaaatggaggaacttatatgagttgaaggttatagctgtgcaacaaaaggagaaggaacttggtggtcgactgaaagaacgttacaaggacgaaaatgaaagtaatagtgcatcaggttacaatcttgggcatgtgaagagcaacatcatgaagaaggcaaaaatagatctgttgaagagtcaagaagtgaaaaatcttactgcgattaaaaggaacaccattcagaagagtttcaggtatcatctccccagcatctatttagctatatcaacccacattcgttatcccccaaacctgatcggtttgattgatcatgtcttgtctagtatttctactccaaagaaaactggcttatctgcgaattcgccttcaacttcaagaagcattccttatggtggacgaaatcttactgaaactaaaaagaacacgattcagaagagtttcagtatatctgctccaaagaggactggcttatccgctaatgcgccttcaacttcaagaagcgttccttctggtggacaaaagctacctccaaggaggatcaacggccttcctgggactgctccttcaacttcaaaaaatgcagccaccagacaaaaacatgtaatgtaa

SEQ ID NO: 30 - DNA, 420 bp, Arabidopsis thaliana
atggcggcttctccgttggtggttcagaaaacagaggaggagtggcgtgcggttctttctccggagcagtttcgtattcttcgtcaaaaaggcactgaaaagccaggaactggagaatatgacaagtttttcgaggaaggaatcttcgattgcgtaggatgcaagactcctctttataaatcaaccacgaagttcgattccggatgtggctggccagctttctttgaaggactccctggtgccataaaccgaacccctgatccagatgggagaagaactgagatcacttgtgctgcgtgcgatggacatttaggccatgttttcaaaggagaaggttacggtaatccaaccgatgaacgtcattgcgttaacagtgtttcgatcagttttaacccggcaaaatcttcctctataatctga

SEQ ID NO: 31 - DNA, 1230 bp, Arabidopsis thaliana
atggatgcttcattgtctccattcgatcaccaaaaaactcaaaacacagagccaaagaaaagcttcattacctcactaatcactctccgttcaaacaacatcaaagaagacacatacttcgtctcagaactcaaacccacggagcaaaaatcacttcaagaactcaaagaaaagctctcagcttcatcctccaaagcttcttcaatgtggggagtctcactcctcggtggagacgacaaagctgacgtaatcctcctcaagttcctcagagcaagagatttcaaagtagcagactctttgagaatgcttgagaagtgtttggagtggagagaagagttcaaagcagagaaattgacagaagaagatctgggttttaaagatttggaaggtaaagttgcttacatgagaggctacgacaaagaaggacacccagtttgttacaatgcttatggtgtgtttaaagagaaagagatgtatgagagagtgtttggtgatgaagagaagcttaacaagtttctgagatggagagttcaggttttggagagaggtgttaaaatgcttcattttaaacctggtggtgttaattccattattcaagttacagatcttaaagatatgcctaagagagagcttagagttgcttctaatcagatcctctctctttttcaagataattaccctgaattggttgctactaagatattcataaacgtgccttggtacttcagtgtgatctactcaatgttcagcccattcctgactcagagaacaaagagcaagtttgtgatgtccaaagaaggcaatgcagcagaaacactctacaagttcattaggccagaagatattccggtgcaatacggtggtcttagccgtcctactgattcgcaaaacggaccgccaaaaccggcgtctgaattctccatcaagggtggtgagaaagttaacattcagattgaaggcattgagggtggagcaaccataacatgggatatagtagttggaggatgggatttagagtacagtgcagagtttgttccaaacgctgaagagagttacgcgatcgttgtcgagaaaccgaagaagatgaaagctacagatgaagctgtttgcaactctttcactacagtagaagctgggaagctcattctctctgttgacaatactctctctcgcaagaagaaagttgctgcttaccgttacactgtccggaaatctactacaaccgtctaa

SEQ ID NO: 32 - DNA, 204 bp, Arabidopsis thaliana
atggtgataaaaaggatagagctgtgtatagagctaatgaagataggtatggagtttgtagtggtggtggctgaagccgtccagattgttatgcggcaacacctcaaccaccgtgctccacctcctccgcctgtcctccgccagggtcttctcccttataccgcttcttacccttctccattcctatttggatttctcccttga

SEQ ID NO: 33 - DNA, 279 bp, Arabidopsis thaliana
atgttgcaacggtttccagtagaatctaaagggcggcgcaaaaagctgcaagaggttggttacgtgacaaccatatgctttacgtgtttcctcatcagatgtatcatgatgtgctttgctgctttcgatgagggggcaaaccttgatgtgttagatcaccccatccttaacttcatatattacctgttggtagagatattaccctcctctctggtcctcttcatcttgagaaagctaccaccaaaacgaggcattacacaataccatcagattcgctga

SEQ ID NO: 34 - DNA, 576 bp, Arabidopsis thaliana
atggcgactcttcgtttcactctacttcttcttgtcttcgtcgtcgggatcttcttctccttctcctccgtttctcatgtacgtgcaacaagtgaaatcaatctcaggatcgaaccattttcctcgccgttcgcgacggatcttgcaaagctgcaaactcaaattggctacaagtttaacaacatcaaccttcttcgccgtgcaatgactcatgcttctttttctcaagagaacaacaaagccttgagtatctttggaacccatatcattgaaaccgcggtctctcttcagtttctcgctaaagatatcgatatttcctcgaaagcactgggccgtttgatatcagaggtttcaaatgtggagtcctcatgtgctcttgacggagaccggttgggtttggggaagataatcagagtttctactaagacagatgcatcgaactcggccattctttgtactggctttagggcaatctttggagctatagctattgatgctggaacggttgatgaagccatcaaggttttctggaaggtacatggagctcgagctggaagactagtctctatgttgtaa

SEQ ID NO: 35 - DNA, 666 bp, Arabidopsis thaliana
atgtccggcgtcacctcggagcctattgctatggatgccactcggttccagcacactccttactactgcgaagagaatgtgtatctgctctgcaagacgttgtgcgagaatggtgtagcggaggcaacgtgttctgatttgtttgttgtttttatctccaatgagaagaagcaggttccactttggcatcagaaagctagtaccagagctgatggggttgtactgtgggattatcatgtcatctgtgtccagaggaagaaagaaagtgattctgagcctttggtgtgggatcttgattcgactttgcctttcccttcacccttagcctcatatgtgactgaaactatccagccatcttttcagcttttcgcagagtaccagaggttcttccgcattgttcatgctcctctgttctttaagcatttcgcttccgatagaagacacatgaaagaacctgatggaagttggactgctcaacctccaccctatgaacccattgttgcccaagatggaatcttgcacaatttgagcgagtacattgccatgagcggtgcggatacattgtcaagcttggatcccgaaacagtgacagcagcaatttcacagaaacttggtgttgtggtgagccacactcagcttcaggatctcttcaccaagcttccttag

SEQ ID NO: 36 - DNA, 1458 bp, Arabidopsis thaliana
atgggaggttgcgtgtcgacgccgaagagctgtgttggagcaaaactgaggtcaagtaaacgaaggaagagtcgtagacgacgaaaaattcaaaggaagagagccgccgtctcttctcgtctctctgacggatctttcgacaatctcgatcatcatcatcgcaacttctctaatcccagttctcgagcaactggcgaagacgcatggtttgagtccaatgtcgcatttgaaacagactgtgatgatgatttccacagtgttcatgaagatgcattgtctttaaacggatctgagcgtgtatcactctcgagtacgacaaccacatcatcaacacgagacactgattcaaatgaagtgatgtctcaatcgaaatcagacggtgacttaaacgacacaaaccagcctgatttgattgattcatctgcagatgaaggtctcttggaaaactgcaggatcttaccgagtaattgtttgccttgtctgaatacaacaactgttccttctattgacaagagaaggtctcttagctctagccctcccagttccaggaaaaaatcatctcttagactttcttataaatggagagaaggtcatgcttcaggagccttgtttttgtcgaaaatgcagctgaagagaccgatagcgggttctcaggttcctttctgtccaattgataagaaaatgctcgattgttggtcaaccattgatccaaatagttttcgggttcgtggcaaaacatatctcagggagaagaagaaagagtttgcacctagccatgctgcgtacaatccttttggtgtcgatgttttcctatcggaacacaaaatacaccatgttgcacaatatgtcaaacttcctgttactaccacatccacaaaactcccatctatccttgttgtaaatgttcagattccgttatatccaactgcaatctttcaaggtgaatctgatggagaaggaatgaatattgtattatacttcaaactctcggataattattcaaaggaacttccgctccattttcaagaaagcattcggagattaatagatgatgaggttgagaaagttaaaggcttccctttggatacaacggcaccttttagagagcggcttaagatattgggacgtgttgcaaacgtggatgatctccatttgagtggtccggagaaaaaactgatgcaggcttataacgagaaacctgtactttcacgtccgcagcacgaattctacttgggtgacaattactttgagattgatatcgatatgcatagattcggttatatatcgcggaaagggtttgaaacattcatagacagactcaagatctgtgttcttgatgttggcctcacaattcaggggaacaaaccagaggagctaccggagcagattctgtgttgcgtcaggctaaatgggattgatttcatgaactatcatcaattaactcaagaactcctatga

SEQ ID NO: 37 - DNA, 201 bp, Arabidopsis thaliana
atggtgaggatcgtgagaagttgtttacagtccatgttaaagctcgtgaattctctaattgggatggttgggattgctatgattctctacgctgtttggctgattaggcaatggcaagaacaaatgggaaatcttccttttgctgattctgatcaccctgttccgtggtatgttgaaagtttcatctttttgtgtgtttga

SEQ ID NO: 38 - DNA, 348 bp, Arabidopsis thaliana
atgacttcgaaaacatgcctcgtcttcttcttctcttctctaatcttaacaaacttcgccttagcgcaagaccgagctcctcacgggttggcttatgagaccccagtggcattttcaccttctgcatttgacttctttcacacacaaccagaaaacccggatcccactttcaacccttgctcggaatccggctgctcacctcttcccgttgctgcaaaggtccaaggagcttctgcgaaagcacaggaaagcgatatagtatcaatttcaactggtacaagaagcggaatagaagaacatggtgtggttggaatcatctttggacttgcgtttgcggtgatgatgtga

SEQ ID NO: 39 - DNA, 666 bp, Arabidopsis thaliana
atggttggttcgtcgtttggaatcggcatggcggcgtacgttagagatcatcgcggtgtttcggcgcaggataaggctgttcaaacggctctgttcttggctgatgaatcaggacgtggtggatcacagatcgggattggattaaggatgagtaataataataataagtcgccggaggaatcttcggatagttcgtcgtctatcggagaaagcagtgaaaacgaggaggaagaagaagaagacgacgccgtttcgtgccaacgaggaacacttgattcgtttagttcttctcttgaagactctcttcctattaagagaggattatcgaatcattatgtcgggaaatcgaaatcgtttggtaatttaatggaagcagcgagtaaggcgaaggatttggagaaagttgagaatccatttaacaagaggaggagattggttattgctaataagttaaggaggagaggaagatctataacctatgaagaggatcatcacattcacaatgatgattatgaggatgatgatggtgatggtgatgatcataggaagattatgatgatgatgaaaaataaaaaagagttgatggctcagactcgaagttgtttctgtctaagtagtttgcaagaggaagatgatggtgatggtgatgatgatgaagatgaatga

SEQ ID NO: 40 - DNA, 1803 bp, Arabidopsis thaliana
atgcacatagtaaaagtcgaagatgatttccatgaaatgcaagagcttaaagttcgagcagaagctgctgatgtcgctaaatcgcagtttcttgctaccgtgtctcacgagatcaggacaccaatgaatggcattctcggaatgcttgctatgctcctagatacagaactaagctcgacacagagagattacgctcaaaccgctcaagtatgtggtaaagctttgattgcattgataaatgaggttcttgatcgcgccaagattgaagctggaaagctggagttggaatcagtaccatttgatatccgttcaatattggatgatgtcctttctctattctctgaggagtcaaggaacaaaagcattgagctcgcggttttcgtttcagacaaagtaccagagatagtcaaaggagattcagggagatttagacagataatcataaaccttgttggaaattcggttaaattcacagagaaaggacatatctttgttaaagtccatcttgcggaacaatcaaaagatgaatctgaaccgaaaaatgcattgaatggtggagtcaatgttaggcttatggtttcaatcgaagacacgggtattggaatccctttagttgcgcaaggccgtgtgtttatgccgtttatgcaagcagatagctcgacttcaagaaactatggaggtactggtattggtttgagtataagcaagtgtcttgttgaacttatgcgtggtcagataaatttcataagccggcctcatattggaagcacgttctggttcacggctgttttagagaaatgcgataaatgcagtgcgattaaccatatgaagaaacctaatgtggaacacttgccttctacttttaaaggaatgaaagctatagttgttgatgctaagcctgttagagctgctgtgactagataccatatgaaaagactcggaatcaatgttgatgtcgtgacaagtctcaaaaccgctgttgttgcagctgctgcgtttgaaagaaacggttctcctctcccaacaaaaccgcaacttgatatgatcttagtagagaaagattcatggatttcaactgaagataatgactcagagattcgtttattgaattcaagaaccaacggaaacgttcatcacaagtctccgaaactagctctattcgcaacaaacatcacaaattcggagttcgacagagctaaatccgcaggatttgcagatacggtaataatgaaaccgttaagagcaagcatgattggggcgtgtctgcaacaagttctcgagctgagaaaaacaagacaacaacatccagaaggatcatcacccgcaactctcaagagcttgcttacagggaagaagattcttgtggttgatgataatatagttaacaggagagtagctgcaggagctctcaagaaatttggagcagaagtggtttgtgcagagagtggtcaagttgctttgggtttgcttcagattccacacactttcgatgcttgcttcatggatattcaaatgccacagatggacggaatgatggagaaggaaactaaagagaagacaaatctcgaatggcatttaccgattctagcgatgactgcggatgtgatacacgcgacctacgaggaatgtctgaaaagtgggatggatggttacgtctccaaaccttttgaagaagagaatctctataaatccgttgccaaatcattcaaacctaatcctatctcaccttcccggaagagtggaccgattctgctgattgatatgcattttggtttctgtacatacagtaggttcacaatctag

SEQ ID NO: 41 - DNA, 1629 bp, Arabidopsis thaliana
atggcgtatatgtgcaccgacagcggaaacttaatggctatagcacaacaactcatcaaacagaagcagcaacaacaatcacaacatcaacaacaagaagaacaagaacaagaacccaacccctggcccaatccatccttcgggtttactcttcccggttcgggtttctccgacccgtttcaagtaaccaacgacccaggttttcactttccacacctggagcatcatcaaaacgcagccgtcgcttccgaggagtttgactccgacgagtggatggagagtttgatcaacggtggagatgcgtcacaaaccaatccagacttcccaatctacggccatgatccattcgtctcattcccgagtcgactcagtgctccttcatatctcaaccgagtcaacaaagatgactcagcgagtcaacaactccctccgccaccagcttccaccgctatatggtctccatctccgccatcaccacaacatcctcctcctcccccgccgcagccggattttgatctaaaccagccgatttttaaagctatccacgattatgcacgtaaaccggaaactaaaccggacacactaattcggatcaaagaatccgtgtccgaatcaggcgacccgatacaacgagtcgggtattacttcgcagaagctctgtctcataaagaaacagagtctccgtcgtcatcgtcgtcgtcatccctagaagatttcattctctcatacaaaaccttaaacgacgcatgtccatattcaaagttcgctcatttaacagcgaatcaagcaattctcgaagctacgaatcaatcaaacaacattcacatagtcgatttcgggatttttcaaggtattcaatggtctgctctgttacaagctttagcgacccgttcttctggtaaacccacccggatccggatttcgggtatacccgctccgtctctaggagactcaccgggaccgtctctgatcgctacgggaaaccgtctccgtgatttcgcggcgattttggatctcaatttcgagttttatccggttctgactccgattcaattactaaacgggtcaagttttcgggttgacccggatgaggttttggttgtgaattttatgcttgagctttataagcttctagatgaaacagcgacgactgttggtacggcgctccggttagctagatcgttaaacccgaggattgtgacgcttggagaatacgaagtcagtttaaaccgggttgaatttgctaaccgggttaagaactctctccggttttattccgcggtttttgaatcgcttgaaccgaatttggatcgagattcgaaagaaaggctgagagtggagagagtgttgttcggtaggaggattatggatttggtccgatcagatgatgataataataaaccgggaacccggtttgggttaatggaggagaaagaacaatggagagtgttgatggagaaagctggatttgagccggttaaaccgagtaattacgcggttagccaagcgaagctgctactatggaactacaattatagtacattgtattcacttgttgaatcggagccaggtttcatctccttggcttggaacaatgtgcctctcctcaccgtttcctcttggcgttga

SEQ ID NO: 42 - DNA, 957 bp, Arabidopsis thaliana
atgctctcttttttctctaaccagatcgaccggcaaaaagatgtgtctaatgaggaaaaaaccctaaccaatctcgaaaaatctgacggttcacaattccctggcgatgactaccgtccgtccgatcggaaaaactggatggctggtcttacgttggagaaactaactctaaacaagatcgtgtggccaggaacgcatgattcagccaccaacgatatcggaatacctctgatctctcgtcctttagctgaatgccaatcgctctctatctacgagcagctcgtcctcgggacacgtgtcctcgatatccgtgtgcaagaggatcgccaaatctgccacgggattctgacgtcatacgaaattgatgttgtcattgatgacgttatcagattcttgtcggagactcactcggagattgtaatcctggagataaggactgagtttggacacaaagatcctccggggttcgagacttacttggcagacaagttaggtcaattcttgatacatcaagatgatagcttgttcaacaagccggtatcagagattttgccgaaaagggttatatgcatctggaaacctagagagtctccaaagccgagccgtggtggaattctctggaactcagattatctaaaagataattggatcgatacggatcttccatggacgaaatttcagagcaatttgaagcatctgagtgagcagcagccgacatcttctagaaaattcttttaccgggttgagaacacggtcacgccgcaagcagataatccggttgtgtgggttaaaccggtgactgatcggatccgaaaacacgccagactatttatttctcagtgtgtttccaagggatgtggagataagttgcagattttgtccactgatttcatcgaaggagatttcgttgatgcctgtgtcggccttactcacgcaagaatcgaaggaaaggtttga

SEQ ID NO: 43 - DNA, 7642 bp, Arabidopsis thaliana
tgaaggctacgttactcgctctcagggttcgtaaccctgacctcgcactcaccattctccaaaccatcgtctccaacgctggaagattcgataatgtcctctggtcacgctcttgtccttccccgtctcttctctcgttcctctccacgattgagcttctgagattcgaaaatcctacttctccttggggatttgattcagaaactctaagtttgcgtgccgatttcttgttgatggttcaggttttgatcgatagagttacagagaggattaaggaagatgaggagagtgaggatgaaaattctggattagggaattgtttaagggtgttgcaaggtgttttggagttaggtgttgagaggttgaagtttgttgttgatactagtagtagtgaaggaagtaataagattgaggaagatgcagttgtgtctttgaggagtatagtattggattactctgatgttttcgatgctttatgttgtaatattcagaggcaacttgcgggttgcgagagttacggtacatgtttggttgaggaagttcagggagaagaacagagaaaggagatgaatgaggccacatgtattggttctccggagctggataacatcaatgtgtttgctttgatacagaggaatgttcagttagcacagttggatgctatgaaaacaaagttggatgaaggtgatgagcgcggggcagctgatcgcattcgttatcttcaccttgattatggagtagagaaagagaactatcatgctgttctaaaagctctcctttcaagagttatggagaaaaaggatgaatatggtgattcctggcacatggtgcgccagaacttgctgtttatgtataaagaagctctctcatcgaattgtggagatcttgttcagatgatccagggtattcaagatgatatgctcctcccacatagccaactacatttatctctcgacaatgaacaaattccactccctcttgaatgtttccggcgatatcttgtagacttgaaaactgagagaaatatagaggacaaaagttctcctatgagcagggcaattaattcttgtctcagagatatgtatcattatgctcgtatttctggatcacatgttcttgagtgtgtgatgtgtgctgctttgtcttctgtaaagaaagagaagcttcaggaggctaatgatgttcttactttgtttccccgacttcgccctttagtagcctccatgggttgggatctattgccgggcaaaactgcaacccgtagaaaattgatgcggctactttggactagtgactcgcaagcacttcggctagaagaatcttctctttatggaaaccagacagatgaactggaacttgcatctttcgctgcttgtgtcaattctggtaaatcatggactccaaaggcatctttcttgatgcatggtaatgtgtcatccgcgcatgatgatgcggaggtggatccttttgttgaaaatcttgtattggaaaggctttcagcgcaaagtccacttcgggtattgtttgacgttgttccgggcataaaattccaagatgctatttcactgattagtatgcaacctattgcttcaactgcagaagcctggaagaggatagaagatattgaactgatgcatatgcgttatgctctggaggcaatcgttttagcactaggtgcaatggaagaggctatgaaggatgagacagatgctagtcatcgagtagtattttaccatttaaaagacctcactaaccatttggaggccattaaaaatgttccacgcaagataatgatggtgaacatagttatttcactcttacatattgatgatatccgtctcagttctacgcaaagtgcctcctcggcatgtttttctgaaaaaagtaacacacctggtttggatcctggcgatcttggtacagaaggggaaaaggaaattgttatttctttcacaaaacagctactcgatgttttacgccgcaatcttccatcacatccaattgaacaagagtgtcagctggatggtaattacagtactgatggaagacaggctttagaatggagagtatccatggctaagcgtttcattgaagattgtgaatggcgattatctgttatgcagcatcttctgccactttctgaacgccagtggggtttaaaggaggttttgagtattctaagggcagcccctgaaaaactgcttaatctctgtatgcaaagagctaagtatgacattggagaagaggcagttaatcggtttgcgttatcagcagaggacaaagctactcttgaattagctgaatgggttgataatgcgttcaaaggaacactggtagaagatgtaatgtctcgtactgctgaaggagcagctgccgtgcaagatttagattttcattctttaggttctcaattgagtccattggctatggttttactttttgcgcagtctcaagttatgttatcggaaatttaccctggaggagctccgaaggtggggtttacttactgggatcaggtccacgaagttgcaataatttctgtattgcgaaggatcttaaagcgtctgcaggaattccttgaacaggatgaccctcaaattcttcaagccagttttagtggagataccataatttcatcttgcacggaatctcatagacagggacaaaaagatcgtgctcttgcaatgctacatcaaatgattgaggatgctcataggggcaagcgtcagttcctgagtggtaagcttcataacttagcgagagcactcgctgatgaaaaaccagaagttgacgtactcaaaggggacggatcagacatggccgttgagaaggatggagttcttggtcttgggctaaaatatacaaagcaaagtcctggttcagcaaatagagccgtggatggaaatcctgtttcacatgaaacagaagacaagggaaagaagtcatttggcccattaagcaacaaaacctctacttatctatctcagtttatcctctatactgctgctattggtgatatagtagatggaactgacacaacccatgatttcaactttttctctcttgtttatgaatggcctaaagacctattgacgcgtctggtttttgatcgaagtagcacagatgcagctgcaaaagttgctgaggttatgtctgctgattttgttcatgaagtgatatcagcatgtgttcccccagtttatcccccacgttctggtcatgggtgggcttgtattcccgtcattccaaccactccatgttcccactcagagggtaaagtgctctctccttcaatagaggctaaacccaactgttatgtccgttcctcagcaacacctggtgtccctctgtatcctcttcagttggatgttatcaggcatttggtaaaaatttcaccagtacgagcagttttagcttgcgtctttggtgggagcatattgtacaatggcagtgattctatcatatctagctccttgaacgatgagtttccaagttctcctgatgcagacagattgttttatgaattttctcttgatcagtctgagaggtatcccactttaaaccgatggatacagatgcagactaatctgcatcgagtttcggaatttgttgtgacaccgaagcaaaaacctgatgacacacggattaagcctgatgaaagaactgggatcaagagacttcttgaacatgatagtgactcagagtcagatacagaagaaacattttctaaaaataacattcaaccagcattgacagacggcagtgctcgtgatggtggatcctttgaaaatggagtttgtagaactgatcctaccgttttcctttcttttgattgggagaatgaagtaccgtatgagaaagctgtaaatagactaattgatgaaggaaaactaatggatgctttagcactttcggaccgcttcttgcggaatggggcttctgattggttacttcagctcctaatcaaaagtagagaagaaaatccttcaacatcaggacgatctcagggatatggaggccagagcaacagttggcagtattgcctgcggctaaaggacaaacagctggcagcaacactggctcttaagtgttgcataggagacaagctctgcagaagtacagccacatactttcggcagatgatcgccataatagctggcaagaggttatctttcttccttttgtttgagatcatgtttggctcttggtatgctcgatgtgtcactctcaaaaatctaaatgggaaacaggtagaagccgaatgtaaagaagaccctgaaggcttggctctaagattggctgggaaaggagctgtttccgctgcgctagaagtggctgaaagtgcaggattatcaatagatcttagaagagaattacaaggacggcagcttgtaaagcttctaaccactgatccactcaatggtggtggtccggcggaagcatctcggtttttatcttcacttcaagactcggctgatgctctaccagtggttatgggtgcaatgcaattattacctgaccttcggtcgaaacagctcctgatactcaaagagttcccagcattaagagataacaatgttatcatggcctatgcagcaaaagctatttctgtgacaattatcccaccaccaagagaacctcgaataactgtgtctgcgtcaaggttaagacagaaatcaagagcagggccagcagtaaaagcatccttcactagtagcttaagcaattttcagagagaggctcgaagggcattctcatgggctccacgtaatgctgaaaaccggacgacgtcaaaggatgtttatcgcaaaagaaagaattccggactgggggcttctgagagagctgcatgggaggcgatgacaggtattcaagaggaccagggatcatcttattcggcagatgggcaagataggctaccttctgtttctattgctgaagaatggatgctaactggcgacaaaaccaaagatgaaggtgttcgtgcatctcacaagtatgaaagcacccccgatattattctctttaaggctctactatcactttgttcagatgagctagtatcagcaagaagtgccatggacctatgcatcagtcaaatgaaaaacgtattgagctccaaacagttgtcagagggtgcgtctgttgaaacaattggccgagcatatcatgcaacggaggcatttgtgcagggtttgtcgtatgcaaaatcattgctgagaaagcttctaggtaccactgaatcgaccaataacaatggtgaaagaagtagagatgttgatgatatatcttctgatgctggcagctccagtgttggcagtcagtcaacggatgaaccatcggatgttctctcacttacagaaatctggttggggcgcgcagagttgctgcagagcctcttagggtctggaatttctacttctcttgatgacattgctgatcaattgtcatccgaatgtctacgagacagattaatatctgatgaacgatatagtatggcggtgtatatgtgcaagaaatgcaagattgatgttttccccgtgtggaaagcatggggtcttgctttgttacggatggagcgctatgctcaagctcgagtcaaattcaagcaagcctttcaattaaagggggaagacattcctgatgtcattcaggagataataaatacaatagaaggaggtccgcctgtggatgtgtcaattgtacgttccatgtatgaccatttggcgaaaagcgcacctacaattttggacgattctttatcagcagactcatacctaaatgttctgcatatgccatccactttccctcgttcagagaggtcgcggagatctctggaatcggaaaagaatagttctgtacctggttcagactttgaagatgggccccgaagcaacttggatactacacgctattctgagtgcaccaactacttgcaggaacatgctcgccaaaacctgcttgggtttatgttccgccatggtcactttaaagatgcatgcatgttattctttccgcaaagtggtcttccccctcctttgcaaacttcatctgtgggcgcagtaagcacatcttcatcacctcaacgaactgatcccttggcaactgaatatgggaccattgaaagtttgtgcgagttctgtgttggttatggagctatctcatcccttgaggaagtaattacagaaagacttgaatccgcaaagaatcaagatcaagccataaatcagtacatagctggagctcttactcgtatctgtgctttctttgagatcaaccggcatttcaattacctatacaagtttctggtactcaagaaggattatgtcacctctgggtattgttgtattcagctttttatgaattctacaactcaggaggatgctgtaaggcatcttgagcatgcaaagaaatactggtctctaactatcctcggggtacaggcacactttgaagaagcattgacagcgcgtcatagaggttcagactcaaaaaaacttgttacaaagggtgttagaggaaaaagtgccgcagagaagctgagtgaagaaactcttgttaagttgtcctcacgggtgaaaatgcagattgatgtggtgaagtccttcagtgactctgaaggagcaccatggaagcattccttgtttggaaatccaaatgattcagagacatccaggagaagatgtgaaatagtggagactcttgttgagaaaaatttcgacttagcttattctgttatatatgaattcaagctctcagctgttgatatatatgctggtgttgctacgtcactagctgataggaagaaaggcagtcagttgacagaacttttcaaaaacattaagggaacaatccaggatgatgactgggatcaggtactgaacattgctgatacagggaaagctcgttcggtatggcttatattctgtgaaatgctgcaggtcctgggtgctgccatcaatatatatgccaacaagcacaaagagcgccctgaccgtctcatcgacatgttaacaagcagccatcgaaaggtgctggcttgtgtggtatgtggccgcctgaaaagcgcattccagattgcatctaaaagcggaagcgtggctgatgttcaatatgtagctcatcaagccttacatgccaattcgcacacagtactcgatatgtgcaagcaatggctagctaaatacatgtaaagccctgtaatctacacgataatagaagccaacataaaaactcgaggtatacatcttttatttttggcagattagcgattgttcttgcctcgtatttgttcctggctaaatttttcttgcaaaaaaaaaggaaaaacacactgccttgtgaggtttttgcttgaaactttgggagcagattgtttaaaagaacatggagggaaatggttcagtctctcataggaagatcattaactgatgattcgcacatgtgagattatgggttttgtgtgttgtaacacatgtctacttgtaaaaatttatatggttggtatatttactattgaatgtatgaggttgataacttgcggcttttttgcagttgagtttcatagttaatcctatattgttgttaaaactatattggaatttgacacatatgtaagtgttgtataaaaattcttactttt

SEQ ID NO: 44 - DNA, 1179 bp, Arabidopsis thaliana
atgatctacctctctagacgctcactctcttctcttctccgatccggtttcaatctccgcggcgatcttacagcagcagctgtctcttgttcctctctcttctccgacgcggacggtgggattaagaagttacactcgcgagctgggaatgcagtgttatggagaaatagtcagctatgtagttctcaaggaagcttttttggacgaggaggacaagtctcaggttctgtgtttcgatgtttctgcagtggtagtgatacttctcctcctagcttggatcggaagtttttggctcagctatgggttgcagataagaaaaagctaaaggctatggaaaagcgatataagaaagcttctaagcataggaactacactgaaaatgatggatttgatgtccattttgaaactgttgagcctacagtggagcaaccaccggttagccagtctatgtctggtcttctgaagcctaaaacttctgatgaggccaaaattgcaactctgcttgcacgatcgaatttgctggttacaagagatattgaatgggcaaatctggttcttggttttgaacaggaaaatcgctatattgtagtagatgtttgctatcctgaggcacctgtggggtctatccgagaacaaagcaatttactggcgcggcagctgcttcgtacccggcgcccatttgttgcttccataactgatgctttgggtaatgagcttttccgggttcgtcgacctttctggtggctcacaagttcaatatatgctgaaattgatggagaggaaattggtgttgttcatcgacgatggcatctatggagaagaatttatgatttatacctggggaacaaccagtttgcagtggtagaaaatcctgggttttggaattggacatttacagtgaaggatgctgatggggaagtcttagcccaaatagatcgtgattggagaggttttggctttgagatattcacagatgctgggcagtacgtgatccgatttggaaaagctgatgctgcagccaagaccggccctgcgacactggtagaagagttagaagtgaaacggccattgactttgtcagaaagagctgttgtccttacgcttgcgatttcactagataatgattacttttcaagacatggtggctggggaatcccattcatggcggtgggtgagtag

SEQ ID NO: 45 - DNA, 909 bp, Arabidopsis thaliana
atgggaacgttcttaggacactttgtgcctggtctctcacttgctcttcttggtctttggcatctcttcaacaccataagatcttactgtcttaaaggccctgaagctttctctgcaaaattctggttccctttccctaaactcaaacatcttgagcttatcttgattctcttcttctccttcctctccatcactctcctcaccctagatttccctaatttcaacttctcctctctcaaaccagacaacctagaacatgcttccatgttcctccacctcattatctttgcgtgtttcgctctcttctgcgagctaaccctttgctcagatctcttctccggtctaatcggagttctttctgcctctgtcttcgctcaagaactcttccttcttcattttcattccactgatcattcaggtcttgaaggtcactaccatttccttctccaactcattgctttcgtctccttctcctcggcgctagcttctgcttcgttccctaaatccttctctgcggctctattcctcccgatatcggttatgtttcaaggatgctggttcttgaacatggggttcatgctttggatcccagagtatgttcctagaggttgcgtgagtaacatgtcaacatctacagacaataatagaaggagtgtttatcatagtggtgcggtggcttgtgagtcccctggtgctgagattagggcaaaagcattggcgaatctgcagtttagttggatgttgtctgctatacttatcattacatgtgccttgtgcctcaagtattccggtaaagttgtgttgcctaagattaggtcatcgttggagtacgagcgtctttgccggcaaggaagtgatcgttctgcaaccgtaacggtggaagcaccggccagttccgatcaacaatag

SEQ ID NO: 46 - DNA, 1044 bp, Arabidopsis thaliana
atgtctagacaagtggcaaggcttatcggatctctgtcatcaaaagctcgccgttgttctaccggcggctcagaggtttttccgtcatgccagtctctcacttcgttgacccaatctcgctccttcgcgtcggatcctcatcctcctgcggcggttttcgttgacaaaaacacacgagtcctctgtcaaggcatcaccggaaagaacggcactttccacactgaacaagccattgagtacggcaccaaaatggtggcaggagtgacaccgaagaagggtggaacagaacacttgggtctcccagttttcaactctgttgctgaagctaaggctgacaccaaagccaatgcctctgtgatttatgttcctgctccttttgctgctgctgctattatggagggtattgaggctgagttagatcttattgtgtgtatcaccgaaggaatccctcaacatgacatggtacgtgtaaagcatgctcttaacagtcaatcgaaaactaggctgattggtccaaactgccctgggattatcaagcctggtgaatgcaaaattggaattatgccgggatacatccacaagcctgggaagattggaattgtctcacgatctggaaccttgacatatgaagctgttttccaaacaactgcagtgggtctaggccaatctacttgtgtaggaatcggtggggatccttttaacgggacaaactttgtcgactgcttggagaaattctttgttgatcctcaaacagaaggtatcgttctcattggagaaatcggaggcactgcagaagaagatgctgcagcattgataaaggcaagtggtactgagaagcctgttgttgcttttattgctggacttactgcaccaccgggtcgtcgaatgggtcatgccggagccattgtttccggtggtaaaggtacggctcaggacaaaattaagagtttgaatgatgctggagtgaaggttgttgaatctccggctaagattggatcagcgatgtatgagctctttcaagaaagaggtcttttgaagcagtga

SEQ ID NO: 47 - DNA, 1899 bp, Arabidopsis thaliana
atgaatccaactccaactccaagctccgccggcaacagtgtctgcacagatgaattgaccaaccttcccccggaggactcgccactcgacagcgagaaggatgatagcgttgacttcagccaggagcaaggatcggagtcaaatgaagctattgacactgagaatggttcaagatccgtagacaagaaccaatactctgaaactgaagttgtagttagagcaaaagatttacagacagaacctgattcactggatgatgatgtggagattgtgatcaaaaaccaacataagtattacatatactgcccttgctgtggtgaagatatcaccaaaacagtcaagctcgtgaagatatcagatcccaaacacacaaaagaccatgacaaagctgttgacagtgacactgagaatggttcaaaatccaaagacaagaacacaaaggttccatcatggttctctgattttattcagccgctgttttcttctgaagacagaggtaccctttcttcctcttctttcgatattgttagatggacagttgtgattgagcttgatttcttggcaattccaggaaagaaaggggttgttgattcagagttactaggaacttacgaagatctcggtatcattggtgaggaaccgagcatagatgtcagtaacgagaaagacagaccgagttttccaaagtggtacctcgatgtttttgcttggttattcctctgtattattattgctctttctgtcctttcgacttctccaccgcctttcattcaaccacatctgcaattaccatctatgcctacattgaggatgccttctgcttctgtacttttgttacttcccacatctgcggtgttgcttctcttcattatttcaatgaggtcccgtttcactccgagatatcacaaggagaaaggcgaggtcgttcccaagtctactgattccaagtctcacgatgaccaagctgcaaatactgatcaagattttgacaagaaaacagacaacaaaagaaatcgcctaactcctatatacccttcatcactagagaaaccttccaagcaaactgtcaataaggaaactcaaaatcacgataaagaagctgcagatcctgaccaagatgtagacaaggaaacagagaaccaaaaaagtcacctaactccgatatatccttcaccactggagcaaccttccaagcaaattatcaataaggaaactcaaacagaacctatgttgccacctaatgctcaatcagagatcccaaatagtgttgaaccacgcaaaggcggtaataaagtagaaattctgaaaagtattgtgtatggaggtcttacagaatccatcacaagcctatgcacggtaacatctgcggcagcttctggtgcttcaactctgaacgttttagccttgggagttgccaatttgtcaagcggtcttcttctgactgttcacagcctccaagaactaataaacgagaaacccagaaaacaaaccaacactgatgattctccagaagaaggagaaggagaagaagatcgatacgaggaagtactcgggagaagagagtattcgaggattcacagagtgatcgcaatctcttctttcgtcatcttcggattgatcccacctttagtatacggtttctcgtttcgaaaaaagatggaaaagagacaagagtacaaggttttagctgtttacgcagtgtctctactctgcatcgtcttgctctcaatagcgaaagcttacgtgtcgaagaaacgcgattatgtcaagactctgtttcggtacacgacgacggcgacgacggcgtcgggattctctcaatttgtgggatacttggtgagtcaatggcttgagaaaagcgggttttatgatgattctccagaaactcaacgagtttga

SEQ ID NO: 48 - DNA, 2979 bp, Arabidopsis thaliana
atggcagacaagatcttcactttcttcctaatcttgtcttcgatctctcctctcttatgctcttctttgatctcacctcttaatctctcacttattagacaagcaaatgtccttatctctctaaagcaaagttttgattcctatgatccttctcttgattcatggaacattccaaatttcaactctctatgttcttggactggtgtttcttgtgacaacttgaatcagtctattactcgtctagacctatctaatctcaacatctccggcactatctctccggaaatatctcgtctttcgccgtcacttgtttttcttgacatttcttctaacagtttctccggtgagcttcctaaagagatctatgagctctcaggcctcgaagtgttaaacatctctagcaatgtttttgaaggagagctggagacacgtgggttcagtcaaatgactcagcttgtgactcttgacgcttacgacaacagcttcaacggatcacttcctctgagtctaaccacactcactcgtctcgagcacttagatcttggaggaaactacttcgacggtgagatccctagaagctatggaagtttcttgagtctcaagtttctttctttatctggtaatgatctccgtgggagaatccctaacgagctagcgaacatcacgactttggtacagctttacttaggttactacaacgattaccgcggtgggatacctgcagatttcgggagattgatcaatcttgttcatttggatttagctaattgcagcttgaaaggatcaattcctgcagaattggggaatctcaagaacttggaggttctgtttcttcagaccaatgagcttacaggctctgttcctcgagagttagggaacatgacaagcctcaagactcttgatctctccaacaactttcttgaaggagagattcctctagagctatctggacttcaaaagcttcagttgtttaacctcttcttcaacagactacacggcgagatccctgagttcgtatctgagcttcctgatctgcaaatactcaagctttggcacaacaatttcaccggaaagattccttcgaaactcggatcaaacgggaacttgatcgagatcgatttgtctaccaataaactcacaggtttgatccctgagtcactctgtttcggaagaagactaaagattctcattctcttcaacaacttcttgttcggtcctctccctgaagatcttggccaatgtgaaccgctatggagattccgtctcggacagaactttctgacaagtaagttgccaaagggtttgatttatttgccgaatctttcgcttcttgagcttcaaaacaactttttgactggagaaatccccgaagaagaggcgggaaatgcgcagttttcgagccttactcagatcaatctgtccaacaacaggttatccggaccgattcctggttcaatcagaaacctcagaagccttcagattcttcttctcggtgcaaaccggttatcgggacagatccctggcgaaatcggaagtttgaagagtcttctcaagattgacatgagcagaaacaacttctcaggcaagtttcctcctgagtttggtgattgcatgtcactcacatatttagatttgagtcacaaccagatttccggtcagattccggttcagatatcgcagattcggattctaaactatctgaatgtttcttggaattcctttaaccaaagccttcccaacgaactcggatacatgaagagtttaacatcagcagatttctcacacaacaacttctccggttcagtaccaacttcagggcaattctcttacttcaacaacacgtcattccttggaaacccttttctctgtggattttcttcaaacccttgcaacggttcccaaaaccaatctcaatctcagctacttaaccagaacaacgcaagatcccgaggtgaaatctccgcaaaattcaagttgttcttcgggttaggcctactagggtttttcttggtgttcgtcgttttagctgtggtcaagaataggagaatgagaaagaacaacccgaatttatggaagcttatagggtttcagaagctcggtttcagaagcgaacacatattagaatgtgttaaagagaaccatgtgattgggaaaggcggacgagggattgtctacaaaggggtaatgccaaacggagaagaagttgcagtcaagaagctcttaaccataaccaaaggatcatctcatgacaacggtttagccgcagagattcagacattaggtagaatcagacacagaaacatagtgagattgctcgctttttgttcaaacaaagacgtgaatctccttgtttacgagtatatgcctaatggtagcctcggagaagtcttgcacgggaaagctggagtgtttttgaaatgggaaacacggttgcaaatagcgttggaagcggctaaggggttgtgttatcttcaccatgattgctcgccacttataatccaccgtgatgtgaagtcaaacaacatcttgttgggtcctgagtttgaagctcatgttgctgattttgggcttgctaagtttatgatgcaagacaatggagcttccgagtgcatgtcctcgatcgctggctcgtacggctacatcgctccagaatatgcatatacactgagaatagacgagaagagcgatgtgtacagcttcggagtagtgttattggagctgattacgggtcgaaaaccagtagataattttggggaagaagggatagacattgtgcaatggtcaaagatccaaacaaactgtaacagacaaggtgtggtgaagatcattgaccagagattgagcaatattccattagcagaggccatggaactgttctttgtggcaatgctatgtgtgcaagaacatagtgttgagagaccgaccatgagagaggttgtccagatgatctctcaggctaaacagcctaatactttctaa

SEQ ID NO: 49 - DNA, 2943 bp, Arabidopsis thaliana
atggattattgttctttgttggttgtctcgttcttgatcactgttatgaccgttcttgcttctaaagagaacgatcatgagctaataaaaaatcctcaaaactctctaagcagttggatttcttcttcttcttcttcgtcttctatgctcgttgatgtttgtaattggtctggtgtgaagtgtaacaaagagagcactcaagtaatcgagcttgatatcagtggtagagatctcggcggcgaaatctcaccgtcgatcgctaatctaaccggtttaacggttcttgatctttcgagaaacttcttcgttggaaaaatcccacctgagataggttcattgcatgaaacattgaagcagctaagtctctctgagaatcttttacatggaaacattccacaagagcttggtttgcttaaccgtcttgtttatctcgatcttggaagcaaccggttaaacggttcaatcccggttcagctcttttgcaacggctcttcttcatctctacaatacatagacctttccaacaactctttaaccggagagatccctttaaattaccattgtcacctcaaagaacttcggtttcttcttctctggtccaacaagctcaccggtactgtcccgtcttctctctcaaactctacgaatctcaagtggatggatttggagtcaaatatgttaagtggagagttaccttctcaagtcataagcaagatgccacaacttcagtttctttacctttcttataaccatttcgttagccacaacaataacacaaacctcgaaccttttttcgcctctctcgccaattcctctgacctacaagagcttgagttagccggaaacagcctcggaggagagattacttcttccgtaaggcacctctctgtaaatcttgtgcagattcatcttgatcaaaaccgtatccatggctctatacctccagagatatcaaaccttttgaacctaactcttctaaacttgtcgagtaacctcttgtccggtcctatcccgcgtgagctctgtaagctaagcaagctcgaaagggtttatctctcgaataatcacctaaccggcgaaatccctatggaactcggggatattcctcgccttggtcttcttgatgtttctagaaacaatctttctggttcaatccctgatagtttcggaaacctttctcagctgagaagacttcttctgtacggaaaccatctctctggtactgtccctcaaagcctcggcaaatgtatcaatcttgagattcttgatctctctcacaacaacctcacagggaccatacctgttgaagttgtctccaatctcagaaacctgaagctgtatctcaacctctctagcaaccacttaagcggtccaatacctttggagctaagcaaaatggatatggttctctccgttgatctgtcttccaacgaactctcagggaagattccgcctcagctcggaagctgcattgcattagagcatctgaatctttcaagaaacggtttctccagtacgcttccttcatcattaggccaacttccatatctgaaagagctagatgtgtcttttaacagattaaccggagctataccgccttcttttcaacagtcttcgactctcaagcacttgaatttctccttcaacttgctctctggtaatgtatctgacaaaggatcattctctaagctgactattgagtcttttcttggagattctctcttgtgtggctctataaaaggcatgcaagcctgcaagaagaaacacaagtacccttctgttcttctaccggttctgttatcgttgatcgcaactcctgttctgtgtgtgttcgggtaccctttggtccaaagatcaagatttggaaagaatctaacagtgtatgccaaagaagaggtggaagacgaggaaaaacagaaccaaaatgacccgaagtacccgagaatatcgtatcagcagctcatagcagctactggaggtttcaatgcttctagcttgattggttcagggagatttggtcatgtttataagggagttctcagaaacaacacgaaggtcgcggtaaaagtacttgatccaaagaccgcactggagttctcggggagtttcaaaagagaatgtcagatcttgaagagaacaagacacaggaacttgatcaggatcatcactacgtgcagcaaacctggtttcaacgctcttgttctgccactgatgccaaatggaagcttggagaggcacttatacccgggagagtactcgagcaagaacttagatttgattcagttggtgaatatatgcagcgatgttgctgaaggaatagcttacttgcatcactattcacctgtaaaagttgttcactgtgatctcaaaccgagcaatatccttcttgatgatgaaatgaccgctctggttacggattttgggatttcaagattggttcaaggtgttgaagaaacagtttctacagatgattcagtgtcatttggctcaacagatggattgttatgtggatcagtcggttacattgcaccagaatacgggatggggaaacgcgcatcgacacatggagatgtgtacagttttggtgttctcctgctagagattgtaagcggaaggagaccaacagatgttcttgtcaatgaaggttcaagcttacatgagtttatgaagtcgcattaccccgattctctagagggaatcatcgaacaagcgttgagtagatggaaaccgcaagggaaaccagaaaaatgtgagaagctatggagagaagtcatattggaaatgattgagttaggattggtatgtactcaatacaatccttcaactaggcctgacatgcttgatgtcgcacacgaaatgggacggcttaaagaatatttatttgcttgtccttctctattgcatttttcatctcaagaaacacaaggagaagctagttcataa

SEQ ID NO: 50 - DNA, 1242 bp, Arabidopsis thaliana
atgggaagcttgagtacgattttgagacatccggatgagttatatccgctcttgaagttgaaacttgcgattacgaaagctcagaagcagattccacttgagccacacttagctttctgttattcaattcttcacaaagtttctaaaagcttttctcttgttattcaacaacttggcaccgagcttcgtaacgccgtgtgtgtgttctacttgattctccgagctcttgatactgttgaggatgacacaagcgtaccagtggagatcaaagttccaattctgatagctttccaccgtcatatatacgatggtgactggcatttttcatgtggtacaaaagagtataaacttctaatggaccaatttcaccatgtttctgcagcttttctgaaacttgaaaaagggtatcaagaggctattgaagatataactaaaagaatgggtgcaggaatggccaagttcatttgcaaggaggtagaaacaattgatgactatgatgaatactgccattatgctgcaggacttgttggtttaggtttgtcaaaaatcttcattgcttcggaattagaaatactgactccagattggaagcagatttcaaattctacaggtttatttctgcagaaaacaaacattatcaaagattatcttgaagacattaatgagagaccaaagtcgcgcatgttttggcctcgtgagatttggggaaaatatgttgacaaacttgaggacttcaaaaatgaggagaaagctacaaaagcagtgcagtgtttgaatgaaatggtcactaatgcattgaatcatgttgaagattgtttgaaatccttggcttcactgcgtgatcctgcaatatttcagtcttgcgccatccctcagatcgtggcgattggaacacttgcgttatgctataacaatgtacaagtgtttagaggtgtcgtgagattgagacgaggtctaatagctaaagtcattgatcgcacaaagacaatggatgatgtctacggtgcgttctatgatttttcttgcatgctacaaacaaaggttgacaataacgatccaaatgctatgaaaacattaaaccgactcgaaaccatcaagaaattttgcaaagaaaatggaggacttcacaaaagaaaatcttatgttaacgatgaaacacaatccaaggctatctttgttgtaatgtttgtgcttctactggccatagtcgttgtatatctcaaagcaaaccaatgtaagtga

SEQ ID NO: 51 - DNA, 2448 bp, Arabidopsis thaliana
atgagagaaattcattctctgttttcgttatctctgttcttaatttcatcttctctctctgttgctttggattataatgtcatcactccaaaagaattccttaaggatggagatacccttagttctccagaccaggttttccaacttgggttctttagtcttgaccaagaagagcaacctcaacatcggtttcttggcttgtggtacatggaaccatttgcagtcgtttgggtggccaaccgaaacaaccctctctacggcacatctggattcttaaacttgagttcccttggcgatcttcagctattcgacggtgaacacaaagccttgtggtcatcatcatcatcatcaacaaaagcttctaaaacagcaaataatcctctcttgaagatatcatgttcagggaatctcatatctagtgacggagaagaagctgtgttgtggcagagttttgattatcccatgaatacaatactcgcgggtatgaagcttgggaaaaacttcaagacacaaatggaatggtctctatcatcttggaaaaccctaaaagatccatcaccaggtgatttcacgttgtctctagacactcgaggtttaccacaattgatcttaaggaagaatggagattcgagttattcctatcgcttaggatcttggaacggcttatccttcaccggcgctccagctatgggacgtgagaatagcttattcgactacaaattcacgtcgagtgcgcaagaagtaaactactcgtggactccacggcacagaattgtctcaagattggtattaaacaacacagggaaactccataggtttatccagtcgaagcaaaaccagtggatcttagcaaacactgcaccagaagatgagtgtgactactactctatatgtggagcttacgcagtttgtgggattaatagcaaaaacacaccttcttgttcatgtttacaagggttcaagcctaaatcaggtcgaaagtggaatatttcaagaggagcatacgggtgtgtccatgagattccaaccaactgtgaaaagaaagatgcatttgtgaagtttccaggtctgaaattaccagatacttcatggtcttggtatgatgcaaaaaatgaaatgacacttgaggattgtaagatcaagtgttcaagtaactgctcttgcacggcttatgcgaataccgatattcgcgagggaggaaaaggttgtttgctttggtttggtgacttggttgatatgagagagtattctagctttggacaagatgtttacataagaatgggttttgctaaaatagagtttaaaggaagagaagtggtgggaatggtcgttggatcggtggtggcaattgcagttgttttggttgtagtgtttgcatgtttcagaaagaagataatgaagagatatcgaggtgaaaatttcagaaaagggattgaggaagaggacttggacttgcctatttttgacagaaaaacgatttctatagccactgatgatttttcatacgtgaacttcctaggaagaggaggttttggaccagtttataagggtaagttagaagatggacaagagattgcggtgaagaggttatccgcgaactcaggacaaggagtggaagaattcaagaacgaagtaaaactaatcgcaaaacttcaacatcgtaacctcgtgaggcttttaggttgttgtattcaaggtgaagaatgtatgttgatctatgagtatatgcctaacaaaagtttagacttctttatatttgatgaaaggagaagtacagaattggattggaagaagagaatgaacattatcaatggagtagctcgtgggattctctatcttcatcaagattcaagattgagaatcatacatagagatttaaaagctggaaatgttttactagataatgatatgaaccctaagatctcagattttggattggctaaatcttttgggggagatcagagtgaatcaagcacaaacagagtcgtgggtacttatggttacatgcctccggagtatgcaattgatggacatttctctgtgaaatctgatgtgttcagtttcggtgtattagtacttgagatcataactggcaagacgaatcgagggtttcgtcatgcagatcatgatcttaatcttcttggacacgtgtggaaaatgtgggttgaagacagagaaatagaagtaccagaggaagagtggttggaagagacaagtgttatcccagaggtactaagatgtattcatgttgctttgctttgtgttcaacaaaaaccagaagacagaccaaccatggcttctgttgtcttgatgtttgggagtgatagttctcttcctcaccctacacagcccggttttttcaccaaccggaacgttcctgatatctcttcatctttaagcttacgttcacaaaacgaagtttccatcacaatgttgcagggacggtag

SEQ ID NO: 52 - DNA, 1887 bp, Arabidopsis thaliana
atggggagaaaaaagtttgaagcttttggttttgtctgcttaatctcactgcttcttctgtttaattcgttatggcttgcctcttctaacatggaaggtgatgcactgcacagtttgagagctaatctagttgatccaaataatgtcttgcaaagctgggatcctacgcttgttaatccgtgtacttggtttcacgtaacgtgtaacaacgagaacagtgttataagagtcgatcttgggaatgcagacttgtctggtcagttggttcctcagctaggtcagctcaagaacttgcagtacttggagctttatagtaataacataaccgggccggttccaagcgatcttgggaatctgacaaacttagtgagcttggatctttacttgaacagcttcactggtccaattccagattctctaggaaagctattcaagcttcgctttcttcggctcaacaataacagtctcaccggaccaattcccatgtcattgactaatatcatgacccttcaagttttggatctgtcgaacaaccgattatccggatctgttcctgataatggttccttctcgctcttcactcccatcagttttgctaacaacttggatctatgcggcccagttactagccgtccttgtcctggatctcccccgttttctcctccaccaccttttataccacctcccatagttcctacaccaggtgggtatagtgctactggagccattgcgggaggagttgctgctggtgctgctttactatttgctgcccctgctttagcttttgcttggtggcgtagaagaaaacctcaagaattcttctttgatgttcctgccgaagaggaccctgaggttcacttggggcagcttaagcggttctctctacgggaacttcaagtagcaactgatagcttcagcaacaagaacattttgggccgaggtgggttcggaaaagtctacaaaggccgtcttgctgatggaacacttgttgcagtcaaacggcttaaagaagagcgaaccccaggtggcgagctccagtttcagacagaagtggagatgataagcatggccgttcacagaaatctcctcaggctacgcggtttctgtatgacccctaccgagagattgcttgtttatccttacatggctaatggaagtgtcgcttcctgtttgagagaacgtccaccatcacagttgcctctagcctggtcaataagacagcaaatcgcgctaggatcagcgaggggtttgtcttatcttcatgatcattgcgaccccaaaattattcaccgtgatgtgaaagctgctaatattctgttggacgaggaatttgaggcggtggtaggtgatttcgggttagctagacttatggactataaagatactcatgtcacaacggctgtgcgtgggactattggacacattgctcctgagtatctctcaactggaaaatcttcagagaaaactgatgtttttggctacgggatcatgcttttggaactgattacaggtcagagagcttttgatcttgcaagactggcgaatgacgatgacgttatgctcctagattgggtgaaagggcttttgaaggagaagaagctggagatgcttgtggatcctgacctgcaaagcaattacacagaagcagaagtagaacagctcatacaagtggctcttctctgcacacagagctcacctatggaacgacctaagatgtctgaggttgttcgaatgcttgaaggtgacggtttagcggagaaatgggacgagtggcagaaagtggaagttctcaggcaagaagtggagctctcttctcaccccacctctgactggatccttgattcgactgataatcttcatgctatggagttgtctggtccaagataa

SEQ ID NO: 53 - DNA, 1914 bp, Arabidopsis thaliana
atggtgcttccgctcttccggcgcgctgcgatcgcccggacttcctcgcttctcagagctcgtcttttcgctcctgcctccgaattccattctcgcttttctaatggactataccacttggacgacaaaattagtagcagtaatggtgtgaggtctgcctctatagacttgattacaagaatggatgatagttctccaaagcccattctgcgatttggcgtgcaaaacttttcatctacaggacccatatcacagacggttcttgcaatgccagccttgtctcctactatgagtcatggaaatgttgtaaaatggatgaagaaagaaggtgacaaggtagaggtgggtgatgtactatgtgagatagagacagacaaagccactgtagaatttgagagtcaagaggaaggatttctggccaagattttagtcactgaaggatcaaaggatatccctgttaatgaaccgattgcaataatggttgaggaggaagacgacattaaaaacgttcctgctaccatagagggtggacgagatggtaaagaggaaacatcagctcatcaagtgatgaaacctgacgaaagcacacaacaaaaaagttccattcagcccgatgcatcagatcttcccccacatgtcgtcttagaaatgccagcactttctcctacaatgaaccaaggtaatattgccaaatggtggaaaaaagagggtgacaagattgaagtgggtgatgtcataggtgagatcgagactgacaaagccactctggaatttgaaagccttgaagaggggtacttagctaagattctaattcctgaaggttccaaggatgtggcggtgggaaagccgattgccctaatagttgaagatgctgaaagtattgaagccatcaagtcttcttccgcaggtagttctgaggttgatacagttaaagaagtccctgacagtgttgtagataaacctacagagaggaaagcaggcttcacaaagatcagtcctgctgcaaagctattgattttagaacatggattggaggcatcatcaattgaggcatcgggtccctatggtacattattgaaatcagacgttgtggccgcaattgcttctggaaaagcttctaaatcatctgcgtctacgaagaagaagcaaccatcaaaggagaccccgtctaaatcctcctccacatcgaagccttctgtgacacagtcagataataattatgaagattttccaaatagtcaaattcgcaagattatagcaaaacgtttattggaatcaaaacagaagataccccatttgtatttacaatcagatgttgtattggatcctcttcttgcatttagaaaagaacttcaagaaaaccatggcgttaaagtgtctgtcaatgacatagttattaaagcagtggcagtcgcactgaggaatgtacgacaagctaatgctttctgggatgctgagaaaggagatatcgttatgtgtgacagtgttgacatatcaattgcagttgcaactgagaagggcttaatgactccaattatcaagaatgcagaccagaaatctatttctgctatttccttagaggttaaggagctggcacaaaaggctcgatctggaaagcttgctcctcatgagtttcaaggagggacattcagcatatcaaatctaggaatgtatcctgtggataatttctgcgcaatcattaacccccctcaggctgggattctagcagttggtagaggaaacaaagtggttgagccagttattggactagatggaattgagaagccttctgttgtgacaaaaatgaatgtaacgttatccgctgatcatcggatctttgatggacaagttggagcttcgtttatgtctgaattgcgttcaaactttgaggatgttcgaagacttcttctgtga

SEQ ID NO: 54 - DNA, 1683 bp, Arabidopsis thaliana
atggcacatcttcaaagaacatttcctactgagatgtcaaaaggtagagctagctttccaaaaggctttctctttggaactgcttcatcttcttatcagtacgaaggagcagtgaatgaaggtgcgagaggacaaagcgtgtgggatcatttctccaacaggtttcctcacagaatcagtgattctagcgacggaaacgttgccgttgatttctaccatcgttacaaggaagatattaagagaatgaaggatataaacatggattcgtttcggctttccattgcttggccacgagttctaccttatggcaaaagggatagaggagttagtgaagaaggaattaagttttacaatgatgttattgatgaactcttagccaatgaaatcactcctcttgttactatctttcattgggacataccacaggatcttgaagatgaatacggcggttttctaagcgagcagattatagatgacttcagagactatgcgagtctctgcttcgagagatttggggacagagtgagtctgtggtgcacaatgaatgagccgtgggtctacagtgtcgcgggctatgacacaggaaggaaagcgccaggacggtgctccaagtatgttaatggcgctagtgttgctggaatgtcgggatacgaggcatatattgtgagccataacatgcttctagcgcacgcagaagcagtggaagtgtttagaaaatgtgaccatattaaaaacggacaaattgggattgcgcataatccactttggtacgagccatatgatccgagtgatccagatgatgtcgaaggatgtaatcgagctatggacttcatgcttggttggcatcagcatccgactgcttgtggagactatccagaaacgatgaagaaatcagttggagatagattaccgagttttacaccagaacaatctaagaaacttataggctcttgcgattacgttggtataaactactatagctcgcttttcgtgaagagtatcaaacacgtggatcctacgcaacctacttggagaactgaccaaggcgttgattggatgaaaaccaacatagatgggaaacaaatagcaaaacaaggaggatcagagtggagtttcacatatccaacaggactcagaaacattttgaagtatgtgaaaaaaacttatggcaatcctcccattctcataactgaaaacgggtatggtgaagtagcggaacagagtcagagtctttatatgtacaatccttcaatcgacacagagagattggagtacattgaaggacatatccacgctattcatcaagccatccatgaagatggagtaagagtggaaggttattacgtatggtcattgctagataacttcgagtggaacagtggatatggtgtgagatatggtttatattacattgattacaaagatgggcttagacgatacccgaaaatgtcggcgttatggttgaaagagttcttgaggtttgatcaagaagacgattcttcgacgtctaagaaagaagagaagaaagagagctatggaaaacagttattgcattctgttcaggacagtcaatttgttcattcgattaaagacagtggtgcgttacctgcggttttggggagcttgttcgttgtgtctgcaactgttggtacttctctgttcttcaaaggagctaataattga

SEQ ID NO: 55 - DNA, 4545 bp, Arabidopsis thaliana
atggattttattgagatctcgttgatctttcgagagcatttgccactactggaactatgttcggtcatcatcaacctcctactctttcttgtctttctatttgctgtctccgcgaggcagattctcgtctgcgtgagaagaggcagagataggctctctaaggacgatacggtttcagcttctaatcttagcttggaaagagaggttaaccatgttagtgttgggtttgggtttaatctgtctttgctctgttgcttatatgtgttaggcgtccaagttttggtgttagtatatgatggggttaaggttagaagagaagtcagtgactggtttgttctttgctttccagcttctcagagtttagcttggtttgtccttagcttcttagttcttcatttgaaatacaagtcttcagagaagctacccttcttggtgaggatatggtggttcctggcgttttcgatttgcctctgtactatgtatgtcgatggaagaaggctagccattgaaggttggagcagatgttcttctcatgttgtcgccaatttagctgttacacctgctcttgggtttctctgctttctggcctggagaggcgtttctggtattcaagttaccagaagctcctctgatcttcaagagcctttgcttgttgaagaagaggcagcttgtcttaaagttactccatatagtactgctgggctagttagccttattacgctttcatggttggatccacttctctcggctggttcaaaaagaccgcttgagcttaaggatataccgcttcttgcaccaagagatagagccaaatcaagttacaaggtcttgaagtcgaattggaagagatgcaagtccgagaatccttcaaagcctccttctttagctcgtgcaattatgaaatcattttggaaagaagctgcttgcaatgccgtatttgctgggttgaatactcttgtgtcctatgtcggtccttacttgatcagctactttgttgattatcttggagggaaggagattttccctcatgaaggatacgtactcgctgggatattctttacgtccaagcttatagagacagtcaccacccgccagtggtatatgggtgttgatatcctagggatgcatgttagatcagctcttacagcaatggtataccgaaaaggtctcaaactttcaagtatagccaagcagaaccacacgagcggtgaaattgtaaactacatggcagtcgatgtccagcgcataggagattactcatggtatcttcatgatatttggatgcttccgatgcaaatagttcttgctcttgcaatcctatataaaagcgtgggcatagctgctgtagctacattggttgctacaataatctcgattcttgtcacgattccactcgctaaggtccaggaagactatcaagataagttgatgactgcgaaagatgaaagaatgaggaaaacctcagagtgtcttaggaacatgagagttctgaaattgcaggcatgggaagatcgttatagagtgagattggaagaaatgagggaagaggagtatggttggcttcgcaaagccttatattctcaggcttttgttacttttatcttttggagttcccccatttttgtcgccgcagttacattcgctacttcgatatttctaggcactcaacttaccgctggaggtgttctttctgctctggcgacattcagaattcttcaggagccacttcggaactttcctgatctggtttcaatgatggctcagacaaaggtttctcttgataggatttctgggttcttgcaggaggaagaacttcaagaagatgcaactgttgttattccacggggactttcgaatatagccatagagattaaagatggtgtgttttgttgggaccctttttcttcaaggccgacattatctgggattcagatgaaagtggagaagggtatgcgtgtggctgtctgtggcacagttggctctggaaaatcaagttttatctcttgcatcctaggggaaatcccaaaaatctctggcgaagttagaatatgtggtactactggttatgtgtctcaatcggcttggattcagtctggtaacattgaagaaaacattctatttggcagtccaatggagaaaacaaagtacaagaatgtgatacaagcatgttccctaaagaaagatatagagcttttctcacatggggaccaaactattatcggggagagaggtataaatctcagcggaggtcagaaacagcgtgtacaacttgcaagggcattatatcaagatgctgacatttatttactagacgacccttttagtgctcttgatgcacacactggctctgatttgtttagggattatattctatctgcattggctgagaaaactgtggtttttgtaacgcatcaagttgagtttctccctgcagctgatctaatattggttctgaaggaaggcaggattattcaatcgggtaaatatgatgatctgctgcaagcaggtactgattttaaggccttagtgtctgcccaccatgaagcaatcgaggcaatggacatcccaagtccctcctcagaagactctgatgaaaatcctattcgcgatagtttggtcttgcataatccaaagtctgatgtttttgaaaatgacatcgagactttggcaaaggaagtacaagagggaggatctgcttcagatctaaaggcaatcaaagagaagaagaagaaagctaagcgttcccgcaaaaagcagcttgttcaagaagaggaacgagtaaagggaaaagtcagcatgaaggtgtacttgtcatacatgggtgctgcatataaaggggctctgattcctcttattatactcgcacaagctgctttccaatttcttcagattgctagtaattggtggatggcttgggcaaatcctcaaactgaaggtgacgaatctaaagtggatcctactctgcttctcatcgtttatacggctttagctttcgggagctctgtgttcatatttgttcgagctgctctggttgcaacttttggtcttgcagctgcacagaaactgttcttaaatatgctcagaagtgtgttccgagcgccaatgtcattctttgattccactcctgcaggaagaattttgaatcgggtttctattgatcaaagtgttgtagatcttgacattccttttagactcggtgggtttgcttcaacaacaatacaactctgtggcattgtcgctgtaatgaccaatgttacctggcaagttttccttcttgttgttccggtagctgttgcttgcttttggatgcagaaatattacatggcttcttcaagagaattggttcggatagttagtatccagaagtctccaataattcatctttttggagaatcaattgctggtgctgccacaataagaggatttggccaggaaaaaagatttatcaaaaggaatctttatcttctagattgttttgttcgacctttcttctgcagtatcgctgctatcgaatggctttgtttacgcatggaattactttccacacttgtatttgctttctgtatggttttactcgtcagttttccacatggaaccattgatccaagcatggcaggtcttgctgtgacatatggacttaacttgaatggacgtctatcacgatggatacttagcttttgtaagcttgaaaacaaaataatctcaatcgaaaggatttatcagtacagtcagattgtaggagaggccccagcaattatagaagatttccgcccgccttcctcgtggcctgcaacgggaacaattgagctagttgatgttaaggttcgttatgctgagaatcttccaacagtactccatggggtgagctgtgtgtttccgggtggaaaaaagattgggattgttgggcgaacgggaagcggaaagtcgactttgattcaagctttgtttcgattgattgagccaactgctggaaaaattactattgacaacattgacatttctcaaattggtcttcatgatcttcgtagtcgccttgggattatacctcaagatcctacattatttgaaggaacaatccgagcaaatcttgacccacttgaagaacattcagatgataaaatctgggaggcgcttgataaatcccagcttggagacgttgttagaggaaaagacctaaaacttgactctccagtactggaaaatggagataactggagtgtagggcagagacagcttgtgtcacttggacgagcattactgaaacaagccaaaatacttgttcttgatgaagcaacagcatcggttgacacagcaacagacaatctgatccagaagataatcagaacagagtttgaagactgcacggtctgcaccattgctcaccggataccaactgttatagacagtgacctagttttggttctcagcgacggtagagtagcagagtttgatactcctgcacggctattagaagacaaatcatcgatgttcttgaaattggtaacagaatactcctcaagatctactggaatccctgaattatga

SEQ ID NO: 56 - DNA, 2736 bp, Arabidopsis thaliana
atgttatcactcaagaaaagcttaaacccacccagttctttcggttggtctgaccctgacccatgtaaatggactcacatcgtttgtacaggaacaaaacgtgtgacccggatccaaatcgggcattcgggtcttcaaggtacactttctcctgatctacgtaacttatcagagcttgaaagacttgagcttcaatggaacaacatctctggtcctgttccttctttaagtggtttagcttcattacaagtcttgatgttaagtaacaacaactttgattctatccctagtgatgtctttcaaggtttaacttcgttacaatctgtagaaattgataacaatccttttaagagttgggagattccagagagtttgagaaatgcttctgctcttcagaatttctctgctaattcggctaatgtttccggttctttacccggttttctcggaccggatgagtttcccggtttgtcgattttgcatttggctttcaacaacttagaaggagagttgcctatgagtttagctggctctcaggttcagtcattgtggctcaatggtcagaaactaaccggtgatattactgttcttcagaacatgactggtttaaaagaggtttggcttcactccaacaagttttcgggtcctttaccggacttttcgggtcttaaggagcttgagagcttgagtttgagagataactcctttacaggtccagttcctgcgtctttgttaagtcttgagtcacttaaagttgtgaacttgacgaataatcatctacaaggaccagtgcctgtgtttaagagctctgtttcagttgatttggataaagattctaacagcttttgcttgtctagtcctggtgagtgtgatcctagagtgaagtctttgcttttgatagctagttcattcgattatccgccccggctcgctgagagttggaaaggaaacgatccttgtactaactggattgggatagcttgtagcaatgggaacattactgttatcagtcttgagaaaatggaactaaccgggacgatttctcccgagtttggagcgatcaagtcgcttcaaagaatcattcttggtatcaacaatcttactggtatgattcctcaagagcttacaacgttacctaatctcaaaacactcgatgtttcgagtaacaagcttttcgggaaggtcccgggttttagaagcaatgttgttgtgaatactaatggtaatcctgacattggaaaggataaaagctctttgtcttctcctggttcttcttcgccttcaggtggttcgggttcaggtatcaacggtgataaagaccggagaggaatgaagtcttcgacttttataggaatcattgttggttcagttcttggaggtttgttatcaatcttcttgattggtttgttagttttctgttggtacaaaaagaggcagaagagattctcaggaagtgagagctcaaatgcagtagtggtgcatccgcgacattcggggtctgacaatgagagtgttaagattacagttgcgggttcaagcgtaagcgttggagggataagtgatacttatacgcttcctggtacaagtgaggttggagataatattcaaatggtggaagcaggaaacatgctgatatcaatccaagtgcttcgttctgtgactaacaacttcagttcagataacattcttggatcaggaggtttcggggttgtgtataaaggcgagttgcacgatggaacgaagattgcggttaagagaatggagaatggagttattgctggtaaaggctttgcggagtttaaatcagagattgcggttttaacaaaggttaggcatcgtcatttggttacgcttcttggttattgtttggatgggaatgagaagttacttgtgtatgagtatatgcctcaagggacattgagtaggcatttgtttgagtggtcagaggaaggacttaagcctctgttgtggaaacagagattgactttagctttggatgttgctagaggtgtggagtatctccatggattagctcaccagagctttatacacagggatcttaagccttctaacattcttcttggggatgatatgagggcgaaagttgcagactttggactcgttcgtctcgctcctgaaggaaaaggatcgattgagactagaatcgctggaacatttggttacttggcacccgaatacgcagtaacgggtcgagtgacaacgaaggtcgatgtatacagcttcggggtaatcctaatggaactcataacgggaagaaaatctctagacgaatcgcaaccagaagaaagcattcacttggtctcttggttcaaacggatgtacatcaacaaagaagcatcattcaagaaagcgatcgacacgacaatagacctagacgaagaaaccttagccagcgttcacactgttgctgaactagcaggccattgctgtgcccgtgagccttaccagagaccagacatgggacacgcagtcaacattctgtcatcactcgttgagctatggaaaccgtcggatcagaatccagaagacatatatggtatcgatctcgacatgtctttacctcaagcacttaagaaatggcaagcttatgaaggaagaagtgatctcgaatcttcaacttcatcacttttacctagcttggacaacacgcagatgagtattcccactagaccttacggattcgcagagtcattcacttcagtagatggacgatga

SEQ ID NO: 57 - DNA, 2631 bp, Arabidopsis thaliana
atggcgatgttaaaatctctttcatcgattttattcacaagctttgctcttctgttctttcttgttcatgctcaagatcaatctggtttcataagtatagattgcgggataccggatgattctagctacaacgatgagactacaggtataaagtatgtttcggattcggcgtttgttgattcaggaacaacaaagagaattgcagctcagtttcaatcaagtggttttgatagacacttgttgaacgtgagaagtttccctcaaagcaagagaagctgttacgatgttccgacgccgagaggcaaaggttttaagtatctaatcagaactcgtttcatgtacgggaactatgatgatcttggaagagtacccgagttcgatctctatctaggagtaaacttttgggactctgttaaactcgacgatgcaacaactatactcaacaaagagataatcaccattccacttttagacaatgttcaagtgtgtgttgttgataagaacgcaggaactccatttttgtctgtcttggagatacggctcttgttgaacactacttatgagactccttacgatgcacttaccctccttcggagattagattacagcaaaacgggaaaacttccatcgaggtacaaagatgacatatatgaccgtatatggacaccgcgtatagtgagttcagaatacaagatattaaatacatctctcactgtcgatcaatttcttaacaatggctaccaaccggcttctactgtcatgagcactgcagaaacagcgcgaaacgagagcctctacctaacgcttagtttcagaccgcccgaccctaacgcaaagttttatgtatacatgcactttgctgaaattgaagtactgaaaagcaaccagacgagagaattcagcatctggctaaatgaggatgtaatctctccttcgtttaagcttcggtacttgcttaccgacacattcgttacaccggatcccgtgagcggaattaccattaacttctctcttcttcaaccacctggtgaatttgtacttccaccgatcattaacgcccttgaggtctatcaagtcaatgagttccttcagatcccaactcatccacaggatgttgatgccatgaggaagattaaagccacgtatagagtgaagaagaactggcaaggagatccttgtgttcccgtagattattcttgggaaggtattgactgtatccaaagtgataacactactaatcctagagtcgtttcactaaatatatcttttagtgaattaagaggccagatagatccagccttctccaaccttacatctataagaaaattagatttatccggtaatactttaacaggagaaatacctgctttcctcgctaacttaccaaacttgaccgaattaaacgttgaaggaaacaagttaacgggcatagttccacaaagattgcatgaaagatcaaagaatggatctctttccttaagatttggtagaaatccggacctttgtctctctgattcctgttcaaacacaaagaagaagaacaagaatggatacatcattccattagtagtcgtaggaatcatcgtcgttcttttgacggctttagctttgttccggcgtttcaagaaaaaacaacaaagaggtacacttggtgagaggaatgggccgttgaaaactgcaaagcgatactttaagtactcagaagttgtgaatatcacaaataactttgagagagttattggcaaaggaggttttggtaaagtataccatggtgtcataaatggagaacaagttgctgtcaaggtactctctgaagaatcagctcaaggctacaaagagtttcgagcagaggttgaccttctcatgagagttcatcacacgaacctgacttctcttgttggatattgcaacgaaataaaccacatggtgcttatctatgagtatatggctaatgagaacttaggagactatttggcaggtaaaaggtcatttatcttgagctgggaagagaggttgaagatatcattagatgcagcgcaaggactagagtatcttcacaatggttgtaagcctcctatagttcacagagatgtgaagccaacaaacatcttactaaacgagaagctccaagcgaagatggcggacttcgggttatctagaagcttctctgttgaaggaagcggtcagatttcaacagttgtcgctggatccatcggttaccttgaccccgagtactattcgactcgccaaatgaacgaaaagagtgatgtttatagtcttggggttgttcttcttgaagtgattacaggccaacctgctattgcaagctcaaaaacagagaaggtgcatataagtgatcatgtcaggtcaatattagccaacggagacattagaggaatcgtggatcagcgtctaagagagagatatgacgttggctcggcttggaaaatgtcagagatcgctcttgcttgtaccgagcacacttctgcgcagaggccaacgatgagtcaggtcgttatggagctgaaacagattgtttatggcatagtgactgatcaggaaaactacgatgactcgacgaaaatgcttacagtgaatctagacaccgagatggttcctcgagcaaggtag

SEQ ID NO: 58 - DNA, 1215 bp, Arabidopsis thaliana
aatgcagacgaagaagctctttatcaccattgtctcctttcttctctatgctccattgttcttatcttcaccagttcctgaccctgaatctgtcgttgaagaagttcacaggagcattaatgcgtcggttgcaggaagaaggaagttaggttacctctcatgtacgaccggtaacccaatcgacgactgttggcgttgtgaccctcactgggagcaacaccgtcaacgtctcgctgactgcgccattggattcggcaaaaacgccatcggtggccgtgacggtcggatctacgtggtcaccgactcaggaaacgacaacccagttagccccaagcccggaactttaagacacgccgtggtccaagacgagccactctggatcatcttccaacgagacatgacgattcagctcaaagaagagctaatcatgaactcattcaagaccatcgatggccgtggtgcttccgtacacatctctggtgggccttgtataacgatccagtacgtgaccaacattatcatccatgggattcatatccatgattgcaagcaaggtggcaacgctatggtgcggagctctccacggcatttcgggtggagaacgatatcggacggtgatggtgtctctatctttggaggaagtcatgtttgggttgaccattgttcgttctctaactgtgaagatggacttattgatgctatcatgggctcgacggctatcactttgtctaacaatcatatgacacatcatgataaggtcatgttgcttggtcatagtgatacttacagtcgtgacaagaatatgcaagttaccattgcttttaaccattttggtgaaggccttgtccaaagaatgcccagacatggatacttccatgtggtgaacaatgactacacacattgggagatgtatgcgattggtggaagtgctaatcctacaatcaatagtcaagggaacagatttttggcacccaatatcagatttagcaaagaagtgactaagcatgaggacgcgcctgagagcgagtggaagagatggaattggagatcttccggagatttgttgctaaacggtgcgttttttactccgtctggtggtgcagcctcgtctagctatgcaaaggcttcgagccttggggctaaaccgtcttctctagttggaccattgacgtctacttctggtgcactgaattgccgtaaaggttcccgttgctg

SEQ ID NO: 59 - DNA, 2223 bp, Arabidopsis thaliana
atgggttgtgtgaattctaggcataggccttttagaagaaagtcaacaacactgaaagagtcatcagaggagaaacgttcctctcggattgattcgtcgaggaggattgatgattggattcaaccggaagatgggtttgatagattgagtaacagtggagatgctaaagttaggttgattgaatccgaaatgtttagtacaagtaggtgtcatgatcatcagattgggaagatattagagaatcctgcgacagttgctcatatggatagagttgtgcatgatcaggaattgagaagggcctctagtgctgttgtagactcggacttggatattgatccaaaggttgttaaggccaagctagatagatggaatagcaaagattccaaagttcggttgattgaatctgaaaagttgagttctagcatgttttctgagcatcatcagatagagaagggagtagagaaacctgaggttgaagcttcggttcgagtggttcatcgggaactgaagaggggttcaagcattgttagtccaaaggatgcagagcggaagcaagtggcagcaggatggccgtcttggctggtctctgttgctggtgagtcactagtggattgggctccacgacgagcaaatacttttgaaaagctggagaaaattggccaaggaacatatagcagcgtatacagagctcgcgatcttcttcataacaagattgttgcgctaaaaaaagtccggtttgatcttaacgatatggaaagtgttaagtttatggcaagagagatcatagtaatgcgacggcttgatcatcctaatgtcctgaaattggaaggattgatcactgcccctgtctcatcgtccctttacttagtttttgagtacatggatcatgatctcttaggactttcttcactacctggtgtcaagtttacagagcctcaggttaaatgttacatgcgacaacttctaagtgggcttgaacattgtcacagccgtggcgttcttcaccgtgatataaaaggctcaaacctactaattgacagtaagggagtcttgaagatagcagattttgggttagcaacttttttcgaccctgcaaaaagtgtttcattgactagccatgttgtcactctttggtaccggccaccagaacttttgcttggagcctctcattacggtgttggggttgatttatggagcacaggttgcatcttaggtgaattatatgccggtaaaccgatcctccctggaaaaaccgaggtagaacaattgcataaaatcttcaagctttgcggttcaccaacagaaaattactggagaaaacagaagttaccatcttcagctggattcaaaaccgcgattccttataggcggaaagtatcagagatgtttaaggactttcctgcaagtgttctttcacttttagagactttactctccatagatcctgatcaccggagctctgcagatcgtgcccttgagagtgagtacttcaaaaccaagccgtttgcttgcgatccatcgaacttaccaaaatatcctcctagtaaagagattgatgcgaaaatgcgtgatgaagcgaaaaggcaacaacctatgagggcggagaaacaagaaagacaagactctatgacgagaatatcacacgagagaaaatttgtaccaccggtcaaagcaaataactctctgtcaatgacaatggagaaacaatataaagatttgaggagtaggaacgatagtttcaagtcgtttaaggaggagaggactcctcatggaccagttcctgattatcaaaatatgcagcacaacagaaacaatcaaactggtgtgagaatttcacactcaggtccattgatgagcaaccggaacatggctaagtcaacaatgcatgtgaaggagaatgcacttcctagataccctccagctagagtaaacccgaagatgttatcaggctcagtctcctccaaaacattattagaacggcaagatcaaccagtcacgaaccaaagaagaagagatcggcgagcatacaatagagctgatactatggatagtagacatatgacagcaccaattgacccatcttggtataatcctagtgatagcaagatttacatgtcaggaccattgttggctcagccaagcagagtggaccagatgcttgaagaacatgacagacagcttcaggaattcaatagacaggcactcaagacaccacaaggctga

SEQ ID NO: 60 - DNA, 1017 bp, Arabidopsis thaliana
atggcaagaatcggaagctttctcattattctttacctcatttacgctcttactctctgcatctgcgacgacgacgagagtaactatggcggcgacaaagggaacctcttcccaggtttctacagaagctcgtgccctagagccgaggagatcgtgaggtcagttgtagccaaagctgttgcaagggagactcgtatggctgcttctctcatgaggctccatttccacgattgtttcgttcagggttgtgatggatcgttgcttctagacaccagtgggagtatagttactgagaagaactctaacccgaacagcagatcggctcgcgggtttgaagttgttgacgagatcaaggcagcattagagaacgaatgccctaacactgtttcttgtgctgatgccttaactctagccgctagagactcctctgttcttactggtggaccaagctggatggttcctttgggaagaagagattcgacaagtgcaagcttgagtggatcaaacaacaacattcctgcacccaacaacactttcaacacaattgtcacgagatttaacaaccaaggtctcgatctcaccgacgttgttgctctctccgggagccacaccattggattttcaagatgcactagtttcagacagagactgtacaaccaatccggaaacggaagtcccgacagaaccttagagcaatcctacgctgctaacttgcgccaaaggtgccctagatcgggtggggaccagaacctgtcagagcttgacatcaacagcgctggaagatttgataacagctacttcaagaacttgatcgagaacatgggactgttgaattccgacgaggtcttgttctctagcaatgagcaatcaagagagctcgtcaagaagtatgcagaggatcaagaagagttcttcgagcagttcgcggagtcgatgatcaagatggggaatatctctcccttgacaggttcgagtggtgagatcagaaagaattgcaggaaaattaataactcttga

SEQ ID NO: 61 - DNA, 1503 bp, Arabidopsis thaliana
atggaaggtcaaaccctaattttcacattccttttcatatctctttctctcacgtttatcatcggaagaatcaagcgaagacctaaccttcctccgagtccgtcgtgggcgttaccggtgatcggtcacctccgccttctcaagccgccactccaccgagtttttctatccgtctctgagtccctaggcgatgctccgataatctccctccgtctcggcaaccgactcgttttcgttgtctcttcacactcactcgccgaggaatgcttcacaaagaacgacgtcgtactcgcgaaccgcttcaactcccttgcttcaaaacacatctcatatggctgcacaacggttgttacagcttcgtacggcgaccattggagaaatctccgccgtattggcgctgttgagatattctcggctcaccgtctcaatagcttttcatctatccgccgagacgagatccaccggcttatagcttgtctctcacggaactcttcactcgaatttacaaaggttgagatgaaatcaatgttttctaacttaacattcaacaacattataagaatgttggctggaaaatgttactacggagatggtgcagaggatgacccggaggctaaacgcgtgcgggagcttatagcagagggaatgggttgttttggtgctggaaacactgctgattatttaccgatcctgacttggatcacaggttccgagaaacggataaagaagatcgctagtaggcttgatgagttcttgcagggattggtcgatgaaagacgagaagggaaggagaaaaggcagaacacaatggttgatcacttgctttgtctgcaagaaacccaacccgagtactacacggacaacattatcaaaggaatcatgctctctcttatactagcggggactgatacatccgcagtaacattggaatggacattgtcagctttgttgaaccatccacagatactaagcaaggcgagagatgaaatcgataataaggttggcctcaacaggcttgtagaggaatcagacctctcacatcttccttatcttcaaaacattgtgtccgagtcgttgcgcttataccctgcgagtcccttgttggttcctcacgtagcatcagaagactgtaaagtagggggttaccatatgccacgtggaacgatgctattgactaatgcatgggcaatacatagggatcctaagatatgggatgatccaacgagcttcaaaccagagaggttcgagaaagaaggggaggctcagaagctattggggtttgggctaggaagaagggcgtgtcctgggtccggtctggctcaacggctagcgagcttgactatcgggtctttgattcaatgttttgagtgggagaggataggagaagaagaggtggatatgactgaaggtggaggaggagtcataatgcccaaagctataccgttggtagccatgtgcaaagcacgccccgttgttggtaagatcctcaacgagtccgcttga

SEQ ID NO: 62 - DNA, 1584 bp, Arabidopsis thaliana
atggcgattaggttgaatcatagtgtaattccagtgagcgtgaagcttggagctccgacgagagtatcggctcggagctcgttaccgttcagcgttggagattggcgtggtgtttctacattttccggtgctaggcctttggttctcgcgaaggtgaaactgagagcagagagtactgaggaagatcgagttccaattgatgacgacgacgattctactgatcagctcgtaagtgtggaatttcatttggatgattcactcctgggagtgattgatatgaactcggaagtggtggaaccggaggagcttttggatcagttaagaactttaaagtcggttaatgttgatggtgttatggttgactgctggtggggaattgttgagtcacatacaccacaggtttataactggagtggttacaagaaactttttcagatgattcgtgagcttggacttaagattcaggttgttatgtcgtttcacgaatgtggaggcaatgttggagatgatgtgcatatacaaatccctgagtgggtgagagaaattggtcaaagcaatcctgacatctacttcactgacagtgctggcaggcgtaacactgaatgccttacttggggaattgacaagcaacgtgttttaagaggacggactgctcttgaggtttactttgattacatgagaagctttcgtgtggaatttgatgaattctttgaggagaaaatcatccctgaaattgaagttggactaggtccatgtggggagctgaggtatccttcataccctgcacaatttgggtggaaataccctggtattggtgaattccagtgttatgataaatatttgatgaatagcttaaaggaggctgcagaagtaagaggccacagcttttggggcagaggacctgataacacagagacttataattcaacaccacatgggactggattttttcgcgatggaggcgattatgacagctactatggtagattctttcttaattggtactcaagagttctgattgaccatggtgatcgtgttcttgctatggcaaatttggctttcgaaggaacttgcattgctgcaaagctctcaggtatacactggtggtataaaacagctagtcatgctgctgaactcactgctggcttctacaactcctcaaaccgtgatggctatggtccaatagctgcaatgtttaagaaacatgatgctgctctcaacttcacatgtgtggagttacggacacttgatcaacatgaggatttcccagaggctctggcagatccagaaggtctagtttggcaggtgctgaatgctgcttgggatgctagtatacctgttgctagtgaaaatgctcttccttgttatgacagagaaggttacaacaagatacttgaaaacgcaaagccccttaccgatcctgatggtcgccacctttcatgtttcacttacctgaggcttaacccaactctgatggagtctcaaaacttcaaagagtttgagagattcctcaaacgaatgcatggtgaagccgttccggatcttggtttggctccagggacacaagagaccaaccccgagtga

SEQ ID NO: 63 - DNA, 1515 bp, Arabidopsis thaliana
atggctaaatcagtatctggcgggaagattacttattttgtggtggcttcatgtgtcatggccgccatgggcggtgtcatcttcggctacgacatcggggtttcaggtggagtgatgtcaatggggccatttctaaaaagatttttcccaaaagtgtataagctccaagaagaagatagaagaagaagaggcaatagcaataaccactactgccttttcaatagccaacttcttacatccttcacatcttctctatacgtttccggtctcatcgctactctgttagcttcgtccgtgactcgttcatggggtcgcaagccctctatatttcttggcggtgtgtcctttctcgccggcgctgctcttggtggctctgctcaaaacgttgctatgctcattattgcgcgtctcttgctcggcgtaggagttggattcgctaaccagtcggttcctctgtatctctccgagatggcgccggcaaaatacagaggagcaatcagcaatggtttccagctctgtatcggaattggatttctatctgcaaatgtaataaactacgaaacccaaaatatcaaacatggttggagaatctctttagccacagctgcaatacctgcttcaatcctcactttaggatcactgtttctcccggaaacgccgaatagtatcatccagaccaccggagatgttcacaagaccgagcttatgcttcgccgtgtccgtggaactaacgacgttcaagatgagcttactgatctcgttgaagcgagttctggttctgatacagattcaaacgcgtttttgaaactgcttcaaagaaaatataggcctgagttagtgatggctttggtgatacctttctttcagcaagttactggaatcaatgttgttgctttctacgcaccggttttgtatagaaccgttgggtttggagagagtggttcgttgatgtcgaccctcgtgactggaatcgtgggaacctcgtcgacgttgttgtcgatgcttgtcgttgacagaatcggtagaaagactctgtttttgattggagggttacagatgctcgtgtcgcaagttaccattggtgtgatcgttatggtggctgatgttcacgacggtgtgatcaaggaagggtatggttacgcggttgtggttttggtgtgtgtctacgtggccgggtttggttggtcttggggtccattaggatggcttgtaccgagtgagatttttccgttggagataagatcggtggcgcagagtgtaactgtggcagtgagttttgtgtttacttttgcggtggctcaaagtgcaccaccgatgttgtgtaagtttcgagctgggattttcttcttttatggagggtggttggtggtaatgacggtagcggtgcagctgtttttgccggagactaagaatgttccaatcgagaaggtggttggactttgggagaagcattggttttggaggagaatgacgagcaagcgtgatatccaagaaaccaccattcttagccattga

SEQ ID NO: 64 - DNA, 2451 bp, Arabidopsis thaliana
atggatatcgggtgtaaagttctcgtctttttcacatgtttcctcactgtgacagcagagatttacattgtgactatggaaggagaaccaatcattagttacaaaggtggtgataatggatttgaagcaactgctgtggaatctgatgagaaaattgatactacaagtgaactggtgacatcatacgcccgtcaccttgagaggaagcatgatatgcttcttggaatgctctttgtggaaggatcttacaaaaagctttacagctataaacacctcattaatggttttgcagctcatgtatcccctgatcaggcggaaatgcttcgtcgcgcgcctggtgtgaaatctgtggatagagattggaaagttaggaaacttactacacatacaccacagtttttgggattaccaactgatgtttggccaactggtggtggttatgatagagcaggggaagatattgttattggctttattgactcagggatatttccacatcacccaagttttgcctctcaccacacaacagtaccttatggccctcatcctagttacaaagggaaatgtgaagaagatcctcatactaagatcagtttctgcaatgggaagatcataggagcgcagcattttgctgaagccgctaaagcagctggtgctttcaatccggatatcgactttgcttcaccaatggatggcgatggacatggaagtcacacagcagctattgcagctgggaacaatggtattccagtgaggatgcacggttatgagtttggaaaagcaagcgggatggctcctcgtgcaaggattgctgtttacaaagctctctaccgactttttggaggctttgtagctgatgtggtggctgccattgatcaggctgttcatgatggagtagatattttgagtctctcggttggtccaaacagtcctccagctactacaaagacaacattcttgaatccatttgatgctacacttcttggggctgtaaaagctggtgtttttgttgctcaagctgctggaaacggaggtccctttccgaaaactctggtttcatacagcccttggataactactgtggctgctgcaattgatgatcgcagatacaaaaatcatctgactcttggaaatggtaaaatgcttgccggaataggattatctccttctactcgacctcatcgttcatacaagatggtttctgcaaatgatgttctgcttggttcttctggtatgaaatacaatccgtcggactgccagaagccagaagtcttgaacaaaaaattagtcgaaggaaacattctgctttgtggatattctttcaatttcgttgctggttcagcttccatcaagaaagttgctgaaactgccaagcatctaggcgctgctggtttcgttcttgttgtcgaaaacgtttctccaggaacaaaattcgatcccgttccttcttgcattcctgggattctgattacagatgtctctaagtcaatggatttgattgattactacaatgtcacaacgtcaagagattggatgggaagggtaaaggactttaaagctgaaggaagcatcggagacggtttggaacccattcttcacaaatccgcacctgaagttgctctgttctcagctcgaggacccaataccaaagatttcagctttcaggatgctgatcttctcaaaccagatattcttgctccaggctctttaatatggtctgcctggtctgcaaatggaacagacgaggctaactatatcggcgaaggatttgcactaatttctggcacaagcatggctgcaccacacattgcgggtattgctgctctggtgaaacagaagcatcctcaatggagtccagctgccattaaatcagctttgatgacgacttcaacagtcatagatagagcaggaagacctctccaagcacaacaatattctgaaacagagacagtaacacttgttaaagcaactccgtttgattatggaagcggtcatgtcaatccaagcgctgctctagaccctggtctcatctttgatgcaggttatgaggattatatagggttcttgtgcaccacacctggtatcgatgctcacgagataaaaaacttcacaaacactccatgcaatttcaaaatggttcatccttcaaacttcaacacgccatccatagccatctctcatctcgtcagaacacaaaccgtaaccagaagagtgacgaatgttgcggaagaagaagaaacatacacaatcacatcgaggatggagccagcaatcgccatcgaagtgagtcctcctgcaatgacagtaagagcgggcgcttctagaaccttttcggtgactctaacagtgagatcagtgactggagcttatagcttcggacaggttacattgaaaggaagccgagggcataaagtgactctccctgtggttgctatgggacaaaggcgataa

SEQ ID NO: 65 - DNA, 2028 bp, Arabidopsis thaliana
atgttcttgaagcttttaaccatcttcttcttcttcttcttcaacctcatctttcaatcttcttctcaaagtctcaactttgcttacaacaatggctttaatccaccgacggacttatccatccaagggatcacaaccgtcacacccaacggtctcttgaagctaaccaacacaaccgttcagaaaaccggtcacgccttctataccaaaccgatccggtttaaagattctccaaacggcaccgtttcatccttctcgacatcgttcgtcttcgctattcactctcagatcgcgattctcagcggtcatggcatagctttcgtcgtcgctcctaacgcaagccttccttacggcaacccaagtcaatacataggtctcttcaacctcgcaaacaacggtaatgagacaaatcatgtctttgctgttgaattagatacgatcttgagtacagagttcaatgatacaaacgataatcatgtcggaatcgatatcaatagtttgaagtctgtgcaaagctcgcctgctgggtattgggacgagaaaggtcaattcaagaatctgactttgatcagtcgtaagccgatgcaggtctgggtcgattacgacggacgtacaaataaaatcgatgtgacgatggctccgttcaacgaagataaacctacaagaccgcttgttacggctgttagagatctttcttcggttctactccaagatatgtatgtgggtttctcctctgcgacaggctctgttctgtcggaacattatattctcgggtggagtttcggtttgaacgaaaaggctccacctttagctttatcgagactcccgaagcttcctcgcttcgagcccaagagaatctctgagttctacaagatcggaatgcctttgatttctctgtttttgattttctcgtttattttcctcgtttgttacatcgtgaggaggaggaggaagtttgcggaggagctcgaggaatgggaaaaagagttcgggaagaatcggttcaggttcaaggatttgtactacgcgaccaaagggtttaaggagaagggacttcttggaactggtgggttcgggagtgtttacaaaggtgtgatgcctggtacgaagttggagatcgctgttaaaagagtttcgcatgagtctcgtcaagggatgaaagagtttgtggcggagattgtgagtattggtcggatgagtcataggaatttagttcctctcttgggttattgtcgtaggagaggtgagcttcttttggtgtatgattacatgcctaatggaagcttagacaagtacttgtacaacactccggaggtaacacttaattggaaacagaggattaaggttattctaggtgttgcctctggcttgttctatctccatgaggaatgggaacaagtggtgattcaccgggatgtcaaagctagcaatgtcttgttggacggagagctcaatgggagacttggggatttcggtttggctcggttgtatgatcacggatcggatcctcagaccacgcatgttgttggaacattgggatacttagctcctgaacatactaggacaggacgtgccacgatggctaccgatgtttttgcgtttggggcgttcttactcgaagtcgcatgcggtagacgtcctatcgagttccagcaagagaccgatgagacgttcttgctcgtggattgggttttcgggttgtggaacaagggagacatcttggctgctaaagatccgaatatgggttcggaatgtgatgaaaaagaggtggaaatggttttgaagctaggtctcttgtgctctcactctgacccaagggctagaccaagtatgagacaagtgctacattatctaagaggagatgcaaagttaccagaattgtctccgttggacttgtccggaagtgggatgatgtttggggttcatgacggatttagtgaattaggaatgtcgtattcctcctccgtattcaaagggtttaccggtggatcttccatcgctgattctcaactttctggcgggagatga

SEQ ID NO: 66 - DNA, 948 bp, Arabidopsis thaliana
atgggaacgagcgaagacaagatgccatttaagactaccaaaccaacatcttcggctcaggaagttcctcccacaccgtatccagattggcaaaattcaatgcaggcttattatggcggaggaggtactccaaatccttttttcccatccccagttggatctcctagtcctcacccctatatgtggggtgctcaacaccatatgatgccgccttatggcaccccagttccgtacccagcaatgtatcccccgggggcagtctatgctcatcctagcatgcccatgcctcctaattctggtcctaccaacaaggagcctgcgaaggaccaagcttctggcaagaagtcaaaggggaactcgaaaaaaaaggctgaaggaggtgataaagcgctctctggttcagggaacgatggtgcctctcatagtgatgaaagtgtcacagcgggttcatctgatgaaaatgatgagaatgccaatcaacaggaacagggttcaattcgaaagccaagctttggacagatgcttgctgacgcaagttctcaaagtacgactggtgaaatccaaggttcggtgcccatgaagccggtagccccggggactaatctgaatatcgggatggacttatggtcttcccaagctggtgtaccagtgaaggatgaacgagagctcaagcggcagaagaggaaacaatctaaccgtgaatccgctaggcggtctagattgcggaagcaggccgaatgcgaacaacttcaacaaagagtagagagtttgtcgaacgagaatcaaagcctgagagatgagctacagagactctcaagcgaatgtgataagctcaagtctgagaacaactcaatccaggatgagttgcagagagtacttggagcagaggctgtagctaatctagaacagaatgctgctgggtcgaaagatggtgaaggaacaaattaa

SEQ ID NO: 67 - DNA, 1431 bp, Arabidopsis thaliana
atggttcaaaaccaccaaacagttctcgccgtcgatatgccacaaaccggcggctccaagtacttggacgacgacgggaaaaacaaaagaactgggagtgtttggacggcgagtgcacacataataacggcagtgataggttcgggagttttgtcactagcgtgggctacggcgcagctaggttggctcgccggaccggtggtgatgttgctcttctctgccgtcacttatttcacttcttctcttcttgctgcttgttaccgctccggcgaccctatctccggcaagaggaactacacttatatggatgctgtccgatcaaatctcggtggcgtgaaggtgacgctatgtgggattgttcagtatcttaatatctttggtgttgctattggctacacaattgcttcagctataagcatgatggcaataaagagatcaaactgtttccacaagagtggagggaaagatccatgtcacatgaacagtaatccttacatgatagcttttggattagtccagattctattctctcagattccagattttgatcaactttggtggctctcaatcctcgccgccgttatgtccttcacttattcctcagccggtctcgccctcggcatagcccaagttgtcgttaatgggaaggtgaagggaagtctcactgggattagcataggagcagtaacagagacacagaagatatggaggacctttcaagctcttggagacattgcttttgcttactcttactccattatcctcatcgagattcaggacacagtgaagtcaccaccatcagaagagaagacgatgaagaaggcaacacttgtgagcgtcagtgtaacgactatgttctatatgttgtgtggatgtatgggatatgcagcctttggagacttgtctccgggaaatctcttaaccggtttcgggttttataatccttattggcttcttgacattgcaaatgcagccattgtgattcaccttattggtgcataccaagtctattgccaacctctgtttgctttcatcgagaagcaagcttccattcaattccctgatagtgagttcattgcaaaagatatcaaaattccaattcctggtttcaagcctctccgcttgaatgtcttcaggttgatatggaggacagtgtttgtgatcataacgacagttatctcaatgcttcttccgtttttcaacgacgttgtgggtctgctcggggcactagggttttggccattgacggtgtattttccagtggaaatgtacatcgcgcagaagaagatacctagatggagcaccagatgggtttgccttcaagtcttcagcttagggtgtctagtagttagcattgctgcagctgcagggtccatagctggagtacttcttgatctaaagtcctacaagccatttcgaagcgaatactga

SEQ ID NO: 68 - DNA, 963 bp, Arabidopsis thaliana
atgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtag

SEQ ID NO: 69 - DNA, 6449 bp, Arabidopsis thaliana
ccagtcttgttcttaacagtgatgagcgtcgtcgtgatacgcatgaatcttctggtgaaccggagagtctcaggggtaggattgatccgaaatcctttggagatcgtgtcgttaggggaaggcctcatgagttagatgagcggcttaataaatctaagaagaagaaggaacgttgtgatgatttggtgtctgctcgtgagagcaaaagagttcgtcttagggaggtgagtgtacttaatgatacggaggatggtgtttatcagccgaagactaaggaaacaagggttgcttttgagattatgcttggtcttatccagcagcaattgggtgggcagcctttggacattgtttgcggtgcggctgatgagattttggcagttcttaagaatgaatccgtcaaaaaccatgaaaagaaggtagagattgagaaactactaaacgttattactgatcaggttttcagtcagtttgtttcgattggaaaactgattacagactatgaagagggtggtgattctttaagtggtaaagctagtgaggatggaggacttgattatgatattggtgttgcccttgaatgtgaagaggatgatgatgagagtgatcttgatatggtccaggatgaaaaagatgaggaggatgaagatgttgttgagcttaacaaaactggagttgtccaggtgggtgtggcaataaacggcgaggatgcaagacaggcaaaggaggatacgagtcttaatgttctggatattgatgcttattggcttcagagaaagatatctcaagaatatgagcagaagattgatgcacaagagtgccaggaactcgcagaagagctgcttaagatacttgctgagggtaatgatagggatgttgagatcaagctgcttgagcaccttcagtttgaaaagttcagccttgttaaatttctgttgcaaaaccgtcttaaagttgtgtggtgcacccgtttggctaggggaagagaccaggaagagaggaatcaaattgaggaggagatgttggggttaggttcagagttggcagcaattgttaaggagttgcatgccaaaagagcaacagccaaagaaagggaggagaaacgggagaaagatatcaaagaagaagctcaacatcttatggatgatgattctggtgttgacggagacagaggcatgagagatgttgatgatttagatttggagaatggttggttgaagggccagcgtcaggtgatggacctggagagccttgcttttaaccaaggtggtttcacgagggagaataacaagtgtgagcttcctgatcgctctttcagaatacgtggcaaggaatttgatgaggttcatgtgccgtgggtttctaaaaagtttgatagtaatgaaaagcttgtgaaaattagcgatttgccagagtgggcccaaccagcttttaggggaatgcagcagttgaatagggttcagagcaaagtgtacggcactgctctttttaaggctgacaacattcttctttgtgctccaactggtgctgggaagaccaatgttgccgtgctcaccatactgcaccagcttggattgaatatgaaccctggtggaacgtttaatcatggtaattacaaaattgtctatgttgcaccaatgaaagcccttgttgctgaggtcgtggatagtctatctcaacgtttgaaggattttggagttactgtgaaggaactcagtggggatcagtcccttactgggcaagaaatcaaagagactcagataattgttacaacgccagagaagtgggatatcatcaccaggaaatctggagatcgcacttatacacagcttgtgaggcttcttataatcgacgaaattcatcttcttgatgataatcgagggcctgtgcttgaaagtattgtcgctaggactcttaggcagattgaaagcacaaaggagcatattcgtctggtaggtttatctgcaacactgccaaattgtgacgatgtggcttcatttttgcgagtggatcttaaaaatgggttgtttatatttgaccgtagctacagacctgtgcctctcggtcagcagtatataggaattaatgtgaaaaagccgttacggaggttccagttgatgaatgatatatgttatcagaaagtagtggctgttgctggaaaacaccaggtccttatttttgttcattcgaggaaggaaacagcaaaaactgcaagggcaatacgggacacagctatggcaaatgataccctcagcagattcttgaaggaagatagtcaaagtcgtgaaattcttaagtgtttagctggacttctcaagaataatgacctgaaagagcttctgccttatggttttgcaattcatcatgctgggttgacaaggactgatcgtgagatagttgagaatcaatttcgctgggggaatttgcaagtgttgatttccacggcaactcttgcctggggtgtgaatttgcctgcacatactgtcattatcaaaggaacccaagtatataatcctgagagaggggagtggatggagctgagtcctttagatgttatgcagatgattggtcgtgccggaagacctcaatatgaccaacaaggggagggaataataatcactggatacagcaagctacagtattatcttcgtttgatgaatgagcaactacctattgaaagccagtttatttccaaacttgctgatcagctcaatgctgaaattgtgcttggaaccattcagaatgctagagaagcttgccactggcttggctatacatatttatatgtccgcatggttcgtaatccgacactgtatggcgtatcgcctgatgcccttgcaaaagacttgctattggaggagagaagagctgatctgatacattctgctgccactatcttggacaagaacaacctgattaagtacgacaggaaaagtggacacttccaggttactgatttgggacgcattgctagctactactacataagccatggaacaatagctgcatacaatgagaatctgaagccaacaatgaatgatatagagctttgtcgtctgttctctctgagtgaggagttcaagtatgtcactgttcgacaagatgagaagatggaactggcaaagcttttggatcgtgtaccaattccggtaaaggaaacactagaagatcccagtgcaaagatcaacgttttgctgcaagtatatatttcaaagctaaagctcgagggtctttctttgacatctgacatggtttatattacccaaagtgctggacgtttgttacgagctatttttgagattgtgttgaagagggggtgggctcaactgtctcagaaagctctcaacttgtctaaaatggtagggaagaggatgtggagtgttcagacacccctctggcagtttcctggaattcccaaggagattctgatgaagttggagaaaaacgatctggtgtgggagaggtactatgatctatcttcacaggagctaggagagcttatttgtaatcctaagatgggcagaccacttcacaagtatatccatcagttcccaaaactgaaacttgcagcacatgttcagccgatttctcgttctgttctgcaggttgagctcacggtgacacctgatttccactgggatgacaaagcaaataaatatgttgaaccgttttggataattgtggaagacaatgatggtgaaaagatccttcatcatgagtactttctttttaaaaaacgggttattgatgaggaccacactttgaacttcactgtaccaatctctgagccaattcccccacagtatttcatccgagtggtttcagacaaatggcttgactcgccgactgtgttacctgtatctttcaggcatcttattcttccagaaaaatacccaccacctacagagctactggatttgcagcccctcccggtgatggccctaagaaatccttcttatgaaactctttatcaggatttcaagcatttcaatccagtgcagactcaggtctttactgttttgtataacacaagtgacaatgtagtggttgctgctccaacaggaagtgggaagactatatgtgcggagtttgctatattaaggaatcatctcgaaggacctgattctgcaatgcgtgttgtctatatagcacctcttgaggctattgccaaggagcagtttcgtgattgggagaaaaagttcggaaaggggcttggtttacgggttgttgagttaactggggagacattattggatcttaagttgcttgagaaaggtcagataatcataagtactcctgagaaatgggacgctctgtcccggaggtggaaacagagaaaatatatccagcaggttagtttgtttatcgttgacgagcttcatttaattgggggtcaaggtggtcaagtgttggaggtaattgtctctagaatgagatatatttcaagtcaggttgggaataaaatcaggattgttgcattatcaacttcccttgcaaatgccaaagatcttggagagtggattggggccagttcatgtggcgtttttaacttcccgcctaatgttcgtcctgtcccactggagatccacattcatggggtggacatattgagttttgaagccaggatgcaggcgatgactaagccaacatacactgccatagtacagcatgccaagaacaagaaaccagctatcgtttttgtcccgacccgtaaacatgtccgccttactgctgtggatctgatagcatactcgcacatggacaacatgaagagccctgatttccttttagggaatctggaagaattagagccttttttaatacaaatttgtgaggaaactctgaaggagactttacgccatggcattggctacctgcacgagggtttaagcaatctggatcaggagattgtgactcagctttttgaagctggacggattcaggtatgtgtaatgtctagttcattgtgttggggtactccattgaaggcacatttggttgttgtaatgggaacacatttctacgatggacgggaaaattctcattcggattaccccatctctaatctgctccaaatgatggggcgtggtagccgacctctgcttgacgacgctgggaagtgtgtgatcttctgtcatgcaccacgtaaagagtattacaagaaatttttgtatgaagctcttccggttgagagtcatcttcaacatttcttgcatgataatttcaatgcagaagtagttgctagagttatagagaacaaacaagatgctgtggattatcttacctggagcttcatgtacaggaggcttccccagaaccctaactactacaatctcctgggagtgagccacagacatttatctgatcacctctcagagctcgttgaaaacactttgtctgatcttgaagtgagtaaatgcattgaaatagacaatgagttggatctctctcctctcaatcttggtatgattgcgtcatattactacataaattacaccaccattgagcgattcagttctctcttggcttccaagaccaagatgaagggtcttcttgagatcttgacttcagcttcggagtatgacttgattcctatacgtcctggtgaagaggacgcagttcggagactcatcaatcaccagaggttctcttttcaaaacccaagatgcacagaccctcgtgtgaagacaagcgcacttcttcaggcgcatttctcaaggcaaaaaatcagcgggaaccttgtaatggatcagtgtgaggtccttttatcagcaacaaggcttcttcaagcaatggtcgatgtgatatcgagcaatggctgtctgaatcttgctcttttagctatggaagtaagccagatggtgactcaaggcatgtgggatcgagactccatgcttctgcagcttcctcacttcacaaaggacttagccaaaaggtgccatgagaatccggggaataacattgaaaccatatttgatcttgtggaaatggaagatgacaaacgccaagagcttctccaaatgtcagacgctcagcttcttgacattgccagattctgcaaccgcttccccaacattgaccttacatatgagattgtgggaagtaacgaggtaagccctggaaaagatatcacattgcaggtattactggagagagacatggagggaaggaccgaggtgggacctgtggacgcgccaagatatcctaagactaaagaagaaggttggtggctagtcgttggagaagccaagacgaaccagttgatggccatcaagagaatctccctgcaacggaaggcgcaggtgaagctggagtttgcagtaccaactgaaacaggagagaagtcgtatacactctacttcatgtgcgattcttacttgggttgtgaccaggagtattctttcactgttgatgtcaaagattctgatgccgcagatcacatggaagaatga

SEQ ID NO: 70 - DNA, 1281 bp, Arabidopsis thaliana
atggaatctccatatccaaaatcaccggaaaaaatcacagggacagttcttctcggaaaatacgaactcggtcgtcgactaggaagcggaagcttcgctaaagtccatgtagctcgttccatctccaccggcgaactcgtagctatcaaaatcatcgacaagcaaaaaaccatagattccggtatggagccgagaataatccgagagatcgaagcgatgcgccgcctccacaaccacccaaacgtcctcaaaatccacgaagtcatggccactaaatccaagatctacctcgtcgtcgaatacgccgccggaggagaactcttcaccaaactcatccgattcggccgccttaacgaatcggcggcgcgtcgttatttccaacaactcgcctccgcgctcagtttctgccaccgcgacggaatcgctcatcgcgacgtgaagccacagaatctcctccttgataagcaaggaaacctcaaggtctccgactttggtctatcggctttaccggagcatcgaagtaataacggattgcttcacacggcatgtggcacaccggcttatacagcaccggaagtaattgctcagagaggttacgacggtgctaaagctgatgcgtggtcgtgtggtgtgtttctctttgttcttcttgctggttacgttcctttcgatgatgccaacattgttgctatgtataggaagattcataaaagagattaccggtttccgagctggatctcgaaaccggctcgatctattatatataagttgcttgatccgaatccggagacgaggatgagtatagaagctgtgatgggaacggtttggtttcaaaaatctctagagatttcggagtttcagtctagtgtgtttgagttggatcggtttcttgagaaagaagcgaagtcgagcaatgcgattactgcgtttgatttgatctcgttgtcatcgggattggatctttcggggttgtttgagaggaggaagaggaaagagaagaggtttacggcgagagtgtcggcggaaagagtggtggagaaggcggggatgataggggaaaagttagggtttagagtggagaagaaggaagagactaaggtggtgggattgggaaaaggaagaactgcggtggtggttgaggtggtggagtttgcggaagggttggttgtggcggatgtgaaggttgtggtggaaggtgaagaggaggaggaggaggtggagtctcattggtcggagctaattgtagagcttgaggagattgtgctctcatggcacaattga

SEQ ID NO: 71 - DNA, 495 bp, Arabidopsis thaliana
atggaagctcctagaggaaatctgagagcggtggctcttatcgccggcgataacaacgtccgaggctgtcttcaattcgtacaagacatttccggaactactcatgtcaccgggaagatctcaggactctctcctggcttccatggatttcatattcactcttttggtgataccacaaatggctgcatctctactggacctcacttcaatccattaaatcgagttcacgggccaccgaacgaggaagagcgtcatgctggcgatttgggtaacattcttgcaggatcaaacggtgttgctgaaatcttaatcaaagacaaacatataccgcttagtgggcagtattccatactcgggagggcggttgttgtgcatgcggatcctgatgaccttgggaaaggagggcacaagcttagcaaatcaactggaaacgcaggctcgagagttggatgtggtatcatcggacttcaatcatctgcggatgctaaactatag

SEQ ID NO: 72 - DNA, 1326 bp, Arabidopsis thaliana
atgaatcggagacagcaagtgaaacgtagagtaggtaaatatgaagttggaagaacaattggagaaggaacgtttgctaaagttaagtttgctagaaactctgaaactggagaacctgttgctctcaagattcttgataaagagaaagttctcaagcataaaatggctgaacagattagaagagagatagctactatgaagttgataaaacatccaaatgttgttcaattatatgaggtgatggcaagtaagacgaaaatatttatcatcttggagtatgttacaggaggagaactctttgataagattgtaaatgatgggcggatgaaagaagatgaggcgcggagatatttccaacagcttatacatgctgtggactactgtcatagcagaggggtctaccatagagacctcaagcctgaaaatttactattggactcctatggaaacctcaagatctcagattttggattaagtgctttgtcccaacaagtcagggatgatggactcttgcatacatcgtgtggaacaccaaactacgttgctcctgaggttctcaatgatagaggctatgatggagcaacagctgacatgtggtcatgcggtgttgtactctatgtcctgcttgcaggttacttaccttttgatgattctaatctaatgaatctttataaaaaaatatcatctggtgaattcaactgtcctccgtggctctcactcggtgccatgaaactcatcactagaatcttagatccgaatccgatgactcgtgtaacaccgcaagaggttttcgaagatgaatggttcaagaaagattacaagccacctgttttcgaggagagggatgattcaaacatggacgatattgatgctgttttcaaggactctgaggaacatcttgttactgagaagagagaagaacagccagcggcgatcaatgccttcgagatcatttcaatgtcaaggggacttaacctagagaatctgtttgatccagaacaggaatttaagagggaaacaaggataacattgagaggaggcgcgaatgagatcatcgagaagatagaagaagctgcaaagcctctcggtttcgatgttcaaaagaagaactacaagatgaggcttgagaatgtgaaggctggaagaaaggggaatctcaatgtagcgacagagatattccaagtagcgccaagtcttcatatggttcaagtatcgaagtcgaaaggagacactctcgaatttcacaagttctataagaagctctctaattctctggagcaagtagtctggacgaataacgaagttaagaaagaaacagcaaagtga

SEQ ID NO: 73 - DNA, 753 bp, Arabidopsis thaliana
atggagatgcaagaggctaatcaaggaggaggatcggaggtttctccgaatcagacgatttacatcaacaatctcaacgaaaaagtgaagcttgatgagctgaagaaatcgctgaatgcagtgttctctcagttcgggaagatactggagatattggcgtttaagacctttaagcacaaaggacaagcttgggtagtcttcgacaacaccgagtctgcttccactgctattgctaaaatgaataattttcctttctacgacaaggagatgagaatacaatatgccaaaacaaaatcagatgttgttgccaaggccgatggtacatttgttcctcgcgagaagagaaagagacatgaggagaaaggaggcggcaagaaaaagaaagaccagcaccatgattctacacagatgggcatgcccatgaactcagcatatccaggtgtctatggagctgcacctcctctatcgcaagtaccataccctggtggtatgaaacccaatatgcccgaggcaccagctccgccaaataatattctctttgtccaaaaccttcctcacgagacaactccaatggtgcttcagatgttgttctgccagtaccaaggatttaaggaagttagaatgattgaagccaaaccgggaatcgcctttgtggagtttgctgatgagatgcagtcgacggtcgcaatgcagggacttcaaggtttcaagattcagcaaaaccagatgctcatcacgtatgccaagaaatag

SEQ ID NO: 74 - DNA, 645 bp, Arabidopsis thaliana
atggcgggttacagagcagatgatgattacgattacctattcaaggtggttctgatcggtgattcaggtgttggaaagtccaatttgctttctcgattcaccaggaacgagtttagtctcgagtctaaatcaacgatcggggtcgagttcgcgactcgtagcttgaatgttaatgaaaaagtcatcaaagcccagatttgggacactgctggtcaagaaagataccgagcaatcactagtgcttactatcgaggagctgttggggcgcttcttgtttacgacgtaacccgacactcaacattcgaaaacgttgagagatggctaagggaactccgtgaccacactgacccaaacatagttgtgatgcttgtgggaaacaaatccgatcttcgccatcttgtagcagtccaaaccgaagatgcaaaatcttttgcagagaatgaatcactctacttcatggaaacctcagctcttgaatctaccaatgttgagaacgcgttttctgaagtactcactcagatttaccatgttgtgagcaagaaagcaatggaggctggtgaagattccggtaatgttccttcgaaaggagagaagatcgatgttgatgtttccgcagtgaagaaaactggttgctgctccaactaa

SEQ ID NO: 75 - DNA, 1104 bp, Arabidopsis thaliana
atgttgaagctttcgtgtaatgtaactgaccatatacacaaccttttctccaactctcgccggatttttgttccggtgcatcggcaaaccagacccatctcttgttttcagttaaagaaggaacctttacgggcaattctctctgctgatcatggaaacagcagcgtccgtgttgctgatactgtttccggtacttctccggcggatcgtctccggtttggtcgattgatggaagatgggttttcttataaggagaagttcattgttagaagctatgaagttgggattaacaaaactgccaccattgaaacaattgctaatctcttgcaggaagtggcatgtaatcatgttcagaatgttggattttctactgatggatttgctacaacacttaccatgaggaaattgcatcttatttgggttactgcaagaatgcacattgagatttacaagtatccagcttggagtgatgtggttgagattgagacttggtgtcagagtgaaggaaggattggaactagacgtgattggattttaaaggattgtgctactggtgaagttattggacgtgctacaagcaagtgggtgatgatgaaccaagacacaaggcggcttcaaagggttacagacgaagttcgggacgagtacttggttttctgtcctccagagcctagactagcgtttccagaggagaacaatagcagcttaaagaaaatcccgaaattggaagatcctgctcagtattctatgcttgggcttaagcctagacgagctgatcttgacatgaaccaacatgtgaataatgttacctacattggatgggtccttgagagcataccgcaagaaatcatagacacgcacgagcttaaagttataactctagattacagaagagaatgccagcaagatgacattgtagattcacttaccacctctgaaacccccaatgaggtggtctcaaagcttactgggacgaacggatctaccacgtcaagcaaacgagaacacaatgagagtcacttcttgcatatcctgaggttgtcagaaaatggtcaggagatcaatcgtgggagaacccaatggcgaaagaagtcatcaagatga

SEQ ID NO: 76 - DNA, 1038 bp, Arabidopsis thaliana
atggaagaactgaaagtggaaatggaggaagaaacggtgacgtttactggttctgtagcggcttcttcatctgtaggatcctcttcctctcctagaccaatggaagggcttaacgaaacagggccaccaccgtttctgactaagacttacgaaatggtggaagatccggcgacggacacggtggtttcttggagtaatggtcgtaacagctttgtggtgtgggattctcataagttctcaacaactctccttccacgttacttcaagcatagcaatttctcaagttttattcgtcagctcaatacttatggattcagaaagattgatccagatagatgggaatttgcaaatgaagggtttttagcaggacaaaagcatctcttgaagaacatcaaaagaaggaggaacatgggtttgcagaatgtgaatcagcaaggatctgggatgtcatgtgttgaggttgggcaatacggtttcgacggggaggttgagaggttgaagagggatcatggtgtgcttgtagctgaggtagttaggttgaggcaacagcaacacagctccaagagtcaagttgcagctatggagcaacggttgcttgttactgagaagagacagcagcagatgatgacgttccttgccaaggcgttgaacaatccgaactttgttcagcagtttgcggttatgagtaaagagaagaagagtttgtttggtttggatgtggggaggaaacggaggcttacttctactccaagcttggggactatggaggagaatttgttacatgatcaagagtttgatagaatgaaggatgatatggaaatgttgttcgctgcagcaatcgatgatgaggcgaataattcgatgcctactaaggaggaacaatgtttggaggctatgaatgtgatgatgagagatggtaatttggaagcagcgttggatgtgaaagtggaagatttggttggttcgcctttggattgggacagccaagatctacatgacatggttgatcaaatgggttttcttggttcggaaccttaa

SEQ ID NO: 77 - DNA, 1197 bp, Arabidopsis thaliana
atgggaggttcgtcggagacaaagatcttacaagaactcatactttacgcggcgagcgctgctttcagctgcttggttctctttgcgggtcttcgtcatctcgatcctaatcgtgaggcttctaaaaaagctctcgagcataagaaggaaatctctaaacgtttgggtcgtcctcttgttcagaccaatccatacgaggatgtaattgcatgtgatgtgataaatccagaccacattgatgtggagtttggttctattggagggttggagaccatcaagcaggctttgtatgagcttgtgattttaccactgaaaagacctgagctttttgcttacgggaagcttcttggacctcaaaaaggtgtcttgctctatggacctcctggtactggaaagactatgcttgctaaggctattgccaaagagtcaggagctgttttcattaatgttagggtttcaaacctgatgagcaagtggtttggagatgctcagaagcttgtttctgctgtgtttagcttggcctacaaactccaacctgctatcatttttattgatgaggttgagagctttcttggtcagcgccgttcaacagatcatgaagctatggccaacatgaagactgagtttatggctttatgggatggattctctactgatccgcatgcaagggttatggttcttgctgcaactaacagaccgtcagagcttgatgaagcaatattaaggcgtcttcctcaggcctttgagattggaatacctgatcgccgggagagagctgagatattgaaagtgactctgaaaggagagagggtggaacctgatattgactttgatcacatagctcgcttatgcgaaggctataccggatcagacatttttgagctatgcaagaaagcagcttacttccctatcagagaaatcctagatgcagagagaaaggggaaaccatgtttggaccctaggccattatcacagttagatttggagaaggttcttgcaacgtcaaagaagacacaagttgcagcaggcgagtactcattgagctcgcagtcctcggcttggagaggctcaagggaaccagatgaggtccaggcagcgataagtgggatctcgaagcttctagtttctcagatcattaacctacagtcagaatctcaggattcatggcagcgggatcccgaagaagattcccgatga

SEQ ID NO: 78 - DNA, 654 bp, Arabidopsis thaliana
atgggagcctacagagccgacgacgactacgattatctcttcaaactagtcttgattggagattccggcgtcggaaaatccaatcttttgtctcgcttcaccagaaacgaattcagcatcgagtcaaagtcaaccatcggtgtcgagttcgccacaagaagtgttcatgtcgacgaaaaaatcatcaaagctcagctttgggacaccgctggtcaagaaagatacagagcaatcacgagtgcatactacagaggagcagtgggggcacttctagtatacgacataactcgacacataacgttcgaaaacgttgaaagatggctcaaggagcttcgtgaccataccgatgccaacgttgtaatcatgcttgttggaaacaaagccgatcttcgtcaccttcgtgcagttcccacagaagaagctagatcattctctgaaagagaaaacatgtttttcatggagacttctgctttggatgctacaaatgtcgaacaagctttcactcatgtcttgactcaaatctatcgtgtaatgagccgtaaagctcttgatggtactggagatccgatgtctttacctaaaggacaaaccattgatatcggaaataaggatgatgttactgctgttaaatcttctggttgttgctcaggttga

SEQ ID NO: 79 - DNA, 1071 bp, Arabidopsis thaliana
atggctctctccatctccatctatttcctcctcatcttcctctctcacttcccatcctcacatgcagagcctttcatcggagttaactacggccaagtcgccgacaatctccctccgccttcagaaaccgtcaagctcctccaatccacttcaattcagaaagttcgactttacggcgccgatcccgccatcatcaaagctttggccggaacaggggtcggtatcgtcatcggcgctgctaacggcgacgttccttctcttgcctccgatcctaacgccgctactcaatggatcaactccaatgtccttcctttttatcccgcctccaaaatcatgctcatcaccgtcggcaacgagattctgatgtcgaacgatccaaatctggtgaaccagctacttccggcgatgcaaaatgtccaaaaagcccttgaggcggtgtctctcggcgggaaaatcaaggtctcgacggtgaactcgatgacggtgctcggtagttcagacccgccatcgagcggttcatttgcggccggttatcaaaccggtttaaagggaattttgcaatttctaagcgacactggttcgccttttgctattaacccgtacccgttcttcgcgtaccaaagtgacccgagacccgaaacgctggcgttttgtctctttgagcctaacgccggacgagtcgactccaaaaccggaatcaaatacacgaacatgttcgatgctcaggttgatgcggttcactcggctttgaaatcgatgggattcgagaaggtggagattgtggtggcggaaacaggttgggcgtcaagaggggacgctaacgaggttggagcaagcgtggataacgccaaagcgtacaacggaaacctaatagctcatctaaggtctatggttggcacacctctcatgcctggaaaacctgttgacacttacattttcgcactgtatgatgagaatctaaagcctggaccatcttcagaacgggctttcgggcttttcaaaactgatctttccatggtctatgatgttggccttgccaagagtagcagcagtagtcaggttagatactag

SEQ ID NO: 80 - DNA, 1440 bp, Arabidopsis thaliana
atggacccgtctcgtcatactcatgtgatgctcgtatctttccccggccaaggtcacgtaaaccctctacttcgtctcggaaagctcatagcctctaaaggcttactcgtcacctttgtcaccacagagaagccatggggcaagaagatgcgtcaagccaacaagattcaagacggtgtgctcaaaccggtcggtctaggtttcatccggtttgagttcttctctgacggcttcgccgacgacgatgaaaaaagattcgacttcgatgccttccgaccacaccttgaagctgtcggaaaacaagagatcaagaatctcgttaagagatataacaaggagccggtgacgtgtctcataaacaacgcttttgtcccatgggtatgtgatgtcgccgaggagcttcacatcccttcggctgttctatgggtccagtcttgtgcttgtctcacggcttattactattaccaccaccggttagttaagttcccgaccaaaaccgagccggacatcagcgttgaaatcccttgcttgccattgttaaagcatgacgagatcccaagctttcttcacccttcgtctccgtatacagcttttggagatatcattttagaccagttaaagagattcgaaaaccacaagtctttctatcttttcatcgacacttttcgcgaactagaaaaagacatcatggaccacatgtcacaactttgtcctcaagccatcatcagtcctgtcggtccgctcttcaagatggctcaaaccttgagttctgacgttaagggagatatatccgagccagcgagtgactgcatggaatggcttgactcaagagaaccatcctcagtcgtttacatctcctttgggactatagccaacttgaagcaagagcagatggaggagatcgctcatggcgttttgagctctggcttgtcggtcttatgggtggttcggcctcccatggaagggacatttgtagaaccacatgttttgcctcgagagctcgaagaaaagggtaaaatcgtggaatggtgtccccaagagagagtcttggctcatcctgcgattgcttgtttcttaagtcactgcggatggaactcgacaatggaggctttaactgccggagtccccgttgtttgttttccgcaatggggagatcaagtgactgatgcggtgtacttggctgatgttttcaagacaggagtgagactaggccgcggagccgctgaggagatgattgtttcgagggaggttgtagcagagaagctgcttgaggccacagttggggaaaaggcggtggagctgagagaaaacgctcggaggtggaaggcggaggccgaggccgccgtggcggacggtggatcatctgatatgaactttaaagagtttgtggacaagttggttacgaaacatgtgacgagagaagacaacggagaacactag

SEQ ID NO: 81 - DNA, 2502 bp, Arabidopsis thaliana
atgggaggaggaagcaataatagtcacaatatggacaacgggaagtacgtgaggtacactcctgaacaagtggaagctctggagagactctacaatgactgtcctaaaccgagctctatgcgccgccaacagctaatccgcgaatgtcctatcctctccaacatcgagcctaaacagataaaagtctggttccagaaccgcaggtgtagagaaaaacagcgaaaagaggcgtcacgacttcaagctgtgaataggaagctaacggcaatgaacaagcttttgatggaagagaatgaccgcttgcaaaagcaagtgtctcacttggtttatgagaacagctattttcgccaacatcctcaaaaccaggggaatttggctaccacagatactagctgtgagtcagtggtgacgagtggtcaacaccacttgacccctcaacatcagcctcgtgatgctagtcctgctggattattgtccattgcggatgaaactttaacagagttcatttccaaggcgactggaaccgctgtcgagtgggtccaaatgcctgggatgaagcctggtccggattccataggaatcgttgctatttctcatggatgcacgggaatcgctgctcgtgcttgcggccttgtgggtcttgatcccacaagggtcgcggagatcctaaaggataagccttgttggttgcgtgattgcagatctctggatatagttaacgtactatccactgcaaatggtggaacccttgaactaatctacatgcagctttatgcgccgacaacactggcaccagctcgtgacttctggatgctacgttacacatctgtaatggaagacgggagccttgtgatatgcgaacgatcactgaacaatacacaaaacgggccaagtatgcctccgtctcctcatttcgttagggcagagattttaccaagtggttacctcattagaccttgcgaaggaggtggatccattcttcacattgtcgatcatttcgatcttgagccatggagtgtgccagaagttcttcgttctctctatgagtcctccactttactcgcccaaagaactacaatggccgctctgcgctatttgaggcaaatatctcaagagatttcacaacctaacgtaacaggttggggaagaagaccagcggctcttagagcacttagccaaaggcttagcaaaggattcaacgaagcagtgaatgggttcagcgatgaaggatggtccatcctagagagtgatggtatcgatgatgtcactcttcttgtgaactcctctcccacaaagatgatgatgacttcaagtctcccatttgccaatggctacacttctatgcctagcgcggtcttatgtgccaaagcttccatgttattacaaaatgttccaccttcgattctgctgcggttcttgagggaacatagacaagaatgggcagacaatagcatcgatgcatattcggccgcagccatcaaagcaggcccttgtagcttaccaatccctcgcccagggagctttggtggtcaagtcattcttcctctagctcacactatagagaatgaagagtttatggaagtcattaagcttgagagcttggggcactaccaagaagacatgatgatgcctgctgatatcttccttctgcaaatgtgcagtggggtggatgagaacgcagttgaatcatgcgcagagcttatatttgcaccaatcgacgcatctttctctgatgatgcaccaatcattccttccggtttccgcatcattcctctagattccaaatcagaggggttgagtcctaaccgaacgctagacctagcgtcggctctagacgtagggagcagaacagccggagattcatgtggaagcagaggaaactcaaagtccgttatgactatagcgtttcagctagcttttgagatgcatatgcaagagaatgtagcctcaatggctagacagtatgtaagaagtgtgatcgcgtcggttcaacgggtcgcacttgctctctctccttcttctcatcagctaagtggcttgcgtcctccacccgcgtcacccgaagctcacactctcgctcgctggatctctcactcttatagatgttaccttggcgttgatcttctcaaacctcatggaactgatcttctcaagtctctttggcaccatcctgacgctgtcatgtgttgctcactcaaggccttatctccggtattcacatttgcgaaccaagctggtttagacatgctggagacgacgttggtggcacttcaagatatcactctcgacaagatcttcgacaacaacaacgggaagaagactttatcctccgaattccctcagatcatgcaacaggggtttatgtgtatggatggaggaatatgcatgtcgagcatgggaagagcagtaacgtacgagaaggctgttgggtggaaagtgttgaacgacgacgaagatcctcattgtatctgcttcatgttcctcaactggtcttttatatga

SEQ ID NO: 82 - DNA, 786 bp, Arabidopsis thaliana
atgaagaacgtaataaagccctcagctattgttcccgaaatcttgtgtacttgtgtcgatcaaacatttgcggcaatcttactgaacactactcttgcctgtcctatctcttctctgcttcactctccgcttgacgagtcatctgtccgtttcattaccggctcacttgtgtctgccatagaagacatacacaagaacgagattctcttcagaggttcatcccccgagttactgatgttggatcaatccggatatctacagattgtagacttcagattcgccaagaaattgtccggggaacgaacatttacaatctgtggaaatgcagattatttagccccagaaattgttcaaggcaaaggccatggttatgcagctgactggtgggctcttggagttttgatctactatatgctagaaggagaaatgccattcgggtcatggagagagagcgagctcgacacgtttcagaagattgcaaaaggccaactaactttccctcgagttctaagctcagaagctgaagatctcatcacaaagttgcttgaagttgatgaaaacctgcggtttggtagccaaggaggtccagaatcaatcaagaaacatccctggttcaatggtcttaaatgggaagctattagtaaccgcgaatttcaagttcctcaagagataatctcgcgaattcatcaccatttggagaatgataacgttctccctctagaaacttctaaatcgcttgacacaacagaagatcaagatgctcaaaactggcttgaagaatggtaa

SEQ ID NO: 83 - DNA, 1158 bp, Arabidopsis thaliana
atggagaaaagagtagagaagagaaggatagtgttggttccacttccattactaggacatttcactccgatgatgcaactcggccaagcccttatcttgaagggattctcaattatagttcctcagggagaattcaatcgagtaaactcttcgcagaagttccctgctgaggagttgaagcttcccaatttcatcttcagtactcaaactgctacacataaagtttgctgcaatgttttaagcaaacttaatgccaagaagtacttgatcgacatggaagagcatgacgtgcaaaacaaggtagtggaaaatatgcatccattaagatacaaagacttaccaactgcaacatttggagaactagaaccttttttggagctctgtagagatgtagtcaacaaaagaacagcctctgctgttatcatcaacaccgtgacctgtctagagagctcgtctctcacaaggctgcaacaagaactccaaattccggtgtatccattaggccctcttcacattacagattcatcgacaggatttactgtgctgcaagaggataggagctgcgttgaatggctgaacaagcagaaaccaaggtctgtcatatacataagtttaggaagcatggttctcatggaaaccaaggagatgttagagatggcttggggaatgttgaatagcaaccaacctttcttatgggtcatccgacctggatctgtctcaggctccgaggggatagagtcattgccagaggaagtcagtaagatggttttagagaaaggatacattgtgaaatgggcaccacaaatagaagtactaggacatccctcagtgggaggcttttggagccactgtggatggaactcaacactcgagagcattgtggaaggagttccaatgatttgcaggccttatcaaggcgagcagatgttaaatgcaatatatctagagagtgtatggagaatagggattcaggtaggaggtgaactggaaagaggagccgtcgagagagctgtgaagaggttgattgtggataaagaaggtgcaagcatgagggagagaacccttgttttaaaagagaagctcaaagcctctattagaggtggaggctcctcatgcaatgcattagatgagcttgtcaagcacttgaagacagagtga

SEQ ID NO: 84 - DNA, 1149 bp, Arabidopsis thaliana
atgacttgccttcttcttcttctcctcctcctcctcttctcctctgccgactctctgacgtcaccatccgacgtgtcagctttaaaagctttcaaagccaccgtgaaacccaactcaatcccaccgtggtcttgtctcgctagctgggactttactgtctccgacccatgtgcttcaccacgtcgaacacatttcacttgcggcatcacttgctcgtctgactccacacgtgtgacccaactcactctcgacccagccgggtacacgggtcgtctcacgcctctcatctccggcctcacagagcttctcacgctcgatctcgccgagaacaacttctacggcctaatcccatcctccatctcctccctcaccagcctcaagaccttgatcctccgatccaactcgttttccgggtcattacccgactcagtaactcgactcaactcactcgaatccattgacatatctcacaactctctcaccgggccgcttccaaaaacaatgaactcgctttcaaatctccgacaactcgatcttagctacaacaagctcaccggagccatcccaaagcttccgaaaaacctcatcgatttagctttaaaggcgaatactttatcaggacccatctcaaaagactcattcaccgagtcaactcagctcgaaatcgtcgaaatcgctgagaactcattcaccggaacactcggagcttggttcttcctacttgaatcaatccaacaagtcgatctagcgaacaacactctcacaggcatcgaagtcctccctccaaacctcgccggagaaaacaacctcgtagctgtagagctaggattcaaccaaatcagaggaaacgctccggcgagtttcgcggcgtatccaagactttcttcactatctatgagatacaacgtgcttcacggtgttataccgtcggaatacgaacggagcaagacattaagacggctttacttagacgggaacttcttgacgggaaaacctccggcgagatttgtgagaacagacgcagaagtaatgggaagtttggggaataattgtctacagggatgtccagggaaagctaagatgtgtgctccatcgcagaaaccattttacatttgtaagcaagcttatggtggaaaaccaaagtcttag

SEQ ID NO: 85 - DNA, 1371 bp, Arabidopsis thaliana
atggcgaccaacgcagatccagctccgacgaagaaaccaaggaacagtagaaaggcgttgaagcagaagaatgagctcgtggagacgccaccatcgcctgtctccgtcaaggggaagtcagcgaagtctttcgagcaagatctgatggagatgcagacaatgttggagaagatgaagatcgagaaggataagacggaggagttacttaaggagaaggatgagattctgagaaagaaggaggaggagctagagaccagagacgctgagcaggagaagctcaaggtggagctgaagaagcttcagaagatgaaggaattcaaacctaacatgacttttgcttgcggtcagtcatctctcacacaggctgagcaagaaaaggcgaataagaagaagaaaaaggattgtcctgagacaaagcgaccatcgtcctcatacgttttgtggtgtaaagatcaatggactgaagtcaagaaggaaaaccctgaggctgacttcaaggagacttcgaacattctgggggctaaatggaagtctcttagtgcagaagataagaagccttacgaggaaaggtaccaggttgagaaagaagcttacctccaggtcattgctaaggagaagcgcgagaaggaggccatgaagcttctggaggatgaccagaagcagagaactgcaatggaattgcttgatcagtatctcaactttgtccaggaagctgaacaggacaacaagaagaagaacaagaaggagaaggaccctctgaagccaaaacatcccgtatctgccttccttgtttatgcaaacgagaggagagctgctttacgcgaagaaaacaaaagcgtcgtggaggtcgcaaagatcactggagaggagtggaagaacttgtcagacaagaaaaaggcaccctacgagaaggtggcaaagaagaacaaggagacatacctgcaagcaatggaggaatacaagaggacaaaggaagaagaagccctgagtcagaagaaagaagaagaggaactcttgaaactccacaaacaagaagctcttcaaatgcttaagaagaaggagaaaactgataatctgatcaagaaggagaaggcgaccaagaagaagaagaacgaaaacgttgaccctaacaaaccaaagaagcctgcttcttcatactttctcttcagcaaggacgaaaggaagaaattgacagaagaacgtcccgggacaaacaacgctactgttactgctctcatttcactgaaatggaaggaattgagtgaagaagagaagcaagtttacaacggaaaggccgcaaaactgatggaagcatacaaaaaggaagtggaagcttacaacaagaagtctgcggctactaccagtagctag

SEQ ID NO: 86 - DNA, 1926 bp, Arabidopsis thaliana
atggctgttcccacgggaagcgccaatctctttctccggcctctcatcctcgccgttctctcctttcttcttctctcttcattcgtctcctctgttgagtggctcgatatcgattcctcagatctcaaagctcttcaggtcatcgaaacagagctcggagtcaacagtcaacgttcttcggccagtgatgtcaacccttgcggtcgccgaggagttttctgcgagagacggcactctgccaccaccggagaatacgttctccgtgtcacgaggctcgtctaccgatccaggagcttgacggggactatctctccggtcatcggaatgttgtcggagctcaaggaacttactttgtctaataaccagttggtcaacgctgttccggtggatatcttaagctgtaagcaacttgaagttcttgatcttcggaaaaatagattttccggtcagattccgggaaacttttctagtttgagccgtcttcgaatccttgatctctcttcgaacaagttatccgggaacttgaatttcttgaagaatctacgcaatctggagaatctctctgttgcaaacaatctcttctcaggcaaaatcccggaacaaattgtgtcgttccacaatctccggttctttgatttctccggaaaccggtatttggaaggtccggctccggttatgagcagtatcaagcttcagacatctccacatcaaacaagacacattcttgctgaaactccaacttcaagtcccacgaacaaacccaacaacagcactacatcaaaagctccaaagggagctccaaaaccagggaagttgaagaagaagaagaagaagagcaagaagaagaaagtagcggcatggatcttagggtttgtcgttggagccataggaggaacaatctctgggtttgtcttctcggtgttgttcaaattgattattcaagcaataagaggatcagaaaaaccaccaggtccttccatattcagcccattgatcaagaaagctgaagatttagctttcttggagaatgaagaagcgttagcttctctggagatcataggaagaggaggttgtggagaagttttcaaagctgaactaccaggaagcaatgggaagatcatagctgtgaagaaagtgatccaaccgcctaaagacgccgatgaactaacagatgaagattccaagtttctgaacaagaaaatgaggcaaattagatccgagatcaacacagtcggccatatccggcaccggaatcttctcccattgttagcacacgtgtcaagacccgagtgccactacctcgtttacgagtacatggaaaaggggagtttgcaagatatattgactgacgtacaagctggaaatcaagaactaatgtggccagcgaggcacaagattgctttaggtatagctgcagggcttgagtaccttcacatggatcataacccacgaatcattcacagagacttaaagccagccaatgttcttcttgatgatgacatggaagccagaatttcagatttcggactggcaaaggcaatgccagatgcagtcacacatattacaacctcgcatgttgcaggtactgtgggatacatagcaccagagttttatcaaacccacaagttcacagataaatgtgatatctatagttttggagtgattcttgggattctggtgattgggaagcttccttcagatgagttttttcagcatactgacgagatgagtctgataaagtggatgaggaacataataacatcggaaaatcctagccttgcgattgatccgaagttgatggatcaaggattcgatgaacagatgcttctggttctgaagatcgcctgttactgtactttggatgatccaaaacagaggccgaacagtaaagatgtcaggaccatgttgtcccagatcaagcactag

SEQ ID NO: 87 - DNA, 1323 bp, Arabidopsis thaliana
atgagtttcttcaaatgggtttcttttgttttgatccttcacttgcttaatccgactctgatttcatgttcctctaatgggttatctcaaataccttcaaagtttcttactttggctaaaaggaatgattttttcgattggatggttggaatcagaaggagaatccatgagaatccagagttaggttatgaggaagtagagacatctaagcttgttagagcagagttggagaagatgggtgtttcttataagtacccagttgctgttactggtgttgttgggtatgttggaactggtcatgctccttttgttgctttaagggctgatatggatgcacttgctatgcaggaaatggtggaatgggaacacaagagtaaggttccagggaagatgcacgcttgtggacatgacgctcacactacgatgcttctcggtgctgcaaaattgctcaaagaacatgaagaagagctacagggcacagtggttctagttttccaaccagctgaggaaggaggaggaggtgcaaagaagattgtggaggctggagtgttggagaatgtgagtgcaatctttggattacatgtcacaaatcaattggcattaggtcaagtgagctcgagagagggtcctatgttggctggtagtggctttttcaaagctaagataagcgggaaaggaggccacgcagctcttccgcagcataccatagatccgatactggcagcttcaaatgttattgttagcttacaacacctcgtttcacgagaggcagatcctttagactctcaggtggttacagttgctaaatttgaaggcggtggtgctttcaatgtgattcctgactctgttactatcggtggtacattccgagctttttcaactaaaagctttatgcaactcaagaaaagaattgagcaggttatcacaaggcaagcgagcgtgaatatgtgtaatgcaacagtggatttcattgaagaggagaaaccttttttcccaccaactgtaaatgacaaagccttacaccagtttttcaagaacgtttcaggcgatatgttagggattgagaattacgtcgagatgcaaccattaatgggatcagaagatttctctttctaccaacaagcaatcccgggacattttagcttcgttggaatgcaaaacaaagctcgttcaccaatggcgagccctcactcgccgtactttgaagttaacgaagaattactaccttatggtgcttcccttcatgcttccatggccacaagatatcttcttgaactaaaagcttcaactctaaataagagtaacaaaaaagatgaactttga

SEQ ID NO: 88 - DNA, 657 bp, Arabidopsis thaliana
atgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataa

SEQ ID NO: 89 - DNA, 774 bp, Arabidopsis thaliana
atggctattaaactagcaattctatttaccacatttgttctttttagcctcgccgacgctagaatccccggtatttactccggcggcgcatggcaaaacgcacacgccactttttacggtggcagcgacgcctccggcacaatgggaggagcttgtggttacggtaacctatacagccaagggtacgggaccaacacggctgctttgagtacggcgctgtttaacaatggtatgagttgtggagcctgctttgagctaaaatgcgccaacgaccctcaatggtgtcactcaggtagtccttcgatcctcatcaccgcaaccaatttctgcccaccaaacttggctcagcctagcgacaacggaggatggtgcaacccaccacgtgaacactttgacctagccatgcctgtcttccttaagatcgctcaatatcgcgccggcattgtccccgtctcataccgcagggtgccatgtagaaagagaggaggcataaggttcacaatcaacggtcaccgttacttcaacttggttctgatcactaacgtggctggagcaggagacatcgtgagggctagtgtgaaaggatcacggactggttggatgagtttgagcagaaactggggacaaaactggcaatctaatgctgttttggttggtcaagcactctctttccgtgtcacaggcagtgaccgtagaacatctacttcctggaacatggttccttctaactggcagtttggtcaaacctttgtcgggaagaatttcagggtttaa

SEQ ID NO: 90 - DNA, 864 bp, Arabidopsis thaliana
atggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaa

SEQ ID NO: 91 - DNA, 753 bp, Arabidopsis thaliana
atggctcttgtcaccttcttgtttattgctacccttggagcaatgacgtcacatgtcaatggttacgccggaggaggttgggtcaacgcacacgccacattctacggtggtggtgatgcttccggcacaatgggaggtgcttgtggatacggaaacctatatagccaaggctatggaaccaacacggcggcgctaagcacggctctattcaataatggtctaagttgtggtgcttgcttcgagataagatgtcaaaacgatggaaaatggtgtcttcctggctcaattgtcgtcacagccacaaacttttgccctcctaacaacgccttaccgaacaacgcaggaggttggtgtaaccctcctcagcagcattttgatctctctcagcccgtatttcaacgcatcgctcaatacagagccggcattgtccccgtcgcttaccgaagagtgccgtgcgtgagaagaggaggaataaggtttacgataaacggacactcttacttcaacctagttctgatcactaacgtcggaggagccggagatgttcactcagcgatggttaaaggttcaagaactggatggcaagcgatgtcaagaaactggggacagaactggcagagtaactcttaccttaacggacaatctctctcattcaaagttacaacaagcgatggccaaaccattgtctctaacaacgttgctaacgcaggctggtctttcggccagaccttcacaggtgcgcagctacgttag

SEQ ID NO: 92 - DNA, 1557 bp, Arabidopsis thaliana
atggaacttataagcacaatcaatctcttaacaatcgttcttctactcttcgttgtttccaagatatggaaagcttgttggatcctccttttgcgtccattgatgctatcaaaaagattcaagaaacaaggaatctcaggaccaaagtacaaaatcttgtacggaaacctcagcgagataaagaagatgaagaaagaagctgacctttgtgttctggatcccaattccaatgatattttccctcgtgtgtttcctcagtatcaccaatggatgtctcaatacggagatacatttctattctggactggaacaaaaccaactatatacatctcaaatcatgagctagcgaaacaggtcttgtcgagcaagttcggtttcactattataccggtgaaacgacctgaggtcttcatacttttcggtaaaggactttcctttatccaaggtgatgattggattcgccatagacgaatcttgaaccctgctttctccatggatcggctcaaggccatgacacaaccgatgggagattgcaccttacggatatttgaggagtggagaaaacagagaagaaatggtgaagtgttgatcaagattgagataagcaaagagttccataaactgaccgctgacattatagcaactactgcgtttggaagtagttatgccgaaggaatcgaattgtgtaggtcacaaacagagcttgagaagtattatattagttctctcactaacgttttcatccccggaactcaataccttcctacgcctaccaaccttaaactatgggagctccataagaaagtgaagaactcgatcaaaagaatcatagattcaaggctaaaatcaaaatgtaagacctatggctatggggacgatcttctaggggtcatgttgactgctgcgaaatctaacgagtatgagagaaagatgagaatggatgagatcatagaggaatgcaagaatttctactatgcagggcaaggaactacttcgattctattgacatggactacgatgttactaagcttgcaccaaggttggcaagagaaactcagagaagaggtttttaatgaatgtggtaaagataaaatcccagatacagacaccttctctaaactcaaattgatgaacatggtgttgatggagtcgcttcgtctgtacggacccgtgattaaaatttcccgagaggcaacacaagatatgaaggtaggacacttggagatcccaaagggcacaagcattatcataccgttactgaagatgcacagagacaaggccatatggggcgaagacgccgaacaattcaatcccttgagattcgaaaacggcatttctcaagccaccattcacccaaacgctctcctcccgttctcaatcggaccaagagcttgcattgccaaaaactttgccatggtcgaagccaagaccgttctcactatgatccttcaacagttccagcttagcctctcccccgagtataagcacacgccagttgatcacttcgatctcttcccgcaatacggcctacccgtaatgcttcaccctctcggatag

SEQ ID NO: 93 - DNA, 2982 bp, Arabidopsis thaliana
atgcctcctcacggtcctaattctcaaggtggtcgtcgaggcggaggtcattcctccggtcgtcgtggtggacgcggcggcggcggtcgtggcggtggtggtggcggccggggggaacagcgatggtgggatcctgtgtggagagctgagcgtttgcgccagcaacaagctgagatggaagtacttgatgagaatgaatggtggaacaagattgagcaatggaaaacaggaggagaacaagagatgctaattaagcgtaattttagccgtggagatcagcaaacactttctgatatggctttgcagatgggtctttactttcatgcgtacaataaagggaaggctcttgttgttagcaaagttcctttaccagattatcgagcggatcttgatgaacggcatggatccactcagaaagagattaaaatgtccacagagactgagagaaaacttggaagtcttttgaaaacaacacaagaatcagggtcctctggtgcctctgcttcagcttttaacgatcaacaggatcgtacttcaactcttggcttgaaaagacctgattctgcttccaaattgccggattctcttgagaaagaaaaattcagttttgcactcaaggaaaggcaggaaaagcttaaggcaactgagagtgtaaaagcacttaaagcgttcagagaaaagctacctgcttttaaaatgaaagaggagtttcttaactctgtttcacaaaaccaggtattggtagtttcaggagagaccgggtgtggtaaaacaacacagcttcctcaatttatattggaagaagaaatatcatccctaagaggtgctgattgcaacataatttgcactcaacctcgacgtatatcggccatatctgttgcttctcgtatatctgctgaaagaggtgaatccattggtgaatctgtgggttatcagattcgtctagaatcaaagcgttctgatcaaacacgattgctattttgcactactggtgttttactccggcggctggatcctaatctaactaacgtaagccatttgctcgtggatgagattcacgaaagaggcatgaatgaagattttctactaatcatactacgcgatctccttcctcgacgcccagatttgcgtcttattctgatgagtgctacgattaacgctgacatgttctcaacatactttgggaactctcccactatgcacatcccgggtttcacatttcctgtggcagagttattcctagaagatgtattggagaaaagtcgttataatattaagtcgtctgactcggggaattatcaaggtagttcgagaggtagaagaagagaatcagaatccaagaaagatgatctgactactctttttgaggatattgacatcaattctcactataaaagttatagctcggccacaagaaattctcttgaagcatggtctggtgcacagattgatgtggatctggtggaggcaacaattgaacatatttgtcgtcttgaaggtggtggggcgattcttgtcttccttactggctgggatgagatttcaaaactgcttgaaaaaattaacatgaacaactttcttggagattcgagcaagttcttagttcttcctttacatggttcaatgccgacggttaatcaacgtgaaatttttgaccgtccacctcctaacaaacggaaaatagttttggctacaaacattgccgagagtagtattacaattgatgatgttgtatatgttgtggattgtggtaaagcaaaggaaactagctatgatgctttgaacaaggtggcatgtctcttgccatcatggatatcaaaggcttcagctcaccagagacgaggtcgtgctggacgtgttcaagctggagtttgttataggttgtatccaaaagttatctatgatgcttttccacagtatcagttaccagaaatcatacggactccattacaagagctatgcctgcatatcaaaagtttgcaagttggatctataggctcattcttggcaaaggcactgcagccaccagatgcacttgctgttgagaatgctattgaacttctcaaaacaattggggctttaaatgacgtggaagagcttacaccccttggtcggcatctttgcactctacccgtggacccaaatattggaaagatgcttctgattggagctatcttccagtgcgtcaatcctgctttgacaatcgctgctgctctggcgtatcgtagcccatttgtcttaccattaaataggaaagaggaagctgatgaagccaaacgatattttgctggtgattcctgcagtgatcacattgctcttcttaaggcatatgagggatatcgggatgcaaagcgtggtggaaacgaaaaagatttttgttggcaaaactttctttcccctgtaactctaaggatgatggaggatatgagaaaccagtttcttgatcttctatcagatatagggtttgtagacaaatcaaagccaaatgcatacaaccaatatagctacgatatggagatgataagtgcggttctatgtgcggggctgtacccaaatgttgtccaatgcaaaagaagagggaagcgcactgcgttctatactaaagagctgggtaaagttgatatccaccctggatctgtcaacgcaagagtgaatctcttctctttgccgtacttggtctacagcgaaaaggtgaagacgacaagtgtttatatccgagactcgacaaatatatcagactatgcactccttatgtttggtggcaatcttatcccaagcaaaaccggggaaggtatagagatgttgggagggtatctccatttctcagcctcgaagaacatcttagaactgatacagagattgaggggagaggtggacaagctactgaataagaagatagaggatccgagtttggacataacagtggaggggaaaggagtggtctcagctgtggtggagttgttacgtagccaaaaacattag

SEQ ID NO: 94 - DNA, 4200 bp, Arabidopsis thaliana
atgagtaactctgtagtgcataacttacttaaccggggtttgattcgtcctcttaactttgaacatcaaaacaagctcaactcctctgtgtaccaaacttcaacagcaaatccggctcttggcaagattggcagatcaaaactttacgggaaaggtcttaagcaggcaggacgcagtctggtcactgaaacaggaggaagacctctctcatttgttccacgagctgtccttgccatggatcctcaggcagccgagaaatttagtcttgacggaaatatcgatttactggttgaagtcacttctacaactgtaagagaagtaaatatccagatagcttatacaagtgacacattgttcctacactggggtgcaattcttgacaacaaagaaaattgggttctaccttctcgctctccggatagaactcaaaacttcaagaacagtgcgcttagaactccatttgtgaaatccggtggcaattctcaccttaaactagagatagatgatcctgccatacacgctattgagttccttatatttgacgaaagtcggaacaaatggtataaaaataatggtcagaattttcatataaacttaccaacggaaaggaatgtgaaacaaaatgtttctgttcctgaagatcttgtacagatccaagcatatcttagatgggaacgtaagggtaaacaaatgtacaaccctgagaaagagaaggaggagtatgaagccgcccggacggagctacgggaggaaatgatgcgaggtgcttcagtggaagatctcagagcaaagctgttgaagaaagataacagtaatgaatccccaaaatctaatgggacatcatccagtggacgggaggaaaagaaaaaagtttccaagcaaccagagcgtaaaaaaaattataacactgacaagatccagcgcaagggaagggacctgactaagcttatctataagcatgttgctgattttgttgaaccagaatccaaatcctcatctgaaccacggtccttaacaactctggagatatacgccaaagcaaaggaggaacaagaaaccactccagtctttagcaagaaaacattcaagcttgaaggcagtgcgattttggtgtttgttactaaactttccggaaagacgaaaattcatgtggcaactgattttaaagagccggttacccttcactgggctttgtctcaaaagggtggagaatggttggacccaccttcagatatactgccaccaaactctttgccagtacgtggtgctgttgatacaaaactgaccatcacttcaacagatcttcctagtccggttcaaacttttgagctggaaatagaaggtgacagctacaagggcatgccgtttgtactcaatgctggtgaaaggtggattaaaaataatgacagtgacttttatgtggactttgctaaagaagaaaaacatgttcagaaggattatggcgatggaaagggtacagccaagcatttactggacaaaatcgcagatttggagagtgaggcccagaagtctttcatgcatcgattcaacattgcagcagatcttgtggacgaggcaaaaagtgctggtcaactgggctttgcagggatcctagtctggatgaggtttatggctacaagacagcttgtgtggaacaaaaactataatgttaagccaagggagataagcaaagcgcaggatagactgactgaccttctccaggacgtttatgcaagttatccagagtacagagaacttttgcggatgataatgtctactgtaggtcgaggaggtgaaggagatgtcgggcaacgaatccgtgacgaaattctagtcatccagcggaaaaatgactgcaagggtggaattatggaggaatggcatcagaagttgcataacaacactagtccagatgatgttgtcatctgtcaggcattgatggattatatcaaaagtgactttgacttaagtgtttactggaagaccttgaacgataatggcataaccaaagagcgactcttaagttatgatcgtgctatacattctgaaccaaattttagaggagaacaaaaagacggtcttttgcgtgatcttggacactacatgaggactttaaaggctgttcattcaggggcagaccttgagtcggctatacaaaattgcatgggctaccaagatgacggtgaaggtttcatggttggggtgcagataaatcctgtatcaggattgccttctggatatccagacttgcttcgtttcgtcctagaacatgttgaagaaaagaatgtagagccacttcttgagggtttgcttgaagctcgtcaagagctaaggccacttctgctgaagtcccatgaccgcctcaaggatctgttattcttggacctcgctcttgattctactgtcagaacagcgattgaaagaggatatgagcaattgaatgatgctggacctgagaaaatcatgtacttcatcagcctagttcttgaaaatcttgccctctcttcagatgacaatgaagaccttatatactgcttgaagggatggcaatttgccctcgacatgtgcaagagcaaaaaagatcactgggctctgtatgcaaaatctgttcttgacagaagccgactagcactggcaagcaaagctgagaggtaccttgaaattctgcaaccatcggctgaatatcttggatcttgtcttggagtcgatcagtcggctgttagtatatttactgaagagatcattcgagctggatctgcagcagcattgtcgtcacttgttaaccgacttgacccagttcttaggaagactgctaacttgggaagttggcaggttattagtcctgtagaggtcgtcggatatgtcattgttgtggacgaattgctcactgtacagaataaaacctacgatagacctacaattatagttgcaaacagagtgagaggagaggaggaaatccctgatggtgcagttgcggtactgacacctgacatgccggatgtactatctcatgtttctgttcgagcaagaaatggaaagatctgctttgccacatgttttgattctggtatcttatctgacctccaaggaaaagatggaaaactgttgagcctacaaccaacctctgcagatgtagtctataaagaggtaaacgatagtgagctttcgagtccaagttcagacaacctggaagatgcccctccaagtatttctttggtcaagaaacagtttgcgggtagatatgctatatcatctgaggagttcacaagtgacttggttggtgctaaatcaagaaatatcgggtatctgaaaggaaaagttccttcttgggttggtatcccaacttcagttgcgttgccatttggtgtttttgagaaggttatctccgaaaaggcgaatcaggcggtgaacgataaattgctagtattgaagaaaactcttgatgagggagaccaaggtgctctgaaggaaatccggcagacactgttggggctagttgcacccccagaactggttgaagaactgaaaagtactatgaaaagttctgacatgccatggccgggtgatgaaggtgaacagagatgggagcaagcttgggcagccattaaaaaggtctgggcttcgaaatggaacgagagagcatacttcagcacgaggaaagtaaaactggatcatgactatctctgcatggctgttttggtccaagaagtcatcaatgcggattacgcattcgtcattcacacaactaatccatcttctggagattcatcagagatttatgccgaggtggtcaaaggccttggggaaactcttgtaggagcatatcccggtcggtctctgagtttcatctgcaagaaaaacaaccttgattcgcctctggtgttgggctacccaagcaaaccgattgggctgttcataagacgttcaatcatcttcagatctgattccaatggagaagatcttgaaggttatgcaggtgcaggcctctacgacagtgtaccaatggacgaggaagaccaagtcgtgctcgattacacaacagatcctctgatcactgacttgagcttccagaaaaaggttctctcagacattgcacgcgctggagatgccattgagaaactctatggaactgcacaggacattgaaggtgtgatcagagacgggaagctctatgtcgtccagacacgaccacaagtgtga

SEQ ID NO: 95 - DNA, 1659 bp, Arabidopsis thaliana
atgactatggagcaagaaattgaagtcttggaccagtttccggttgggatgagagttcttgctgttgacgatgaccagacttgtctccgtattctccagactttgcttcagcgctgccaatatcacgttacaacaacgaatcaggcacagaccgcattggagttgttgagggagaacaagaataagtttgatcttgttattagcgatgtcgacatgccagacatggatggtttcaagctgcttgagcttgttggtcttgaaatggacttacctgtcataatgttatctgcgcatagcgatccaaagtatgtgatgaaaggagtcaagcacggtgcctgtgattatctgcttaaaccggttcgaattgaggagcttaagaacatatggcaacatgttgtgagaaagagcaaacttaagaagaataagagcaatgtgagtaatggttcaggaaactgtgataaagcaaacagaaaacgtaaagaacagtatgaagaggaggaagaggaagaaagagggaatgataatgatgatccaacggcgcagaagaagcctcgtgttctttggacgcatgagctgcacaataaattcctagcagctgttgatcatttaggcgttgagagagctgttccaaaaaagattctagatctgatgaatgttgacaaactcactagagagaatgttgcaagccaccttcagaaattccgcgttgctctgaagaaggtgtctgatgacgccattcaacaagctaacagggcggctattgactcacattttatgcaaatgaattctcagaaaggacttggtggcttctaccaccaccaccgcggaatacctgttggatccggtcagttccatggtggaaccacaatgatgaggcattactcttcaaataggaatcttggtcgtctgaattcccttggagcaggaatgttccaaccagtctcatcatcgtttcctcgtaaccataatgatggaggaaacatacttcagggtttgccgctagaagagcttcagatcaacaacaacatcaacagggcttttccaagctttacttcacaacaaaactctccaatggtagctcccagtaatctgttacttctcgagggtaacccgcagtcatcatctttaccctcaaacccgggtttttctcctcatttcgagatcagcaagcgtctagaacattggtcaaacgctgcattgtcaaccaacattccacagagtgatgttcattcaaaacctgacaccttggaatggaatgcgttctgcgactcagctagtccgctagtaaacccaaacctggatacaaatccggcatctctctgcagaaacacgggttttggatccacaaatgctgcacaaacagacttcttttatccattacagatgaatcagcagcctgcaaacaactcaggtccagtgacagaagctcaactgtttagaagtagcaatccaaacgaaggtttactcatgggacaacagaagcttcagagtggtttgatggcttctgatgctggttccttagatgatatagtcaattccttaatgacacaggaacagagccaatctgatttctcggaaggtgattgggatttggatggtttagctcactcggaacatgcatacgagaaactccattttcccttttctttgtcagcttga

SEQ ID NO: 96 - DNA, 1437 bp, Arabidopsis thaliana
atgtccgtttcaacacatcaccaccacgtggtcctcttccctttcatgtcaaaaggccacatcatccctctcctccaattcggtcgtctcctcctccgtcaccaccgcaaagaaccaaccatcaccgtcaccgttttcaccactcccaagaaccaacctttcatctcagacttcctctcggatacgccggagatcaaagtcatctctctccctttcccggaaaacatcaccggaatccctcccggcgtcgagaacaccgaaaagctcccatccatgtcacttttcgtccccttcacacgcgccacgaagcttctccaacctttcttcgaagaaacactcaagactcttccaaaagtttcgttcatggtctctgatggattcctctggtggacatcggagtctgcagctaagttcaacattccaagatttgtctcctacggcatgaactcttactccgccgctgtctccatctctgttttcaaacacgaactctttaccgaaccggaaagtaaatctgataccgaaccggtcactgtaccagactttccatggatcaaggtcaagaagtgtgatttcgaccatggcactaccgagccggaagaatcaggtgcagccctcgaactatctatggaccaaatcaagtcgaccaccacaagccatgggtttttagtcaatagcttctacgagctcgagtcagcatttgttgattacaacaacaactctggtgataaaccaaagtcgtggtgtgttgggccactgtgtttgacagatcctcctaaacaggggagtgctaaaccggcttggattcattggttggatcagaagcgagaggaagggcgtccggttttgtacgtggcgtttggaacgcaggcagagatatcgaacaagcagcttatggaactagctttcggcttggaagattcaaaggtgaactttctgtgggtcacaagaaaagatgtggaggagattattggagaaggattcaacgatagaataagagagagtgggatgatagtgagagattgggtggaccaatgggagatattgtcacatgaaagtgtcaaaggatttttgagccattgtgggtggaactcagcacaagagagcatatgtgtcggggtcccattgttggcttggccgatgatggccgagcaaccgctcaatgcgaagatggttgtggaggagataaaggtgggagtaagagttgaaacggaagatgggagtgtaaaaggttttgtgacaagagaagaactaagtggaaagattaaagaactgatggaaggagaaacggggaaaaccgcaagaaagaatgtaaaagaatattcgaaaatggcgaaagcggctttggtcgaagggactggttcgtcatggaagaatttagatatgattcttaaggagttatgtaagagtagagattcaaacggtgctagtgagtag

SEQ ID NO: 97 - DNA, 1824 bp, Arabidopsis thaliana
atggcgatatcagtacaacacgtcgtcgttttactcctctccactctcctcatcgccatcaccttcttcctcttcacctccgataacgccagattccctttcccttctctctccaccaccgattactacacaccaatcccaaaatctccaattcctcaccgaatcgtcgacgtttcttcagatcaaactccacagaagatgaagctaaacacttccctcgaggtgggagagctgaaatgggatctatgtaaaggtgcagaatctgttgattacataccttgtcttgataattacgctgccatcaagcagctcaaatcaaggagacatatggagcatcgagaacgtcattgccctgaaccaagtcctaaatgtctccttcccttgcctgataattataagccgccggttccgtggcctaagagccgggatatgatttggtatgacaatgttcctcatcccaagcttgttgaatacaagaaggaacaaaattgggttaaaaaagagggtgaatttctagtttttcctggaggaggtactcaattcaaattcggggttactcattacgttgagttcatcgaaaaggcgttaccgagtatcaaatgggggaaaaacataagggttgtattagatgttggttgtggtgttgctagctttggcggatctttattagataaagatgtcattacaatgtcgtttgctcctaaagatgaacatgaagctcagattcaatttgcgttagaacgaggaatacctgcaacactttctgttattggaacacaacagctcacgtttccgagcaatgcatttgatcttatacattgtgcacggtgcagagtccattgggatgctgatggtgggaaaccgttgttggagctcaatagggtacttaggccaggaggtttcttcatatggtctgcaacaccagtctatcgagataatgacagagatagcagaatttggaatgaaatggtttctcttactaaatccatttgctggaaggtcgtgacaaagacggttgattcctctggaatcggacttgtgatctatcaaaagccaacatcagaatcctgttataataaacgcagcacacaagatccaccactttgtgataaaaaggaagcaaatggttcatggtatgttcctctcgctaaatgcctttccaagttacctagtggaaatgtccagagttggcctgaactatggcctaaacggcttgtgagtgttaaaccgcaaagcatttcagttaaagcggaaacattgaagaaagatacagagaaatggtcagcaagtgtttctgatgtttacctcaaacatctagctgtaaactggtcgactgtgcggaatgtgatggacatgaatgctggttttggcggttttgctgctgcacttataaatctaccactctgggtgatgaatgttgtccctgtggataaacctgacactctctccgtcgtttatgatcgaggcttgatcggagtttaccatgattggtgtgagtccgtcaacacttaccctagaacatacgatctgttacattccagtttcctcctaggtgatctcacacaaaggtgtgagattgtacaagtggtagctgagatagatcggatagtgagaccaggtggatatcttgtggtacaagacaacatggaaacaataatgaagcttgaatccatacttggttcgcttcattggtcaaccaaaatatacgaggaccggtttttggttggtcggaagggattttggcatattaaagttaacgagaataattcttttgccaacaacatatattgttttgagcaaaacaaattgtttcttatatcttag

SEQ ID NO: 98 - DNA, 1002 bp, Arabidopsis thaliana
atggagactctgagtcgtttattggttttcatgtctctgttttccggtttagtttctggatttgctctgcaaaatcttccaatcacatcttttgaagaaagttacactcaactttttggtgacaagaacttatttgttcatcaagatggcaaatctgtccggttaacgctcgatgaaagaaccggttccggttttgtttcaaatgattattacttgcatggattcttcagtgcttcaattaaattaccttctgattatacagctggagttgttgttgccttttatatgtctaatggagatatgtatgagaagaatcatgatgagatagattttgagtttcttggtaacattagagaaaaagaatggagagttcagacaaacatttacggtaatggaagtactcattcaggaagagaagagagatataatctctggtttgatcctactgaagattttcatcaatacagtatcctctggtctgattctcacatcatattctttgtagacaatgttcctattagagaggtcaaacgtactgcggaaatgggtggtcactttccatcaaagccgatgtctctctacacaacaatatgggacggttctaaatgggcaactaacggtggaaagtacggtgtaaactacaaatatgcgccttacattgcgcggttctcggatctagtcctgcacggctgccccgtggaccctatcgagcagtttccgaggtgcgatgaaggcgcggctgaggatatgcgtgcggcgcaagagattactccttcacaaaggagtaaaatggatgttttcagacggagactcatgacatattcatattgctatgatcgggctaggtacaatgttgctttatcggagtgtgtggtgaatcccgctgaggctcaaaggcttagggtttatgatccggtcagatttggcggcattccgaggcgccaccgcaatggaaagcaccggagcaagagaagccgggttgatggaaccgagtcgatatga

SEQ ID NO: 99 - DNA, 1329 bp, Arabidopsis thaliana
atggtggcgatgatcatggcttcaaggtttaaccgggaagctaagctcgcatctcaaatcttgtctacacttttgggaaaccgaagctgctacacatccatggccgccacatcttcctctgctttacttcttaatccgttgacttcttcttcttcttcttctactctccgtcgtttcagatgctcgccagagatctcttctctctccttctcctccgcttctgatttctctctagcgatgaagaggcagagtcggagttttgctgatggttcggaacgagatccgtctgttgtgtgtgaggctgttaagcgcgagactggacctgatggactcaacatcgctgacaatgtgtctcagctcattgggaaaactcctatggtgtacttgaacagtatagcaaaaggttgtgtagcaaatattgctgccaaactcgagatcatggagccatgttgcagtgtcaaggataggattgggtacagtatggttactgatgctgagcaaaaaggatttatatcacctggaaagagtgttcttgtggaacctacaagtggaaacacgggtattggcctagcattcatcgctgcttcaaggggctatagacttatcttgacaatgccagcatccatgagtatggaaagaagggttcttttaaaggcatttggagctgagcttgtattaacagatcctgctaaaggcatgactggagcggttcagaaggctgaagagatcttgaaaaacactcctgatgcatacatgctccaacagtttgacaaccctgcaaatccaaagattcattacgagactactggtcctgagatctgggatgatacaaagggcaaggtggatatctttgttgcaggaattggaactggtggaactatcactggtgttggtcgatttattaaagagaaaaatcccaaaacgcaggttattggtgtagaacccaccgaaagcgatatactttctggtggcaaaccgggacctcacaagattcaaggaattggagctggatttatacctaagaatttggatcagaaaattatggatgaagtcatagcgatttcaagtgaggaagctatagaaaccgcaaagcaactagctcttaaggaaggcttgatggttggtatatcatctggagctgcagctgctgctgcaatcaaggtggctaagagacctgagaatgctggaaaactcatagctgtaactgttaatgaatctatgaatgcggtttttcaggttgttttcccgagcttcggggagagatatctatcgaccccgctgttccagtctatccgggaagaggtggagaaaatgcagcctgaggtatga

SEQ ID NO: 100 - DNA, 489 bp, Arabidopsis thaliana
atgatacattttgtgcttctagttagccggcaaggaaaggtaaggctcaccaaatggtattctccttatgcacagaaggaaagatctaaggttatacgtgaactcagtggagtgattctgaatcgaggtccaaagctctgcaattttgttgaatggagaggatacaaagttgtttacaaaagatatgcaagtctctacttctgcatgtgcattgatcaggaggataacgagttagaggtccttgagatcattcatcactatgttgagattctcgatcgctattttggaagtgtgtgtgaactcgatttgatttttaacttccacaaggcatattacatattggatgagctcttgattgctggggagcttcaagagtcaagcaagaaaacagtagccaggattatatccgctcaggatcaactggtggaggttgcaaaagaggaggccagttcgataagtaatataatcgctcaggctactaatcgataa

SEQ ID NO: 101 - DNA, 312 bp, Arabidopsis thaliana
atgatcggaagatctagtcttccggaagttgaagcttctccaccggctgggaaacgagctgttatcaagagtgccgatatgaaagatgatatgcaaaaggaagctatcgaaatcgccatctccgcgtttgagaagtacagtgtggagaaggatatagctgagaatataaagaaggagtttgacaagaaacatggtgctacttggcattgcattgttggtcgcaactttggttcttatgtaacgcatgagacaaaccatttcgtttacttctacctcgaccagaaagctgtgctgctcttcaagtcgggttaa

SEQ ID NO: 102 - DNA, 294 bp, Arabidopsis thaliana
atgaagcgtctgatcccaacgttcaaccgcatcttggtgcagagagtcatccagcccgctaaaaccgaaagcggcattctcctacctgagaaatcctccaagctgaactcaggcaaggtgatagctgttggacctggatcaagggataaggacgggaaattgattccggtctctgtgaaggaaggcgacactgttcttcttccagagtacggtggtacacaggtcaagctcggcgagaacgagtaccatctcttccgggacgaggatgttttgggaactttgcacgaggattga

SEQ ID NO: 103 - DNA, 969 bp, Arabidopsis thaliana
atggatgattcaagctttatggatttgatgatcgacactgacgagtatctgatcgatgactgggaatccgatttcccgatatgcggggaaactaacaccaaccccggttccgagtctggatctggaaccgggtttgagttgctagcagaaagaccaacgaagcaaatgaaaaccaacaacaacatgaattcaacatcttcttctccgtcgtcttcttcttcttctggttctcgcacgtcacaagtgatctcatttgggtctccagacacgaaaaccaacccggtcgagacatctttgaacttctccaaccaagtaagcatggatcagaaagtggggtcgaaaagaaaagattgtgttaacaatggaggaagaagagaaccacatctattgaaagaacatgttttggctgaacgaaaacgtcgacaaaagctcaacgagcgtttgattgctctctctgctcttcttcctggcctcaaaaagacggacaaggcaacagttcttgaagatgccatcaaacatttgaaacaacttcaagagcgggtaaagaagctggaggaggagcgagtggtgaccaagaaaatggatcaatcaattatattggtgaagagatctcaagtgtatttagatgatgattcttcatcttattcttctacttgctctgctgcgtctcctctgtcttcttcttcggacgaagtttcgatcttcaaacaaacaatgcctatgatcgaagcccgagtttcagacagagatttgttgattagagtccattgtgagaagaacaaagggtgtatgattaagatcttaagttccttggagaagtttcgtcttgaagtagtcaatagcttcactttaccatttggaaattcaactctcgttataaccattctcactaaggtatgttatcaatcttctaatatttttttatttatcatattctatctttttttatatattatcatttactgttga

SEQ ID NO: 104 - DNA, 1065 bp, Arabidopsis thaliana
atggatccaaaccaacgtatcgcgagaatctctgctcatctcaatcctcctaatcttcataatcagattgctgacgggtcaggtttgaatcgggtggcttgtcgggcaaaaggtggatcacccggattcaaagtggcgatacttggagcagctggtggaattggacaacctcttgcgatgttgatgaagatgaatcctttggtttcggttcttcatctctatgatgttgctaatgctcctggtgttactgctgatattagtcatatggatactagtgccgttgttcgtggatttctcgggcagccgcagttagaggaagcacttacgggtatggatttagtgatcatacctgctggtgttccgaggaaaccagggatgacgagggatgatctgtttaacattaatgctgggattgtgaggacactctctgaagctatagctaaatgttgtcctaaagcaattgtgaatataatcagtaatccggtgaactccacggtgccaatcgcagctgaggttttcaagaaagctggaacctttgatccaaagaaactcatgggtgtcactatgcttgatgttgttagagctaatacctttgtggcggaagtaatgagtcttgatccccgtgaagttgaagttccggttgttggaggacacgcaggagttacgattttaccactgctttcgcaggtgaaacctccttgctcgttcactcaaaaagagattgaatatctcacagaccgcatccaaaacggtggcactgaagttgttgaggctaaagctggagcaggttctgcaacactatccatggcatatgcagcagtggagtttgcagatgcttgcctcaggggtctacgaggtgatgcaaacatcgttgagtgcgcatatgtggcatcccatgtgactgagcttcccttcttcgcatcgaaggtgcgtctgggacgatgtgggatcgatgaagtgtacggccttggaccattgaacgaatatgagaggatgggattagagaaggcaaagaaagagctttcagtaagtattcataaaggtgttacctttgcgaagaaataa

SEQ ID NO: 105 - DNA, 3507 bp, Arabidopsis thaliana
atggaaaaagaagagctcaacaaattgaatcatctctctctcgtctccaatgtctgcaacgaattggaaacgcatctaggatctgcagaaaaagttttggctgagttcattatcgatctaggtcgtcactctgagacagtcgatgaattcgataagaatcttaaggaagcaggtgcagagatgccggattacttcgtccggtcgttgttaactacaatccacggtatttatcctccgaagcctaagtcggagaagaagaaagaggaaggtgatgatcagaaattcaaaggcttagcgattaaggatactaaggataaagttaaggagctcgagaaagagattgagagagaagctgaggagcgacggagagaagaggatcgaaatagagatagagatcggagagaatccggtagggatagagacagagatagaaatcgtgatcgtgatgatagaagggatcgacatagggatagagagaggaatcgtggagatgaagaaggtgaagatagaagaagtgataggaggcatagagaaagaggacgtggtgatggtggtgaaggggaagataggcgtagagataggcgtgcgaaggatgagtatgtggaggaagataaaggcggtgcgaatgagccggagttgtatcaggtatataaagggagagttactagggttatggatgcaggttgttttgttcagtttgataagtttagaggaaaagaaggtttagttcatgtttctcagatggctactagaagggttgataaggctaaggagtttgtgaagagagatatggaggtttatgtgaaagttatatcgatttcgagtgataagtatagtctttctatgagggatgttgatcagaatacaggtagagatttgattcctttgaggaagccttcagatgaagatgattcatccaggagtaatccgtcgtatagaactaaggatgggcaagtgactaagactgggatttcagggatcaggattgtggaggagaatgatgttgcgccttcacgtagaccgttgaagaagatgagctctcctgagagatgggaagccaagcagttgattgcctctggtgttttgagagtagatgagtttccaatgtatgatgaggatggagatgggatgctttatcaagaggaaggtgctgaagaagaacttgagattgagatgaatgaagacgaacctgctttcttacaagggcagactaggtactctgttgacatgtctccggttaagatcttcaaaaatccagaaggttctttgagtcgtgcagctgcacttcagtccgctctcactaaggagaggagagaaatgagggaacaacagcagagaacaatgcttgactcaatccccaaggatctgaatcggccatgggaagaccctatgcctgaaactggtgaaaggcatcttgctcaagagcttaggggtgttgggttatcagcttatgacatgcctgagtggaagaaggatgcctttggtaaaactcccacttttggacagagatcaaagctttctattcaagagcaaagggagagccttccgatatacaagttgaaaaaggagctgatacaggctgtgcacgataatcaagttttggtggttattggtgagactggatctggaaagacaacacaggtgactcagtaccttgcagaagcaggttatacaacaaaaggaaagattgggtgtacccagcctcgtagggttgctgcaatgtctgttgccaagagagtagctgaggagtttggttgtcgtttaggagaggaggtagggtatgcgattcggtttgaagattgtactggaccggatacagtgatcaagtacatgactgatggtatgcttctcagggaaattctgatagatgaaaacctctctcagtactctgtaatcatgcttgatgaagctcacgagcggacaatccacactgatgtgctgtttggtcttctaaagaagctgatgaaacgtagactcgaccttcgtctgatagtcacgtctgccacattggatgcagagaagttctctgggtacttctttaactgcaacatttttaccattcctggaagaacatttcctgttgagatactatataccaaacagccagaaacagattacttggatgccgctctgatcacagtccttcagattcacttgactgaacctgagggtgatattctggtctttttgacgggacaggaagaaatcgattctgcctgccagtctctgtacgagaggatgaaaggtctaggtaaaaatgttcccgaactcatcatacttccagtttacagtgcgcttcctagtgaaatgcagtctagaatttttgatcctccccctcctggtaaacggaaagtggttgtagctacaaatattgcagaagcttctttaacaatagatgggatatactatgttgttgatcctgggtttgctaagcagaacgtgtacaatccaaagcaagggctggaatcgctagtcattactccaatttcacaggcatcagcgaagcaaagggctggacgtgctggtcgtactgggccagggaaatgttatcgtctctacacagagagcgcatatcgtaatgaaatgcctcctacatcaatccctgaaatccaaagaatcaaccttggaatgacaaccttgaccatgaaagcaatgggcatcaatgacctgttatcgtttgacttcatggatccaccccaacctcaagcattgatttctgcaatggaacagttgtacagcctgggagctttggatgaggaaggattgttgacaaagctaggtagaaaaatggctgagtttcctcttgaaccgccgctctctaaaatgttgctagctagtgtggatctcgggtgcagcgatgagattttaacgatgattgctatgatccagacgggtaacatattttatagaccaagggagaagcaagcacaggcagaccaaaaacgggcaaagtttttccagcccgaaggtgatcacttgacattgctagctgtgtatgaagcttggaaggctaaaaacttctcaggtccatggtgtttcgaaaacttcatacagtcaagatcgttacgacgtgctcaagatgtgaggaaacaacttctcagcattatggacaagtataaactagacgtcgtaactgctggaaagaatttcacgaagataaggaaagcaatcacggcaggattcttcttccatggagcaagaaaagatccacaggaaggttacaggacgctggtggagaatcaaccggtgtatatacacccgagcagcgcgctgttccagagacaaccagactgggttatatatcatgatcttgtgatgactacgaaagagtacatgagggaagtgactgtgattgacccaaagtggcttgttgagttagctccaaggttcttcaaagtgtctgacccaacaaaaatgagcaagcgtaagcgccaagaacggattgagccgttgtatgaccgttaccacgagcctaactcatggcgtctcagcaaaaggcgtgcttga

SEQ ID NO: 106 - DNA, 1164 bp, Arabidopsis thaliana
atgacttcgattctcaacactgtctccaccatccactcttccagagttacctccgtcgatcgagtcggagtcctctctcttcggaattcggattccgttgagttcactcgccggcgttctggtttctcgacgttgatctacgaatcacccgggcggagatttgttgtgcgtgcggcggagactgatactgataaagttaaatctcagacacctgacaaggcaccagccggtggttcaagcattaaccagcttctcggtatcaaaggagcatctcaagaaactaataaatggaagattcgtcttcagcttacaaaaccagtcacttggcctccactggtttggggagtcgtctgtggtgctgctgcttcagggaactttcattggaccccagaggatgttgctaagtcgattctttgcatgatgatgtctggtccttgtcttactggctatacacagacaatcaacgactggtatgatagagatatcgacgcaattaatgagccatatcgtccaattccatctggagcaatatcagagccagaggttattacacaagtctgggtgctattattgggaggtcttggtattgctggaatattagatgtgtgggcagggcataccactcccactgtcttctatcttgctttgggaggatcattgctatcttatatatactctgctccacctcttaagctaaaacaaaatggatgggttggaaattttgcacttggagcaagctatattagtttgccatggtgggctggccaagcattgtttggcactcttacgccagatgttgttgttctaacactcttgtacagcatagctgggttaggaatagccattgttaacgacttcaaaagtgttgaaggagatagagcattaggacttcagtctctcccagtagcttttggcaccgaaactgcaaaatggatatgcgttggtgctatagacattactcagctttctgttgccggatatctattagcatctgggaaaccttattatgcgttggcgttggttgctttgatcattcctcagattgtgttccagtttaaatactttctcaaggaccctgtcaaatacgacgtcaagtaccaggcaagcgcgcagccattcttggtgctcggaatatttgtaacggcattagcatcgcaacactga

SEQ ID NO: 107 - DNA, 975 bp, Arabidopsis thaliana
atggagaagatagagcacacgacgatatctaccaatggtattaacatgcatgtggcttcgattggttcaggtccagtgatcctattcgtccatggctttcccgatctctggtactcatggcgtcaccagcttgtctctttcgctgccttaggttaccgcgcaatcgctccagatcttcgaggatacggcgattccgatgcgccgccgtctcgtgaatcttacaccatccttcatatcgtcggagacctcgtcggattactggattcgctcggtgttgatcgggttttcctcgtcggtcacgattggggagcaattgttgcgtggtggctttgtatgatcaggcctgatcgagtcaacgcgttggtcaacactagcgttgtgtttaatccgaggaatccttctgtgaaacctgttgatgcgtttagggctttgttcggcgatgattactacatttgcaggtttcaggagcctggagagatcgaagaggactttgctcaagttgatacaaaaaagttaataaccagatttttcacttcgcgtaacccacgtccaccttgcattccaaagtcagttggtttcagaggtttacctgatccaccttctttgcccgcttggctcaccgaacaagatgtcaggttctacggagacaagtttagccaaaaaggcttcaccggtgggctaaactactatcgcgccctgaacctaagctgggaactaacagctccatggaccggtctacaaatcaaagtccctgtgaaattcatagtgggtgatctagacataacatacaatatccccggaacaaaggaatacatacatgaaggtggtttgaagaagcacgtaccttttctacaagaagtggtggtaatggaaggtgtaggtcacttcctccatcaagagaagcctgacgaggtcactgaccatatctatggcttcttcaagaaattcagaacccgcgaaaccgcatccttgtag

SEQ ID NO: 108 - DNA, 1128 bp, Arabidopsis thaliana
atgcctttttccgccgcgagttcgagctccgtaagctcaatcgctgaagaaccgccgccaaagaaacagcatgatccatcgccgtcctgttcatcgtatctgttactacttccagacgaaatcattctgaattgcttagcacgcttgccgaaatgttactacccggtgatttcactcgtctccaagacctttaggcgtctcatagcttcaccggagatctacgttgaaaggtcattacttcgccgcaccgagcgtgtcctttatgttgtgcttagatctcacgctacagaaactccccgatggtacactctcaatttcaaaccctttggaaatgattcaaataaccatagattggttccgattccgtcgtttccttcgattccttgctggggaatgtcaattgtcgctattgattctgaaatttacgtccttggtggatgcattgataatgaattggtctccactgggtttgtcgtcgaatgtccatctcacacgtgtcgtctcctccctagcatgaagcaggcacgtggctgcgccgccgtgggattttttgatgggaaattgtatgtaatcggaggttgtaaccctctgtctgtgaattgggtagaggcttttgatctaaagactcaaacttgggagtctggtttgggtgttaataatgtggaaatgcatgacttaaccatcagaagttttgcgatagatgataagatttacattatggatcgaaagaatagctttgtttatgatcctaaagaaggtacgttggagactgatgagttgttggacacacaatggagtgttggttcttgcgtcattgatggaaagatttacacttttggtagcaagaatagaatatgggtgtttgatccaattgccatggtttgggatcgcttgaagggtctcgacgatcttcctgacaagcgtgatggctcgagaatgtcgaatctcgggggaaatcttgcgattatgtttaaccttgagaagggttcaaccaaaatctgttgcacggagatcagattggaaaggagggaaggaggaaagatttgggggacggtcctgtggtctaatattgtcattaccttgaaagaaccttccaccattgtacgatgtctaactgtaacagtttga

SEQ ID NO: 109 - DNA, 870 bp, Arabidopsis thaliana
atgttgttgcaggctaacagagggcttggactctctgcccatattatcgatcactgtaatcttatcctcaagttccctgaaggcactaacagtacttggtacaatgcacaatttaaagtttttgaagcattggagttcaagtataatgtttgtgaggcagttctcttatgggagcagtaccgcaatatgactacagtattgacaagagaatacctcgatgtacgccctgatgggtggttggactacgcagctatgagaattgcacagttgggagctgataagtgttataatcgtacattgtgtgaagagcatcttaatgtgattcttccagcgaagcctccttttcacccacggcagtttcataaatgcgctgttgttggaaattctggagatctgttaaaaacagagttcggagaagagattgacagtcatgatgctgtatttcgagacaatgaagctcctgtcaatgagaagtatgccaagtacgtaggagtgaaaagggatttccgactagttgttcgtggtgcagctcgtaacatgattaagattctcaatgggtctgacaatgaagtgcttataataaaaagtgtgacccaccgagacttcaatgaaatgataaagcgtataccaaaccctgtttatcttttccaaggaattgtcctacgcagaggtgccaaaggaaccgggatgaaatccattgaactagcattgtccatgtgcgatattgttgacatatatggtttcactgttgatcctggatacacagagtggacgcgttacttttccacgccaaggaaagggcacaacccacttcaaggaagggcatactaccaacttctagagtgtcttggtgtacagataacttgttaa

SEQ ID NO: 110 - DNA, 1266 bp, Arabidopsis thaliana
atgggttccagagatttaattagcagtctgccagatgaaattcttggcaaagtcctgtctttgcttccgacaaaacgtgctgcttccacagctgttctgtctaaaaggtggaacaatctgcctgctcttgtagacaagcttgatatcaatgacgcaattggtggtcctggaggcttccctgaattcatagataaaacacttgccctcttaacaaattctaccaccattaagagaacctctctgaataatgaatttcagtatggcgagtctcaagtgaacacttggattcgcagtttcctcgagcgcggctgcttgcaactttacttgaacgctcaaagtttgtatactatagacactgagttcttcacgagcaacacacttgttgagctcactataaccggtgggttttctcctgatggtcttcttcctcctggtggcgtgtttttcccaaagcttaaaacactctctctcgttctaatgacgtttgtagattctgatatgtatgaacttttcatctctggctgccctttgcttgaggaattcttactacgtaatgatgaaattgaaattcccccggtttggaatgcgctagtttcgagtccttccatcaaacgactaaccatcgttcaccattttcccaattaccgtgaggcacacgatggttgttggttccggacaccaaatctcgtgtaccttgactattctagctatgtcccggattggtatgaggttgatttaggttcccttgtagaagctagactcgatcttcgatcatgggagcgccttagagatgagaaggctggtggttatggtgactgtgatagtgtttatgatgatgaggaatatccagatgatcctattttgggtgatgttaccaatctggttacaggactaagcaacattaaaacccttcacttgtctcctgattctctcgagggtcttgtgcaccaagttacacgtagatgcggggacgcctgcccttgtatacctaagaggatgaagaagaagaagaaggaattgggaatatgctgtttatcgacttgtcaagtgaaggtgctacatatttcagggtatcaaggtacatgtagagagctgaaacagatgaggcatttcttgggaaatttgaaatgtcttgaaactgtcaatgttggtgttgaaatgaatcaccgagaagacaacgatgttgacaacaaatacctcagaatcactgatgctcttatgaagcttcccagagtttcatcaaactgtagaatccatttcttctga

SEQ ID NO: 111 - DNA, 2166 bp, Arabidopsis thaliana
atgtcaagctccgacccgaaacccggacctaaaccgggtccatggccaccaactccagaatccgccgcaatgccaccgtcttcctgggctaaaaaaaccggatttcgtcccaaattctccggtgaaactaccgccactgattcttcttccggtcagctctcattaccggttagagctaaacaacaagaaacccaaccggatcttgaagctggtcaaaccagactccgtcctcctcctcctgtctccgccgcagtaactaacggtgagactgacaaggataagaaagagaagccaccaccaccacctcctggttctgttgctgttccggttaaggatcaaccggttaagagaaggagagattctgatggggttgttggaagatcaaatggacccgatggagctaatgggtcaggtgacccggttagaagaccgggtcgtattgaagaaacagttgaggttttgcctcagagtatggatgatgatttagtggctaggaatttgcatatgaagtatggtcttagagatactcctggacttgttccaattgggttctatggtttgcagcattacctttcaatgttgggatcattgattctggttccacttgttattgttcctgcaatgggaggttcacatgaggaggttgcaaatgttgtatcgactgtactttttgtctctggaatcactacactgttgcatacttcgtttgggtcgaggcttcctttgattcaaggtccttcctttgtctttctggctccggctttggctataataaactctccagagtttcaaggtttgaatggaaataataacttcaagcatatcatgagggagctgcaaggtgcaatcataattggttcagcttttcaagcagtgcttggatacagtggcctaatgtcactgattttgaggttggtcaatccagtagttgttgctccgacggtagctgcagttggactttccttttacagctatggtttcccgcttgttggtaaatgtcttgagatcggtgttgtgcagatactacttgtgatcatctttgctctttacctccggaaaatctcagttttaagccatcgtattttccttatttatgcggttccattgagtcttgcaatcacttgggctgctgcattccttttaactgaaacaggagcttacacctacaaaggttgtgacccaaacgttcctgtctcaaatgttgtatcgacccactgcagaaaatacatgaccagaatgaagtactgtcgggttgatacttctcatgcgctgagttccgccccatggtttaggtttccttaccccttgcaatggggtgtaccgttattcaactggaaaatggcttttgttatgtgtgtggtctccgtaattgcttcagtagattcggttggttcgtaccatgcttcttctctattagtagcatcgaggcctccaactcgtggtgttgtgagtcgggcaatcggtcttgaaggtttcacaagtgtcttagccggtctttggggtacaggtactggttcaaccactctaaccgaaaacgttcacacaatcgctgtgaccaaaatgggaagccgcagagttgttgagttaggcgcgtgtgttttggttatattttctcttgttggtaaggttggagggtttctcgcatcaattccgcaagtcatggttgcttctcttctgtgcttcatgtgggcaatgtttacggctttaggtctttccaacttacgttatagtgaagctggaagctcgcggaatatcataattgttgggttgtcgctgttcttttctctctctgtcccagcttacttccagcagtatggcatatctccaaactcgaatctctctgttccaagttattaccaaccttacattgtttcttcacatggacccttcaaaagccaatacaaaggggaccttcagttttcatatcttctagtgtatttgcagatgaactacgtgatgaacacgctcttgtcaatgagcatggtgattgcgttcatcatggctgtgattttggacaacacggtcccggggagcaagcaagaacgcggagtttatgtttggtctgacagtgagactgcaacaagagaaccagcacttgctaaagactatgaactgccgtttcgggtggggaggtttttcagatgggtcaaatgggtgggcatttga

SEQ ID NO: 112 - DNA, 1383 bp, Arabidopsis thaliana
atgagtgaagaagttgagaagagatacaaaattgttaggagtatcggtgaggaatgtatacaagaggaagagctaaagaatcttcttgctaagaaggctgctccgatttgctacgacggctttgaaccatcaggaagaatgcacattgctcagggagtgatgaaagtcatcaatgtgaacaaaatgacttcagctggttgcagagtgaagatttggattgctgattggtttgctcagttgaacaacaaaatgggtggtgacttgaagaaaatcagagtggttggagaatactttcaagagatatggaaggctgctgggatggataatgacaaagtagagtttttgtggtcgtccgaagaaattaattctaaggcagataagtattggcctcttgtgatggacattgctcgcaaaaacaagctccctagaatcttaaggtgtgtgcagattatgggacgtagtgagactgatgaactgagtgctgcccagatcctttacccatgcatgcaatgtgcagatatttttttccttgaggctgatatttgccagcttgggatggatcaaagaaaagtaaatgtgctagcgagagaatactgtgatgacataaagaggaaaaacaaaccgataatcttgtcacaccatatgcttcctggtctccaacaaggacaagaaaagatgtccaaaagtgatccattatctgctatctttatggaagatgaagaggctgaagttaatgtgaagatcaagaaagcttactgccctccaaaagtcgtgaagggcaatccatgcctcgaatacatcaaatacatcattctaccatggtttgatgagttcacagttgagagaaatgaagaatatggcggtaacaagacctacaaaagctttgaagacattgctgctgactatgagagcggcgagttgcaccctggcgatctaaagaaaggcctgatgaacgcgttgaataagattttgcaagtaatcccaatggcgtcaaacaccagcaacgacaatttccagcatagaccacggcaaagaaacggaccacctcctccgcggcgacagggaagaaatccgccgcctccgtcttcgtcaacgcgaacttctcagaatcagccaccacagcatacgccgcaggagaagaagaaaccggtgtttgtcaaagtggatcagcttaaacctggaacgagcggccacactttgactgttaaagtcgtcgatcagaattccgtacctcagaaaccgggagctgcttcttcttctcatctccgacctgctaggatctctgagtgtcttgttggagatgagactgcttgcatcctcttcactgctcgcaacgatcaaggtgagataatccgattctgtgttctaagattctatttttga

SEQ ID NO: 113 - DNA, 816 bp, Arabidopsis thaliana
atgaggccagtgttcgtcggcaatttcgagtatgaaactcgccagtcggatctggaacggttgttcgacaagtatgggagagtcgaccgagtggacatgaaatctggatatgcttttgtgtactttgaggatgaacgtgatgctgaagacgctattcgcaaactcgacaattttccttttggatatgagaaacgcaggttatcagttgaatgggcaaagggtgaacgtggcaggcctcgtggtgacgcgaaagccccttcaaatctgaagcctacaaagacactgtttgtcattaactttgaccccattagaacaaaagagcacgacattgaaaaacactttgagccctatggtaaggtcaccaacgtgcgtatcagacgcaacttctcatttgttcagtttgaaacacaagaggatgctacaaaagcccttgaagctactcaaagaagcaaaatattggatagggttgtttccgtggagtatgcgttgaaagatgacgatgaaagagatgatcgaaatggtggtcgtagcccgagaaggtctcttagtcctgtgtatcgtaggcgtccaagtccagattatggcaggcgtccaagccctggtcagggtaggcgtccaagtccagattatggtcgtgctcgaagcccagaatacgacagatacaaaggtccagcagcttatgaaagacggaggagtccagattatggacgaaggagttctgattatggtagacaaaggagccctggttatgaccgatacagaagtcccaagaggaagaccttgatcaatgcagaaaacagaagcttcgaagaatga

SEQ ID NO: 114 - DNA, 966 bp, Arabidopsis thaliana
atgggaatatatggagtgatgacagggaaaaaaggaaagagtgggtttggatctgcttctactgctgaagatgttactcaagccattgatgccagtcatctcactgccatcatcacaggtggaacaagtgggattggattggaggcagctagagtgttagcaatgagaggagctcatgtcatcattgccgcaagaaacccaaaagctgctaatgagtctaaagagatgattcttcagatgaaccctaatgctcgcgtcgactatctccagatcgatgtctcttccatcaaatcagtcagatccttcgttgatcagtttcttgcccttaatgttcctctcaacattctcataaacaatgcaggtgttatgttttgtcctttcaagctcaccgaagatgggattgaatcacaattcgcaacaaaccacattggtcattttctgttgacgaatctgcttctggacaaaatgaaaagtaccgcaagagaaagtggagtccaaggaaggattgtgaatctgtcatctattgctcatacttatacttactctgaaggtatcaagttccaaggcatcaatgaccctgctggatattcggagagaagggcttatggacagtccaaactctcaaacttgttgcactccaatgcactctctcgtagactacaggaagaaggtgtgaacatcactataaattcggtgcaccctggtcttgtcaccactaatctctttcgctactccggttttagcatgaaggtcttcagggctatgactttcctcttttggaaaaatatacctcagggagcagcaacaacatgctacgttgcacttcatccagatctcgaaggcgtcaccggaaagtatttcggcgactgtaacatcgttgctccgagcaaatttgctaccaacaattctctcgccgataaactttgggatttcagtgtctttctcatcgattctatctctaaataa

SEQ ID NO: 115 - DNA, 1662 bp, Arabidopsis thaliana
atgacggatgtgtccccactttcggaccagaccactttactccccgagttagcaagtgaagtgagaaaactgtctgtgtgtcacatgttggccactcgcgcgctatccccgcccaaggaccttaccgtcattttggttggaaactatttggtgagaggagtttttactagtatcttttttactgtacaccaaatccctaaatttaaggacatgtatgctcgcaatcctcccctcaatggctcacaatctgctcaagctcccgactggacccctgcagatgccgataccggactccaaggtctcgcatgcgctttgattctcagcaactggttgggtagcgactcgtaccctgagagaccaggtgctcctgactgtgcctactacatgcgaactggtgtctgtggctacggtaatagatgtcgttacaatcaccctcgcgatcgtgcctcggttgaagcaactgttagagctaccgggcagtatcctgaacgttttggtgaacccccatgccagttttacttgaaaactggaacttgtaaatttggggcgtcatgcaaattccaccatccaaagaatgcaggtggatccatgagccacgttccactaaatatatatggataccctgtacgagagggtgataacgaatgctcctactatttgaaaacggggcaatgcaaatttggtataacctgtaaatttcatcatcctcagcctgctggtactactgtcccaccaccaccagcatctgcacctcagttttatccatcggtgcagtcacttatgcctgaccagtatggaggtccatcttctagcttgagagttgcaagaactcttcttcctggttcttatatgcaaggcgcctatggtccaatgctattaacccccggggtcgttcctattccaggctggagtccttactcgtctcttactgtctcacttttgcttttgcttcaggcacctgtgagccctgctctatctcctggtgcgcagcacgctgttggggcaacttctttatatggagttacacagctcacttccaccactccttcgcttcccggggtttatccatctctgtcctctcctacaggtgttatacagaaagaacaggcctttccagagagacctggtgaaccagagtgccaatactatttgaaaacaggagattgtaagtttggaacatcttgtaagtttcatcatcctcgagatcgggttccaccaagagcgaattgcgtcctcagccccattggtcttcctctacgcccgggtgtgcaacggtgcactttctacgtacaaaacggcttctgtaagtttggatcaacatgtaagtttgatcatccaatgggaacgatcagatacaatccttctgcgtcctctctagctgatgcaccggtggctccttacccagtgagctctctcttgggtgctctggcagctgccccttcttcttcatcgacagagctcatagcaggcggtgcaaaagatgcttacatgaccggtgtgcctacatcaagaagcacatcaaacatctcggcaggtttgattttctcccagagcggtgggtcaattccattctcagagctgcaactctcgagccagagctctcttcctctaacaggtagcagaatcacaagacaagggcgtgaaattcgtcgatccttttga

SEQ ID NO: 116 - DNA, 615 bp, Arabidopsis thaliana
atggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctga

SEQ ID NO: 117 - DNA, 2175 bp, Arabidopsis thaliana
atggagactgcaacgaggactcaccaacagagaaaactgatctcatctttcctcgatatcaccgttaaccaaactgtggaaatcgcaacacagttccttgaggcaacaacctggaaccttgaagatgcgatcaacctctttctcatcgctcggagaaaccctcatcatcaccatggagaagaactagtccctcttcctttaccttcgaagaagaatactctctacgactacgatcctttcatgtctcacaacacttcggtcgcagtatgtcctgaagagatctgggacgacgagtcgacatctgaggaatccgattctaggttgtcttctttgtaccgtcctcctccaagtctgtttttccacggttcgtttgaagatgcgaaagcaacgtcctctagagaggatctatggttgcttgtctatgatgataccagcgaaggtcagaaaatatctactttctacaagatcgactctgttcctcctgtggtgcttctcatcgatcccatcactggccagaagatgcgtatgtggagcggtgtgattgaacctcagggctttctcgaggatttgatgaagtacatggattctggtcctcacgaacacgttgcatctctgacaagcaacaaacgtatgaaaacagagaagatctcctgttcaagtaacaacgctgatgatcaagacatggctactttctggggaaacgctattgaagaagaaaagactgtaatcaaatctggaaaggaggagacttttacgtctgatcgcgttgtggctccttcttgggggccagaatttgaagacataatgactttatccgaacatgaggaggaaacttgtttgtcatgcgacctgcttgagtttccggttttgacagaagagcctaaagcagactgtgatagaagcgttgtgtgcagtatttgtgttcgatttccagatgggagaagaaagcagaggaagtttctcaagagcgaaccgattcagcttctctggtctttctgttattctcacatggaggaatccgagaaaaaggagttcaagcttgtgcaggcgattcctggtgcttccaagactctggattatggagctaaggccacgtttgttcaatctgggatcgctaattcgatgatttcagttacttgggacattaacttgccactggattcaaagaagactgtcctaagtggatgcagggttatgattggtcaaattgctagtagtggcctaactaagaagctgatgataaagagaaacatgtgggctaaggttcgtggtgtggctatgatgaacccagtggagcatcctcatggaggaaggacagagttaggttctcatatacttaatcgagatgtatgggcgaacgacgcggtttcgagaaccattgagtcccacttcatcgtatggcaggtctatgatgatacaaacgaaggtcagaaaatctctagtttctacaagatcgaagctcctcctcctgtggtgtttgtaatcaatcccatcactggccagaagatgcatatgtggagcggcgtgattgaagctgagagtattgtcgaggatttgatgatgttttgggacgctggtcctcacgaaaacattgcttctctgacaaggaacaggcgcacggaaactgcggagacttgtttgtcaagctacaacttctatgaaacccctgctccttcctggggtgaagagtttgaagaggaggataattggtcgtcaagaagcaacaataatcaagtcgtggctcctacttgggagaaagaacttgaagaacaagacgagtgggagatttggtcgtcacgcagtgacactgatgacttcgtgcctccttttatgggggacgaatatgaagatccggatgaagtaaaggaggaggagatatgtttagtgttcccggttttgacagaagagccaaaaggagactgtgatcgaagcgttgtgtgtagtctctgcgttcgatttccagatgggagaagaaagcagaggaagtttctcaagagcgaaccgattcagcttctttggtcattctgttattctcacattgatgaatctgagaaaaaggcattcaagctggtgcaggcgattcccggtgcttcaaagactctagattgtgaagctgacgccacgttcgaccaatctgggcttgctaattcgctgatctcggttacttgggaatga

SEQ ID NO: 118 - DNA, 3936 bp, Arabidopsis thaliana
atggcttcagaaggaaaattgttatttgatcttaatgaacttcctacagaagatgatgatggcattgataatgttaacttcaatcagcagccacaggtgactatcccatcttctaaccccagttcctctgccttgcttgctacaccgtcgtcttctcaagataatgtaaacaacaaccgagtgttctctcacgcgtcaacagtttctggttttcagccttttgttcgccctgtagctgctcaacatacggatgttgcagttgaaagaaaggtggacgagggttctcttgaggaagcaaaggttacatcattgaaagttccaaatgatgttggagcacctgagagagaagaaggggaatggacggagtcggaggttcctgccaatgataatgtacatagtagttctgattattctacagttacagagaaagataatggcactctaggattagatatcaactcagactcggctcttcagaagaaaaacgtcaatcatatttcagaaagtagtggtaaagatagtggatctatagatagtcctcaagaacagggtttaacggtgaggccgagagaaactaaaggagttgaagcaagtcatgcaatcaaatgcgcaaatactactgtcaaaagaaagatggatcatcagaaagagacaatgttgggaaagaaacgccacaggcagaccatgtttctcaacctggacgatgtcaggcaagctggtcctattaagacaacaacacctagaagacagaatttcccacaacctgtcgtcacacgcacagttagagaatctcgtgcaggccctccaactgctgagcaagcaggcggggttccagggcatgttgtataccgggatcagaaaccaattgacattcctaatggtggtatacatccagaaacatctgaacctaagttagaatctaatggtgaatcacaatccggctccgctggtaaaactaggaggatgaatggggaggcaggaccttctgctgaggcgacatcgacatctgtgtcaaggcagggttcatggaagcagccaataaattcacggcagctgaagagtggtcattcgtcaaatagacaagttcccttgtgcagtcaaacctctgccgactccaagtttggtaacaagaaatttacttcgttcaagaagcaagcaacaaatagtacccaataccaagatacgtctgtggagcgtcttctacgagaagtgaccaacgaaaagttctggcatcatccagaggatactgatctccagagtgttcctgagcggtttgaatcaatggatgagtatgttagagtgtttgaacctttacttttcgaggagtgtcgggcacaactttacagtacatgggaagaattggctgaggcaaactcatacatgaaggtcagaataaagttcatcgaaagaagagagagaggatggtatgatgtgatacttaactcagtaaatgaatgtaaatgggctttcaaggagggagatgttgctgttctatcaaatcctgtgcctgaatcagaaggagagcatgatgatgttgggcgtgtagctggtacagttaggagatatataccggttgatactcgagatcctcatggagcaattctccatttctatgttggagatgcttatgactctggcagcaagattgacgacaatcatattttaaggaagcttaaacccaaggaaatctggcatctgactgtgcttggttcgattgcaaccacacaaagggaatatgttgctttgcatgcgttttcccagcttaacccacagatgcaaaatgcaattctcaagcctagcccagagcagtttcctaattacggggagcagactcctacagtgcccgattgtttcactccgagctttgctggccatttacacagaagctttaatgctcctcagttggcagcaattcactgggccgcaatgcatactgcagctggtacgagcagtggggtaaagaggcaagatccatggccatttactcttgttcagggccctccaggaacaggcaagacacacacagtttggggaatgttgaatgttatccatttggttcagtatcagcagtattacacttccttgctgaagaaattagctcctgaaagttataaacaagttaatgagagcagttcagataatattgtgtcagggtctattgatgaagtcctacaaaacatggaccagaatctatttcgtacgctgccaaaactgtgtgctaaaccaaggatgctcgtttgtgctccttcaaatgctgcgaccgacgaacttctctcacgtgtccttgatcgtggttttattgatggggaaatgagggtttatcgccctgatgtagctcgagtaggtgttgatacccaaacgaaagctgctcaagcagtttctgtggagcgaagaagtgatctgctactagccaagtcccgtgaggaaattctaggacacatacacaaccttagagtacgagatgctcagctatctcaagatattgctggacttaaaagggaacttactgctgcagcgtttgctaaccgttctcagggatctgttggcgttgaccctgatgttcttatggttagagaccagacaagagatgcaatgttacagcgtctttctgctgttgttgaagccagagataaagatcttgttgaaatgtctcgccttcttattgttgagggaaagtttcgagctggtacttcttttaatcttgaagaagctcgcgcaagtcttgaggcaagttttgcaaatgaggctgaaattgtttttacaaccgtatcaagcagtggccgtaaactgttttctcgtcttactcatggcttcgatatggtggtcatcgacgaggctgcccaagcttctgaggttggagttcttcctccccttgcgcttggtgctgcgcgatgtgtacttgtcggtgatcctcagcagcttcctgctacagttattagcaaagctgctggaacccttttatacagtagaagtctctttgaaaggtttcagctagcaggttgtccaactttgttgttaactgttcaatataggatgcatcctcaaatacgcgacttcccttcaagatatttctaccaaggacgccttacggacagtgaaagtgtttccactgctcctgatgagatttactacaaagattctgtccttaagccttaccttttctttgatatcagccatggacgggaatcccatcgaggtggatcagtatcttatgagaacattgatgaagctcgcttctgtgttggggtgtacttacatctacagagaactctgaagtctttgggtgggggtaaagtctctgttggggtaattaccccatacaaactgcagttgaaatgcctgaaaattgagtttggaaatgctttgagccaagatgaactgcaagagatttatatcaatactgtagacgcgtttcagggtcaagaacgtgatgtcataatcatgtcatgtgtgcgtgcttctaatcacggggttggcttcgttgctgatatccggcggatgaatgttgctctcacccgtgcgaaaagggctttatgggtgatgggaaatgcatctgctctgatgaagtgcgaggattgggcagcattgatcactgacgccaaagcaaggaattgttttatggagatggagtctcttcccaaggatttcccggttccaaaggtacctagctttatcccaaaagcacctaatgctagaggtttcagatcaggtgggccaagaaccagatccatcgatatgcaccctgaatccaggtcagggacaccatcagaagacgacaagaagctgagcacaacaacatttccaagaaatggaaattctcgaagggagaactcagttgatgattctgacccgcccggggatagatatagagatgcttggcaacatgggatccaaaggaggcaaaattttggacggcctttagggagaagagattaa

SEQ ID NO: 119 - DNA, 1344 bp, Arabidopsis thaliana
atggagataaggtattggcggaggttaagaggataccaaaggctagatggttctgccaagaaggcgagctcgggccggagaaatgtaaagcgggtcaaaatggatcccacacggaagagacggttttggaggatcaagatagtgccgaagctaaggatcttgaaaaaggcgtcgcctaagaagcttttaacgtggcttcgagatgcttacgtcaacatgatgctgcgcctagcgaattctcgggtcgtcggatcatcgtacgggtacggcgaatatgggtacgggtcgggtttggcgtcgaaggagtatgacgagaagaagctggtggagatttacaaatcgatattgatggctcaggggaatctcgtgcaccgtgacgtacctaaactgtcctcaaattcgattttactctcacccattaggctcttcttcctctccgttcagatccaagagatgtccgctaattctcatcctcctaattccaaaaacgtcctctgtaatgcagccgccggtgccgccgccggtagtctaattgttggcagtcttgagcagatcttcaagagagaagggatgcgtggcttataccgcggtctttcccctactgtcatggctcttctctccaattgggccatttattttacaatgtatgaccagctcaagagctttctttgttcaaatggtttgtgcttttcaactcaaaaccttgttaatagctgcttaagtggcgatcacaaactcagcgttggagctaacgtattggctgcttcgggagctggagctgcaactaccattgccacaaatcctctttgggtcgtcaagactagacttcagacacaaggaatgagagtgggtatagtgccatacaaaagcacattttctgctttaaggagaatagcttatgaggagggaattcgcggattgtacagtggtcttgtccctgcactagctggtatcagtcatgttgccattcagtttcccacatatgagatgatcaaagtgtacttggccaagaaaggtgataaatcagtcgataacctcaatgctcgtgatgtagcagttgcctcttcgattgcaaagatatttgcatccacattaacttacccgcacgaggtagtacgagctaggcttcaagagcaagggcaccacagtgagaaacgttactcaggagtaagagattgcatcaagaaagtgtttgagaaagatgggttccctggtttttacagaggctgcgccacgaatctactgagaacaactcctgcagcagttataactttcactagcttcgaaatggtgcatcgtttcctcgtcactcatataccttctgagcaaagctctatactttaa

SEQ ID NO: 120 - DNA, 753 bp, Arabidopsis thaliana
atgatggctttgccgaagctggccggtctccgtcgctgtgggaagagctgccgtctacggtggaccaattatctccgacctgacttgaagagaggtcttctctccgacgccgaggaacagcttgtcatcgaccttcatgctcttctcggcaacagatggtccaagatcgctgcaagattaccaggaagaacagacaacgaaataaaaaatcattggaatactcatatcaagaagaagctccttaagatggaaatcgatccttcgacccatcaacctttaaacaaagtatttaccgatacaaacttagtcgataaatctgaaacttcatcgaaagccgacaatgtaaatgataataaaatcgtagagatcgatgggacaacgacaaatacaatagatgatagcattatcactcatcaaaatagttcaaatgatgattatgaattacttggtgatataattcataattatggagatttatttaatattctatggaccaacgatgaacctcctctagtcgatgatgcatcatggagcaatcataacgttggtattggaggaacagctgcagttgcagcctcagacaagaacaacactgctgccgaggaagatttcccggaaagatcatttgaaaaacagaacggcgaaagttggatgttcttggattattgccaagaatttggtgttgaagattttgggttcgagtgttaccatggttttggtcaaagctccatgaagacgggtcacaaggactag

SEQ ID NO: 121 - DNA, 741 bp, Arabidopsis thaliana
atggggagaagaccatgctgtgagaagataggattgaagaaagggccatggagtgctgaagaagatcgaatcttgatcaattatattagtctccatggccatcccaattggagagctctccctaaactagccgggctacttcggtgcggaaaaagttgcaggcttcgttggattaattatttgagaccagacatcaaacgtggcaatttcactcctcatgaagaagatactatcatcagcttacatcaactcttaggcaacagatggtctgcgatagctgcaaaattgcctggacgaacagacaacgaaattaaaaatgtttggcacactcatttaaagaaaagactccaccacagtcaagatcaaaacaacaaggaagatttcgtctctactacagctgcggagatgccaacctctccgcaacaacaatctagtagtagtgccgacatttcagcaattacaacattgggaaacaacaatgacatctccaatagcaacaaagactccgcgacgtcatccgaagatgttcttgcaattatagatgagagcttttggtcagaagtggtattgatggactgtgacatttcaggaaatgagaagaatgagaaaaagatagagaattgggagggctcactagatagaaacgataagggatataaccatgacatggagttttggtttgaccatctcactagtagtagttgtataattggagaaatgtccgacatttctgagttttga

SEQ ID NO: 122 - DNA, 858 bp, Arabidopsis thaliana
atgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctagaaccggcggggaacaagatctcttagccgggctctag

SEQ ID NO: 123 - DNA, 456 bp, Arabidopsis thaliana
atggcgacatcgggaacatatgtgacggaggttccattgaaaggatcggcggataaacactacaagcggtggagagatgagaaccacctcttccccgatgccatcggccaccacatccaaggtgtcactgtccacgacggtgaatgggactctcatgaagccatcaagatttggaactatacatgcgatgggaaaccggaagtgttcaaggaaaggaaagagatagacgatgagaatatggtgataacgttcagaggactagaaggtcacgtcatggagcagcttaaagtgtatgatctcatatatcagttcagccaaaagtctcccgatgatatcgtatgcaagatcacaatgatttgggagaagcgaaccgatgattcgcctgagcctagcaactacatgaagttcctcaaaagcgttgttgctgacatggacgagcatgttctcaaagcctaa

SEQ ID NO: 124 - DNA, 1305 bp, Arabidopsis thaliana
atggcgtcttctcgaatcatcatcttctccgttcttcttctctccatcttctcactctcatcatctgcccaaccatctttccgccccaaagctctccttctcccagtaacaaaagacccatctaccctccagtacacaaccgtcatcaaccaacgcacacctctcgtccccgcttccgtcgtattcgacctcggtggtcgagaattctgggtcgactgtgaccaaggctacgtctccaccacttaccgctctcctcgctgcaactccgctgtctgctcacgcgccggctccatcgcctgcggcacatgcttctctcctccgagacctggctgtagtaacaacacttgcggcgcttttccagataactccatcaccggatgggcaacctcgggcgaatttgctttagacgttgtgtctatccagtccactaacggatccaatccgggtcggttcgttaaaatccccaatctaatattcagttgcggatcaacgtctcttcttaaaggactcgctaaaggagccgttggtatggctggaatgggacgtcacaacatcggcttaccgttgcagttcgccgccgcgtttagcttcaaccgcaaattcgccgtgtgtcttacttccggtagaggcgtcgccttcttcggcaacggaccttacgttttcctccccgggatccagatctcaaggcttcaaaagacaccgcttctcatcaatccagggaccactgtttttgagttttcaaaaggcgagaagtcgccggagtattttatcggcgtgacggcgattaagatcgtcgagaaaacacttccaatcgatccaacgcttttgaagataaacgcaagtactggaataggaggaaccaaaatcagctccgtcaatccttacacggtgttggagtcatcgatctacaaagcttttacgtcggagtttattagacaagcagcggcgaggagcatcaagagagtagcgtcggtgaaaccgttcggcgcgtgtttcagcacgaagaacgttggcgtcacgcgcctaggatacgccgtaccggagattcagctcgtgcttcatagcaaagacgtcgtttggagaatctttggagctaactcgatggtgagtgtcagtgatgacgtcatctgtttgggtttcgttgacggaggagtcaacccaggagcctctgtggtgatcggagggttccagttggaggataatttgatcgaatttgatttggcgagtaacaaatttgggtttagttccacgttattgggccgtcaaactaactgcgccaactttaatttcacttccactgcttga

SEQ ID NO: 125 - DNA, 438 bp, Arabidopsis thaliana
atggcttccaaggctttggttctgttgggtctctttgctgttcttctcgtcgtctcagaagtagccgcggcatcttctgccacagtgaattcagagagtaaggaaactgtgaaacctgatcaacgtggctacggtgacaatggaggaaattacaataacggaggaggttaccagggaggagggggtaattaccaaggaggaggaggtaattaccaaggaggaggaggtaattaccaaggaggaggaggaagataccaaggaggaggaggacggtaccaaggaggaggaggacgataccaaggaggcggtgggcgacaaggaggagggggaagtgggggaagttactgccgccacggctgctgctacagaggttacaacggctgctcaagatgctgctcgtatgccggagaagctgttcagactcagcccggtcactaa

SEQ ID NO: 126 - DNA, 639 bp, Arabidopsis thaliana
atggcaggtatcaaagttttcggacacccagcttccacttccaccaggagagtcctcatcgccctccatgagaaaaacctcgactttgagctcgttcatgttgaactcaaagacggtgagcacaagaaggagcctttcctctcccgcaacccttttggtcaagttccagcctttgaagatggagacctcaagctcttcgaatcaagagcgattactcagtacatagctcaccgatacgaaaaccaaggaaccaaccttctcccagctgactccaagaacatagctcagtatgcaatcatgtccattggaatacaagtagaagctcatcagttcgatcccgtggcttcaaagcttgcttgggaacaagtattcaagttcaactatggcttgaacacagaccaagccgttgttgcagaagaagaagctaagttagccaaggtccttgatgtctacgaggctaggctgaaggagttcaagtatttggctggtgaaactttcactttgaccgatcttcaccacattcccgtgattcaatacctgctcggaactcccaccaagaagctcttcacggagcgtccacgtgtcaacgagtgggtggctgagatcaccaagaggccagcttcagagaaggttctgtga

SEQ ID NO: 127 - DNA, 243 bp, Arabidopsis thaliana
atggtggtggattcggtgacaatggaggaggaagataccaaggaggaggcggccatggtggccacggagggggaggataccaaggaggaggaggacgataccaaggaggcggtgggcgacaaggaggagggggaagttactgccgccacggctgctgctacaaaggttaccatggctgctcaaggtgttgttcatatgccggagaagcggttcagactcagtctggtcactaaatctacataa

SEQ ID NO: 128 - DNA, 252 bp, Arabidopsis thaliana
atggaggccgggaaaacaccaccgacgacgacaacaacgacggagaagaaaacggagcaagtgaaagacaacgacttgccgaccgatagcccttacatggcgacgggtactttggaagattacaaattgaaagcttatggagccgaaggtcaccaagagcctactcctggtcttggaggtggctccaccgatgctcctactccttctggcgacgcacccgccgccactaccaccgatgcgaaagctccgtga

SEQ ID NO: 129 - DNA, 612 bp, Arabidopsis thaliana
atgataaaatcagtgactcttcgttcgtttcatctcccaattgagtttaacgacaccaaattcgtctcacggccttgtttcctggcgagatccttcccggtggttcgttgttcaagcaccagagacgtacctaagcttgaactcttcagccgcggaaaattcgaccggattcttcaagatccgccacttattgaaaaagccgaatccgaactctcagattactgttcgacgcttgaaggtgatgactcttacagttgctggagagcttactttgaactcaaagatctcgaaagagagaagccaaaggttgaagttgagaatttgattttgcaaacaggtggtttgaaatcgttaatcgggtgtttacatggagttgcttcaatggagaaagataacaaaaccaagaatggtttacatgtaggagaagaatcagatagagagaaaggaatgaatttgcacattcatattcctgatggtttaccaaaatctgaacaagagttggaggaagaagagaaatcgaaaatgccggattcagctttcactagattgcttagaagtaaaggaactatccctgcttggttctctcacgctcctgaccacgaaaccgactga

SEQ ID NO: 130 - DNA, 1302 bp, Arabidopsis thaliana
atggcgccttctccgatcatcttctccgttcttcttctcttcatcttctcactctcatcatctgctcaaacacctttccgtcccaaagctctccttctcccagtaacaaaagaccaatctaccctccagtacacaaccgtcatcaaccaacgcacacctctcgtccccgcttccgtcgtcttcgacctcggtggtcgagaactctgggtcgactgcgacaaaggctacgtctcctccacttaccagtctcctcgctgcaactccgccgtctgctcacgtgccggctccacaagctgcggcacatgcttctcccctccgagacctggctgtagtaacaacacttgcggcggcattccggataacaccgttaccggtaccgcaacttccggcgaatttgctttagacgttgtgtctatccagtccactaacggatccaatccgggcagggtcgttaaaatcccaaatttgatcttcgattgtggagcaacgtttcttcttaaaggactcgctaaaggaaccgttggtatggcgggaatgggacgtcacaacatcggtttaccgtcgcaattcgccgccgcgtttagcttccaccgtaaattcgccgtctgtctaacttccggtaaaggcgtcgccttcttcggcaacggaccttacgttttccttcccggaatccagatctcaagtctccaaacgacgccccttctcatcaatccggtcagcactgcttctgcgttttcacaaggtgagaaatcctcagagtactttatcggcgtgacggcgattcaaatcgtcgagaaaacagttccgatcaatccaacgctattgaagattaacgcaagtaccggtatcggaggaaccaaaatcagctccgtcaatccttacacggtgttggagtcatcgatctacaatgcttttacgtcggagttcgttaaacaagcagcggcgaggagcatcaagagagtagcgtcggtgaaaccgttcggcgcgtgtttcagcacgaagaacgtcggcgtgacgcgcctaggatacgccgtgccggagattgagcttgtgcttcatagcaaagacgtcgtttggaggatatttggagccaactcgatggtgagtgtcagtgatgacgtcatctgtttgggtttcgttgacggaggagtcaacgcaagaacctctgttgtgattggagggtttcagttggaggataatttgatcgaatttgatttggcgagtaacaaatttgggtttagttccacgttattgggccgtcaaactaactgcgccaacttcaatttcacttccactgcttga

SEQ ID NO: 131 - DNA, 447 bp, Arabidopsis thaliana
atgccttcaagcacattctccgggactgttagcacgccgaagctgtcggtggcagtggacatgggaaacccttttctcaatctcaccgttgatgccttcctcaagatcggagctgttggagtcactaaatctcttgcagaagacacttacaaggccatcgacaaagggagtctctccaagagcactttggagcatgcgcttaagaagttgtgtaaagaaggtgtttactggggagctgctggtggagtgtacattggaacagaatacggaatcgaacgtatccgtggcagcagagattggaaaaacgcaatgttagcaggcgcggcgacaggagcagtgctctcagcggttggtaagaaaggcaaagacactattgtgatcgatgccattcttggtggcgcgcttgcaaccgcttctcagttcgttaacaatcattatttctactga

SEQ ID NO: 132 - DNA, 3261 bp, Arabidopsis thaliana
atggcagaaactcgttcgcagatgttttatcgggaggtttcagctattcacgaaactatgtatccgtcattgaaagtggtttgtggtcacaaatctgatgtgcgttccggcaaagcggcgacgacgaatcagcaatttggtgttcaatcctcaccgtgcatcggagaatcaatgttggatacgagagcttacaacattggaagatcctcacagctgatatctacagctccgatcgtcactcctgacaccagcaaagagagagtcggtatgtcgaacaaatattttccattggaagagagatctgattttgcgagacttgagcatctcagatttaatggtgatagaattacagaatggttgttccagattgaacaatttttcttaattgatcgtactccggaggaattgaaagttggcttcgcttcactccatttcgatgacactgctgcgactttgcaccaatcaattgtacaatcgatgtggtggaagcatgttaggcatgattggtggagttacaaactgttgttgcaagtgagatatgatgagcatgttaatgactcgattgcaaaactgacacagttgcaggagactgaaggaatagaggagtatcatgctcgatttgagttgattagcactagattgaacttcgctgaagattacttggttagtgtttacttggcaggtttgagaactgatactcaactgaatgttaggatgtttggacctcagacaattcaacaatgtttaatgttgggaagattatatgagatggctcacccaaagagtgtgcttatcagaaaaaagagtgatgattatcagaaagaagctcaacatgtttcaagtaatgctgcaggaacttctatgattaatgatggtaattgcatgataggtaatgatggagatcgattccttagtggttcagacttggtagagaatgcggttgcgacggtgaagaaatatttggttgaaattgatgatgctatgtctagtgatgatgatcaaaattcggatgctggggacgtctttggattcaacatagaagagtgtgaaacagattcatggattgaacataagccgttgattcaagatcaagccgcgtttcactccatagacatagaaggtgtctcacaacttcagaaggttcgttcaaaccttaaggattttgataaagttgatgcaacaatgaatcaaatgctgtcatcaattggatttgttgttgatgaattacactctagttgtggaagtgctaccgtccatgtccagaagaagcctagtaagtctctcaaatcctggaagttcaaatttaaaaccagctcacaagaccaaggggatcatgaatcacttccaatagggttacatatcagattcaagtcctggaaatttaagttcgtgaatagaaatttacaaatgatgagagaacatggatatacaacacactttcagctaatgtctgataagagagaacatcaagagatgttcattgtggccaggattgttgatgtgagatgtttgcttagcatgatacttgggataacagagagtgatgcaggtcatggagaacaatttgtgtatgaccggattacaatggtaaagaggctgctgttgcaaaccagtttagtcattcaagaagtgatgagaaacaaaaagatcaagtttaccaaacggtggtggttcaagtataaatttggggaagagggtttcacgagactgaattctttcaatttgcgtatgacttatcattttgcggtttggcattgttggaagagcaagaccatggtgcatgttgaaatgagtggtgatcactggtcttggatggtcttagtcatgaaatctacaacatctagctttttgtcacttctctatgatcgaagaatgggagatccaagcagacatgaaacgggtcgggagattgtgtcacttcagggtcaaattcacactggttctcctatgattcagtgcataaagatgagcttcagcattctccttcttcagggtctgtttcagagtttgacaatgaagatgctcacatatatgcacttgtttggtagcaaaagttgtgtttcaactttgggaagacttctagatttccctcatcgttttaccggagctctcgtcgagtctcttgtaggtgagaagttgatatcgcgtctctttacgaacgttgtatcaaatggtgagagaagcagagttgcatgctcagaaagacaaagaaaagaattgatcgacaccaagaacacagctgacacaacaatttacagcatagagaagagtcttggtgaatacagagagaagatcccaagtgaaatcgccaaggagattgaagatgctgtggcagatctaaggagcgcttcctctggggatgatctcaacgagatcaaggccaagattgaggcggcaaacaaagctgtttctaagattggggagcacatgtctggtggttctggtggaggctctgcaccaggaggaggatctgagggaggcagtgatcaagctccagaggcagagtacgaggaagtgaaaaaggctgatttaatcgagatcccatttcttttgttggcttacttctctcgaatttacgcaggaagatcattagcagagaattctcatctgattcagtccatggctgccacggctcttttccgatcgattcgtcgacgcgacgtcgtctccgcgcctctttccgtttacaaatcccttgctggtaatgctcaaccttcctggggtagttcatacattggtcagaactatgcaagtttctccagagctttcgggtcaaaacctgttgtgaatgacattcttggtactggtttgggcactaacaatgccattagagaggagagagagaagtcaaaatctactgaagctgcaattgttggtgctcaattgactcgatctttccgtgctcttgatgtgggaacatcgaaacgattgttttctacaatctcaggggatataaagacaacacaggaggaaccaaaaatcaaaagctttcgccctttatctcctcacctttctgtttaccagcctcagatgaactccatgctatcgattttcaacagaatctcaggggtttacttgaccggtgtcactttcgctggctaccttctctacctgaagatgggtatgatctgcctcacctacccgagtttctaccaagtcctttaccatacacaacagcaacttccagtcatcacctcggttactgcattagccgctatttatcatactatcaagagtactcactcactcttgacccattaa

SEQ ID NO: 133 - DNA, 483 bp, Arabidopsis thaliana
atggcacaagctacgcgtcagtcttctctacaaggggaacttgaggtagatattgagatcaaagcatcggcaaagaagttccatcacatgctctctggaagaccacaagatgttgcgaaagccactcctgacatccagggatgtgctttgcatgagggagagtttggcaaagttggcagtgtcatattctggaactatgctattgatgggcagcccaaggtggcgagggagaggatcgaggcagtggatcaggagaagaatctgttagtgctcagggtaatagatggagatctgacgaaagagttcaagagcttcttggtcactatccaggcaaccccaaagctaagaggaccgggaagtgtggttaagtgtcacttaaaatatgagaggattgacgagaaggtggctcctccggagaagctgctcgagttgtttgccaagctaaccgaatcaatggacgaaatgcttttgtccgaagtctag

SEQ ID NO: 134 - DNA, 1059 bp, Arabidopsis thaliana
atgtggagattctgcttcttcttatcgttactattctttgatgttagcgcggtgaaatctgcagaatcgattttcctcccaagtcaaatcggagttgaagattcccgcgtctttgaatctcttagtcttagtcctgtatgctccgcggctgatccaaacctcaactacaagccggtcatcgggattctgacccaccctggcgaaggtcgatgggacgctcgtcttcactctctgaaaaactacgcctacgcgacgaacatatcgtacatcgcagcttcgtatgtgaagttagctgagactggtggagctcgtgtgattcctcttatctacaacgagcctgaagaaatcttgtttcagaagctagaattggtaaatggtgtgatattcacaggtggttgggctaaaacagggttatattacgatgttgtggagaaaatcttcaataaagttatggagaaaaatgatgctggagaacattttccggtgtacgccatgtgtcttggattcgagattttgtcaatgatcataagtcagaacagagacattcttgagaggtttaactcagtaaactatgcatcaagtctccagttttttaaaaacgttaatatcgaagcaaccgtgttccaaagatttcctccagagctgttgaaaaagctcagtgcagactgtttggttatgcagaaccactattttggtatctcaccagacaactttcaaggcaatccttatctgtctagtttcttcaatatcgtcacaaccagcgccgataaagacagcaagacttttgtttcaactattcgatcaaaacgataccctgtgaccgccttccaatggcatccagagaaaaatgcattcgaatggggatcatctgaaatcccacactctgaggacgcaattcaggtgactcaacatgctgcaaattatctagtcagtgaagccagaaagtcaatgaacagaccatcttctgagaaagtgctgagcaatctcatctacaactacaagcctacgtactccggatacaaagggagcggtgacgacgaggtttatattttcacgtaa

SEQ ID NO: 135 - DNA, 624 bp, Arabidopsis thaliana
atggccgcctccgcagaaatcgacgctgagattcaacagcagcttaccaatgaggttaagctcttcaaccgttggagctttgatgacgtttcggttacggatattagtcttgtggactacattggtgttcagccatcgaagcacgcaacttttgttccccatactgctggacgatactctgtgaagaggttcagaaaggcgcagtgcccaattgttgagaggctcactaactctctcatgatgcacggaagaaacaatggtaagaagttgatggctgtcaggatcgtcaagcatgccatggagattatccacctcttgtctgacttgaacccgattcaagttatcattgatgccattgttaacagtggtccacgtgaagatgctaccaggattggatctgctggtgtggttaggaggcaggctgttgatatctctcctctaagacgtgtgaaccaagcgatcttcttgcttacaactggtgcacgtgaagctgcctttagaaacatcaagacaatcgctgagtgccttgctgatgaactcatcaatgctgcaaagggatcttccaacagctatgccatcaagaagaaagatgagattgagagagttgctaaggccaatcgttaa

SEQ ID NO: 136 - DNA, 486 bp, Arabidopsis thaliana
atgctttcttcatctccaacttcctttactcatccatttctctcttcttctccgcctctatctccgatatctccgccgtctcgcacggctcggatctctccacctctcgtctccgcctcttgctcatacacctacacggaagattcgccgagactgcatcagatcccgcggcgattgacgacggtgccagcttcgctttacgatgttcttgaggttcctttaggcgcgacgagtcaggatatcaaatcggcttaccggagattagccaggatctgccatccagacgtggcgggaactgatcggacttcttcttcatcggcggatgaattcatgaagatccatgccgcttactgtacgctttctgatcctgagaaacgctccgtttatgatcggaggatgttgcgacggagccgtcctttgaccgtcggaacctccgggttgggaagctacgtcggacggaactgggaaaccgatcagtgttggtag

SEQ ID NO: 137 - DNA, 402 bp, Arabidopsis thaliana
atgactttcaagcgaaggaacggtgggaggaacaagcacaacagaggacacgtcaacccaatcagatgctccaactgtggcaaatgttgccccaaggacaaggccattaagaggttcattgtgaggaacattgtggagcaggctgctattagagatgttcaggaagctagcgtctatgagggatacacattgccgaagctatatgcaaagacgcaatactgtgtctcctgtgctatccactctcatgtcgttagagtccgttcccgcaccaaccgcagggttcgtactcctccacctcgtttcgccagacgcaaggaggatactcccaagcctgggcaaccaggacaggcacctcgtcctgctggacctggagctgcagctgcagctgcaccgcgtgtctga

SEQ ID NO: 138 - DNA, 1233 bp, Arabidopsis thaliana
atgaccgttgatattatgcgtttacctaagatggaagatcaaacggctatacaagaagctgcatcacaaggcttaaaaagcatggaacacttgattcgtgtcctctctaaccgtcccgaagaacgtaacgttgattgctctgagatcactgatttcacagtttctaagttcaagaaagttatctctcttcttaaccgttccggtcacgcccggtttagacgtggtccggttcattcccctccttcctcctccgttcctccaccggtgaaagtgacaactccggctcccactcagatctctgctccagcaccggttagcttcgttcaggcaaatcaacaaagcgtgacgttagatttcactagaccgagcgtttttggcgctaaaaccaagagctcggaggttgttgagtttgctaaagagagctttagcgtatcttctaactcttctttcatgtcttctgcgatcaccggtgatggaagtgtctctaaaggctcttcgatctttcttgctccggctccagcggtgccagtgacttcctccgggaaaccgccgctttctggtcttccttacaggaagagatgctttgaacatgaccactctgaaggcttttccggcaagatctctggctccggcaacggcaagtgccattgcaagaaaagccgaaaaaatcggatgaagagaaccgtgagagtaccggcggtaagtgcaaagatcgccgatataccaccagacgaatattcatggagaaagtatggacaaaaaccgatcaaaggctcaccacatccacggggttattacaagtgtagtacatttagaggatgtccagcgaggaaacacgtggaaagagctttggatgattcaacgatgttgattgtgacgtacgaaggagagcaccgtcatcaccagtccacgatgcaggagcatgtaactcctagcgccaaaatagacatgccgttatcagtcattaacggaacttctaacgtccgttatcattcgttaactttattagtcaagtttcaaattgtggccattttaaacatcaacttcttatgtggctatttaaaacatgaattaaacgttgaataccatttaaaacatgaaaaattcgttgaccaggccaaaatagacatgtctttatcagtagaacctagaaacccgttaatgactgttaatctgtccaaaataacgtcgttcaagaataatcgaaagaacataaagattttttccatatga

SEQ ID NO: 139 - DNA, 801 bp, Arabidopsis thaliana
atgttggctatcttccacgaggcgtttgctcatccgccggaggaactcaacagtccggcatctgagaaatgctctaaacaaccaaaacttccagaagaaaccctaaatgatttcttattacgttaccctctcaacactttctccatgtctttcggacaagctgctgttcttgcttacgttcgtccctctgcttccttctccatccaccagaggttgttttgtggatttgatgacatctactgtctcttctttgggagcttgaacaatctgtgtcagctaaacaaacagtatggtctcaccaagacaacaaacgaggccatgtttgtgatcgaagcttataggactcttagagacagaggtccttatccagctgatcaggtcgtcaaagacttagacggtagcttttcctttgtggtttatgatagcaaagccggctctgtcttcactgctctggtactaattcacaaaatcagtccacgcctgttggaactcaatttcaatggatctgatggaggggtgaagctatactggggcatagctgctgatggatctgttgttatatcagatgatttggatgttatcaaagagggttgtgctaaatcttttgctccatttcctacagggtgtatgttccatagtgaaggagggttaatgagctttgagcatccaatgaacaagatcaaggcgatgccgagggtagacagtgaaggagttctatgcggtgccaacttcaaggtggatgtgtacaatcgtgttaacagtatccctcgtcgaggaagtgaagccaattggtctctctga

SEQ ID NO: 140 - DNA, 1368 bp, Arabidopsis thaliana
atgtctcgatttgctatcttagtaaccttggcacttgccattgccactgtttcggtggttatagctcaagtccctccggagaaacaattcagagtcgtcaacgaaggagaattcggtgaatacatcactgagtacgacgcaagttacagattcatcgaatcatcaaaccagagcttcttcacatcaccattccagctcttgttttacaacactacccctagcgcctacatcttagctctccgagtcggactcaggcgtgacgagtctaccatgcgttggatatgggacgcgaatcgcaacaaccccgtcggagaaaacgctacactctcactcggccgtaacggcaacctcgtcctcgctgaagctgacggacgagtcaaatggcagactaacacagctaacaaaggcgtcaccggattccaaatcttacccaacggaaacatcgtcctacacgacaaaaacggcaaattcgtatggcagagtttcgatcaccccaccgatacactcctcaccggccaatcgttaaaagttaacggagtcaacaaactcgttagccgtacatctgattcgaacggctcagatggtccgtacagcatggtgctggacaaaaaaggtttaaccatgtacgttaacaaaaccggtacgccgttagtttacggcggatggccggatcacgatttccgcggcaccgtcactttcgccgttacaagagaattcgataatttaacggagccgtcagcttacgagcttctcttagaacccgcaccacaacccgctacgaacccgggtaataaccgccggttactccaagtcagaccaatcggaagcggaggaggaactttaaatctgaacaaaatcaattacaacggaacgatttcgtatctaagactcggatctgacgggagtctcaaggcttactcgtatttcccagcagctacgtatctcaaatgggaagagagtttctcattcttctccacttacttcgtccgtcaatgtggcttgccgtcgttttgcggcgattacggttactgcgatcgtgggatgtgcaacgcgtgtcctacaccaaaaggattactcggatggagtgataaatgcgcaccacctaaaacgacgcagttttgcagcggagtcaagggtaaaactgtcaattattataagatagtcggtgttgagcattttactgggccttatgttaatgatggacaaggcccaacttctgtgaacgattgcaaggccaagtgcgatcgtgattgcaagtgtttgggttacttctacaaagagaaagacaagaaatgtttgcttgctcctctgcttggtacacttatcaaagatgccaacacttcttctgttgcttacatcaaatattag

SEQ ID NO: 141 - DNA, 438 bp, Arabidopsis thaliana
atgactcttggctcaggatcgagtgttgtcgttccgaggaatttccggttgctggaggagcttgaacgtggagagaaaggtattggagatggaactgtgagctatggaatggatgatggagatgacatttatatgcgctcttggactggcactatcatcggtcctcacaacactgtacatgagggtcggatttatcagttgaagctcttctgtgacaaagattaccctgagaaacctccgactgttcggttccattcgcgtatcaacatgacttgtgtcaaccatgataccggcgtggtggattcaaagaagtttggggttcttgcaaactggcaaagacagtacacaatggaggacatactgactcaattgaagaaggagatggctgcatcgcataaccggaagcttgttcaacctcccgaaggaactttcttctaa

SEQ ID NO: 142 - DNA, 519 bp, Arabidopsis thaliana
atggcgttccctaaggtatacttcgacatgaccatcgacggccagcccgcgggaaggatcgtgatggagctgtacaccgataagactcccaggactgccgagaatttcagagctctctgcaccggagagaaaggtgttggcggtaccggaaaaccccttcacttcaagggatctaagtttcaccgtgtgatccctaacttcatgtgccagggaggagatttcaccgccgggaacggaacaggcggtgagtcgatctacgggagcaagttcgaggacgagaatttcgagaggaagcacaccggaccggggatcctgtcgatggcgaacgccggtgcaaacacgaacggatctcagttcttcatctgcaccgtgaagaccgattggcttgatgggaagcacgtggtgtttgggcaggtcgtggaaggcttagacgtggtaaaggccatcgagaaggttggatcatcatctggaaagccgacgaagcctgtggttgttgccgattgtggtcagctctcttag

SEQ ID NO: 143 - DNA, 1017 bp, Arabidopsis thaliana
atggctgacaagaagattaggatcggaatcaacggattcggaagaattggtcgtttggttgctagagttgttctccagagggacgatgttgagctcgtcgctgtcaacgaccccttcatcactactgagtacatgacctacatgttcaagtacgacagtgttcacggtcaatggaaacacaatgaactcaagatcaaggatgagaagacccttctcttcggtgagaagccagtcactgttttcggcatcaggaaccctgaggatatcccatgggccgaggctggagctgactacgttgttgagtctactggtgtcttcactgacaaagacaaggctgcagctcacttgaagggtggtgccaagaaggttgttatctctgcccccagcaaagacgctccaatgtttgttgttggtgtcaacgagcacgaatacaagtccgaccttgacattgtctccaacgctagctgcaccactaactgccttgctccccttgccaaggttatcaatgacagatttggaattgttgagggtcttatgactacagtccactcaatcactgctactcagaagactgttgatgggccttcaatgaaggactggagaggtggaagagctgcttcattcaacattattcccagcagcactggagctgccaaggctgtcggaaaggtgcttccagctcttaacggaaagttgactggaatgtctttccgtgtcccaaccgttgatgtctcagttgttgaccttactgtcagactcgagaaagctgctacctacgatgaaatcaaaaaggctatcaaggaggaatccgaaggcaaactcaagggaatccttggatacaccgaggatgatgttgtctcaactgacttcgttggcgacaacaggtcgagcatttttgacgccaaggctggaattgcattgagcgacaagtttgtgaaattggtgtcatggtacgacaacgaatggggttacagttcccgtgtggtcgacttgatcgtccacatgtcaaaggcctaa

SEQ ID NO: 144 - DNA, 553 bp, Arabidopsis thaliana
cgattccttgcccgccggatccgtggtttcgcgtatcggcatggtcgggagcttttatctcggtcttgtcgtgcgcgttgcttccggatatcacaaaaccccggcacgaaaagtgtcaaggaacatgcaaacgaacggctggcattcgcctccccggagacggagtgtgggcggatgctgtgctgcgaactgaagtctaaaacgactctcggcaacggatatctcggctctcgcatcgatgaagaacgtagcgaaatgcgatacttggtgtgaattgcagaatcccgtgaaccatcgagtctttgaacgcaagttgcgccccaagccttctggccgagggcacgtctgcctgggtgtcacaaatcgtcgtccctcaccatcctttgctgatgcgggacggaagctggtctcccgtgtgttaccgcacgcggttggcctaaatccgagccaaggacgcctggagcgtaccgacatgcggtggtgaacttgatccattacattttatcggtcgctcttgtccggaagctgtagatgacccaaagtccatatagcg

SEQ ID NO: 145 - DNA, 888 bp, Arabidopsis thaliana
atggcggaatcctcaaccaggacgagagatggtcgaggaaaatctatcgtgttcgaggattcatcgaccaggggtgttggaatcgtcgaccggtaccgagaattcgtcgatcaggacggcggaatcctcgaccagtgcgaggaatggtcgaggaaaatctatcggggtgttggaatcgttgttcggtaccgagaattcttcgaccagaacggcggaatcctcgaccagtacgaggaatggtcgaggagaatctatcgggttcgaggattcatcgaccaggaattgaaatcgtcgaccgggtccgagaattcgacgaccaggacaaggagtggtcgaggattcatcgactatgtgttggaatcgtcgaccggtactgagaattcgtcaaccaggacggcggaatcctcgactaggacgaagaatggtcgaagtaaatctatcgtggagtctgggcagtccatgggaacccccttactcggttcggacttgggtagcgatcgagggatactatcggataccgacacgaggaatgaccgaccaaccgtccgaccaaccgaccgtccgactgactgtccgaccgactatcgacttttccgacaatcggcttttttgccttttttgagttttacagcagttttcagacaaaaattgatgaatcgtcgaggagaatgggcttgcctagcacaaaaattgttgagtggtcgagaagaatgggcatgtcatgtgtcggctgacatggattcttcgaggcctagggttggcgagaatgggcgtgtcatgcatgagctgacatggattctcctaggccgtttgggtggcggtataatcatcttgcgcacgaaataccgagatgtccccatgggcatcgattccattcgcctaggttga

SEQ ID NO: 146 - DNA, 666 bp, Arabidopsis thaliana
atgtctccgacgacgacatcgttacgatccctaagcttctcgctttacgcttcttctaattctactccgatttctacaccaattgaggcccgacagttactgagttcatgcaatagattctacggtctgtcctcttcgagctcttcttcctcccttactacttcatctttgatcggaaatcttgttttctcatcaaggaatcagtctctctccgtaaaggtccaagcgttagctgctgaaaccgaacagccaaaatggtgggagaggaaagcagggccaaacatgattgacattacctcagctgagcagtttctcaacgcgttaaaagatgcgggagatagattagttatcgtagatttttacggaacttggtgtggttcttgccgtgcaatgttcccaaagctctgcaaaacggcgaaagaacaccctaacatcttgttccttaaagtaaactttgacgagaacaagtctctctgcaaaagcttaaacgtcaaggtgttaccgtatttccacttctaccgcggtgctgatggccaagtcgaatccttctcatgctctcttgccaagttccagaaactgagagaggcgatagagagacacaatgtaggaagtatcagtaacatctcttcttcagcttctgagaaagttgaagattcaagtgaataa

SEQ ID NO: 147 - DNA, 357 bp, Arabidopsis thaliana
atggcaagagttgttaaaatcgattctgcagagtcatggaatttctatgtgagtcaagccaagaatcagaattgtcccattgtggctcatttcactgcattatggtgtattccttctgtgtttatgaactccttcttcgaagagcttgcgtttaactataaggatgctctgtttctaatagttgatgttgatgaagttaaggaagtggcaagtcaactagaggtaaaggcgatgccaactttcttgttcttgaaggatggtaatgcgatggacaaactcgtgggcgcaaaccctgatgagattaagaaacgggtcgatggtttcgttcagtcctcacgtgttgttcatattgcttaa

SEQ ID NO: 148 - DNA, 540 bp, Arabidopsis thaliana
atggcagctttggcatcaaacccccaaatgctaactagacaagctcacggtaacaagaaggaacaattgtggaggaaagagagtttaaatttggagaagaagtgtgggttttgtgtgagcgtttacagtaatgaaaagcttgggaggtcacatatggagaaagagtggagactaaaagccttttggtcaaacatagctcagcctacgactttggagatggaacccattaacaacgttgaagaactcgatgctgttctctctcacgcacgccaactctctcagcctatcatcatcgaatggatggcttcttggtgtcgaaaatgtatttacttgaagcctaagttggagaaattagcggcagaatataataaccgagcaaagttttactatgtggatgtaaacaaggtccctcaaaccttggtgaaacgtggaaacatttcgttatggaaggaagatgagatgaaagaggaggtgattggaggtcacaaaggatggcttgtcatcgaagaagttagagaattgatcaacaaatttgtctag

SEQ ID NO: 149 - DNA, 1557 bp, Arabidopsis thaliana
atggcttctatttcaaccccttttccgatttctctccacccaaaaaccgtacgatcaaagccgttgaaattccgagttttgacccgtccgatcaaagcttccgggtcagaaactcctgatctaaccgtagcgacacgaaccggatccaaagatctcccgatccgaaacataccgggaaactacggtttaccaatcgtaggaccaatcaaagaccgttgggattacttttacgaccaaggagctgaagagttcttcaaatcacgaatccgtaaatacaactccacggtgtacagagtcaacatgccaccgggagcttttatcgccgagaatccacaagtcgtggctttactcgacggtaaaagcttcccggttttattcgatgtcgataaagtcgaaaagaaagatcttttcaccggtacttacatgccgtcaacggaactaaccggaggctaccgtatcctctcgtacctcgatccatcggagcctaaacacgaaaagctcaaaaatctccttttcttcctcctcaagtcatctcgaaaccggatcttccctgagtttcaagctacttactccgagcttttcgattctttggagaaagagctttcccttaaagggaaagcggatttcggcggttccagcgacggaaccgcctttaatttcttggctcgagctttctacgggacgaatcccgcagatacaaagctcaaagccgacgctccgggtttgatcactaaatgggttttattcaatctccatccattactctctattggtttaccgagagttatagaagaacctctcatccatacatttagtctaccaccggcgttagtcaaatctgattaccagagactctacgagtttttcttagaatccgccggtgagattctcgttgaagccgataaattgggtatctcacgagaagaagctactcacaatcttctcttcgccacgtgcttcaacacgtggggtgggatgaagattttgtttccgaatatggttaaacgtatcgggcgggcgggtcatcaagttcataaccgattagcggaggagattagatctgtgattaaatccaacggcggagaactcacgatgggagcgattgagaaaatggagttaaccaaatcagtggtttacgaatgtctccggtttgaaccaccggttacggctcaatacggtagagcgaagaaggatctggttatcgaaagccacgacgcggcgtttaaagtcaaagccggtgaaatgctttacggttatcaaccgttggcgacgagagatccgaagatttttgatcgggcggatgagtttgtgccggagagattcgtcggagaagaaggagagaagcttttgaggcatgtgttgtggtcgaatggaccggagacggagactccgacggtggggaataaacaatgcgccggtaaggattttgttgttttggtggcgaggttgtttgtgattgagattttccggcgatatgattcgtttgatattgaggttggtacgtcgccgttaggaagctccgttaatttctcgtcgttaaggaaagctagcttttag

SEQ ID NO: 150 - DNA, 1788 bp, Arabidopsis thaliana
atgtcttcctctatgaacgtagcgacgatgcaagcactgactttctctcgccggcttctcccttctgttgcttctcgttatctctcttcttcttctgtgaccgttactggatactccggtagaagctcggcttacgcgccttctttccgttcgattaaatgcgtctctgtttctccggaagcttcaatagtaagtgatacaaagaagttggcagatgcttctaagagtacaaaccttataccaatttaccgctgtatattctctgatcagcttactcctgttcttgcttaccgttgtttggtcaaagaagatgaccgtgaagctcctagctttcttttcgagtccgttgagcctggttctcagatgtctagcgttggtcgttatagcgttgttggggctcagcctgcgatggagatcgtggcaaaggagaataaagttattgtaatggatcacaacaatgaaaccatgactgaggaattcgtcgaagatccaatggagatcccaagaaaaatctctgagaaatggaaccctgatcctcaactagttcaggaccttccagatgcgttttgtggtgggtgggttggttttttctcgtacgacactgttcgttatgttgagaagaggaaattgccattttcaaaggcccctgaggatgataggaacttgccagacatgcatcttggtctgtacgacgatgtagttgtatttgatcacgtggaaaagaaagcatatgtcattcactggattagactagatgggagccttccttacgaaaaggcatacagtaatggaatgcaacatttggagaacttggtggccaagttacatgatattgagccgccaaaactggctgcaggtaacgtgaatcttcagacacgacaatttgggccatctttggataattcaaacgtgacatgcgaagagtacaaggaggctgtggtcaaggccaaagaacatatacttgcaggagacatatttcagatcgtgctgagtcaacgttttgagcggcgaacatttgcagacccctttgaagtttatagagcactaagagttgtgaatccaagtccgtatatgggttatttgcaggctagaggatgcattttggtagcatcaagtccagaaattctcaccaaagtaaagcagaacaagatagtgaatcggccattggcaggaaccagcaagagagggaagaatgaagttgaggataagagattagaaaaggaactgctagagaatgaaaagcaatgtgctgagcacatcatgttggttgatctcggtcgcaacgatgttggaaaggttacgaaatacggatcagtgaaagtagagaagcttatgaacatcgaacgttattcccatgttatgcatataagctccacggtgacaggagaattacaagatggtttgacttgctgggacgtactacgtgcggctttaccagtgggaacagttagtggtgcaccaaaggtcaaagctatggaactaatcgatgagctagagccaacgaggcgtggaccatacagtggcggttttggtggagtctccttcactggtgacatggacattgctttatcccttaggacaatcgtttttccgacagcatgtcaatacaatacaatgtactcttacaaggatgctaacaaacggcgtgagtgggtggcttatcttcaagctggagctggtgtagtagctgatagtgacccgcaagacgaacactgtgagtgccagaacaaagccgctggtcttgctcgagccatcgacttggctgaatctgcatttgtgaaaaaatga

SEQ ID NO: 151 - DNA, 885 bp, Arabidopsis thaliana
atggatcagtacgagaaagttgagaagattggtgaaggaacttacggtgtggtttataaggcacgtgacaaagtgactaatgagacaattgctttgaagaagatcaggctagagcaggaggatgaaggtgttcctagcacagcaatcagagaaatctccctcttgaaagaaatgcagcacagcaacattgtcaagtatgatgatgtggtgcacagcgagaaacgtttgtatctggtttttgagtatcttgacttggatctcaaaaagcacatggattctactcctgatttctccaaggatctacatatgatcaaaacatatctttaccagattctccgtggaattgcgtattgccactctcatagggttctccatcgtgatctgaagccacagaatttgttgattgatcgccgcacaaactcactgaagcttgctgattttggactggccagagcattcggtatccctgtcaggacatttactcatgaggttgttactctctggtaccgagcaccagagatactcctaggatctcatcattactctacacctgttgatatttggtctgtggggtgcatatttgctgagatgatcagccaaaagcccttatttcctggagactccgagattgatcaactcttcaagattttcagaatcatgggaactccgtacgaggatacatggcgtggggtaacttctctaccggattataaatctgctttccctaaatggaaaccaacggacctagaaacttttgtccccaatctagatcccgatggagtcgatctcctttctaaaatgctgttaatggatccgaccaaaagaatcaacgcaagagccgccctggagcatgaatacttcaaggatcttggaggcatgccttag

SEQ ID NO: 152 - DNA, 930 bp, Arabidopsis thaliana
atggagaagtacgagaagctagagaaggtcggagaaggaacatacgggaaagtctacaaagcgatggagaaaggaactggtaagcttgttgctctgaagaaaactcgtctcgagatggacgaagaaggtattccaccaactgctcttcgtgagatctcgcttctccagatgttatcaacatcgatctatgttgttcgattactctgcgtcgaacatgttcatcaaccatcaaccaaatctcaatctaccaaatccaatctctatctcgttttcgagtatctcgatactgatcttaagaaattcatcgattcgtataggaaaggacctaatcctaagcctcttgagccttttttgattcagaagttgatgtttcagctttgtaaaggtgttgcgcattgtcatagtcatggtgtgcttcaccgtgatcttaaaccgcagaatcttcttctggtgaaagataaagagcttcttaagattgctgatttgggtcttggtcgtgcttttactgttcctcttaagtcttatacgcatgagattgttactctttggtatagagctcctgaagttcttcttggatctactcattattcaactggtgttgacatgtggtctgttggttgtatctttgctgagatggttcggaggcaagctcttttccctggtgattctgagtttcagcaattgcttcatatcttcaggttgctaggaacaccaactgagcagcaatggccgggtgtttccacactgcgtgactggcatgtttaccctaagtgggagccgcaagacttaactcttgctgttccttctctttcacctcaaggagttgatcttctcacgaaaatgctcaagtacaatccagccgaaagaatttcagcaaaaacagcacttgatcacccatattttgacagccttgacaagtctcagttctga

SEQ ID NO: 153 - DNA, 741 bp, Arabidopsis thaliana
gaggaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagacccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataa

SEQ ID NO: 154 - DNA, 732 bp, Arabidopsis thaliana
atgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataa

SEQ ID NO: 155 - DNA, 990 bp, Arabidopsis thaliana
atgtcgactatagatgagtcggtcattcgatccaacggctctgagtccacgaaacacgcaaccaagtgctttttgaaaattttatcaatggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttctatcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttga

SEQ ID NO: 156 - DNA, 1731 bp, Arabidopsis thaliana
atggcgacacattctatgatcattccttctccttcttcttcttcctcgtctctcgctactgctgcgtctccgtttaaagagactctaccactctttagtagatctctcacattcccgagaaaatccttgttttctcaggttcgcttgagattcttcgccgagaaacattctcagcttgatacttcaaatgggtgtgccactaatttcgcttctttacaagattctggagatcaacttacagaggaacatgttacaaaaggagagtctactcttagtattacagttgttggagcgtcaggggacttagccaagaagaagatatttcctgcattgtttgctctcttttatgagggttgtcttcctcaggacttttctgtttttggttatgctcggactaaactcactcatgaagagcttcgtgacatgattagtagtactttaacttgccggattgatcagagggaaaaatgtggggataagatggagcagttcttgaaaagatgcttttaccattcgggtcagtataactcggaagaggattttgcggaactaaacaagaagctcaaagagaaagaggcaggaaagatatcaaacaggctgtactatttgtcgatacccccaaacatattcgttgatgtggttaggtgtgcaagtcttagagcctcctcagagaatggctggacaagggtcattgtggaaaagccatttggtcgtgactctgaatcatccggagagttaactagatgtctgaaacagtatcttacagaggagcaaatcttcaggattgatcactatttgggaaaggagcttgttgagaacctttcagtgctccgattctcaaatcttgttttcgagcctctgtggtcaagaaattacatacgcaacgttcagctgattttttctgaggatttcggaacagaagggcgtggaggttactttgatcaatatggaatcatacgagacatcatgcaaaaccatctcttgcaaatacttgcactttttgcaatggagacgccagtgagcttagatgctgaggacataagaagtgaaaaggtgaaagttttgagatcaatgaaaccgttgcggcttgaagatgtggttgttggtcaatacaaaggccataacaagggaggaaaaacttatccaggttatacagacgatccaacggttccaaatcacagtctcactcctacatttgctgcagcagccatgttcatcaacaatgcgagatgggacggtgttccttttcttatgaaagctggaaaagctctccataccagaggagcagagatcagagttcagttcagacatgtcccaggaaacttgtacaagaaaagttttgctactaatttagacaatgcaacaaatgaactagtgattagagttcagcctgatgaagggatatacctgaggatcaacaacaaagttcctggtcttggaatgagactagatcgcagcgaccttaaccttctatatcgatccaggtatccaagagagataccagatgcatatgaaagactgcttctcgatgcaatcgaaggagagaggaggttgtttatcagaagtgatgagctagatgcagcatgggatctattcacaccggctttgaaggaactagaggagaagaaaatcattcctgagctctatccatatggaagcagaggtcctgttggtgcacattaccttgcatctaagtacaatgtgagatggggagatcttggagaagcttaa

SEQ ID NO: 157 - DNA, 2028 bp, Arabidopsis thaliana
atggaagagatttcgacggatccggttgttccagcggtgaaacctgacccgagaacatcttcagttggtgaaggtgctaatcgtcatgaaaatgacgacggaggaagcggcggttctgagattggagcaccggatctggataaagacttgctttgtccgatttgtatgcagattattaaagatgctttcctcacggcttgtggtcatagtttctgctatatgtgtatcatcacacatcttaggaacaagagtgattgtccctgttgtagccaacacctcaccaataatcagctttaccctaatttcttgctcgataagctattgaagaaaacttcagctcggcatgtgtcaaaaactgcatcgcccttggatcagtttcgggaagcactacaaaggggttgtgatgtgtcaattaaggaggttgataatcttctgacacttcttgcggaaaggaagagaaaaatggaacaggaagaagctgagaggaacatgcagatacttttggactttttgcattgtctaaggaagcaaaaagttgatgaactaaatgaggtgcaaactgatctccagtatattaaagaagatataaatgccgttgagagacatagaatagatttataccgagctagggacagatattctgtaaagttgcggatgctcggagatgatccaagcacaagaaatgcatggccacatgagaagaaccagattggtttcaactccaattctctcagcataagaggaggaaattttgtaggcaattatcaaaacaaaaaggtagaggggaaggcacaaggaagctctcatgggctaccaaagaaggatgcgctgagtgggtcagattcgcaaagtttgaatcagtcaactgtctcaatggctagaaagaaacggattcatgctcagttcaatgatttacaagaatgttacctccaaaagcggcgtcagttggcagaccaaccaaatagtaaacaagaaaatgataagagtgtagtacggagggaaggctatagcaacggccttgcagattttcaatctgtgttgactaccttcactcgctacagtcgtctaagagttatagcagaaatccggcatggggatatatttcattcagccaacattgtatcaagcatagagtttgatcgtgatgatgagctgtttgccactgctggtgtttctagatgtataaaggtttttgacttctcttcggttgtaaatgaaccagcagatatgcagtgtccgattgtggagatgtcaactcggtctaaacttagttgcttgagttggaataagcatgaaaaaaatcacatagcaagcagtgattatgaaggaatagtaacagtgtgggatgtaactactaggcagagtcttatggagtatgaagagcacgaaaaacgtgcctggagtgttgacttttcacgaacagaaccatcaatgcttgtatctggtagtgacgactgcaaggttaaagtttggtgcacgaggcaggaagcaagtgtgattaatattgatatgaaagcaaacatatgttgtgtcaagtacaatcctggctcaagcaactacattgcggtcggatcagctgatcatcacatccattattacgatctaagaaacataagccaaccacttcatgtcttcagtggacacaagaaagcagtttcctatgttaaatttttgtccaacaacgagctcgcttctgcgtccacagatagcacactacgcttatgggatgtcaaagacaacttgccagttcgaacattcagaggacatactaacgagaagaactttgtgggtctcacagtgaacagcgagtatctcgcctgtggaagcgagacaaacgaagtatatgtatatcacaaggaaatcacgagacccgtgacatcgcacagatttggatcgccagacatggacgatgcagaggaagaggcaggttcctactttattagtgcggtttgctggaagagtgatagtcccacgatgttgactgcgaatagtcaaggaaccatcaaagttctggtactcgctgcgtga

SEQ ID NO: 158 - DNA, 975 bp, Arabidopsis thaliana
atggcggcgatagaggacagtccaacgttttcctctgtggtaactccggcggcttttgagataggcagcctcccgacaaccgagataccggtggatccggtggaaaatgattcaacagcaccgccaaaaccggtgagaatcacctgtccaacagtcgccggaacttatcccgtcgttttattcttccatggcttttatcttcgcaactacttctactctgacgttcttaaccacatcgcttcgcatggttacattcttgtagccccacagttgtgcaaattattgccgccgggagggcaagtggaagtggacgatgctggaagtgtgataaactgggcatcggaaaacctcaaagctcacctaccaacttcggtaaatgctaatggaaaatacacctcactcgtgggccacagccgcggtgggaaaacggcgtttgcggttgcgctaggccatgccgcaacattagacccatccatcacgttttcagctctaataggaattgatccagtcgcaggaactaacaaatacattagaaccgatccgcatatcttaacgtataaaccggaatctttcgagctggacataccggttgcagtggtgggaaccggactcggaccgaagtggaacaacgtgatgccaccatgcgcaccaacggacttaaaccatgaggagttttacaaagagtgtaaggcgacgaaagcccatttcgtggctgcggattacggacatatggatatgttggacgatgatttgcccggttttgttgggtttatggccggttgtatgtgtaagaatgggcaaagaaaaaagtctgagatgaggagctttgtaggtggaattgtggttgcgtttctcaagtatagtttgtggggtgaaaaagcggagattcgattgattgtgaaggatccttccgtttctccggccaagcttgatccttcacctgagttggaagaagcttctggtatcttcgtctag

SEQ ID NO: 159 - DNA, 4605 bp, Arabidopsis thaliana
atggtggaaaatggggctaaagctgcgaagcgaaagaagagaccacttccagagattcaagaggtagaagatgtacctaggacgaggagaccaaggcgtgctgcagcgtgtaccagtttcaaggagaaatctattcgagtctgtgagaaatctgctactattgaagtaaagaaacagcagattgtggaggaagagtttctcgcgttacggttaacggctctggaaactgatgttgaagatcgtccaaccaggagactgaatgattttgttttgtttgattcagatggagttccacaacctctggagatgttggagattcatgacatattcgtttcaggtgctatcttaccttcagatgtgtgtactgataaggagaaagagaagggtgtgaggtgtacatcgtttggacgggttgagcattggagtatctctggttatgaagatggttcccctgttatttggatctcaacggaattggcggattatgattgtcgtaaacctgctgctagctacaggaaggtttatgattacttctatgagaaagctcgtgcttcagtggctgtgtataagaaattgtccaagtcatctggtggggatcctgatataggtcttgaggagttacttgcggcggttgtcagatcaatgagcagtggaagcaagtacttttctagtggtgcggcaatcatcgattttgttatatcccagggagattttatatataaccaactcgctggtttggatgagacagccaagaaacatgaatcaagctatgttgagattcctgttcttgtagctctcagagagaagagtagtaagattgacaagcctctgcagagggaaagaaacccatctaatggtgtgaggattaaagaagtttctcaagttgcggagagcgaggccttgacatctgatcaactggttgatggtactgatgatgacagaagatatgctatactcttacaagacgaagagaataggaaatctatgcaacagcccagaaaaaacagcagctcaggttctgcttcaaatatgttctacattaagataaatgaagatgagattgccaatgattatcctctcccatcgtactataagacctccgaagaagaaacagatgaacttatactttatgatgcttcctatgaggttcaatctgaacacctgcctcacaggatgcttcacaactgggctctttataactctgatttacgattcatatcactggaacttctaccgatgaaacaatgtgatgatattgatgtcaacatttttgggtcaggtgtggtgactgatgataatggaagttggatttctttaaacgatcctgacagcggttctcagtcacacgatcctgatgggatgtgcatattcctcagtcaaattaaagaatggatgattgagtttgggagcgatgatattatctccatttctatacgaacagatgtggcctggtaccgtcttgggaaaccatcaaaactttatgccccttggtggaaacctgttctgaaaacagcaagggttgggataagcattcttacttttcttagggtggaaagtagggttgctaggctttcatttgcagatgtcacaaaaagactgtctgggttacaggcgaatgataaagcttacatttcttctgaccccttggctgttgagagatatttggtcgtccatgggcaaattattttacagctttttgcagtttatccggacgacaatgtcaaaaggtgtccatttgttgttggtcttgcaagcaaattggaggataggcaccacacaaaatggatcatcaagaagaagaaaatttcgctgaaggaactgaatctgaatccaagggcaggcatggcaccagtagcatcgaagaggaaagctatgcaagcaacaacaactcgcctggtcaacagaatttggggagagttttactccaattactctccagaggatccattgcaggcgactgctgcagaaaatggggaggatgaggtggaagaggaaggcggaaatggggaggaagaggttgaagaggaaggtgaaaatggtctcacagaggacactgtaccagaacctgttgaggttcagaagcctcatactcctaagaaaatccgaggcagttctggaaaaagggaaataaaatgggatggtgagagtctaggaaaaacttctgctggcgagcctctctatcaacaagcccttgttggaggggaaatggtggctgtaggtggcgctgtcaccttggaagttgatgatccagatgaaatgccggccatctattttgtggagtacatgttcgaaagtacagatcactgcaaaatgttacatggtagattcttacaaagaggatctatgactgttctggggaatgctgctaacgagagggaactattcctgactaatgaatgcatgactacacagctcaaggacattaaaggagtagccagttttgagattcgatcaaggccatgggggcatcagtataggaaaaagaacatcactgcggataagcttgactgggctagagcattagaaagaaaagtaaaagatttgccaacagagtattactgcaaaagcttgtactcacctgagagagggggattctttagtcttccactaagtgatattggtcgcagttctgggttctgcacttcatgtaagataagggaggatgaagagaagaggtctacaattaaactaaatgtttcaaagacaggctttttcatcaatgggattgagtattctgttgaggattttgtctatgtcaaccctgactctattggtgggttgaaggagggtagtaaaacttcttttaagtctgggcgaaacattgggttaagagcgtatgttgtttgccaattgctggaaattgttccaaaggaatctagaaaggctgatttgggttcctttgatgttaaagtgagaaggttttataggcctgaggatgtttctgcagagaaggcctatgcttcagacatccaagaattgtatttcagccaggacacagttgttctccctccaggtgctctagagggaaaatgtgaagtaagaaagaaaagtgatatgcccttatcccgtgaatatccaatatcagaccatattttcttctgtgatcttttctttgacacctccaaaggttctctcaagcagctgcccgccaatatgaagccaaagttctctactattaaggacgacacacttttaagaaagaaaaagggaaagggagtagagagtgaaattgagtctgagattgtcaagcctgttgagccacctaaagagattcgtctggctactctagatatttttgctggttgtggtggcctgtctcatggactgaaaaaggcgggtgtatctgatgcaaagtgggcgattgagtatgaagagccagctgggcaggcttttaaacaaaaccatcctgagtcaacagtttttgttgacaactgcaatgtgattcttagggctataatggagaaaggtggagatcaagatgattgtgtctctactacagaggcaaatgaattagcagctaaactaactgaggagcagaagagtactctgccactgcctggtcaagtggacttcatcaatggtggacctccatgtcagggattttctggtatgaacaggttcaaccaaagctcttggagtaaagttcagtgtgaaatgatattagcattcttgtcctttgctgactatttccggccaaggtattttcttctggagaacgtgaggacctttgtgtcattcaataaagggcagacatttcagcttactttggcttcccttctcgaaatgggttaccaggtgagatttggaatcctggaggccggtgcatatggagtatcccaatctcgtaaacgagctttcatttgggctgctgcaccagaagaagttctccctgaatggcctgagccgatgcatgtctttggtgttccaaagttgaaaatctcactatctcaaggtttacattatgctgctgttcgtagtactgcacttggtgcccctttccgtccaatcaccgtgagagacacaattggtgatcttccatcagtagaaaacggagactctaggacaaacaaagagtataaagaggttgcagtctcgtggttccaaaaggagataagaggaaacacgattgctctcactgatcatatctgcaaggctatgaatgagcttaacctcattcgatgcaaattaatcccaactaggcctggggctgattggcatgacttgccaaagagaaaggttacgttatctgatgggcgcgtagaagaaatgattcctttttgtctcccaaacacagctgagcgccacaacggttggaagggactatatgggagattagattggcaaggaaactttccgacttccgtcacggatcctcagcccatgggtaaggttggaatgtgctttcatcctgaacagcacagaatccttacagtccgtgaatgcgcccgatctcaggggtttccggatagctacgagtttgcagggaacataaatcacaagcacaggcagattgggaatgcagtccctccaccattggcatttgctctaggtcgtaagctcaaagaagccctacatctcaagaagtctcctcaacaccaaccctag

SEQ ID NO: 160 - DNA, 2151 bp, Arabidopsis thaliana
atgaaagaccacgatttcgacggcgacaaagggcttgccaagggatttctcgagaatttcgccgacgctaatggcagatctaagtacatggagattctccaagaggtttcaaatcgtaagattcgagctattcaagtcgatctcgatgacttattcaattataaagatgaaagtgaggagtttctcggacggttgacggaaaacactcgccgatatgtttcaattttctccgccgctgttgacgagttgttacccgaaccaacggaagcgtttccagatgatgatcatgatattctcatgactcagagagcagatgatgggactgataatccagatgtttctgatcctcatcagcagattccttctgagattaaaagatattatgaggtttattttaaagctccttcaaagggaaggccatctaccatcagggaggttaaggcttcacacattgggcaacttgttaggatatctggtattgtgacccgttgttccgatgtcaagccattgatggcggttgctgtttacacatgtgaagattgtggtcatgagatttaccaggaagttacatctagagtcttcatgcctttgtttaagtgtccttctagtcgctgtcgtcttaatagtaaagccgggaatcctattcttcagctcagagcatcaaagtttctaaagtttcaggaggccaagatgcaagagttggctgaacatgttcccaaagggcatattccgaggtctatgactgttcatctaagaggagagttgacaagaaaggtatcaccaggtgatgttgttgagttctcagggatttttcttcccattccttacactgggtttaaggcacttcgagctggcttagtagcagacacctatctggaagcaacgtctgttactcatttcaagaagaaatatgaggaatatgagtttcagaaagatgaggaagaacagattgcacgtttggctgaggatggtgacatatacaataagctgtcgcgatccctggcccctgagatttatggacatgaagatattaagaaagctttgcttctccttcttgtgggtgctcctcacaggcaattaaaggatggaatgaagattagaggagatgtgcatatctgtctgatgggtgatcctggagttgccaagagtcagcttctcaagcacattataaatgttgctccaaggggagtctacacaacaggcaaaggtagcagtggagttggtctaactgccgctgttatgagagatcaagtaacaaatgagatggttttagaaggaggagcactggtgctggctgacatgggaatctgtgcaattgatgagtttgataagatggatgaatcagatcgtactgctattcatgaggtcatggagcagcaaactgtaagcattgcaaaagctgggattaccacgtctttgaatgctcgaacagctgttcttgctgcagccaatccagcctggggaagatatgatttgcgaagaactccagctgaaaacattaatcttccaccggcccttctttcaagattcgatctgctgtggttgatcttagatcgagctgacatggacagtgaccttgaattggcaaagcatgtgcttcacgtacatcagacagaagaatctcctgcgcttggtttcgagcctctggaacccaacattctccgtgcatacatttcagctgcaaggagattatcaccatacgtcccagcagagttggaggaatatatagcaactgcttattccagcatcaggcaagaagaagcgaaatcaaatactcctcattcttacacaacagtgaggacactgctcagcattctgcgcatatccgctgcattagcaaggttgagattttcagaatcagtggcacagagtgatgtggatgaggcgcttagactaatgcagatgtcgaaaatatcattgtatgctgatgaccgacaaaaagcaggactagatgcaatatcagacacatactcaatcataagagacgaagctgcaagatcaaaaaagacccatgtgagctacgcaaatgccctgaactggatctccagaaagggatacagtgaggctcagctaaaggagtgtttggaggaatatgcagctttgaatgtttggcagattgatcctcacacctttgacatccgttttatctga

SEQ ID NO: 161 - DNA, 1599 bp, Arabidopsis thaliana
atggcatgctactgtgtgaattatcttcttgtttctttttctgttctcattcttttctctttatgtgacagagatatactaaagtcagagttgatatgcgaggatgattcagttaaatcgactgctgctgctgaggagatatctgagctgttacttcattttttgtcttcattagaagtgcagaagaagaaaaaagcatctaaacttttgcaagatatccagaccttagaggatgatattaaggaggccgagcgaagatattcttcaaatgtatctctggtgagatctcatggagctattgaaaaaagggtgcaatcatctcccctagacgagcactgtacaacttccagtgccttgtttgtaccaactgctaatacagacaggctgatgagtaatatccgtcaacttgaagatgcatattttttcatgcgatcacaaatcaacttatcgagttctgctgctactgcccgttctgacaaaacactaaaggacagggacagatgctctgaaaaccaaaatgaaaatcaggatatgagtaccaaaggaaaatcttcagatcaactcgaagtgtttttcgaggggttgtgcaaatttgctcggtatagcaagttcgaaacctgtgggacaataagaagtggggaccttttaaactctgcaagtgtggtctgctcgttgagttttgaccctgatgaagaacacatagcagcagctgggatatcaaagaagatcaagatttttgacttcaatgcatttatgaatgaatctgtcggtgttcattatccactagtagagatggtcaacaaatctaaattaagctgtgtttgctggaatagctacatcaaaaactacttggcctcgactgactacgatggtgtagttcagatatgggatgccggcactggacaaggattttcgcagtacacagaacaccagaagagagcctggtcagttgatttttctccatctgacccgacaaaatttgttagtggaagtgatgactgctcggtgaagctttggagcatcaatgagaaacgttcattaggcacaatctggagtccagcaaatgtgtgttgcgtgcaattctcttcttattccaatcacttattggcatttgggtcagctgattacaaggtctattgctatgaccttcggtatgtcaaaacaccttggtgcacattggctggtcatgagaaagcggtgagttatgttaaatttatggattcagaaaccattgtttctgcttccactgataactctctcaagctttggaatcttaacaagacaaattcctctggtttatctcctggtgcttgttcattgacatataaaggacatacaaatcagaagaatttcgttggattgtcggttttggacggatacatagcttgtggttcagagaccaatgaggtatatagttactataaatctttaccgatgccaatgacttcatacaagtttggatccgtcgatcccatttctggaaacgaatactttgatgacaatggacagtttgtgtcgagcgtctgttggaggaaaaaatcgaatatgcttgtagctgcaaactctactggaaacatgaagctactaaaacttgtttga

SEQ ID NO: 162 - DNA, 1539 bp, Arabidopsis thaliana
atggatcattcatcaaatagatttggcaataatggagtggaatcgattttaccgaattacaagcttggtaaaactcttggaattgggtcttttgggaaggtgaaaatagcagagcatgttgtcacagggcataaggttgctatcaaaatccttaatcgtcgtaagatcaagaacatggagatggaagagaaagtgaggagggagattaagattctacggttgtttatgcatcctcatattattcggcagtatgaggtaatagagaccacgagtgacatttatgttgtgatggagtatgtcaagtctggagagctctttgattatattgttgagaaaggcagattacaagaagatgaggctcgtaactttttccagcagataatatctggtgtagagtactgccatcgtaatatggttgtccatagagacctgaagcctgagaatttactattggattcgaggtgtaatattaagattgcagactttgggttgagtaatgttatgcgggatggtcattttctaaagacgagttgtggaagccccaactacgctgctcccgaggttatatcaggtaaattatatgctggacctgaagtagatgtatggagttgcggagttatattgtacgctctattatgcggtactcttccttttgatgatgaaaacattcccaaccttttcaagaaaattaagggtgggatttacactcttccaagtcatttatcatctgaggctagagacctgatcccaaggatgcttatagttgacccggtgaaacgaatcaccattcctgagatccgtcaacaccgttggttccagactcatctccctcgttatcttgctgtctctccaccggatacagtagagcaggctaaaaagatcaatgaggagatagttcaagaagtggttaacatgggatttgatagaaaccaggttttggaatctctacgcaacagaacacaaaacgatgctactgttacatactacctgttattggataaccggttccgtgttccaagtggctatctagaatccgagtttcaggagacaacagacagtggttccaatcctatgcgcacacctgaagcgggcgcttcacctgtaggccactggattcctgcacatgtggatcactacgggttgggagcaagatcacaagtccctgttgatcgaaaatgggctcttggacttcagtctcatgcgcatcctcgtgaaatcatgaatgaagttttgaaagctcttcaagaactcaatgtgtgttggaagaagattggtcactacaacatgaaatgtcgatgggttcctggtttagctgatggtcagaatactatggtcaacaatcagctgcacttcagagatgaatccagcatcattgaggatgactgtgccatgacttcacccactgtcatcaaatttgaacttcagctatacaaagcccgggaagagaagtacttgctggatatacagagagttaacggtccgcagtttctcttcttggatctatgcgccgcctttcttacagagcttcgtgtgatctga

SEQ ID NO: 163 - DNA, 345 bp, Arabidopsis thaliana
atggcttcggaagaaggacaagtgatcgcctgccacaccgttgagacatggaacgagcagcttcagaaggctaatgaatccaaaactcttgtggtggttgatttcacggcttcttggtgtggaccatgtcgtttcatcgctccattctttgctgatttggctaagaaacttcctaacgtgcttttcctcaaggttgatactgatgaattgaagtcggtggcaagtgattgggcgatacaggcgatgccaaccttcatgtttttgaaggaagggaagattttggacaaagttgttggagccaagaaagatgagcttcagtctaccattgccaaacacttggcttaa

SEQ ID NO: 164 - DNA, 360 bp, Arabidopsis thaliana
atggcggcagaagagggtcaagtgattggttgtcacacgaacgatgtatggactgtgcaacttgataaagccaaagaatccaacaagctgattgtgattgatttcactgcttcatggtgtccaccatgccgcatgattgctccaattttcaacgatttggccaagaagttcatgtcaagtgccatcttcttcaaggtggatgttgatgaacttcagagtgttgctaaagagtttggtgtggaggcaatgccaacctttgtgttcattaaagccggcgaagttgtggataagctcgttggtgcgaataaagaagatcttcaggcgaaaatagtgaagcatactggtgttacaactgcgtaa

SEQ ID NO: 165 - DNA, 1587 bp, Arabidopsis thaliana
atgggtttcatagtcggcgttgtaatcggactcctcgtcggaatcgcaatcatcatcggctttgtcaagttggagaattctcgatccaagcttcgctctgaacttttgacttggctcaaccatcacttgacaaagatctggccttatgttgatgaggcagcctctgagcttataaaggcatccgtggagcctgttcttgagcaatatagacctgccattgtggcctccttaacattttctaagcttactctcggtacagtggcacctcaatttacaggtgtttccgttatcgacggtgataaaaatgggattaccttggaacttgatatgcaatgggatggaaacccaaatatagtacttggcgtcaagaccttagttggtgtatccctccccattcaggtgaaaaacatcggattcactggtgttttcaggctaatttttaggccactagttgaggactttccctgctttggagctgtcagcgtttctcttagagaaaagaaaaaattggacttcacccttaaggttgttggaggtgatatttcagcaattcctggactttctgaagctattgaggtggaatcatatgtgtttatcttagaacttgctagacaggttggcaatttgagtagacagcttaaatttttttgtgtttctattcccagcgatctggagctaaagcctgttggaatgttagaggtgaagcttgtgcaagcaaagaacttgaccaacaaagatctagttggaaaatcagacccctttgctaaaatgtttatacgccctttgcgtgaaaagactaaaagaagcaagacaattaacaatgacctgaatcccatctggaatgagcattttgaatttgttgtggaagacgcgtcaactcaacatttagtggtcagaatatatgatgacgagggtgtacaagcatctgagcttattggttgtgcccaaatccggctttgtgaacttgaacctggtaaagtgaaagacgtctggttgaagctggtcaaagatttggagatccagagagatactaagaaccgtggagaggttcaccttgagctcctttacatcccttatggttcgggaaacggcattgtaaatccctttgtcacttcatcgatgacgtccttagagagggtgctcaagaatgatacaacagatgaagaaaatgcatcaagccgtaaaagaaaagatgtcattgtaagaggagttctctctgtgacagtgatatctgcagaagagataccaatacaagatctgatggggaaagctgatccatatgttgttctctcgatgaagaaatcaggtgccaagagcaaaactcgggtcgtcaatgacagcttgaacccggtatggaaccagacttttgattttgtagttgaagacgggttacatgatatgctagtccttgaagtctgggaccacgacacctttggaaaggactacattgggagatgtatcctcacgttgacaagggttataatggaagaggagtacaaagactggtacccattagacgaatccaaaacgggcaagcttcagctgcatctgaagtggatggctcaatcaatttatcgtgattcctaa

SEQ ID NO: 166 - DNA, 315 bp, Arabidopsis thaliana
atggcgataaagaagtcgaacaaagcggcgttgtctcaagcagcatctctaaagcaaatcttgaagaggtgctcaagtctaggaaagaagaatcaaggtaattgctacttcaacgacgtgccaaaaggtcacttcccggtctacgtcggtcaacaccgaagtcgctatgtggtcccaatctcgtggctagatcatcatgagttccagtcactcctccaactagccgaggaagagtttggtttcgagcacgagatgggtctcactatcccttgtgatgaagtcgtctttcgttctctcatctcaatgttcagataa

SEQ ID NO: 167 - DNA, 1104 bp, Arabidopsis thaliana
atggaggatccttctaacccacaaccaaaccagagcaatctctcgcaatgcccgcctttagccacagctccgacacctgcgccagttcgtggtccgtaccaccggagagcacattcggaggtccaattccgtctccctgaagatctggatctctctgaaccattcggaggattcgatgagcttggatccgaagatgatctcttttgctcatacatggacattgagaaacttggatccggatccggatccgcatccgattcggctggtccttctgctcctaggtctgataacccgttttccgctgagaatggaggtgcggaggctgggaattcgagacctcgacacaggcatagcctctccgttgatggctcttcgactttggagtcaattgaggctaagaaagctatggctcctgataagctcgctgagctttgggtcgtcgaccctaaaagagctaaaaggataattgctaatcgacagtctgctgctcgttcgaaagagaggaaggctcggtatatcttggagctcgagaggaaagttcagaccttgcaaactgaagctactaccctttcagcacagttgtctttgttccagagagacacaactggtttgtcatctgagaatacagagctcaagcttcgtttacaggtcatggaacaacaagctaagttgcgagatgcactgaacgagcaactgaaaaaggaagttgagaggctgaaattcgccacgggagaagtctcacccgcggatgcttataacctcggaatggcacacatgcaatatcagcaacaaccacaacaatccttctttcaacatcatcatcagcaacaaaccgatgctcaaaacctgcaacaaatgactcatcagtttcatctcttccagcctaacaacaaccagaaccaatcttctcgcacaaaccctcccaccgctcatcagcttatgcatcacgctacttctaatgccccggctcaatctcattcctattcagaggcaatgcatgaagaccatcttggccggttacaggggcttgacattagcagctgtggcagaggctcaaactttggtaggtctgacaccgtcagtgaaagcagcagcactatgtga

SEQ ID NO: 168 - DNA, 1329 bp, Arabidopsis thaliana
atggaacaacaattaaccttagtattgcttgatagcccaaaaggcgccaaatatgtagaaacctttgaagaagccgcttcttcttcttcttcttcttcttcttcttctgttccctcctgcactgatcaccgccatcgaaccttcgtcaaattcttcctttacttctctctcgtcgctcttgcttactatttcatcatctccagtctcgccgtctctccaattcccccaacattgccgcaatcttctcccggaaacgtttcatcagcaaagtgtgatcttttcaccggagattggataccagatccaacaggtcctctgtacacaaatgtcacttgtcgtcacattcaagattttcagaactgcctattgaatggacgaccagatgtgaattatctcttctggagatggaagcctcgtgattgtgatcttcctaggtttagtccatcgcagtttcttgcttcagtgaagaacaaatggtgggcttttatcggtgattccattgctcgtaatcatgtccagtctctcatctgcattctctctcaggtggaagaagtggaggaaatctatcacgataaggagttcagatccaagatatggagattcccttctcacaacttcacactatcagtcatttggtctcctttccttctcaaatccgaaacatctagcaactcggatattcagctttacctcgaccagcttgaccacaaatggactgtccaatacccgaaattcgactacgttgttatctctggaggcaaatggtttcttaaaacaacaattttccatgaaaacaacgtagtcacgggctgtcattactgccaaggaagaaacaacctaactgatctcggctatgattactcctaccgcaaaaccctaaaccttctccgtgacttcgtcctaaactcaacccacaaaccgctggttctgtttcgaacaacaacgcctgaccatttcgaaaacggagagtggaacactggtgggtattgcaacagaacgatgccgtttaaagaaggccaagcaaatatgaaaactgtagatgatgtgatgcgtgatgttgagcttgaggtgtttcagaaatttgggaaaggttttggcttaggttccaacatcaggctattagacacgactggaatgtctcttctccgtccagacgggcatccgggaccataccggcatccaaatccttttgctggagttaagaataagagcaatgttcagaatgattgtctgcattggtgcttacctggtccaattgattcatggaatgatgtgatggtggaaaccacgcttaaccgggaacgggaactatacgatttaaccggttaa

SEQ ID NO: 169 - DNA, 1215 bp, Arabidopsis thaliana
atgtctgcgaagatcaaaggagagtattcttctagaagcttcgtatcgagaaaatggacgatattactctgcttaggaagcttctgcgtcggaatgttcttcaccaatcggatgtggaatattccggaatctaaaggcatgtctcatccatctgtaaccgaagctgagagattgaagctggtctctgaaggctgcaatccaaaagctaaagaagtcaaaagagatcctcaggctttgtttggagaagtagccaatacacatattgcattacagacattggataagaccatttcaagcttagagatggagttagctgcagcaaggtcagttcaggaatctttacaaaacggtgctcctttatcagatgatatggggaagaagcaacctcaggaacagagacggtttttgatggtcgttgggattaatacagcttttagtagcagaaagagaagagattctattcgagcaacttggatgcctcaaggtgaaaaaaggaagagactagaagaggagaaggggattatcatccggtttgtcattggtcacagtgccacgaccgggggaattctagatcgagctatagaagctgaggacaggaagcatggagatttcttgagactggaccatgttgaagggtacctagagttgtcaggcaagacgaaaacttacttttctacagcattttcgatgtgggatgcagatttctatgtcaaagtagatgatgatgttcatgtcaatatagcaactcttggggaaactcttgttagacaccggaaaaaaccacgggtctatattggttgcatgaaatctggccctgtcctctctcaaaaaggggtgaggtaccatgagccagagtactggaagtttggtgaaaatgggaacaaatacttccgtcatgctactggacagttatacgccatttcaagggacttggcttcttatatatcaatcaatcagcatgttcttcacaagtatgcgaacgaagatgtttcgctaggagcttggtttatcgggattgatgttaaacacattgatgatagaagattatgctgcggaactcctcctgattgcgaatggaaagcacaagctggaaacatctgtgtagcatcattcgactggagctgcagcggaatctgcagatccgcagatcgcatcaaagaggttcatagacgttgcggtgaaggtgaaaaggctctttggagtgccacgttttga

SEQ ID NO: 170 - DNA, 2082 bp, Arabidopsis thaliana
atgtggaagtttaaaccttttgctcaaaaagaacctgcgggtctcgaaggtcgatttctcgagataggaaatctgaaagttcaagttagaaatgtcattgcggaaggaggtttctccagtgtttacttagctcaagatgtaaatcacgcgtcaaagcaatatgctttgaagcacatgatatgcaatgacgaggagtcacttgaactcgtaatgaaagagatctcggttctgaaatccctcaagggacatccaaatgttgtcacgctctacgcacatggtatcttggatatggggaggaataaaaaagaagctcttttggctatggatttttgtggtaaatctcttgtggatgtgcttgagaatagaggtgctggttactttgaagagaaacaagctcttacgatttttagagatgtgtgtaatgctgtctttgcaatgcattgtcaatccccacgcattgctcacagagacttgaaggctgagaatcttctattgagctcagatggacaatggaaattgtgtgattttggaagcgtttcgacaaatcacaagatttttgaaagagcagaagagatgggaattgaagaagataatattagaaaatacacaacaccaacatatagagctcctgagatgtgggatctctttcgaagggagatgataagcgagaaggtcgatatatgggctcttggatgtctcttgtttcggatatgctatttcaagaatgcatttgatggagaatcaaagctgcaaatcttaaacgggaattatcgtattccagaatcgcctaaatacagtgtatttattacggatctcatcaaagaaatgctccaagcttcacccgatgaacgaccagatattacacaggttaaaagtcaatttttactcattgtttcttctcagttgaggaaatgtaaaatgtctctaacaacatgctcatcaaaatcagcaactaaaccttctccagcacctcgtagaagtccgccaccgccgccaccatcttctggagaatcagatagtggaggaccgctcggtgccttttgggcgactcagcatgctaaaacctcagttgtatcagaagataacaaaaacatgcctaaatttgatgaaccaaacagtaacacatctaaatctgaaagagttcgtgtggatagtcatcaacccaaaaaaccaagtcctgtgagaggagaggctcgtggtattcaaagaaataaagatcttgaaactacgatttctcagaagaatacaactcctgctgcagccaataacatgacaagagtgtccaaggatgatgccttcaactcgtttgttgctgactttgataccacaaagttcgataatggtaataaacctggcaaagaagaggcattggaagctgagatacagaggttaaaagacgagttgaagcaaacaaaatcagagaaggcagaaataactgctaagtttgaaaagctttctgctatctgcagatcgcaaaggcaagagttgcaggatctcaaacaaacacttgcctctaaaagtgcctcaccgtcaccgagcagagactcttcacaaaatcaaccctctccagggatgcattccatgtcatcaactccatcggtattattcttggttcttgttcatctaagcttagacacccatacaaaagtcttcatcaatgtatatcttagaattctaatgttcttgatgaaacagagagataagatggaaggaacaatgtgggaacttcaacaggacagatctaactggtcaactggcagctctgatacaaattcatggcaaccttttagtgatgaagcgaaacccgtgatggaatctgcatcaaagggtaacaataatacgattaatcagtctgtgagaaccagaagtaaaccagcttctgctgcaggtactcaaggttttgagccatggggtttcgagacagaatcctttagagccgctgcaacgtctgcagctgctacttctgcatctggaacacaaagatctatgggctctggaaacagcacttcacagagatatgggaactcaaagatgagagaaaaccagaaaacagctcaacctgctggatgggccggcttctaa

SEQ ID NO: 171 - DNA, 480 bp, Arabidopsis thaliana
atggaatcgtcgtcgtcgggaacaacttcgtcgacgattcaaacgtcgtcaggatcggaggagagtctcatggagcagaggaaacgtaaacggatgctctcaaaccgtgaatctgcaaggagatcaagaatgaagaaacaaaagctcctagacgatctaacggctcaggttaatcatctgaaaaaagagaacacggagatcgtgacaagtgtcagcatcacaacgcaacactacctaaccgttgaagcagagaactctgttctcagagctcagcttgatgaacttaaccacaggctccaatctctcaacgacatcatcgagttcctcgacagtagcaacaacaacaacaacaacaacatgggcatgtgttcgaaccctctggttggtttggagtgtgatgatttcttcgtgaatcagatgaacatgtcttatattatgaaccagcctctcatggcgtcttctgatgctttaatgtattaa

SEQ ID NO: 172 - DNA, 1092 bp, Arabidopsis thaliana
atgacgactcgaatcgctcctggtgttggagctaatcttctcggccaacactccgctgagaggaaccaagacgccactgtttacgtcggtggtctcgatgctcagctttctgaagaattgctttgggaattgttcgttcaagctggacctgttgttaatgtctatgtaccgaaagatagagtgacaaatcttcatcagaactatggattcattgaatatcgtagtgaggaagatgctgattatgcgattaaggttcttaacatgattaagctccacgggaagcctatacgtgttaacaaggcatctcaagataagaagagcctggatgttggtgctaaccttttcattggaaaccttgaccctgatgtggatgagaagctcttgtatgatactttcagtgcatttggtgtgattgcttctaatcctaagataatgagagatcccgatactggaaactcacgaggttttggtttcatcagctatgactcctttgaagcatctgatgctgctattgagtcaatgactggacaatatctcagtaatcgtcaaatcacagtctcttacgcatacaagaaagacaccaaaggagagcgccatggtactccagcagagaggcttttggcagccacaaatccaactgcccagaaaagcagaccccatacgctattcgcaatgggccctccatccagtgctcctcaagttaatggtctaccacgtccgtttgctaacggcagcatgcaacctgtcccgattcccgctccccgtcaaccaccaccacctcctccacaagtatatcaaactcagccaccatcctggccatctcagccacaacaacacagcatggtcccaccacccatgcaattccgtccacctcagggtatgcctccgccaccacctcctcagtttctaaatcaccaacaaggtttcggtggtccgaggccgccgccaccacctcaagccatgggaatgcaccaacatggaggatggccaccgcaacacatgcagcagcaaggtggaccaccacaacaacaacaaccaccataccaacaccatcacatgtctatgcctccaccaccaccacaccaaggttga

SEQ ID NO: 173 - DNA, 1146 bp, Arabidopsis thaliana
atggccggagctggcgtcgatgatttcgttaaaggaaatgtttttccgaatggtgtcgctctcatcactctcgatcgaaccaaagctctcaacgccatgaatttagatatggatataaagtataaaagctttcttgatgaatgggaatctgatccgagagtgaaatgtgttatcgttgaaggaagcacatctagggccttttgtgcagggatggatattaaaggagttgctgcagaaatccaaaaggacaaaaacacacctcttgtgcaaaaggtatttacagcagagtatacactgatatgtgcaattgctgcgtacaaaaagccatatatttcattgatggatggtataacaatgggatttggtcttggtctttctggacatggtcgctaccgtgtgataacagagaggacggttcttgccatgccagaaaatggaattggcttgttccctgatgtcgggttttcatatatagcagctcatagccctggaggaggatctgttggtgcttatcttggtttgactggtaaaaggatctccgcgccatcagacgcactgttcgttggtcttgggacgcattatgtaccatctgaaaagctagcttcattaaaggaagccattttgtcagctaacctttctgaggatcctaatcaagacatccaagcaactttatcaaaatacagcagcaatcctgaatctgaggcccatctcaaatcacttttgcctcacatagagtcagcctttagctcaaataagtctattaaggaaacaatagaagagctcaaaaagtaccagcaaagcactgagtcttcagttgtagaatgggctaatgaggcactcaaaggtttggaaaaaggagcaccattttctctttacctaacacaaaagtatttctccaatgttgcatgtgccaagagtaaacccgaaaacgaattagcaacacttaatggcgtaatgaaaactgagtatcgcattgcactaagatctgccctgcgtggtgattttgctgaaggtgttagagcagttttgattgacaaggatcagaatccaaaatggaacccgacaagcattgaagaggtagacgaaaacgaagtggaagctctgtttaaaccattaagtccagaagtggaagagttaaaagtctga

SEQ ID NO: 174 - DNA, 1716 bp, Arabidopsis thaliana
atgaatcactccacttctgaccagagcctctacatcgagagtgatgatggagatgacgagagaaaacacttgtccgacgatgaagacgacgatggaactctttctgatacttctgacgcttacaatcaaaaccaacatcatctgtctaaagctagcccatactcaacggcatggcctaagagttataggcaatcgattgatatgtttggaagtgtaccatcaccaaatttgggttttcttgctaattcttctatgtcgagaagaggaagctcattcatgtcttcgacactgacaagaagacatactccagaatcattaccttgtgttacaaagcctctcctagaagatgaagaagcaccaaaacataaacttagcactcattctttgcttccgtcgaaaccatcgtcatccatggtggtgtctcatgatatgggaatctccaatgatagctcctttggacaggctgttcttaatggagtgaatgttttatgtggggttggaatattgtcaacaccatatgctgtgaaggaaggaggatggttgggacttatcattctctttgcatttggtattctttgtttttacaccggtttgcttctgcggtactgcctcgacagccaccccgatgtccagacctatcctgatattggccatgccgcttttggttccaccggccgcatcctggtctccgtaatactctatatggagttatatgctatgagtgttgaatacataatattggaaggtgataatctttcatcaatgtttccaaatgctagtctaagtattggagggtttcacttagatgcgcctcgtctatttgctctgcttaccaccctcgctgttctcccaaccgtttggcttcgagatctcagcgtactaagttacatttcagctggaggggtgattgcatcagtgttggtggttttgtgcttgttttgggttggtttggttgatgatgttggtattcacagcaaaggaactccactaaacctcgcaacattaccggtttctgtaggactctatggttattgttactcaggacatggtgttttccctaatatttacacttcaatggccaaaccatctcaattttctgctgttctcttggcatcttttggaatttgtactcttatgtatgcgggtgttgctgttatgggatatagcatgtttggagaatcaacagaatcacagtttactcttaacttgcctcaagatttggttgcatctaagattgctttgtggactacaaaagaaagcacatatgctttgacattatctccagttgcaatgagtcttgaggagttaataccatcaaactatgggaagtcacgtttctacgcaatcgccattagaagtgcattagccatctctactctgctcgttggtcttgcgattcccttcttcgtgaatttgcttagcctgacaaagtttctggacacagacgctgatactaccgccagcttgtttcttgagcatcttaaggaaaaaagtaacccctactcagatcttgtatcacagaccttgcaagtgaagaccatcatgaagtcatgcctcgggtttatttttaactgggacttgtacttcaccatcatttcctcagagggcgtcgcaggggagggaactttggccgattcagtagcagagtttgacgagttgcagacattggttacagaagcttcatttgcctcacggattacagataactgtctctga

SEQ ID NO: 175 - DNA, 2265 bp, Arabidopsis thaliana
atgacaaataacgagctgattatgtcgggaaaccacgatatctcgtttaggcaggagcaatatatggaagctcgacagaacaatgaactttttactagtcatgattacaattttgctttggaaccattacaagagaccaacctgcagataggtgtttcccgtgagcaaaatgaggtttggaaccacggccaggaacatgcattggctctacaaaactcagggactcacagtgaagaaatacatgaaaagcaacttgtggaaggaaaagatgaggttgattctcaggaaaaccaaaatgaaagctatgaccatacttttgacctctcctttcctgataatgatgactcgggaacttcagagaatgataaacttgctttattagtttctcaggatctcaatgataatttacagttggcggtgggtcattgcatgaatagggatcccttacctggcctgaacataagcctttctcagcagctagagttggctcctcctatccttcaatgccggtctctgcaaacagctcctgagcacaatttgatcgttggtatggaattttctgatgtccttgcgtgtaggagagcactcagagatgcagcaattgccttacgctttgagatgcagactgttaaatctgacaaaactcgcttcactgctaagtgcaatagtgagggttgcccttggagaattcactgtgccaagcttcctggtctaccaacctttacaataaggactattcatgggagtcacacatgtggtggtatttcacaccttggtcaccatcaagcttcagttcagtgggttgctgatgctgtgacagaaaggctgaaagtaaatcctcattgcaaacccaaggagatactggagcaaattcatcaagttcatggaattacactaacatacaagcaagcatggaggggaaaagaacgtataatggctgctgttcgcgggtcatatgaagaagattatcgccttcttcctcgatattgtgatcaaattaggagaacaaatcctgggagcgttgctgtggttcatggaagcccagttgatgggagcttccaacaattcttcatttcttttcaagcatcaatctgtggttttctaaatgcttgtcgacctcttattggattggacaggactgttttgaagagcaaatatgtagggacattgctgcttgccactgggtttgatggagaaggtgcagtgtttcctttggctttcgctattattagtgaagaaaatgatagtagctggcagtggttcctctcagaattgcgtcagctgcttgaagttaattccgaaaacatgccaaagctgacaattttatctagtagagatcaatccattgtcgatggagtagatactaattttccaacggcgtttcatggcttgtgtgtccattgtctcacagaaagcgtccgtactcagttcaacaactccattcttgtgaaccttgtttgggaagcagcaaaatgtctgaccgactttgaatttgaaggaaaaatgggagagatagcccagatatccccagaagctgcctcgtggattcgtaacatccagcacagtcaatgggccacatactgctttgaaggaacaaggtttggacatctgactgcaaatgtttccgagtcacttaatagttgggttcaagatgcgtcaggtcttcctataatccaaatgttggagagtattcgtcgccaactaatgactctgttcaatgaacgccgtgaaacaagcatgcaatggtctggtatgctagttccatctgctgagagacatgtccttgaggctatagaagaatgtcgtttgtacccagttcacaaagcaaacgaagcacaattcgaggtcatgaccagtgaaggaaaatggatagtggatattagatgccgtacgtgttactgccgtggatgggagttatacggtttgccttgtagccacgcagttgcagccctcctcgcttgtagacagaacgtatacaggttcacagagagttacttcactgtagcaaattaccggcgaacttacgcagaaaccatacatccagttccagacaaaactgagtggaaaacaacagaacctgccggagaaagtggtgaggatggtgaagagattgttatcagaccacctagggatttaagacaaccaccacggccaaagaagaggagaagtcaaggagaggaccgtggacgtcaaaagcgggttgttcgatgtagccggtgtaatcaggctggccatttcagaacaacttgcacagctcctatatga

SEQ ID NO: 176 - DNA, 1539 bp, Arabidopsis thaliana
atggaatgctctgcaactcctcccaagctttatccaaccgtcgacacttcaaccaccgttgctcctctccctaagtcctcttcctcctcctcttctactaataataataatctctatccttcaatcaatgtcaatgatcttgtcaacaatatcttccccgatcccaccgcctctgactcagcttcagcgcctcctctcgcgacggaggaagtgattctcacaatccacggcgcgatggtccacctcattgacaaatcctacagcgtagagctcgcttgcggcgatctcgagattctccgtcttgttcaaggagatatcaccgtcgcggttttcgctcgcgtcggtgacgagatccaatggccgttgactaaagacgaacccgccgttaaagtcgatgagtctcattacttcttctcgctccgacccgttaaagaatccgagtcatcggatcattcagtcaacgaaacagagaacgagatgttgaactacggattaacaatggcttcgaaaggtcaagaaccgatgcttgagaagctagacaagatcttagctgattacagtagtttcacagcggaggagaaacagaaagaagagaacgttttggatttgacggcggcgaaggagacttcaccggaggagctgaagggaaagaggaaaaagatggtggagaagcagtgtacggcttattggacgactctggctccgaatgttgaggattacagtggcgttgcagcgaaactgatcgctgctggttctggtcaattgattaaagggatcttatggtgtggggatctcacaatggatagactcatgtggggaaatgatttcatgaagaagaagttgtccaaagcagagaaggagagacaagttagtcctggaactttgaaacgtctcaaaagagtaaagaagatgacaaaaatgacagagaaagtggcgaatggtgtgctctctggtgttgttaaagtttctggattcttctcgagttcagtgataaatagcaaagctgggcagaaactctttgggcttcttcctggagaaatggttcttgcaacacttgatggattcaacaaggtttgtgatgctgtcgaagtagcaggaagacacgttatgaaaacaacttcagatgtaactactgaaatcgtcgatcacaagtatggagcaaagacagcacaagcgacaaacgaagggcttagcgcagcagggcatgcttttggaacggcgtggactgttttcaagattagacaagctcttaaccccaagagtgccatgaagccatcatcactcgctaaaaccgttgatgagcagaagcaagctgctgctgatgtgttgtttagttattccaagtttgcaatggcctgcattggtaaccatactcgtcctactgacatgaggttgcatttgatgaaggagatctctggaatgccaacttctctgaaaggaagagactcttctagagcagcttctcctgatccacttggcgaatcatcaagctccggtactgccaggctagataaaacggatagtttcagggcactttga

SEQ ID NO: 177 - DNA, 1230 bp, Arabidopsis thaliana
atgtcgacgaagatcaaaggagagctttttccctccagaagtttagtatctaaaaaatggacatttttactctgctttgggagcttctgcttcggaatattattcaccgataggatgtggattattccggagtctaaagacatgcctcgaccatctgtaagtacagaagctgaaagattgaagctgatctctgagggctgtgatccgaaaaccctctaccagaaagaagtaaatcgtgatcctcaggcattgtttggagaagtttccaagactcataacgctatacagacattggataagactatttcaagcttagagatggagttagctgcagcaagatcggctcaggagtctttagtaaacggtgctcctatatctaatgatatggagaagaagcaattaccggggaaaagacggtatttgatggttgtagggattaatactgcttttagtagccgaaagagaagagattctgttcgaacaacttggatgccttcaggtgagaaaagaaagaagttggaagaagagaagggaattattatacggtttgtgattggtcatagtgccacggctggcggaattctagaccgatccattgaagcagaggacaagaagcatggagatttcttgagattggaccatgttgaaggataccttgagttatcaggcaaaacgaaaacatatttttctacagctgtttcgaagtgggatgcagagttctatgtcaaagtagatgatgatgttcatgtaaatatcgcaactcttggggaaactcttgttagacacaggaagaaacatcgagtctatctcggctgcatgaaatctggtccagtactatctcaaaaaggagttagataccatgagcctgagtattggaaatttggtgagaatggaaacaagtacttccgtcacgctactggacagttatacgccatttctagagacttggcttcttacatttcccttaatcagcatgttctgcacaaatatgcaaatgaggatgttacattaggtgcttggtttatcgggcttgatgtgacacatatcgatgatagaagactatgttgtggcactcctcctgattgtgaatggaaggcacaagcaggcaacatatgtgtagcttcattcgactggacgtgtagcggtatctgcagatcagctgatcggataaaagaggttcacaagcgatgtggtgaaccggaaaacgctatttggaaagccagattttga

SEQ ID NO: 178 - DNA, 1368 bp, Arabidopsis thaliana
atggattccagagagatccaccaccaacaacagcaacaacaacaacaacaacagcagcagcagcaacaacagcaacatctacaacaacagcaacaaccaccgccagggatgttaatgagtcaccacaattcctacaatcgaaaccctaacgccgccgccgctgttttaatgggtcacaacacctccacatctcaagctatgcatcaaagattaccttttggtggttctatgtcaccgcatcagcctcaacaacatcagtatcatcatcctcagcctcagcaacagatagatcagaagactcttgaatctcttggatttgatggatcgccttcttctgttgccgccactcaacaacattcgatgagatttgggatcgaccatcaacaggttaagaagaaacgaggtagacctaggaagtatgctgctgatggtggtggtggtggtggtggtggtagtaacattgctcttggtttggctcctacttcgcctcttccttctgcttctaattcttacggtggtggaaatgaaggaggtggtggtggtgatagcgccggagctaatgctaactcttccgatccacctgctaaacggaacagaggacgtcctcctggctccggaggaacaggaggagttgggttcacgcctcatgtcattgaggttaaaacaggagaggacatagctacgaagatattggcgtttacgaaccaagggccacgcgcaatctgtattctctcagctacaggagctgtaactaatgtgatgcttcgtcaagctaacaatagcaatcctactggaactgttaagtatgagggccgatttgaaatcatttctctgtcaggttctttcttgaattctgagagtaatggtactgtgaccaaaactggtaacttgagtgtgtcgctggctggacacgaaggccggattgtgggtggatgtgttgatggaatgctagtagctggatcacaagtccaggtcattgtgggaagctttgtaccagatggaaggaagcagaaacaaagtgcggggcgtgctcagaatactccggagccagcttcagcaccagccaatatgttgagctttggtggtgttggtggaccgggaagccctcgatctcaaggacaacaacactcgagcgagtcatcagaggaaaacgaaaaagcaacaacaacaacagcaacaatcatgggatatttggaaactctacacctcaaccgcttcaccaaattcctatgcagatgtaccagaatctctggcctggcaacagtcctcaataaacagatggttcatgggtcaagatttgaccgggtttgcttctctgttccttttgacacatctctccatcagatttatctctataaagtagattga

SEQ ID NO: 179 - DNA, 1647 bp, Arabidopsis thaliana
atggggagcttatcttctgaggaagacgacgaagtctcttccgagagatgcggaagttacagtcccagcgccgacattagcgagtccgagagttccagcagcttctcctgccaccgcttcgacggcgagggtgcctctagctccatcccttcttcccctcgagttgtcgctggtagaggattttacttcccggccccagtcatgcttccggtgatcggcggcaaagatgtggtctgggatgacaaacaaccagacaacgatttatccgaaattgagatgatgaaggagagatttgctaagctacttctcggggaagacatgtctggtggaggtaaaggggtttgtacggcgcttgctatctccaacgccatcaccaatctctctgcgactgtgtttggcgaactatggaggcttgagcctcttgctcctcagaagaaggccatgtggcgcagagaacttgagtggctgctctgtgttagcgattctatcgttgagctcattccttccattcagcagttccctggaggcggaacttatgagatcatggagacccgtccacgttctgatctctatgccaatctccctgctctcaagaagctcgatgctatgttgatcgatatgcttgacgctttctccgatactgagttctggtacactgatcgcggcatagttcttggtgattgtgacaaggattcttacaattctccagcttccgttaggcaggaggacaagtggtggctgccttgccctaaggttccgcctaacggtttgtcagaagaggccaggaagaaactgcagcagtgtcgggactttgctaaccagattctcaaggctgcattggcaattaacagtggcgtgcttgccgaaatggagattcccgacccttacttggagactttgcccaagagcgggaaggaatgtcttggagagatcatctaccagtacttaactgcaaacaagttctctcccgaatgcctcctggactgtcttgatctctcatcggaacatcagactcttgaaatcgccaaccggattgaggcggctgtgcatgtttggagacaaaagaatgggaggaggcacaagaagcaggcgaaactaaagctgtcttcttggggtggcaaggttaaaggccttgttaatgacaacgaaagaaatgatttccttgtgcagagagccgagaccctcttgcagagtctcaggatccgtttcccgggacttccccagacaacgctggacatgaacaagattcagtacaacaaggatgtagggcaatcaattctggagagttactctagggtgatggagagcatggccttcaacatcacggccagaatagatgatgtgctttatgttgatgatgccatgagaagatccatctctgtcacagaatcgctatccctattcagcatcaatggactcaaccctcaaaaagcgttctctgtgcagagctctccgcacggttcaccatttgcaacgcctgccctaagtgtagcatcaagaagcccgaggagagcaccgccgctgtattcagtgaagaggaatgggacgagagagaagggaatagtgggagaaacagagaaagcatggtcgtatgcagggaatctgagttcaagaagagtaacgggagtgacgccggaaagagattaa

SEQ ID NO: 180 - DNA, 1005 bp, Arabidopsis thaliana
atggcacctgagatgaacaacaagttgagctacggagaaaagaagagagcgtacgttacgttcctcgccggaaccggagactacgtgaaaggagtggttggtctggctaaagggctaaggaaaactaaaagcaagtacccattagtggttgctgtgttacctgacgtgccggccgatcaccggagacagctattggaccaaggctgcgtcatcaaggagattcagccggtttacccaccggataaccaaactcagtttgctatggcttactacgtcctcaactactctaaacttcgtatttggaagtttgtagagtacagcaagctgatatacttagacggagacatacaagtgtttgagaacatagatcacttgtttgatcttcctgacggcaacttctacgccgttaaagactgtttctgcgagaagacttggagccacacgcctcagtacaagattggctactgccaacagtgtccggacaaggtgacgtggcctgagtcagagcttggtcctaagccaccgttgtacttcaacgccggcatgttcgtctacgagccaagcctccccacttattacaaccttttggagacactcaaagttgtccctcccacaccttttgctgaacaggatttcttgaacatgtacttcaaagacatatacaagcctattccaccagtttacaatcttgtcttggccatgctctggaggcatccagagaacatagagcttaacgaagctaaggttgttcattactgtgcagccggtgctaagccttggaggttcacaggccaagaaggaaatatggagagggaagacatcaagatgcttgtagagaaatggtgggacatttacaacgacgagtctcttgactacaaaaactttaatgtgcattgcggacaaaaagaagatgttcacaggaaaccgaaaacccttccacagttctttacagatttgtctgaagctgatgtgcttcaatgtgccaaagctccatccgcggcttag

SEQ ID NO: 181 - DNA, 990 bp, Arabidopsis thaliana
atgatactccggcagcagccaccaccaccgtccgctccaccacagccgcagacatccccatactacgaggtagccgagctgacgtgggagaacgggcaactaggcttgcacggcttaggtccaccgcgagtgacggcttcgtcgaccaagtactccacaggcgccggtggaacgttggagtcgatagtggaccaagctactcgcctccctaaccctaagcccacggatgagctcgtcccgtggttccatcatcgctcctccagggccgcgatggcaatggacgcgcttgtcccttgctccaacctagtacacgagcagcagagcaagcctggtggcgttggctccacccgggtggggtcatgtagcgatggtcgtaccatgggcggtggaaaacgagcaagagtggcaccggagtggagcggcggcgggagtcagcggctgaccatggacacttacgacaagaggagagataaaatcaatcaaaggatgaagactttgcaaaaactggttcccaattccagcaagacggataaagcatctatgttggatgaagtgatagagtatttgaagcaacttcaagcacaagtgagcatgatgagcagaatgaatatgccttctatgatgcttcctatggccatgcagcaacaacaacaactacaaatgtctctcatgtccaatcccatgggtttagggatgggcatggggatgcccggtctcggtctcctcgaccttaattctatgaaccgagctgctgcaagcgctcctaatatccatgccaacatgatgccaaacccatttttgcccatgaattgtccatcgtgggatgcttcttccaatgactctcgatttcagtctcctctcatccccgatcctatgtctgcctttcttgcatgctctactcagccaacgacgatggaagcgtatagcaggatggctacattatatcagcaaatgcaacaacaacttcctcctccttcgaatccaaaatga

SEQ ID NO: 182 - DNA, 3129 bp, Arabidopsis thaliana
atggcaacttcttctcgttcggagcgatttccgataacgccgagtacggcggctactaatagattgacgattacgcctaattctagggttttgaaaagccctctcactgaagaaatcatgtggaagcggctcaaagatgctgggtttgatgaacaatcgatcaagaatagggataaagctgccttaatcgcttacatcgccaagctagaatctgaggtttatgattaccaacacaacatgggtcttctccttttggagaaaaacgaattgtcttcgcagtatgaagagattaaggcctctgtggatgagtctgacctaacacatatgcgagagaaatcagcatatgtctcggctctagctgaagcaaagaaacgagaagagagtttgaagaaggatgtagggattgcgaaggagtgcatttctagtttggagaagactctgcatgagatgcgcgcagaatgtgccgaaacaaaagtttctgctgggagtactatgtcggaagcacatgttatgatcgaggatgcgctgaagaaacttgcagatgctgaagcaaaaatgcgcgcagcagaggctttacaagcagaagctaaccggtatcaccgaattgcagagagaaagttgaaagaagttgaaagtcgtgaagatgatcttactcggcgtcttgcatctttcaagtctgagtgtgaaacgaaagagaacgaaatggttattgagcgacagactttaaatgagaggcggaagagcttgcagcaagagcatgaaagattattggatgcacaagtttcactaaatcaaagagaagatcacatttttgctagatcccaagaattagctgaacttgaaaaggggttagatactgcaaagaccacatttgaggaggaacgcaaagccttcgaagacaaaaaatccaacttggagattgcgttagccttgtgtgctaaaagagaagaggtttgtttttattcacacaattctctgttatttttggttttgcattataggtcatcaaaaaaatttctgggagacaagatagctgtctctgaaagggaatcttcgctacttaagaaggagcaagaactgcttgttgctgaagaaaaaattgccagcaaggaatctgaactaattcagaacgtcttagcgaatcaagaagttatcctgaggaaaagaaaatctgatgtggaagctgaattggaatgtaagagcaaatcggtggaagttgaaattgagagcaagagacgggcttgggaattaagggaggttgatatcaagcagagggaagacctagttggtgaaaaagaacatgacttggaagttcaatcaagagcattggcagagaaagaaaaagatataacagagaagtcttttaaccttgatgagaaagagaagaatttggttgctacagaggaagatattaaccgtaagactactatgctggaggatgagaaggaacggcttagaaaattggacctggagctgcagcagtctttgacgtcattagaagacaagagaaaacgggttgattctgcaacacaaaaacttgaagccttgaagagtgagacaagcgaattatctactctggagatgaaacttaaggaggaattagatgatttgagggcccaaaagcttgaaatgctggctgaagctgatagattgaaggtggagaaagctaaatttgaggctgagtgggaacacattgatgtgaaaagggaagagttaagaaaagaagcagagtatataactcggcaaagagaggctttttcaatgtatctcaaggacgagcgtgataacatcaaagaggaaagagatgcattgagaaatcagcacaaaaacgatgtggagtcgctaaaccgagagcgtgaagaattcatgaataagatggtggaggaacattctgaatggcttagcaagatacagcgtgagcgtgctgacttcttgttgggcattgagatgcagaaacgagagttggagtattgcatcgaaaacaaacgagaagaattggaaaattcttcaagggatagagaaaaggcttttgagcaagagaagaagttagaagaggagcgtatacagtcgcttaaggaaatggcagagaaagagttagaacatgtccaagtggaactaaagaggttggatgctgagaggttggagatcaaattggatcgtgaaagaagagagagggagtgggcagagttaaaggattcggttgaggagctaaaggtgcaacgagaaaaactagagacgcaaaggcatatgcttcgtgctgaaagagatgaaatccgacatgagattgaagaactgaagaaattagagaatctgaaagttgcattagatgatatgtccatggctaaaatgcagctgtccaatttagagcgtagctgggaaaaggtttctgctttgaagcagaaggttgtgtctcgggatgatgaacttgacctgcaaaatggagtcagcactgtgagtaatagcgaagatggctacaactcttcaatggaaagacagaacggcttaaccccttcatctgccactccattttcatggataaaacgatgtactaatctgattttcaagacttctccagagaaatccaccctaatgcatcattatgaagaagaaggaggagtgccttcagaaaagttgaagctagaatcgtcgagaagagaagaaaaggcttacactgagggactgtctattgcggttgaaagacttgaagcaggaaggaaaagaagaggtaacacatctggagatgagactagcgaaccaagcaataacaaaaagaggaaacatgatgttacccaaaaatattctgatgaagctgatacccagagtgtcatatcaagcccgcaaaatgtgcctgaggacaaacatgaactaccatcaagccaaacccagacgccaagtggtatggtagtcatcagtgaaaccgttaagatcacaagagtaacgtgtgagacagaggtgaccaacaaagtcacaacccttgactgctcagaaagtccttcggaagcagggagaaagatgggagaggagacagaagatggtgattgcaatcaggtagttttcatgaactctttaaagaagaattgcctgcaaactttacaacagatgaataataccctttggctatttctgtag

SEQ ID NO: 183 - DNA, 477 bp, Arabidopsis thaliana
atgtggcaacaacagcagcaacaacaacaacaccaaaacgacgtcgtggaagaaaaagaagctcttttcgagaaacccttaaccccaagtgacgtcggaaaactcaaccgcctcgtcatcccaaaacagcacgccgagagatacttcccactagcggccgccgccgcagacgccgtggagaaaggacttctcctctgctttgaggacgaggaaggtaaaccatggagattcagatactcgtactggaacagtagccagagttatgtcttgaccaaaggctggagcagatacgtcaaggagaagcaccttgacgccggagacgtcgttctcttccatcgacaccgttcagacggcggaagattcttcattggctggagaagacgcggtgactcttcttcctcctccgactcttatcgccatgttcaatccaatgcctcgctccaatattatcctcatgcaggtaccctttttatttaa

SEQ ID NO: 184 - DNA, 741 bp, Arabidopsis thaliana
atggagatgatagtgttcgcggtgaggatgatgatggtggatatagaggtgatgaagctgagtgggaagaacacgagagagattcttgttagtgaaagccatgaagaagtagcgatgatcatcgatcatctctttaagcgtcaagactccgaagagtataaaacatcgcgtgcgctttacgacatctgcgtttcttgtaacccagatcaatgccattttgtgttggcttccatgaacgagatcgaaggagtagtcggaacagagaccaaggagattgtgaggaatgccaaaatgttgattacagaaccacatgatgatcttaagaatggtagagaagagtttgaacgagctacgagattatattgcatcgaaagaggtggaacgtttacaacttggacagtccgaaaggatgaagaagctgcggctagagaagagcagatcaaacgcgaggacgctagaaaaagagatgctgaatctcgtctcgaagtgcttcgtaacgtccgtggtttagcccctctcaccggaggcagagaaggcgtccttgagaaacgtaacgatgaaaatgatagtgttcgaggtgagggtgatgatggtggatgtggtggttatgaagctaagaagaagaagatgagtgggaagaagagcttaaaggagttgaagagggagagggttgagaaggaaagagagagagcccttttcatgaaacagagccagagagccggtggtttttctcggaggtga

SEQ ID NO: 185 - DNA, 390 bp, Arabidopsis thaliana
atggccaagggaagaggcagtgcatcatggtcggctcgagccatagtgactctcatggctgtgtcagtgttgttgcttcaagctgactacgttcaagctgcaacgtacacggtcggtgactctggtatctggacctttaacgctgtgggttggcctaaaggcaaacactttagagccggcgacgttcttgtgtttaactataatccgaggatgcacaacgtagtgaaggtagatagcggaagttacaacaactgcaaaacaccgacaggggcaaaaccttacacttcaggcaaagatcgtataactttgtctaaaggacaaaactttttcatctgcaattttccaaaccattgcgaaagcgatatgaaaatcgcagtcaccgcggtttga

SEQ ID NO: 186 - DNA, 1707 bp, Arabidopsis thaliana
atggtgctaataatagcgttgacatggctccgtagcacgtgcggagagctcgaggaccaactattcgaagtaggaaagcttaagatgttcgtcgacgacctcccagatatgcccagactctatggctttaactctgttcatggtatcatcaaaccagcttctcttcaaatcggcatgttctccactaaatggaaattccacagagatttgcctgcgacgccagtgtttgcatacggtacatcacggagcaaggcaacagttcctggtccgacgattgaaaccgtatatggagtagacacatacgttacgtggcgaaatcaccttcctaaatctcacatccttccttgggaccccacaatctccccagcaactccgaaacacggtggaattcctacggttgttcacttacatggaggaatccacgaaccaacaagcgacggaaacgccgacgcgtggttcactgccggtttcagagaaacaggaccaaaatggaccaaaacgacgttacattacgagaacaagcaacaacctggtaacatgtggtaccatgaccatgccatgggtttgactcgagtcaacctccttgccggtttggtaggcgcctatattcttcgccaccacgccgttgaatctccctttcagctacctactggcgatgagttcgaccgaccgttgatcatttttgatcgtagctttcgtaaagacgggtcaatttacatgaacgccactgggaacaacccatcgattcacccgcagtggcaaccggaatattttggcgatgtgataatcgttaatggaaaagcatggccaagattaaacgtccgacgtaggaaatacagattccgtatcataaacgcaagcaacgctaggtttttcaagtttttcttctccaacggtctagatttcatcgttgtggggtctgattcagcgtatttgtcaaagccggtgatgaccaaatcgattctcttatctccatcagaaattgtagacgttgttgttgatttctacaaatcaccgtcgagaacggtggtgcttgctaatgacgcaccatatccttaccctagtggtgatcctgtcaacgaagaaaatggcaaggtaatgaaatttatcatcaacaatgaatcagaggatgacacatgtacaattcccaagaagctcatcaattatccgaatgctgacgtgtcaaacgccgttctcacgcgttacatctctatgtacgagtatgtgagtaactctgatgagccaactcatttgttagtcaatggtttgccctatgaagctcccgttacagaaactccaaaatcagggactacagaggtatgggaagtgataaatttgacggaagataaccatccgttacacattcatctaggattgttcaaagtggtagagcaaacggcattactggcggcaggattggaggagttcaaggagtgtatgacgaaacaaaacgacgcggtcaagtgtcaaattagcaaatacgctcgtgggaaaaagacagcggtgacggcacacgagaggggttggaagaacgtattcaagatgatgccgggacatgttacgaggatacttgtccgcttttcttatatccacactaatgcatcttacccattcgatccgactcaggaaccgggctatgtctaccattgtcacatattggaccatgaggacaatatgatgatgaggccgcttaaggtcatcatttga

SEQ ID NO: 187 - DNA, 1275 bp, Arabidopsis thaliana
atggcgaaaatgattcctagcctcgtctctctaattcttatcggtcttgttgcgatcgcctccgccgcagttattttcgaggagcgctttgatgatggctgggagaacagatgggttaaatctgagtggaagaaggatgataacactgctggggagtggaagcacactgcgggaaattggtctggtgacgctaacgataaaggtatccagaccagtgaagactacagattctacgccatttcagctgagttccctgaattcagtaacaaggacaagaccttagtcttccaattctcagtcaagcacgagcaaaagcttgactgcggtggtggctacatgaagctactaagtggtgatgttgaccaaaagaaatttggtggagacacaccatacagtatcatgtttggtcctgatatctgtggctacagcacaaagaaagtgcatgctatccttacctataatgaagccaaccacctgatcaagaaagatgttccatgtgaaactgaccagctcacccatgtgtacacatttatcctccgcccagatgctacttacagcattctcatcgacaatgttgagaaacaaactggtagcctttactctgactgggatcttctcccacccaagaagatcaaggaccccagcgccaagaagcctgaggactgggacgaacaagaatacatttctgaccctgaagacaagaaacctgacggttacgatgatatccctaaggagatcccagacaccgactcaaagaagcctgaggactgggatgatgaagaagatggtgagtggactgccccaacaatccccaaccctgagtacatgggtgaatggaagcctaagcaaatcaagaaccccaactacaagggcaagtgggaggctccattgattgacaaccctgacttcaaggatgacccagagctctacgtcttccccaagctgaaatatgttggactcgaattgtggcaggtgaaatcaggatcattgttcgacaatgtcttgatctgcgatgacccagactatgccaagaagttggcagatgaaacatggggaaagctcaaggatgcggagaaagcagctttcgatgaggctgagaagaagaatgaggaagaggaatccaaggacgcacctgcggaatctgatgctgaagacgaaccagaggatgatgaaggaggagatgattccgattctgaatctaaggccgaggagaccaaatcagtagatagcgaggaaacctctgagaaagacgccaccgctcatgatgagctatag

SEQ ID NO: 188 - DNA, 1701 bp, Arabidopsis thaliana
atggcccctgctctcgccgttacacgagatctcaccgccgtcggatctccggagaatgctcctgcgaaaggacgtgcttcggtttacagtgaagttcaatcaagccgtattaacaacactcttcctttgccttctgttctcaaaggagctttcaaaatcgtcgaaggtcccgctagttccgccgccgggaatccagatgagatagcgaagttgtttccgggtctatatggccagccatcagtagcagtggttccagatcaggatgcaccttcgtcggcaccgaaattgaagattggtgttgttttgtctggaggtcaggcacctggtgggcacaatgttatttctggactgtttgattacctgcaagagcgtgcgaaaggtagcacattttacgggttcaagggtggtccagctggtatcatgaaatgcaaatatgttgagttgaatgctgaatatattcagccttacagaaaccagggtggttttgacatgatctgcagtggaagagacaagattgaaacacctgaccagtttaaacaagctgaagaaacagcaaagaagcttgatttggatgggttggtggttatcggtggagatgattccaacaccaatgcttgccttcttgctgaaaacttcaggagtaagaacttgaaaacccgagtcattgggtgccccaagaccattgatggtgatttgaaatgcaaagaggttcctactagttttgggtttgatacagcttgcaagatttactctgaaatgatcggaaacgtcatgattgatgcaaggtcgactggaaagtactatcattttgtaagacttatgggtcgtgctgcttcccacattacgcttgagtgtgctttacaaactcacccaaacataaccattattggagaagaggtttctgcccagaagcagactttgaagaatgtcacagactacatggtggatgttatctgcaaacgtgctgaacttggttacaactacggtgtcatactgattccagaaggtctgatcgactttattcctgaggtccaagagctcattgctgaactgaatgaaattctggcaaatgaggttgtcgatgaaaatggtttgtggaagaagaagctcaccgagcaatccctgaagctgtttgatcttctgcctgaagcaattcaggaacagctgatgcttgagagagacccacacggaaatgtccaggttgctaagattgagactgagaagatgcttattcaaatggttgaaactgaattggagaaaagaaagcaagctggtgcatacaagggacaattcatgggacagtcacatttcttcgggtatgaaggaagatgcggcttgcccacaaattttgatgccacatactgttatgcacttggttatggcgctggagtactcctcaacagtgggaagaccggactaatttcttcggttgggaacttggctgctcctgtggaagaatggactgtaggtgggactgctctcacagccttgatggatgtcgagaggagacacggtaagttcaagcctgtgatcaagaaagcaatggtggaacttgaaggtgcaccatttaagaaattcgcatcactgcgtgaagaatgggcattgaagaaccgatacatcagcccaggtccgatccaattcactggacctggttcagactctctcagccacactctacttcttgaactcggggctcaatag

SEQ ID NO: 189 - DNA, 555 bp, Arabidopsis thaliana
atgttgcaggcatcggagaagaagctctcgaaccctatgagggatattaaggtccagaagctagttcttaacatctctgttggtgagagtggtgatcgtctcactcgtgcctccaaggtgttggaacagctcagtggtcagactcctgtcttctctaaggcgaggtacactgtgaggtctttcggtatcaggcgtaatgaaaagattgcgtgctatgtcaccgtgagaggtgagaaggcaatgcagcttcttgagagtggcttgaaagtgaaggaatacgagctgttgaggaggaacttcagtgacactggctgcttcggattcggtatccaggagcacattgatcttggaatcaagtatgatccttctaccggtatctacggtatggatttctacgttgttcttgaacgtccaggataccgtgtggcccgtcgccgtagatgcaagactcgcgttggtattcaacatagagttaccaaggatgatgccatgaagtggttccaagttaagtatgaaggagttatcctcaacaagtctcagaacatcactggttga

SEQ ID NO: 190 - DNA, 1332 bp, Arabidopsis thaliana
atggcgtctgagctgacaaaccggcgacacgagatagagcaaccagaagcggaatcttattatccaaagccgataaagccatggttcgtagcgattcgtccgatccgttacatgctcagagaacagagactcgtcttcgtcctcgtcggcattgccatcgccacattaggattcacaatcttctccaaatcatccaaccaccaaccaattccttacgacgtggatccgctttccggatacggaatgcgatcggagtcatcgtatctgccagcgacgattcataagaagccaagcatcgagtacatgagccggatcggatcggcaggcggcaaaatccctctaggcttgaaacggaaagtgctaagggttgttgtgacaggtggagcagggttcgtcgggtcacacctggtggaccggttgatggctcgaggagacaacgtgatcgtggtcgacaatttcttcacgggaaggaaagagaacgtgatgcaccatttcaataaccctaatttcgagatgatccgtcacgatgtagtggagccgatccttctagaggttgatcagatctaccatttggcatgccctgcttctcctgttcactacaaattcaatcccgtcaagactatcaagacgaatgtggtgggaacattgaacatgttgggactagcgaagagagtgggagcaagattcttgctgacgagtacgagtgaggtctatggagatcctcttcaacatcctcaggttgagacttactggggcaacgttaatcccatcggtgttcggagttgttacgacgaaggcaaacgtacggctgagactttgaccatggactatcacagaggcgctaatgttgaggttaggattgctaggatattcaacacttatggcccaaggatgtgtatcgatgacggtcgtgtggttagcaacttcgttgcccaggcattaagaaaagagcctttgactgtttatggtgatggtaagcagactaggagtttccagtttgtctctgatctggtggaaggtctgatgaggttgatggagggagaacatgtcggtccatttaaccttggtaaccccggtgaattcaccatgctcgagctcgctaaggtggttcaagagacaattgacccgaacgcaaagatagagttcagaccaaacacagaggacgacccacacaagaggaaaccagacatcacaaaggccaaagagcttcttggttgggaaccaaaggtggctctacgccaaggactcccacttatggtcaaagatttccgtcaacgtgtctttggcgaccaaaagcaggattcttccaccacttcatcatcaacagagtaa

SEQ ID NO: 191 - DNA, 369 bp, Arabidopsis thaliana
atggcgtatgaaccgatgaagcccacgaaagctggtttggaggctcctctggagcagattcataagatcaggatcactctctcttcaaaaaatgtgaagaacttggaaaaagtgtgcactgatttggtccgtggagctaaggataagagacttagagttaagggaccagtgagaatgcccactaaggttcttaagatcactaccagaaaggcaccttgtggtgaaggtaccaatacttgggacaggtttgagctcagggttcacaagcgtgtcatcgatctcttcagctcccctgacgttgttaagcaaatcacgtctatcaccattgagcccggtgttgaggtcgaggtcactattgctgactcttag

SEQ ID NO: 192 - DNA, 534 bp, Arabidopsis thaliana
atggctttgaatgtgtgtcctgtgactgtttgtgattgtgaccagggttggactgagctttgccgattcagtggccagaaaatttaccctggtagagggatcagatttatccgatcggactctcaggtgtttttgtttctcaactccaaatgtaagaggtatttccacaacaagttgaagccatctaagctttgctggactgctatgtaccgaaagcagcacaagaaggacgcagcacaagaggctgtgaagagaaggagacgtgcaactaagaagccttactcaaggtcgattgtcggtgctactttggaggttattcagaagaagcgagcagagaagcctgaagttcgtgatgccgctagagaagctgccctacgtgagatcaaggagagaatcaagaagaccaaggacgagaagaaggcaaagaaggtcgagtatgcatcaaagcaacagaagtcacaagtgaagggaaatatccccaagagtgctgcacccaaggctgctaagatgggtggtggtggaggcagacgttga

SEQ ID NO: 193 - DNA, 879 bp, Arabidopsis thaliana
atggcatccatggcaggaccagatcatctcttcaatttgagaaaccatttctacttgggtgcttatcaagctgcgatcaacaacagcgagatccctaatctttcgcaggaagatatcgtcgagcgagactgtctcgtccatcgcgcttacatcgctctcggaagttaccagcttgtcatcagtgagatcgatgaagccgctgctactcctctacaggcagtgaaactccttgctatgtatctatcgagtcctgaaaacaaggaatcaaccatttcgagcttgagggaatggttggcagatccaactgtaggaaacaatgctattatcaggttgattgctggtactatattcatgcatgaggaagactataatgaggctctgaagcacactcattctggaggaaccatggatctgcatgctttgaatgtccagatattcataaagatgcacagatcagattttgcggagaaacaactgagagtgatgcaacagattgatgaagaccacacactcactcagctcgcgagcgcgtggttgaatctggcagtaggtggttccaagatacaggaagcttatctaatcttccaggatttctctgagaagtacccaatgacaagcttgatcttgaacggcaaagcagtttgctgcatgcatatgggtaattttgaagaagctgagactctactacttgaagcactcaacaaggatgctaaagacccagaaactcttgcaaacctcgttgtatgcagtcttcacgtcgggaaatcatcttctcgctacctaaaccagctgaaactttcacatccagaacacgtccttgtgaagcgagcagcatcagctgaagataacttcgagagagcacttcaatctttcgcctga

SEQ ID NO: 194 - DNA, 1368 bp, Arabidopsis thaliana
atgcttaggtttgattacttactaatcacggcacttgccatttcaactgtttcggttgtcatggcccaagtccctcccgagaaacaattcagagtgctcaacgaacccggctacgccccatacatcaccgagtacgacgcgagttaccgattcctcaactcaccgaatcagaatttcttcacaattcctttccagctcatgttttacaatacaactcctagcgcctacgtgttagctctccgagtcggaacgaggcgtgacatgagtttcacgcgttggatctgggacgccaatcgcaacaaccccgtcggagacaactccacactctcattcggccgaaacggaaaccttgtgctcgctgagttaaacggccaagtcaagtggcagactaacacagccaacaaaggcgtcaccggattccaaatcttgcccaatggaaacatggtgctacacgacaaacatggaaaattcgtttggcagagtttcgatcatcccaccgatacactcctcgtcggccaatccctaaaagttaacggagttaacaaactcgttagccgtacatctgatatgaacggctccgatggtccgtacagcatggtgttggacaacaaaggcttaaccatgtacgttaacaaaaccggtacgccgttagtttacgggggatggacggatcacgacttccgcggtaccgtcacgttcgccgttacaagagagttcgataatttaacggagccgtcagcttacgagcttctcttagaacccgcaccacaacccgctacgaacccgggtaataaccgccggttactccaagttagaccaatcggaagcggaggaggaactttaaacttaaacaaaatcaactacaatggaacgatatcgtatctgagacttggatccgacggtagcctcaaggccttctcgtatttccctgccgcgacgtatctcgaatgggaagagactttcgctttcttctccaattacttcgtccgtcaatgcggtttgccgacgttttgcggcgattacggttactgcgatcgaggaatgtgcgtcgggtgccctacaccgaaaggtctgttagcttggagtgataaatgcgctccacctaaaacgacgcagttttgcagcggaggcaagggtaaagctgtcaattattacaagatagtcggtgttgagcattttactgggccgtatgttaatgatggacaaggcccaacttctgtgaacgattgcaaggctaagtgcgatcgtgattgcaagtgtttgggttacttctacaaggagaaggacaagaaatgtttgcttgctcctcttcttggtacacttatcaaagatgccaacacttcttccgttgcttacatcaaatattag

SEQ ID NO: 195 - DNA, 3108 bp, Arabidopsis thaliana
atggatgaggtaggagctcaagtggctgctccgatgtttatacatcaatcgctggggagaaagcgagatctttattatccgatgtcgaatcggttggttcaatctcagcctcagcgtagagatgagtggaattcgaagatgtgggattgggatagccggagatttgaagctaaaccggtggatgttgaggttcaagagtttgatttgactttgaggaataggagtggtgaagaaagaggacttgatttgaatctgggaagtggtttgactgctgtggaagagacgacgacgacgacgcagaacgttagaccgaacaagaaggttcggtctggatctccgggagggaattatcccatgtgtcaggttgataattgtactgaagatttgtctcatgctaaggattatcatagaaggcataaagtttgtgaagttcatagtaaagctactaaagctcttgttggtaaacagatgcagaggttttgccaacagtgtagcaggtttcatctgctttctgagtttgatgaggggaagagaagttgtaggcgtagattggctggccataatcgacggaggaggaaaactacgcagccggaggaggttgcatctggggttgtggttccggggaaccatgatactactaacaatacggctaacgccaatatggatcttatggctttgttaaccgccttagcttgtgcacaaggtaagaatgcggtaaagcccccagtgggatctccagctgtgcctgatagagagcagcttcttcagatacttaacaagataaatgcattgcctttgcctatggatcttgtctctaagttgaacaatattggaagtttagccaggaaaaatatggatcacccgacggtgaacccacaaaatgatatgaatggggcttctccttctaccatggacttgcttgctgttctttcgacgacattaggttcatcttcacctgatgcactagcgatattatctcaaggtgggtttggtaacaaagacagcgagaagactaagttatcgtcttatgaaaatggtgttacaaccaacttggaaaagagaacttttgggttttcttctgttgggggagagaggagcagtagcagtaaccaatctccttctcaggattctgactcacgtggtcaagacactaggtctagcttgtctctacaactattcacctcatcacccgaggatgagagtcgaccgacagtagcatcttctagaaagtattattcttctgccagcagtaatcctgtggaggatagatcaccatcttcttctccggtcatgcaggagttattccccttgcaggcatcccctgaaaccatgaggtccaagaatcataaaaactcaagtcccaggactggttgcttgccccttgagctctttggtgcatcgaatagaggagctgcagatcctaactttaaaggtttcgggcaacagtctggttatgcttcttctggctctgactactctcctcctagcttaaactctgatgctcaggaccgcactggaaagatagtctttaaactacttgataaagatccaagtcagctccctgggactctacgatctgagatctataactggctttcgaacattccatcagaaatggagagttatatcaggcctggctgtgttgttctatctgtttatgtagcaatgtcacctgcagcctgggaacaacttgagcaaaaattgctgcaacggcttggtgttttgctacaaaattctccttctgatttttggagaaacgcaagatttatagttaacacgggaagacaactcgcatcacacaaaaatggtaaagttcgatgtagcaaatcttggagaacttggaattcaccagagctcatctcagtgtcacctgtagctgtggtagctggtgaagaaacaagtttggttgtaagaggtagaagcttgacgaatgatggaatcagtattcgttgcacacatatgggtagctacatggcaatggaggtaaccagggcagtgtgtagacaaaccatatttgacgagttgaatgtaaatagtttcaaagtccaaaatgtacaccctggttttcttggacgctgtttcattgaggtggagaatggattcaggggtgacagttttccattgataattgccaatgcatccatctgcaaagagttgaatcgtctcggagaagagtttcaccccaaaagtcaagatatgacagaagagcaagcgcagagctcaaatcgtggtcccacatcaagagaagaagttttgtgcttcttgaacgagcttggttggcttttccagaagaatcagacctctgagcttcgggaacaatctgacttttcccttgcccgcttcaagtttttgctagtttgctcagttgaaagagattactgtgctctcatcagaacgctcctcgacatgttagtagagagaaatttggtgaatgatgagctgaacagagaagccctggatatgcttgctgagattcagttgttgaatcgtgctgttaagaggaaaagcacaaaaatggtcgaactactcattcattacctggttaaccccttgacactcagttcctccagaaagttcgttttcttacctaatataactggacctggcggtatcacacctttacatctagctgcatgtacatctggttcagatgatatgattgatctactcaccaatgatccacaagagattggattatcgagctggaacactcttcgcgatgcaaccgggcaaactccatacagctacgctgcaataaggaacaaccataactataactcattggtggctcgtaaacttgcagacaaaagaaacaagcaagtctcactaaacatcgagcacgaggtagttgaccaaaccggtctgagcaagagattaagtttagagatgaacaagtcatcatcatcttgtgcctcgtgtgcaacggtggctttgaagtatcaaaggagagtttcaggttcacaacgtttgttcccaactcctatcattcactcaatgcttgcggttgcaacggtctgcgtttgcgtctgcgttttcatgcatgctttcccaatcgtcagacaagggtctcacttcagttggggaggtttggattatggctcaatctag

SEQ ID NO: 196 - DNA, 1185 bp, Arabidopsis thaliana
atggttgagccagctagtccagattccgacgaagggatctcgctgctcgagtttcacggtaacggtgaccgttcctggcagttaaatttcgatgatttccaggtttcaccggaacacaaggagaagaaatctccgagtaaactacacaactgtcttggttgtttgggtccggaagacaatgtggcagattattaccagcagcaagtagagatgcttgagggctttactgaaatggatgaacttgcagaacgtggctttgttcctggaatgtcaaaggaagagcaggataatttggctaaaagcgagacattggcgattagaatatcaaacattgcaaacatgcttctttttgctgctaaagtctatgcttctgtcactagtggctctttagctatcattgcctctacattggactctcttcttgatcttctttctggcttcatcctctggtttaccgccttctccatgcagacacccaacccgtatcagtatcccattggcaagaaacgcatgcaaccactgggaatcctagtctttgcatcagtgatggcaacacttggattgcagattatcttggaatctcttcgcacaatgttatccagccacaaggagttcaacctaacaaaagagcaagagagttgggtagttgggatcatgctttctgttacattggtcaaactgcttctggttctttactgcagatccttcactaacgagatcgttaaagcttatgctcaagatcatttcttcgacgtcatcacaaacatcattggactcattgcagtaatcctggccaattacattgattattggattgatccagttggagctatcattcttgcattatacacaatacggacatggtcaatgacggtcttggagaacgttaactctcttgttgggaaatcagctagaccagagtatctgcagaaactaacttacctgtgttggaaccaccataaagccattaggcacattgacacagtgagggcatacacatttggctctcattattttgtggaggttgatattgttctcccagctgacatgcctctgcaagtggctcacgacattggagaatcgctgcaagagaagctcgagctactagaggagatcgaacgggcttttgtgcatcttgattatgagtacactcacaaacctgagcacgctagatcccactgttag

SEQ ID NO: 197 - DNA, 249 bp, Arabidopsis thaliana
atggtgggaagtggagctccacagagaggaagtgcagctgcaactgcaagcatgcgtaggaggaagccgaccagcggtgctggtggaggaggtgcctctggtggtgcagccggatccatgcttcagttctacaccgatgacgcacctggtctcaagatctcccccaatgttgttcttatcatgagcatcggtttcattgctttcgtcgctgtgcttcatgttatgggcaagctctactttgtcaaatga

SEQ ID NO: 198 - DNA, 864 bp, Arabidopsis thaliana
atggcaaccgcagctctctccgccgcccgacccaaccgccttagctcagcctcctccgatgttcctctccaccccctatatctccctaccaagctccaatttccttcccgtaagactcagctgtggcgctccgccgcgattctcttacccacacggcggcgatgcgctccgcctagagctagttctcgcgccgacgattctccacccttcgatatgtctgtggagacggcgcttaaggttctcggagtctccgaaggagcttccttcgacgaaattcttcgtgccaagaaatcgatcctggcttctcgtaaggacgaccccaacgccatctctcaggctgaggctgcatatgacatgctgctgatgcagagcctaaaccaacgccgagcaggaaaagttgtaagcaacaacattcgctacgctgatgttaaatctagtaaccctctgggaacaagtactgtgactcagtggatgaagaatccacctgtctctgttgatatgccttccacgagcgatctcgggatacaagctggagtctatggagccatgatggttttgacttatgtgaatgggagttcctttgaatcttctgggatgccttatgctggtgctgatgtgcccggacttatattggctagcagctttggggcttccctatactttatgaccaaaaagaaagtcaagctagggaaagcagctgcgttgacggcaggaggattagtggcaggtgcagtggtgggatcagccattgagacctggctgcacgttgatgtggttccgtttctgggtctccactccccagctgcagtcgtgagtgaattcatagtattctctcagttcttggtgtctctatgcttaaggtag

SEQ ID NO: 199 - DNA, 1539 bp, Arabidopsis thaliana
atggatatcatctttgaacaagctttgttccctctattttgctttgtcttatcatttttcataatcttcttcactacaacaagaccccggagctctcgcaaggtcgttccatctccgccgggacctccgcgactgcccatcatcggaaacattcaccttgtcggtagaaacccacaccattcattcgctgacctctcaaaaacatatggaccaatcatgagccttaaatttggaagtttaaacacagtggtcgtaacttcacctgaggctgcaagagaggttctaagaacatacgaccaaatcctctctagccgtacccccactaactcgatacggtccattaatcacgacaaggtttccgttgtctggcttccaccatcgtcgtctcgttggagacttttgagaaaactgtcggcgactcagctcttctcgcctcagcgtatcgaagccacgaaaacgttgagggagaacaaggtgaaggaactcgtgagcttcatgagtgaaagcagcgagagagaagaagctgttgatatatctcgtgctaccttcatcactgctcttaatatcatatcaaacattctgttttctgtcgatctcggtaactacgactcgaataaatccggtgtgtttcaagacacggtgattggtgtcatggaagctgtcgggaatccagacgctgctaacttctttccatttctggggttccttgatctgcaaggtaatagaaagactctgaaggcttgttccgagagattgtttaaggttttccgtgggttcattgatgctaaattagcggaaaaatcattgcgggatactaactctaaagatgtccgggagagagattttgtggatgtgcttctcgatcttaccgaaggagatgaagcagagctcaacactaacgatattgtacaccttctcttggacctgtttggagcgggcacagacacaaactctagtaccgtggaatgggcaatggcagagttacttcgaaaccctgaaacaatggtgaaagctcaggctgagatcgactgtgtgattggtcagaaaggtgttgttgaagagtctgatatctcggcacttccctatctacaagcagtggtgaaggaaactttccggttacatccggctgctccgctactagtcccccgaaaagctgaatcagatgtggaggttcttgggttcatggtgcctaaagacactcaggtatttgtgaacgtgtgggccataggaagagacccgaacgtgtgggagaattcgtcccggtttaagccagagaggtttttagggaaagatatcgacctgagaggtagagattatgagcttacaccattcggagccggacgtagaatatgcccgggattgcctttggctgtgaaaacagtgcctcttatgcttgcttctcttctttattcatttgactggaagcttccaaacggtgtcggttcagaggatttggacatggacgagactttcggtctcacattgcacaagaccaacccgttacatgccgtacccgtcaagaaacgtggccgtaattag

SEQ ID NO: 200 - DNA, 1437 bp, Arabidopsis thaliana
atgttcgctagccccggaatgggccacatcatcccggtgatcgagctcggaaaacgcttagctggttcccacggcttcgatgtcaccattttcgtccttgaaaccgacgcagcctcagctcaatctcaattccttaactcaccaggctgcgacgcggcccttgttgatatcgttggcctcccaacgcccgatatctccggtttagtcgacccatcagccttttttgggatcaagctcttggtcatgatgcgtgagaccattcctaccatccggtcaaagatagaggagatgcaacacaaaccaacggctctgatcgtagacttgtttggtttggacgcgataccgctcggtggtgagttcaacatgttgacttatatcttcatcgcttcaaacgcacgttttctcgcggtggctttgtttttcccaacgttggacaaagacatggaagaagagcacataatcaagaagcaacctatggttatgcctggatgtgaaccggttcggtttgaagatacacttgaaacattccttgacccaaacagccaactctaccgggaatttgttcctttcggttcggttttcccaacgtgtgatggtattattgtgaatacatgggatgatatggagcccaaaactttgaaatctcttcaagacccaaagctcttgggtcgaattgctggtgtaccggtttatccaattggtcctttgtctagaccggttgatccatctaaaactaatcatccggttttggattggttaaacaaacagccggacgagtcggtactttacatttcatttggaagcggtggctctctctcggctaaacaactaaccgaattggcttggggacttgagatgagtcagcaacggttcgtttgggtggttcgacccccggtggacggttcagcttgcagtgcatatttatccgctaacagtggtaaaatacgagacggtacacctgattatctcccggaaggttttgttagccggactcatgagagaggctttatggtctcttcttgggctccccaagcggagatcttggcccaccaagccgtaggtgggtttctaactcactgcggttggaattcgattctcgagagcgtcgttggtggcgttccgatgatcgcgtggccactttttgcggagcagatgatgaacgcgacactcctcaacgaagagcttggcgttgccgtccgctctaagaaactaccgtcggagggagtgattacgagggcggagatcgaggcgttggtgagaaagatcatggtggaggaggaaggtgctgagatgagaaagaagataaagaagctgaaagagaccgctgccgaatcgctgagttgcgacggtggagtggcgcatgaatcgttgtcaagaatcgccgacgagagcgagcatcttttggagcgtgtcaggtgcatggcacgtggtgcctag

SEQ ID NO: 201 - DNA, 423 bp, Arabidopsis thaliana
atgtcgaagcgaggacgtggaggaacgtctggtaacaaattcaggatgtcacttggtctgcccgttgcagccacagtgaactgtgcagacaacactggtgctaagaacctttacatcatctctgttaaaggaatcaaaggtcgtctcaatcggttaccttctgcttgtgttggtgacatggttatggccactgtcaagaaaggtaaaccagacctcaggaaaaaggttcttcctgctgtgattgttaggcaacgtaagccatggcgccgaaaggacggtgttttcatgtactttgaagataatgctggagtgattgtgaaccctaagggagaaatgaaaggttctgcaattactggacctattgggaaagagtgtgcggatctctggccaaggattgctagtgctgctaacgccattgtctga

SEQ ID NO: 202 - DNA, 426 bp, Arabidopsis thaliana
atggggcgtgttagaaccaagaccgtgaagaaatcttctcgtcaagtcattgagaagtactactctcgcatgactcttgactttcacactaacaagaagatccttgaagaggttgccatcatcccatcaaagagactccgcaacaagattgctggattctccacccacttgatgaaacgtatccagaagggaccagtccgtggaatctcactcaagcttcaagaagaagagcgtgaacgccgtatggactttgttcccgatgagtctgctatcaagactgatgagatcaaggtcgacaaagagactcttgagatgcttgcttctctaggaatgtctgacactctcggcatctctgcagtcgacccacaacaagctatggcaccaatccctgctttcggcggcggcagggcacccagaagatactaa

SEQ ID NO: 203 - DNA, 396 bp, Arabidopsis thaliana
atgactttcaagcgaaggaacggtgggaggaacaagcacaacagaggacacgtcaacccaatcagatgctccaactgcggcaaatgctgccctaaggacaaggccattaagaggttcattgtgaggaacattgtggagcaggctgctattagagatgttcaggaagctagcgtctatgagggatacacattgccgaagctatatgcaaagacgcaatactgtgtctcctgtgctatccactctcacgtcgttagagtccgttcccgcaccaaccgtagggttcgtactcctcctccacgtttcaccagacgcaaggaggatactcccaagcctggacagccaggacaggcccctcgtccagctgggcctggagctgcagctgcaccgcgtgtctga

SEQ ID NO: 204 - DNA, 342 bp, Arabidopsis thaliana
atgtctgatcttgaagttcaagtccccactgcctttgatccgttcgctgatgcaaatgctgaggactctggggcgggaacaaaggaatacgtgcacattcgtgttcagcagcgtaatggtagaaaaagcttgacaactgtccaggggcttaagaaagagtatagctatagcaagatacttaaagaccttaagaaagaattctgctgcaatggcaccgtcgtccaggactctgaattaggacaggttattcagcttcaaggtgatcagaggaagaacgtatctacgttccttgttcaggctgggcttgtgaagaaggataacataaaaatccatggtttttga

SEQ ID NO: 205 - DNA, 2010 bp, Arabidopsis thaliana
atgaaggcaagaacaactaacaatgttgttcagtcgaagagatctactaagagtgtaagaaaagatcaaaagctgcagaagacgaatagccagaaaaaaacagaacaggagaagcacaaggacttggatactaaggaagagtctagtaatatctctacagtagcaagtgattcaaccatacaatcagatccctctgagtcttacgagacggtagatgttcgttacttggatgatgataatggtgtcattgcctctgcagatgctcatcaagaatcagattctagcagcgttgttgacaaaacggagaaggagcataatttaagtggatccatttgtgatttggagaaagatgttgatgagcaagaatgtaaagatgctaacattgataaagatgctcgtgaaggtatcagtgctgatgtttgggaagatgcttcgaatggtgctcttagtgctggcagtgagaatgaagcagctgatgtaacagagaataatggtgggaactttgaagatggatcttcggaagagaagattgaacgtttagagacgaggatcgagaaacttgaagaggagcttagagaagttgctgcactcgagatttcgctctattctgttgtgccggaccattgtagctctgctcacaagcttcatacgcctgctcggcgtatttctagaatctacatccatgcctgtaagcattttactcagggaaagcgtgctacgatcgctagaaactctgtatctggtcttgttttggttgccaaatcttgtgggaatgatgtttcgaggttgaccttctggttatcaaacatcatagctttgaggcagataatttcgcaagcatttggtaggtctcgcatcacacaaatctctgaaccaaatgagagtggtaatagtgattcagggaagaaaacgaacctgagatggaagaatggtttccaacagcttttggaggattggcaagaaactgaaacatttactactgcacttgagaaaatcgagttttgggtattctctagaatagtggagtctgtttggtggcaggtctttactcctcatatgcaatcacctgaagacgactcatcagcaagtaaatcaaatgggaaactgatgggaccttccttgggtgatcagaaccaaggaaccttttcgataagcctatggaaaaatgctttccgagatgctctgcaacggatttgtcctatgcgaggagcgggacacgaatgcggttgcttacctgtattggctagaatggttatggacaagtgtatcggtagattcgatgtagccatgtttaatgctattctccgcgaatcagaacatcagattccaactgatcctgtctctgatcctattcttgattccaaagttctgcctattcctgctggagacttaagctttggatcaggggcacaacttaaaaacgcgattggcaattggtctagatgcctcactgaaatgtttggcatgaactctgatgattcttcagcgaaagaaaaacgaaacagtgaagatgatcatgtagaaagtaaagcctttgttttactaaatgaacttagtgatcttcttatgctcccaaaagacatgctgatggaaatatccattagagaagagatatgcccatcaatcagtcttccactcatcaaaagaatactctgcaacttcactcctgatgagttctgtccagatcaagtacccggagctgtcctagaagagcttaatgctgcagagagcattggtgataggaagctatcagaagcaagcttcccttatgcagcttcttctgtttcttacatgcctccatcgaccatggatatagcagaaaaagttgcagaggcttcagcaaaattgtcaaggaatgtgtctatgatacagagaaaagggtacacaagcgacgaggagcttgaggaactggactctcctcttacatccattgttgacaaagcgagtgacttcactggttcagcgacttcaaatgcaagatacaagcttcttcgacaagtgtgggtttag

SEQ ID NO: 206 - DNA, 1047 bp, Arabidopsis thaliana
atgatcgacaacaattgtttatataaagaagagctgaatcgcaattcttactcaggtctggccaaggaggcttctgagtcgattttgctccctagtgaatccggatttgacggttctcggagtccggtttgctcctcgccggatccgaacctcaactacagacctgtcatcggtatcctgagtcaccctggagatggtgcgtctggtcggttgaccaatgatacgagctcgacgtacatcgctgcttcgtatgtgaagttcgctgaggcaggtggtgctcgtgttatcccactcatctacaacgaacctgaagaagtgctcttccagaagctagagttggtcaacggtgtgatattcactggtggttgggctaaaaaatatgattatttcgagatcgtcaaaaaaatcttcactaaagctttggagagaaatgatgctggagagcatttcccagtatatggcatttgcctcggattcgagcttatgtcaattatcataagtcagaacagagacattcttgaaagatttgatgcagaggataatgcatcaagtctccagtttgttgataatgttaataacgatggaacattattccaaagatttccgccagagttgttgaaaaaactcagtacagattgtttggttatgcagaaacacaagtatggtatcacaccagcaaactttcaagccaatcctgctttgtctagtttctttgaaattctcacaacctgcattgatgaaaacagcaagacttatgtttcaactgttaaagcaaagagatacccaataactggcttccagtggcatcctgagaaaaatgcatttgaatggggatcatctgcgattccacactctgaggatgcaatccaggtgacacagcatgctgctagttatttagtcagtgaagctaggaagtcactgaacagaccagagtctcagaaagtgctgagcaatctcatttacaactataagcctacttactgtggatacgcagggaggggttacgacgaggtttacatttttacacaaccaagatcccgtttctaa

SEQ ID NO: 207 - DNA, 2010 bp, Arabidopsis thaliana
atggcttcgtacactcccaagaacattctcatcaccggagctgctggtttcattgcgtctcatgtcgccaacagactcatacgaagctatcctgattacaaaatcgttgtgcttgacaagcttgattactgttcaaatctcaagaatctcaatccttctaagcactctccgaacttcaagtttgtcaaaggtgatatcgctagtgctgacttggtgaatcatcttctcatcactgaaggtattgacaccatcatgcatttcgctgctcagactcacgtcgacaattccttcggtaacagtttcgagtttactaagaataatatctatggaactcatgtccttcttgaggcttgtaaagttactggtcagattaggaggtttattcatgttagtactgatgaagtttatggtgaaactgatgaggatgctcttgttggtaaccatgaggcttctcagctgcttccgacgaatccttactctgccacgaaagctggtgctgagatgcttgttatggcttatggtagatcttatggtttgcctgttattaccactcgtgggaataacgtctatggaccgaatcagtttcctgagaagttgattcctaagttcattttgctggcaatgagagggcaggttcttcccattcatggagatggatcaaatgtcaggagctacctctactgtgaagacgttgctgaggcttttgaagttgttcttcacaagggagaagttggccatgtttacaatattgggacgaagaaggagaggagagtgaatgatgttgccaaagacatctgcaaactcttcaacatggaccctgaggcgaacatcaagtttgtcgacaacagaccttttaacgatcagaggtacttccttgacgatcagaagctcaaaaagttgggatggtcagagagaaccacgtgggaagaagggttgaagaaaactatggattggtacacacagaacccggagtggtggggtgatgtttctggagcattgcttcctcatccaaggatgctgatgatgcctggtgggcgacactttgatggctccgaggacaattcgctggcagctactttatctgaaaaaccaagtcaaacccatatggttgttccaagccaaaggagcaacggcacacctcaaaagccttcgctgaagttcctgatatatggaaagaccggatggatcggtggtctgcttggaaagatatgtgataagcaaggaattgcttacgagtatgggaaaggtcggttggaggatcgatcttctcttctgcaggatattcagagtgttaagccaacccatgttttcaattccgctggtgtgactgggagacccaatgttgactggtgtgagtctcacaagaccgagactatccgtgccaatgtagctggcacattgactctagctgatgtctgcagagagcacggactcctaatgatgaatttcgctactggttgtatattcgaatatgacgacaagcatccggaaggttcaggaattggcttcaaggaggaagacacacccaacttcactggctctttctactcgaaaaccaaagccatggtcgaggagctgctaaaggagtatgacaacgtatgcacattgagggtaaggatgccgatctcctcggatctaaacaacccgcgcaacttcatcaccaagatctccaggtacaacaaagtagtgaacatcccaaacagcatgactgtgttggacgagttattaccaatctccatcgagatggcgaaaagaaacttgaaaggaatctggaacttcacaaacccaggtgtggtgagccacaacgagatcctagagatgtacagagactacatcaaccctgaattcaaatgggcaaacttcacattagaggagcaagctaaagtcattgtggctccaagaagcaacaacgagatggatgcttccaagctcaagaaagagttccctgagctactctctatcaaggagtctctgattaagtatgcatacgggccaaacaagaaaacctga

SEQ ID NO: 208 - DNA, 1347 bp, Arabidopsis thaliana
atgaggatcttacccgaacctcgaggttcggttccgtgtcttctccttcttgtgtcggttctcttatcagcgactctctcactcgctcgtgtcgtcgaagttgtcggttacgccgagagcaagatcaaaaccccccatgcattttcaggacttcgagtgacgatcgactgtaaggtgaataaaggccattttgttacaaaaggttcgggaaacattgacgacaaaggaaagtttggtcttaatattcctcatgacattgtctccgacaacggagcgttaaaggaggagtgttacgctcagcttcacagcgcggcgggaacaccttgtccggctcacgacggccttgagtccaccaagatcgtgtttttatccaaatccggggataaacacattttgggtctcaaacaaaatctgaaattttcaccggagatttgcgtttccaaattcttctggcctatgcctaagttgcctccttttaagggctttgatcatcctttccctttacctccacctttggaacttccaccgtttctcaagaagccatgtccacctaaatacagtcctcctgtggaggttccacccccggtaccagtttacgagccgccgccaaagaaagagattcccccgccggttccggtttacgatccaccgcctaagaaagaggttccaccacctgtcccagtttacaagccaccaccaaaggtggagcttccaccgcctattcctaagaagccttgtccacctaaaccgccgaagatagagcacccacctccggttccggtttacaagccaccgccaaagatagagaagccacctccggttccggtttacaagcccccgccaaagatagagcacccacctcccgttccggtacacaagctaccgaagaagccatgtccgcctaagaaagttgatccaccgccggtgccagtccacaaaccaccaacgaagaagccttgtccgcctaagaaagttgatccaccgccggttccagtccacaagccgccgccaaagatagtcattccaccgccgaagatagagcacccacctccagttccggtttacaagccgccgccgaagatagagcatccaccaatctacataccaccaattgtgaagaagccgtgtcctccgccggtaccaatatacaaaccaccggttgtgatccccaagaagccatgccctccgccggtaccagtatacaaaccaccggtagtggtgattccaaagaagccatgtccgccacttccacagctcccaccacttccaaagtttccacctcttcctcctaaatacattcaccaccccaagttcgggaaatggcctccgttgcctccacacccttga

SEQ ID NO: 209 - DNA, 1197 bp, Arabidopsis thaliana
atggagattgaagaagcgagtcgtgaaagtggacatgttgtgtgcggatcatggattcgtcgcccgaagaaagtaaactgggttcttatcgctaaagcttccaaacgccgtggctcatctgtttcttctcctgctctcctcaacatcttctcttttgaccccattactgcttctctttcctcctctcctttggcaacacacacgcttaaggatagtgatggtgatcctgtggctgtttcagtgcaccctggtggggattactttgtttgctcaacctccaaaggtggttgcaagttatttgagcttgtcggaggagcaacaggtattacgatcttagccaaagaactccttcctctccaaaatgctggactacaaaagtgtatggccttcagctttgatgggtctaaattagctgttgggggagtggatggatgtcttagaattatggagtggccaaacctaagtgtaattttggatgagccaaaggcacacaaatccatccgggacatggattttagtcttgactcagagttcttagctacaacatcaactgatggatcagctagaatatggaaagcagaagatggttttcctttgtctactttggaacgtagtggggatgaaaatattgaactgtgccgtttctctaaagacggaacaaaaccttttttgttttgtgctgctcaaagaggtgatacgcctatggtcaatgtttatgacattagtacatggaagaagcttgggttcaagaagctgtcaaggaagactgcatcgacaatggcagtgagcttggacgggaaatatattgctttgggtgggaaagatggagatgtatctgttgctgaagttaagacaatggaaatctaccactacagtaagaggctgcatcttggtcaatccattgcttcacttgagttctgccccagtgaaagggttatgctgacaacttctagcgaatggggagagatggtgaccaaactcactgtaccaaaggagtggaaagagtggcagatatatgcactgctgttttgcttgttcatggcatcagtgatagctgcatacgtattcttcgagaactcagattcgttttggaagttaccaatgggaaaagatcaaaaaagaccaaagattagtctatttggaggttcctcctccacgccttctgaggatcatagtaggtggaacttggacctatag

SEQ ID NO: 210 - DNA, 1074 bp, Arabidopsis thaliana
atgggtatatatctaagtactccaaaaacagacaagttctcagaagatggcgaaaatcataaactcagatatggtttatcctctatgcaaggttggcgtgcgtccatggaagatgctcatgctgcaatacttgatctcgatgataacacttccttcttgggtgtctatgatggtcatggaggtaaagttgtttctaagttctgtgccaagtatctacaccagcaggttcttagtgatgaggcgtatgcagctggagacgtagggacttctcttcaaaaagcatttttcagaatggatgagatgatgcaaggacaaagagggtggcgagagttagcagtacttggtgacaaaatcaataagttcagtgggatgattgaagggcttatatggtcaccaagaagtggggacagtgctaataaacctgatgcttgggcgtttgaggaaggtcctcattctgattttgctggacctaattctgggagcacggcatgcgtagctgttgttagagacaagcagctatttgttgcaaatgcaggtgactcacgttgtgtgatatccagaaagaatcaggcttataatctttctagagatcacaaaccagatcttgaagctgagaaagaaaggatattgaaagctggtggctttatacatgcagggcgagtcaatggaagcttaaatctatcacgagctatcggtgacatggaattcaagcagaataagtttttgccatctgaaaagcaaatagttaccgctagtccagatgttaacactgttgaactctgtgatgatgatgatttccttgttcttgcctgcgatggaatttgggattgcatgacaagccaacaactcgttgatttcatacatgaacaattgaattcagagaccaaactctcggtggtatgtgaaaaagttctcgatagatgtctggctccaaacacttcaggtggtgaaggctgtgataacatgaccatgatattggttcgattcaagaaccctactccatcagagaccgaactaaaaccagaagcaagccaggcagaaggaaaccacgatgagccgagctcatcaaactag

SEQ ID NO: 211 - DNA, 303 bp, Arabidopsis thaliana
atgtctgcaaaccaggaggaagacaagaagccaggagacggaggagctcacatcaatctcaaagtcaagggacaggatggaaacgaggttttctttaggatcaagagaagcactcagctcaagaagctgatgaatgcttactgtgaccggcaatctgtggacatgaactccattgctttcttgtttgatgggcgtcgtcttcgtgctgagcaaactcccgatgagcttgacatggaggatggtgatgagatcgatgcgatgctccatcagactggtggcagcggtggtggtgctacggcctga

SEQ ID NO: 212 - DNA, 807 bp, Arabidopsis thaliana
atgtggaagaacatcacccacggttttcactgtgtgaagggcaagtccagccatccgatggaggactatgtagtgtctgaattcaagaaacttgaaggtcatgaattgggtttgtttgctatctttgatggtcacttggggcatgatgtggctaaatacttgcagactaatctctttgacaacattcttaaagagaaggatttttggactgacacagagaatgctataaggaatgcctacagatcaacagatgccgtgatattgcagcagtcccttaagcttggtaaaggcggatcaacagctgtaacgggaattctaattgatggtaaaaagctagttgttgctaatgttggagactccagagcagtgatgtctaagaatggtgttgcgcatcagctatctgtcgatcatgaaccaagcaaggagaaaaaagaaatagagagccgaggtggctttgtgtcaaatattccaggggatgttccacgagtggatggacagttagcggttgcaagagcatttggagataagagcttaaagttacatctgagctcagaaccggacataacacaccagacaattgatgatcacactgaattcatccttttcgcaagcgatggtatttggaaagtaagtttaatgactcagtatcttactctgtttctaaccgtggtattatcaaaccaagaagcggttgatgctatcaagagtatcaaagatcctcatgcagctgcaaagcacttgatagaggaagctatatctaggaagagcaaagatgacatctcatgtatcgttgtaaagttccactaa

SEQ ID NO: 213 - DNA, 1002 bp, Arabidopsis thaliana
atggcaacgatttcgtcaactctactcttaaattcttctagatcagctttaccactaagattcccaaaattctcgggattttcttcttcctctccattcgctagatcttacagatttggacgacgtaatctggaaccactttccaacggaatgctttcgtcgggaagtagagccgacggtgctacggcggcggctgcatcgatggaaggagtgatgacggaggcgatgaaactgattcaatcggcgtcaccaacttggaaatcagctgtggctaacaatttattgatttttgttctcggttcaccgcttcttgttaccggattgtccgcttctgggatcgccgccgcgtttttgcttggtactttaacttggagagcttatggctctgctggtttcctcttagtcgctgcttacttcgtcataggaacagcggcaacgaaggttaaaatgacgcaaaaggaagcacaaggtgtggccgaaaagagaaagggtagaagaggaccacgcagtgtgattggttcaagtgctgctggttgtgtctgtgcttttctttcaatatatcaagtgggaggagcagctttttcccagcttttccggcttggttttgtttccagtttctgcactaaagtatctgacactgtctcgagcgagataggcaaagcttatggaaaaacaacgtatttagctacgacatttaagattgtaccaagaggaacagagggagctatgagtcttgaaggaacattggctggacttttagcatcattttttcttgcatctgttggctgcttcctgggtcagataactcctccagaagcagctgtatgtgtactagcttcccagattgccaatcttggagagagcataataggtgcttcttttcaagacaaagaaggattcaaatggctaaacaatgatgtagtcaacgtgatcaacataagcttgggaagcattgtggcgattttgatgcaacagtttatactccagaactgggtcaagtaa

SEQ ID NO: 214 - DNA, 1281 bp, Arabidopsis thaliana
atggcgacggagcctagtctgttgaatcaaactactccttatgatcgtcactctgttcttcatgtcgctgctgctaatggtcagatcgagattttgtcattgcttttggaacgatttacgaatccagatttgttgaatcgtcacaagcagactccgttaatgttggctgcgatgtatggaagaatctcttgtgtgaagaagctagctgaagttggagctaatattttgatgtttgattctgtgaatcgaagaacatgtttgcattacgctgcttattatggacatgctaattgtgttcaagctattctctctgctgctcaatcaagtcctgttgctgtccattggggatatgcgagatttgtgaacataagagatgataaaggagcgactccgttgcatttagctgctcgacagagacgacctgaatgtgtgaatgttttgttggatagtggttctcttgtttgtgcatctactagtgtatatggttctccaggaagcacacctcttcatttagcagctagaagtggatctatagattgtgtcagaaagttgcttgcttggggtgctgatcgtcttcaacgagacgcttctgggagaataccttatgtggttgcgatgaagcataagcatggagcatgtggagccttacttaatccgtcctctgcagagccacttgtttggccatcaccattaaagttcatcagtgagcttaatgacgaggcgaaacttctcttagagcaggctttaatggaggctaacagggagagagagaaaaccatcctcaaaggaacagcttattccttaccatcaccctctttctctgacacggatgataacatgtccgaggtgagtgatacggaactgtgctgcatttgctttgagcaagtatgtacaattgaagttaaagactgtggtcaccaaatgtgtgcacaatgcacacttgcactgtgctgtcacaacaaaccaaacccaacgacctcaaccgtgactccaccggtctgtccgttctgtagaagcaccattgcatgtttagtcgtcgcccagaacaacaacaacaacaacgaaaagagcaaaagcctagatgatgttgttgttgttgatcgtgaggcaggtgatgttagctcctccaaattcagaaaacatagaagatcaataaaccttggcgaagaaagcagcagcttcatgggactatcaactattggatcattcggtaggataaccggccgtggctcgggaaggatcgcagccgaaaacgagctgatggacaaaccaatattgtga

SEQ ID NO: 215 - DNA, 564 bp, Arabidopsis thaliana
atggatttcttcaccgatcaagtaaagaagaaattctccgacaagaaaccggagagctctgatccggagccaaaccacaacaaaaacaaacccggtcacacggagccaacaacacataaacccggtcacggcgagccaacaacacataaaccggtctccaacaccgatccaacaacacacagaccggctacgaacgctgagctcatggctagtgccaagatcgtagccgaagctgctcaagccgctgctcgtcacgagtcagacaagcttgacaaagccaaagtcgccggagccaccgctgatatcttagacgccgcttctagatacggtaagctcgatgaaaagagcggtgttggtcagtaccttgaaaaggctgaacaatatcttcacaagtacgaaacttcccactctcactcctccaccggtggaactggaagccacggtaatgttggaggacacggtggtggagctggagcaccggcggctaagaaagaagatgagaagtccggaggtggtcatgggtttggagattatgctaagatggctcaaggttttatgaagtga

SEQ ID NO: 216 - DNA, 1761 bp, Arabidopsis thaliana
atggcgtctgcaaacgctctctcttccgcctccgtcctctgttcttcccgtcagagtaagttgggaggaggaaatcagcagcaaggtcagagagttagctacaacaagaggacaatcagacgttttagtgttagagctaatgtaaaggaaatagcttttgaccagcactctagagctgctctacaagctggtattgataagcttgctgattgtgttggtctcactcttggccctagagggaggaatgttgtgttggatgaatttggaagtcctaaggttgtgaatgatggagtcaccattgctagagctattgagttacctaatgccatggaaaatgctggtgcagcgcttattcgtgaggttgcgagtaagactaatgactctgctggtgatgggacaaccactgcgtctatccttgctcgggagataatcaaacatggattgttgagcgtcacttctggtgcgaatcccgtttcactcaagaggggaattgataagactgttcaaggtctgatcgaagagcttcagaagaaagctaggcccgtgaaaggtcgtgatgacatcagagctgtggcttctatctctgctggaaatgatgaccttatagggtcaatgattgctgatgccatcgacaaagttggacctgatggtgttttgtccattgaatcttcatcttcttttgagaccacggtcgaagttgaagaagggatggagattgacagaggttacatctcgcctcagtttgttacaaaccctgagaaactactagctgagtttgagaatgctagggtattgatcactgatcagaagatcactgcgatcaaagacatcatccctattttggagaagaccactcagcttcgtgctccgttgttgattattgcagaggatgttactggtgaagccttagctacccttgtcgtgaacaagcttcgtggtgtcctcaatgttgttgccgttaaagcgccaggatttggagaaagaagaaaagccatgcttcaagatattgcaatcttgacaggagctgagtacctagccatggacatgagcttactggttgaaaacgcaaccatagatcaattgggtattgcccgaaaagtcacgattagcaaagattcgactaccctcattgcagatgcagcttccaaggacgaattacaagctcggattgctcagctgaagaaagaactattcgagactgattctgtgtatgactcagagaagctcgctgagagaattgcgaagctatctggaggtgttgctgtcattaaagtcggagcagcaactgaaactgagcttgaggaccgtaagcttcgtatcgaggatgcaaagaacgcaacatttgctgctatcgaggaaggcatagttccaggtggtggtgctgctttggtgcatctctccactgttattcccgccattaaggagacttttgaggatgctgatgaacgtttgggagctgacatagtacaaaaggcattgctgtcaccagctgctcttattgctcagaacgctggagttgaaggagaagttgttgtggaaaagattatgttcagcgattgggagaatgggtacaacgcaatgactgatacatatgagaatctgttcgaagctggagtgattgatccggctaaagtgacaagatgtgcgctacagaacgctgcttccgtagcaggaatggtactgaccactcaggccattgttgttgacaaaccgaaacccaaggctcctgctgctgctgctcctgagggtctcatggtgtaa

SEQ ID NO: 217 - DNA, 792 bp, Arabidopsis thaliana
atgagtgaggaggagaggaagcaacacgtcgttctagtacatggtgcttgccatggcgcctggtgctggtacaaggttaagccgcagctcgaggcttctggccaccgcgtaaccgccgtagatctagctgcctccggtatagacatgaccaggtcaatcacagatatatccacatgcgaacaatactcagagccattgatgcagctaatgacctcactaccagatgatgagaaggttgtgcttgttggtcatagcttaggaggtttgagtttagctatggccatggatatgtttccgaccaaaatctctgtttctgtctttgtgactgctatgatgccagacaccaaacactcaccatccttcgtatgggataagctaagaaaagaaacttcacgagaggaatggttagacaccgtgtttacgagcgagaaacctgattttcctagcgagttttggatttttggaccagaattcatggccaagaacttgtatcagttgtctccagtccaagatcttgaattggcgaaaatgttggtgagggcaaacccattgattaagaaagatatggcagagagaagaagcttcagtgaggaaggatacggatccgttacacgtatatttattgtatgcggaaaggatcttgtgtcacccgaagattaccagcgatcgatgatcagcaactttcccccaaaagaagtaatggagatcaaagacgcagatcatatgccaatgttctccaagcctcaacaactatgtgctcttctcttggagattgcaaataaatatgcctaa

SEQ ID NO: 218 - DNA, 2352 bp, Arabidopsis thaliana
atggatgcaatcaaatgcagttccagtttcctccatcacaccaagctcaacactctcttctctaatcacacctttcctaaaatctccgctcccaatttcaagcccctcttccgtccgatttcgatttccgcaaaggacagaagaagcaacgaagctgaaaatatcgccgtagtagagaaacctcttaaatcagatagattttttatctccgatggacttccttctccattcggacccaccgtcagagacgacggcgtcaatttctctgtttactctacaaactccgtttccgctaccatctgcttgatttctctctccgatctccgtcagaacaaagtgacggaggagattcagcttgatccatcaaggaatagaactggccatgtttggcatgtgttcttgagaggagatttcaaagatatgttgtatggttatagatttgatggcaagttttctcctgaagaaggtcattattatgattcctccaacattttattggatccttacgcaaaggcaattataagcagagatgagtttggagttttgggacctgatgataattgttggcctcaaatggcgtgtatggtacccactcgtgaggaagagtttgattgggaaggggatatgcatctgaagcttccacagaaagatcttgttatatatgaaatgcatgtgcgaggttttacaaggcatgagtctagtaaaattgaattccctggcacataccagggtgttgcagagaagcttgaccatttgaaggagcttgggataaattgtatagaattaatgccatgtcacgagtttaatgagctggagtattacagctacaatacgattttgggagaccacagggtaaatttttggggttactctaccattgggttcttctcgcccatgatcagatacgcatcagcaagctctaacaattttgctggacgagccataaatgaattcaaaattcttgttaaggaggcacataaacgaggaattgaggtaatcatggatgtcgtcttgaaccacacagccgaagggaatgaaaaagggcccattttctcatttagaggagttgataacagtgtctattacatgcttgctccaaagggcgagttctataattattcaggctgtggtaatacattcaactgcaatcatcctgtggtgcgtcaattcatattggattgcctgagatattgggttacagaaatgcatgttgacggcttccgctttgatcttggttcaatcatgtcaaggagcagcagcctttgggatgcagccaatgtttacggggctgatgtagaaggtgacttgctcacaactggtactcctattagctgccctccagtaattgacatgataagtaatgatccaatactccgcggtgttaagctaatagctgaagcatgggatgcgggtgggctgtaccaagttggcatgtttccacactggggtatttggtctgagtggaatggaaagtttcgggatgttgtgagacagttcataaaaggcaccgatggcttttctggtgcttttgctgaatgtctctgtggaagcccaaatctgtaccagggaggtaggaaaccttggcacagcatcaattttatatgtgcgcatgatggttttacgttggcagatttagtaacttacaacaataagaataacttggcaaatggagaagagaataatgatggagagaatcacaattacagctggaactgtggagaggagggagactttgcgagtatctcggtgaagagactaaggaaacgacagatgcggaatttctttgtttccctcatggtttcccaaggtgtcccaatgatttacatgggagatgaatatggccatactaaagggggaaacaacaacacgtattgccatgacaactatatgaactattttcggtgggataaaaaggaagaagcacattctgacttcttcagattctgccgtattcttatcaagtttcgtgatgaatgtgaatcacttggcttgaatgatttcccaacagcaaagcgtctgcagtggcatggtcttgctcctgagatcccaaattggtctgaaacaagtcgatttgttgcattttcactggtcgattctgtgaagaaagaaatctatgtggccttcaacaccagtcatttagccacacttgtttcgctaccgaataggccaggataccgatgggagccatttgtagacacgagcaaaccgagcccttacgactgcataacaccggatctcccagagagagaaacggcgatgaagcagtataggcacttcttagatgcaaatgtgtacccaatgctcagttactcatccatcattctccttctttcaccaattaaagacccctga

SEQ ID NO: 219 - DNA, 1893 bp, Arabidopsis thaliana
atgttaaggattttggggagaagagttgtttcagcttcgaaagagcttactagtattcaacaatggcggatccgaccaggaaccgattctcgtcccgatccttttcgaactttccggggactacaaaagggtttctgcgtgggcattttaccggacggagtcgacagaaattcggaggctttttctagcaattcgatcgccatggaagggatcttatcggagcttcgttcccatatcaaaaaggtattggccggaggtggagaggaagcggttaagaggaacagaagcagaaacaagcttttgcctagagaaaggattgatcggctacttgatcctggttcttcctttttggagctctctcagcttgcaggacatgaattgtatgaggagcctttgccttcaggtgggataatcacagggataggaccaatccatggacgtatttgtatgtttatggcaaatgatcctacagttaaaggagggacgtattatcccattactatcaagaaacatctcagagcacaagagattgctgctcggtgcagacttccttgcatatatcttgttgatagtggtggtgcttaccttccaaaacaggctgaggttttccctgacaaggagaattttggtagggttttctacaacgaatcggttatgtcatctgatggaattccacaaatcgccattgttttaggctcctgcactgctggtggtgcctacattcctgccatggctgatgaaagtgtaatggtcaaagggaatggtaccatatttttagcaggaccgccacttgtcaagtttcttgagaatctaacgctaaatgaaaaagcttttgaacaggctgctacaggagaagaagtttcagctgaggatttaggaggcgccactgttcactgtactgtgtccggtgtgtcagattattttgctcaagacgagctacatggcctcgctattggaagaaacattgtcaagaatttgcacatggctgcaaaacaagggatggaaggaacatttggaagcaaaaatcttgtatacaaggaaccgctctatgacataaacgagcttcgctccattgctccagtagatcacaaacagcaatttgatgtgcggtctattattgcccggattgttgatggaagtgaatttgacgagttcaagaaacaatacggcactacgcttgtgactggttttgctagaatttatggtcagacggtgggtattatcgggaacaatggcatactgttcaatgaatctgcactaaaaggagctcacttcatcgaattatgttctcaacgtaaaattcctcttgttttcctccaaaacatcacaggctttatggtgggttctagagctgaggccaacggcattgcaaaagctggagcgaaaatggtgatggcagtatcctgtgctaaggtaccaaagattacaatcataacgggtgcaagctttggtgctggaaactatgcaatgtgtgggcgtgcatacagtccagattttatgttcatttggccaaacgccagaattggcatcatgggaggcgctcaggtaaaccagaatgcaccgaaatgtttaaaccgaaaccaaactgaatcaaaatgtgtttataatcttagtgtagcagaacaaaattcagctgcaggtgttttaactcagattgaaagggctaccaagaagagacaaggaatcaagtggactgaggaagaggaagaagcgttcaagaagaaaacggtggatgcgtatgagagagaggcaaatccttactactcgacggcgagactttgggatgatggagtgattgatccttgtgataccagaaaggttttgggactttgtctctctgctgctttaaaccgtcctttagaagatactcgatttggtgtctttagaatgtaa

SEQ ID NO: 220 - DNA, 1884 bp, Arabidopsis thaliana
atgcgaagaacatgggtactggcggaagaaagctcggttgcgattgctccgctattagctgagccacagtcaacgatgtttccagagatgactcctgaatgtgccacggttatgcctgacctgctcgaaaagtgttttgcaaccggtagtgtgacgccaacagaagattgctgcaccgatctaaaatccgcaacctcaacgcaagtgacttgtctttgtgataactacatagcaaaccccgccgtttcaaacatcaccggaccttactccaaagcaatcacaactaaatgtggcgttttcgacaaatactcttgtgacggtactagtaaagtaatttcaaacaagaatggtgcgttcatggtaattaatggattttggttttgtgtggtgaaggaggagaagaaaagaaaggaggaagcagcagtagcaatgggtgttttaactttattgggccttattaacgggcttatagtggcccacggaaaaactcgccaacaaaataagccggtttgtaaactaattttattccaatttcaacattttggtttttgttcaattcgattttccgcaaataaaaaagcacgaagccggtccaaaaccggcgatgcttatccgtttagaaatgagaaggtactagaacaaaagccttattcacttccttttgttccccaaattctcgaaatcgaaacacgacttaaaacgaaaaagacgagacttttaacactcagacctaaaccaacactcttcctctttctatctctctctcgccgatcggaagcagatttttctcaaaaggatggattcaacgaagcttatcttggtgctaagatacctactggtgtccatgaagaagacaaagacactaagccgaggagtttcgtagtggaagagagtgatgatgatatggatgaaactgaagaagtaaaaccgaaagtggaggaagaagaagaagaggatgagattgttgaatctgatgtagagcttgaaggagacactgttgagcctgataatgatcctcctcagaagatgggggattcatcagtggaggtgactgatgagaatcgtgaagctgctcaagaagctaagggcaaagccatggaggccctttctgaaggaaactttgatgaagcaattgagcatttaactcgggcaataacgttgaacccgacttcagctattatgtatggaaacagagctagtgtctacattaagttgaagaagccaaacgctgctattcgagatgcaaacgcagcattggagattaaccctgattctgccaagggatacaagtcacgaggtatggctcgtgccatgcttggagaatgggcagaggctgcaaaagaccttcaccttgcatctacgatagactatgatgaggaaattagtgctgttctcaaaaaggttgaacctaatgcacataagcttgaggagcaccgtagaaagtatgacagattacgtaaggaaagagaggacaaaaaggctgaacgggatagattacgtcgccgtgctgaagcacaggctgcctatgataaagctaagaaagaagaacagtcatcatctagcagaccatcaggaggcggtttcccaggaggaatgggcggtggtatgcccggaatgggcggtggtatgcctgctggaatgggtggtggcggtatgccaggtgcaggcggtggtatgcctggtggtggcggtatgcctggtggtatggacttcagcaaaatattgaatgatcctgagctaatgacggcatttagcgaccctgaagtcatggctgctcttcaagatgtgatgaagaaccctgcgaatctagcgaagcatcaggcgaatccgaaggtggctcccgtgattgcaaagatgatgggcaaatttgcaggacctcagtaa

SEQ ID NO: 221 - DNA, 135 bp, Arabidopsis thaliana
atgattaagaagaaattggggaagaaaatgaggcaaaacaggcctattcctcactggattcgtcttcgtaccgacaacaccatcaggtacaatgctaagcgtaggcattggcgcagaaccaagcttggattctaa

SEQ ID NO: 222 - DNA, 1536 bp, Arabidopsis thaliana
atggtaagcgtttctttaactctattttcttcattgtttcagttattggcgattgtattctctgtttattgtaatcgtattgcaactcttgaagattctttccttgctgatttggacgagttatctgacaatgaagcagaattggacgagaatgatggtgatgttggaaaggaagaagaagatgttgatatggatatggctgatttagagacacttaactatgatgatctcgataatgtttctaagctgcagaagagtcagagatatgctgatattatgcataaagtagaggaggctcttgggaaagattctgatggagctgagaaaggaactgtcttggaagatgatcctgagtataagcttattgtggattgtaatcagctttcggtcgatattgagaatgaaatcgttattgtccacaactttatcaaagacaagtacaagcttaagtttcaagagcttgagtcgttggttcatcaccctattgactatgcatgtgttgtgaagaagattgggaatgagacggatttggctcttgttgatctcgctgaccttcttccttcagctattatcatggttgtttcagttactgctttaactacgaaagggagtgcactgccagaggatgttttgcaaaaggtgttagaggcttgtgatcgggctttagatcttgattccgcaaggaagaaggtccttgagtttgttgaaagtaagatgggatctattgcacctaatctttctgctattgttgggagtgctgttgcagccaaactcatggggactgctggaggtttgtcagcacttgctaaaatgcctgcgtgtaatgttcaagttcttggccacaagaggaagaaccttgctgggttttcttctgcaacgtctcagtcccgtgtgggttatctggagcagacagagatttaccaaagcacgcctcctggacttcaggctcgcgctggcaggctcgtggctgcaaaatcaactttggcagcaagagttgatgctactagaggggatccgttagggataagtggaaaagctttcagggaggagatccgtaagaagattgagaaatggcaagaacctcctcctgcaagacagcctaagccacttcctgttcctgattctgaaccgaagaaaagaaggggtggtcgccgtctaagaaaaatgaaagaaaggtatcaagtaacagatatgaggaagctggccaacagaatggcgtttggtacacctgaagagagctccctcggtgatggactaggagaaggttatggaatgcttggccaggcaggaagcaacaggctgcgagtatccagtgttccgagcaagcttaagattaatgctaaggtcgccaaaaagcttaaagaaaggcagtatgcgggtggtgcgactacctctggtttgacatcgagcctggctttcactcctgtgcagggaatagagttgtgcaatcctcagcaggctttaggattaggaagtgggactcaaagcacttacttctcagagtcaggaaccttctcgaagctgaagaagatctaa

SEQ ID NO: 223 - DNA, 1974 bp, Arabidopsis thaliana
atgagagatactttggctcttggtgatctttttatgcagcaggaaccagagagaaagagtggcaaagaaaagaagaagaaaggttttgggaagctaaggcatggcgagaccaattcatttcttcccatcttcagagagcctagtagtatcgaaaagatcttgggcgaggctgagagagatcacaatcttgtcttcaggcctcctactcctgatcgaccaaatccatattcagcctctcctcctccgaggcctgcttctcctcgggttgcttccccaagaccaacttctccaagagttgcctcaccacgagtcccttctccaagagctgaagttccaagaaccctttcaccaaagcctccttctccaagagctgaagttccaagatccctttcaccaaagcctccttctccaagagctgaccttccaagatcactttcgccaaagccctttgatcgatcgaagccatcatcagcctctgctaatgcccctcctactcttaggcctgcttctactcgagttccttctcagagaattacacctcacagtgttccttctccaagaccaagttcaccaagaggtgcctccccacaagccatctcttcaaagccgccttctccaagagcagagccaccaacattggacactccaagacctccctctccaagagctgcttctctaagagcagacccaccaagattggatgctgcacgacccaccacgcctaggcctccttctccactagcagacgcaccaagattggatgctccacgacccactacgcctaagccgccttctccaagatcagacccgccaagattggatgctccaagacccactacgcctaagcccccttctccaagatcggtttctcctagggctgtgcagcggcgggagattgtttatagaccagagccaacgcttccggtccaacatgcttctgcaacaaagattcaaggagctttcagaggttacatggcaaggaagagtttcagagctctcaaaggtctagtcagacttcaaggtgtggtgagaggatacagcgtgaagcggcagacgataaatgcaatgaagtacatgcagcaagtggtccgtgttcaatcccaaatccagtcacgtcgcatcaaaatgttggaaaaccaagcccaggtagagaaagatgaagccaaatgggctgcgtctgaagctggtaatgataattgggatgacagtgtgctgacaaaagaggaaagggattcaagatcacaaagaaagactgacgcaatcatcaagagagaaagatccatggcctatgcatattctcgcaagttgtggaagaacagtcctaagtctactcaggacaatcgttctttccctcaatggtggaactgggtggaccggcagaatcctcttgctagtcctgcaccgagctatagccaaccacaaagagatttcaggctaacaccatcaagactgtgcccaagtcctctgtctcagtcaagcaaacaacaccatatcaggcttgacaaccactttgacacttcaacacccagatcgtcaagatccacttttcacactccctccagacccatccacacagggacatcaagatactcaagaggaagactaagaggtcaagattctcctttcaaggatgatgatagcctcacaagctgccctccattccctagctacatggctccaacagtctctgccaaagcaaaagttagaccaaacagcaatccaaaggagagagtgatgggtacaccagtcagcgagaagaggagaatgtcgtatccccccacgcaagatacgtttagatggaacaaagggtcattggtcatgagcaacagcagcagccacagaggtcctggttcacctggaggtgtggttcttgagaagcacaagacacttaaatcagtaggaaatttgagcattggttccactgcctccatggcaacaacagttgggagaaaggaatttaacagatttgtgtga

SEQ ID NO: 224 - DNA, 2010 bp, Arabidopsis thaliana
atgtttgcgcctgcgactcaaccgcaacagcaacatgagcagaagaagcaatcagagactgtttcatctgctgaagaagatgctttgaagtggaacaccgattgcgtttactttctcgcttctcctttaacctgcaagaagggacctgaatgcgagtatcgccacagtgagtatgcgcgtatgaacccgagggattgctattattggttgaatggaaactgtttgaatcccaaatgtggatttcggcatcctcctttggagggattgttgggaaatcaaggaggtgctcctgctgtttctgtacagccaatacatgcaaccgcgcagcatcctagtgttgcaaaacagcctgttccatgtctgttctttcaaaaaggcatgtgtatgaaaggagatatgtgttcgttcttgcacacgccgaatcctgctgcgtataaaaaacagcatcctgtagaagctaagcctgctactgatcctcagtgttctaaaaagccaattgaaaataacactgaggagaagaaacttcctgatgttaatctctcaaaggtggttaaaggacatactgacatatcggctgcaccaagagtcgcttctactggactaagggatagtagaagtgtagagggatacattccaaaccatgtgggatatgagcctgttgtgcagagaaagggtccaggattcccttcttttactgaaggaggccattctactcagttgcttcagaaatatggatctgatgataataacagtttccacaatggtaaggatgcagatgacgttttaagagagtcgtctcctgggtttgatgttcttgtggataatgaggctggagattctgagtattatcatgttgaagatcgatatggacgtagaagtcaggagagagggaactcagagtatgaccctgatttcagtgcaattgctgatggtgataaagaagcattacgtgaacaacgttttgattcatatgatcggagggaagacaggggatggggccatcgtcgagtttcttctgagagagaggatcgtttggacagaagggtttacgcagaagatgagagatcagagaacatactggaatcggatctgagatatcgtttggctaagcagagaaaaggcaatggtatgagattatcagtaggaggccatgactatgctgctcctgactcttcgatggacagaggatatagagagtctcgtagggatacaccgagggaaaactccattagcagtagtcgtcttcagggtagaattaagcttcgtgagagaagcaatggcgaagagggtcaccactttgacaggagaagtgagaggggaagggacagaagcgagttaccttctcagggtagactccgagatagaattaagggtaggttagaggaaaaccatagtggtaatcaggaaagaggtttcggggctccatgggcgagaagaagagaaatggaagacgaaagaaaatcagctcctaaaagcagcagagaggaaagtaagccagagccatctcttgggaagaggaaaagctttgaagaggatcatcatagtcataagcgatcaagggattcatttgcagctccattgcctttcagtgagattctcaagagaaaaaaagcggccgcatctggtggtagcagaaacaacaacaaggacgagacgatatcgaaagaggaagctggagatgagatcaaactcataaccgaagagaaaaccgaggttgtctctgaacccaaagctgaagtagaagaagaaggaacggttatggaggaagaagaaattgttggggaggaagtgtatgaaggaaatgaagacgagcaagcttatgaaggcgatgagctaaacggagagtactattacgaagaaggatatgaagaagagggaggagaatacgcttacgaagaaggtgaagaagtagtttacgcggctgaggaaggagaagaagaagcaacagaaggaggtgaaggtgagggtgaagaagacattgagaagaagaccgttgagatgttgtcataa

SEQ ID NO: 225 - DNA, 402 bp, Arabidopsis thaliana
atgggaggagctttatcaactgtgtttggaagtggagaagatgcaacagctgcagggaccgaatctgagccaagtcgcgtcctaaagtttagctcttccgctcggtggcaacttcatttcaacgagatcaaagaatcaaacaaactgctggtggttgatttctcggcctcatggtgcggaccatgtaggatgattgagcctgcgattcatgccatggctgataagttcaatgatgttgatttcgtcaaattagatgttgatgaacttcctgatgtggctaaagagtttaatgtgacggcaatgcctacctttgtgctggtgaaaaggggtaaagaaattgaaagaatcattggtgccaaaaaggacgaacttgagaagaaagttagcaaactcagagcataa

SEQ ID NO: 226 - DNA, 1125 bp, Arabidopsis thaliana
atgactaaccagaatgtcatcgtttccgacaggaaacccatcttgggtttgaaaaccatcactgtctctgtctctaactctcctctgttctctaattcctttcccacttactttaacttccctcgtcgaaagctcttgaaacttcttgaagcagccgacaaaaacaacttagttgttgctccaaagattacgtctatgatcgattccatgcgtgattcttcccctacacgtctcagatcctcttcctatgactctgtttcagataacgacgacaaaacatcttggatcgttcgttttccttcggctttaaatatgtttgatgagattgtgaatgctgcgaaagggaaacagattgtcatgtttcttgattacgacggaactctttctcccatagttgaagatcccgacaaagctttcataacccatgagatgagagaagtcgtaaaagacgtggcttcgaatttcccgactgctattgtcaccgggagatccattgagaaggttcgtagttttgtccaagtaaacgagatttactacgccggaagccacggcatggacattgaaggtccgaccaacgaaaatagtaacggccagagtaatgaaagagtgctattccaacctgctcgtgaatttttaccgatgatcgagaaggtggttaatattttagaggaaaaaacaaaatggatccctggggctatggtggagaacaacaagttttgtctgtccgtacattttcgacgtgttgatgagaagagatggcctgcattagctgaagtagtaaaatcagttcttattgattatccaaagctgaaactaacccaaggtagaaaggtacttgaaatccgccccacaatcaaatgggacaagggccaggcactcaattttttactaaaatcattaggatatgaaaattcggatgatgttgtgccggtgtatatcggggatgaccgtactgacgaagatgcgtttaaggttttacgtgaaaggggacaaggttttgggattcttgtctcaaaagtaccaaaggacaccaatgcctcttattctcttcaagacccttctcaggttaacaagtttctggaacgtttagtagaatggaagaggaagacagtgggagaagagtga

SEQ ID NO: 227 - DNA, 726 bp, Arabidopsis thaliana
atggcgtcgaactcgcttatgagctgtggcatagccgccgtgtacccttcgcttctctcttcttccaagtctaaattcgtatccgccggagttccactcccaaacgccgggaatgttggtcgtatcagaatggctgctcactggatgcctggcgagccacgaccagcttaccttgacggttctgctcctggtgactttgggtttgacccacttggacttggagaagttccagcgaaccttgagagatacaaagagtcagagctcatccactgtagatgggctatgctcgctgttcctgggattttggtaccagaagcattaggatatggaaactgggttaaggctcaggaatgggcagcactaccagggggtcaagccacttacttgggaaacccagtcccgtggggtactttgcccacaatcttggccattgagttcttagccattgcatttgttgagcaccagagaagtatggagaaagaccctgagaagaagaagtacccgggaggcgcatttgaccctcttggatactcgaaggaccccaagaagctcgaggaattgaaagttaaagagatcaagaacgggcggcttgcgctgttggcgtttgtaggattctgtgtgcaacagtcggcttacccggggacaggaccattggagaacttggcaactcacttggcggatccatggcacaacaacattggcgatattgttatccctttcaactaa

SEQ ID NO: 228 - DNA, 822 bp, Arabidopsis thaliana
atgttgactcccaccatttctaaatccatctctttagtaaccattctattagttctacaagctttctctaacacaacaaaggctcaaaattgcggttgttcgtcagagctatgttgtagtcagtttggcttttgcggtaacacttcagactattgtggtgtaggttgccaacaaggaccttgttttgctcctccccctgcaaatggtgtctctgtggctgagattgtaacgcaagaattcttcaatggaatcatcagtcaagccgcgtctagttgcgccggcaatagattttacagtcggggagcttttcttgaggccttagactcatattctcgtttcggtagagttggatcgaccgacgactctaggcgtgagattgcagcgttctttgctcatgtcacacatgaaacaggacatttctgctacatagaagagatagacggagcctcaaaggattactgcgacgagaatgcaacacaatatccatgcaatcctaacaaaggctactacggccgcggaccgatccaactctcttggaatttcaactacgggccagccgggacagcaattggtttcgacggcctgaatgcaccggaaacagtagccacggatccagtcatatccttcaaaaccgccttgtggtactggaccaatagggttcagcctgttatctctcaaggttttggtgcaacaatccgtgccattaacggtgctttggagtgtgacggggccaacacagccaccgttcaagctagagttcgttactacacggattattgtcgtcaacttggcgttgatcctggaaacaacctcacttgctaa

SEQ ID NO: 229 - DNA, 1188 bp, Arabidopsis thaliana
atggtgatggctggtgcttcttctttggatgagatcagacaggctcagagagctgatggacctgcaggcatcttggctattggcactgctaaccctgagaaccatgtgcttcaggcggagtatcctgactactacttccgcatcaccaacagtgaacacatgaccgacctcaaggagaagttcaagcgcatgtgcgacaagtcgacaattcggaaacgtcacatgcatctgacggaggaattcctcaaggaaaacccacacatgtgtgcttacatggctccttctctggacaccagacaggacatcgtggtggtcgaagtccctaagctaggcaaagaagcggcagtgaaggccatcaaggagtggggccagcccaagtcaaagatcactcatgtcgtcttctgcactacctccggcgtcgacatgcctggtgctgactaccagctcaccaagcttcttggtctccgtccttccgtcaagcgtctcatgatgtaccagcaaggttgcttcgccggcggtactgtcctccgtatcgctaaggatctcgccgagaacaatcgtggagcacgtgtcctcgttgtctgctctgagatcacagccgttaccttccgtggtccctctgacacccaccttgactccctcgtcggtcaggctcttttcagtgatggcgccgccgcactcattgtggggtcggaccctgacacatctgtcggagagaaacccatctttgagatggtgtctgccgctcagaccatccttccagactctgatggtgccatagacggacatttgagggaagttggtctcaccttccatctcctcaaggatgttcccggcctcatctccaagaacattgtgaagagtctagacgaagcgtttaaacctttggggataagtgactggaactccctcttctggatagcccaccctggaggtccagcgatcctagaccaggtggagataaagctaggactaaaggaagagaagatgagggcgacacgtcacgtgttgagcgagtatggaaacatgtcgagcgcgtgcgttctcttcatactagacgagatgaggaggaagtcagctaaggatggtgtggccacgacaggagaagggttggagtggggtgtcttgtttggtttcggaccaggtctcactgttgagacagtcgtcttgcacagcgttcctctctaa

SEQ ID NO: 230 - DNA, 699 bp, Arabidopsis thaliana
atggcgaaaactctatcccgatccaccgcctcatgcgtcgctaagcgtttcttttccacctccaatgccgtcgcctctccttctccgcttccttctcatctcatctctcgtcgattctcaccgacgatcttccacgccgtcggatacatcccagctttgacccgcttcacaacgatccggacccggatggataggtctggcggctcatattcgccgcttaaatccggatcaaacttcagcgatcgaccacccactgaaatggcacctctatttcctggttgcgattacgagcattggcttatcgtcatggagaagcccggaggtgaaaatgctcagaaacagcaaatgatcgattgctatgttcaaaccctagctaaaattgttggcagtgaggaagaggctagaaagaagatctataatgtttcgtgtgagaggtattttgggtttggctgtgagattgatgaggagacatcaaacaaactcgaaggacttcctggtgttctgttcgtgcttccggactcttatgttgatccagagttcaaagattacggagctgaactgtttgtgaatggagaagtagttcctcgtccaccagagagacagaggaggatggtggagttaacgaatcaaagagggtcggataaaccaaagtaccatgaccgaatcagaaatgtccgacggagggagaacatgcgttga

SEQ ID NO: 231 - DNA, 1080 bp, Arabidopsis thaliana
atgggaaaggttcttcagaaagaggcgttcggattagccgcgaaagacaattccggagttctctcgcctttcagtttcactagaagggaaacaggagaaaaggatgtgaggttcaaagtgttattttgtggaatttgtcactctgatttgcatatggtcaagaacgagtggggaatgtctacttatcctcttgtcccagggcatgagatcgtgggcgtggtgactgaagtcggagccaaagtgactaaattcaaaaccggagaaaaagtcggagttgggtgtttggtcagctcgtgcgggtcatgtgacagctgcaccgaaggtatggaaaactattgtccaaaatcaatccaaacgtacggattcccgtactacgacaacaccataacatacggtggttactccgaccacatggtttgcgaggaaggtttcgtcatccgtattccagacaatctccccttggacgccgccgcaccgctcctctgtgccggtatcacggtctattcccctatgaagtatcacgggctcgacaaacccggtatgcacatcggtgtggtaggattaggcggtttaggtcatgtaggagtgaaatttgccaaggctatgggtactaaggttacggttattagtacttcggagaaaaagagagatgaggcgattaatcggcttggtgcggatgctttcttggtgagccgtgacccaaaacagattaaggatgcaatgggtactatggatggtataattgataccgtctctgcgactcattcacttcttccgttgctcggtttgctgaagcataagggaaaacttgttatggttggtgcacccgagaagccactcgagctacctgtcatgcctctcatctttgagaggaagatggtaatgggaagtatgataggagggataaaagagacccaggaaatgatagatatggccgggaaacacaacatcactgcggatattgagcttatctctgccgattatgtcaacaccgccatggaacggctagagaaagccgacgttaggtaccgctttgtgattgatgttgccaacacattgaagcctaatcctaatttataa

SEQ ID NO: 232 - DNA, 1029 bp, Arabidopsis thaliana
atggcggatctgaaatcaaccttcctcgacgtttactctgttctcaagtctgatctgcttcaagatccttcctttgaattcacccacgaatctcgtcaatggcttgaacggatgcttgactacaatgtacgcggagggaagctaaatcgtggtctctctgtggttgatagctacaagctgttgaagcaaggtcaagacttgacggagaaagagactttcctctcatgtgctcttggttggtgcattgaatggcttcaagcttatttccttgtgcttgatgacatcatggacaactctgtcacacgccgtggccagccttgttggtttagaaagccaaaggttggtatgattgccattaacgatgggattctacttcgcaatcatatccacaggattctcaaaaagcacttcagggaaatgccttactatgttgacctcgttgatttgtttaacgaggtagagtttcaaacagcttgcggccagatgattgatttgatcaccacctttgatggagaaaaagatttgtctaagtactccttgcaaatccatcggcgtattgttgagtacaaaacagcttattactcattttatcttcctgttgcttgcgcattgctcatggcgggagaaaatttggaaaaccatactgatgtgaagactgttcttgttgacatgggaatttactttcaagtacaggatgattatctggactgttttgctgatcctgagacacttggcaagatagggacagacatagaagatttcaaatgctcctggttggtagttaaggcattggaacgctgcagtgaagaacaaactaagatactatacgagaactatggtaaagccgaaccatcaaacgttgctaaggtgaaagctctctacaaagagcttgatctcgagggagcgttcatggaatatgagaaggaaagctatgagaagctgacaaagttgatcgaagctcaccagagtaaagcaattcaagcagtgctaaaatctttcttggctaagatctacaagaggcagaagtag

SEQ ID NO: 233 - DNA, 510 bp, Arabidopsis thaliana
atggctgcttcttccgaacccaaatctctttacgatttcaccgtcaaggatgctaagggaaacgatgttgatctaagcatctacaaagggaaggttcttttgattgtgaacgttgcttctcaatgtggcttgactaattcgaattatactgagcttgcgcagctgtatgagaagtacaaaggccatggtttcgagattcttgcgtttccgtgtaaccagtttgggaatcaagagcctggtactaatgaagagattgttcagtttgcttgtactcgtttcaaggctgagtacccgattttcgacaaggttgatgttaacggtgacaaagctgccccagtctacaagtttctgaaatcaagcaaaggcgggctctttggagacggcattaagtggaacttcgcaaagttcttggttgacaaagatggaaatgttgtcgatcgtttcgcaccaactacctcacctctcagcattgagaaggatgtgaagaagttgttgggagttactgcttaa

SEQ ID NO: 234 - DNA, 855 bp, Arabidopsis thaliana
atgacggctgtgacggcggcgcaaagatcagttccggcgccgtttttaagcaaaacgtatcagctagttgatgatcatagcacagacgacgtcgtttcatggaacgaagaaggaacagcttttgtcgtgtggaaaacagcagagtttgctaaagatcttcttcctcaatacttcaagcataataatttctcaagcttcattcgtcagctcaacacttacggatttcgtaaaactgtaccggataaatgggaatttgcaaacgattatttccggagaggcggggaggatctgttgacggacatacgacggcgtaaatcggtgattgcttcaacggcggggaaatgtgttgttgttggttcgccttctgagtctaattctggtggtggtgatgatcacggttcaagctccacgtcatcacccggttcgtcgaagaatcctggttcggtggagaacatggttgctgatttatcaggagagaacgagaagcttaaacgtgaaaacaataacttgagctcggagctcgcggcggcgaagaagcagcgcgatgagctagtgacgttcttgacgggtcatctgaaagtaagaccggaacaaatcgataaaatgatcaaaggagggaaatttaaaccggtggagtctgacgaagagagtgagtgcgaaggttgcgacggcggcggaggagcagaggagggggtaggtgaaggattgaaattgtttggggtgtggttgaaaggagagagaaaaaagagggaccgggatgaaaagaattatgtggtgagtgggtcccgtatgacggaaataaagaacgtggactttcacgcgccgttgtggaaaagcagcaaagtctgcaactaa

SEQ ID NO: 235 - DNA, 2736 bp, Arabidopsis thaliana
atgaatccagagaaattcacacacaagacaaacgagacaattgctacagctcatgagctagctgtgaatgcaggacatgctcaattcactcctttgcatttagctggtgctttgatctctgatcccaccggtatatttcctcaagcaatctctagtgccggtggcgagaacgcagctcaatctgctgaaagagtgatcaatcaagccttgaagaagcttccttcacaatctcctccacctgatgatattccagcgagttctagtcttattaaggtcattcgtcgtgctcaagctgctcagaagtcacgaggtgatactcatttggctgttgaccagttgattatgggtcttcttgaagattctcaaatcagggatttgttgaacgaagtcggtgtagcgacggcgagggtaaagtctgaggttgagaagcttcgtgggaaagaagggaagaaagttgagagtgcttcaggggacacaaattttcaagctttaaagacttatggaagagatttggttgagcaagcagggaagcttgatcctgtgattggtcgtgatgaggagattagaagagtcgtgaggattctttcgaggagaacgaagaacaatcctgtgcttattggagagccaggagttggtaaaacagctgtggttgaaggtttagcacaaaggattgtgaaaggagatgtgcccaacagtcttactgatgtgagattaatttcgttggacatgggtgcgttagttgctggtgctaaataccgaggagagtttgaagaaaggttgaaatctgttttgaaagaagttgaggacgctgaaggcaaagtgattctctttattgatgagattcatttggttcttggtgctggcaaaactgaagggtcgatggatgcagctaatctgttcaagcccatgttagctagagggcagcttcgatgcattggtgctacaacgcttgaagaatacaggaaatatgttgagaaagatgctgcctttgagaggaggttccaacaagtctatgttgcggagccaagtgtgcctgacaccattagtatccttagaggactcaaggagaagtatgagggacatcatggtgtgcgaatccaagacagagctcttataaatgctgctcagctgtctgctcgttacataactggtcggcatttaccggataaagcaattgatttggttgatgaggcttgtgcgaatgtgagagtccagcttgatagtcaacctgaagagattgataaccttgaaaggaagaggatgcagctggaaattgaacttcacgccttggaaagggagaaggataaagccagcaaagctcgacttatagaggtgcggaaagagcttgatgacctgagagacaagcttcagcctctcacgatgaaatacagaaaggagaaagagagaattgatgagattcgaaggcttaaacagaaaagagaagagctcatgttttctttgcaggaggcagaacgaagatatgaccttgcaagagctgctgatctaagatatggcgcaattcaagaagtggaatctgcaattgcccaacttgaaggaacttcttctgaagagaatgtgatgctcacagaaaacgttgggcctgaacacattgctgaggttgtgagccgttggacagggattccagtgacgagacttggccaaaatgagaaggagaggttgattggtcttgctgataggttgcataagcgggttgtgggacagaatcaagcggtaaatgcagtttctgaggcaattctaaggtcaagggcaggacttggaaggccacaacagccaactggatcattcttattccttggaccaactggtgttggcaaaactgagctcgccaaggctcttgctgagcagctgtttgatgatgaaaacctcttagttcggattgatatgtcggaatatatggaacaacactctgtctctcgcctcattggggcaccaccagggtatgttggtcacgaggaaggtggacaactaactgaggctgtgaggaggcgaccttattgtgtcatactctttgatgaagtggagaaggctcatgttgctgtcttcaacactctgctccaagttttggatgatggtcgattgacagacgggcaaggcaggacagtcgatttcaggaactcggtgataatcatgacatcaaaccttggtgctgaacacctccttgcagggctaactgggaaagtaacaatggaagtggcccgggactgtgtgatgcgggaggtgaggaaacacttcagaccagagctcttgaacaggcttgacgagattgtggtgttcgaccccctttcacatgaccagttgaggaaagtagctcggcttcaaatgaaagacgttgctgtccggcttgctgaaagaggagttgctttggcagtcactgatgctgctttggactatatcttggcagagagttatgacccggtgtatggtgctaggcctataaggagatggatggagaagaaggtggtgacagaactgtcaaagatggttgtgcgtgaggaaatcgatgaaaactccactgtttacatagatgcaggcgctggtgatcttgtgtaccgggtagaaagtggaggtctagtggacgcttcaacaggcaagaagtcagatgtgctgattcatattgctaacgggccaaagagaagtgatgcagctcaggcggtgaagaagatgaggatcgaggaaatagaagatgacgataatgaggaaatgatcgaggattaa

SEQ ID NO: 236 - DNA, 474 bp, Arabidopsis thaliana
atgtctctaattccaagcatcttcggaggaagaagaacaaacgttttcgatccgttctcgctggatgttttcgatccgttcgaaggtttcttgacgccgtcaggattggcaaacgcacccgctatggatgtggcagcgttcacaaacgctaaagtggattggagggagacacctgaggcgcacgtgttcaaggcggatttaccgggactgaggaaggaagaggtgaaagtggaggttgaggatggcaacatacttcagataagtggagagaggagcaatgagaatgaagagaagaatgacaagtggcaccgtgtggagcggtcgagtgggaagttcacgaggaggtttaggctgccggagaatgctaagatggaggaaatcaaagccagtatggaaaatggtgtgttgtcggttaccgtgcccaaggtgccagagaaaaagccagaggttaagtccattgatatctctggttaa

SEQ ID NO: 237 - DNA, 471 bp, Arabidopsis thaliana
atggatttggagtttggaaggtttccaatattttcaatcctcgaagacatgcttgaagcccctgaagaacaaaccgagaagactcgtaacaacccttcaagagcttacatgcgagacgcaaaggcaatggctgctacaccagctgacgttatcgagcacccggatgcgtacgttttcgccgtggacatgcctggaatcaaaggagatgagattcaggtccagatagagaacgagaacgtgcttgtggtgagtggcaaaagacagagggacaacaaggagaatgaaggtgtgaagtttgtgaggatggagaggaggatggggaagtttatgaggaagtttcagttacctgataatgcagatttggagaagatctctgcggcttgtaatgacggtgtgttgaaagtgactattccgaaacttcctcctcctgagccaaagaaaccaaagactatacaagttcaagtcgcttga

SEQ ID NO: 238 - DNA, 2118 bp, Arabidopsis thaliana
atggcggatgttcagatggctgatgcagagacttttgctttccaagctgagattaaccagcttcttagcttgatcatcaacacgttctacagcaacaaagaaatcttcctccgtgagctcatcagtaactcttctgatgctcttgacaagatccgatttgagagcttaacggataagagcaagctcgatggacagcctgaactcttcattagattggttcctgacaagtctaataagacgctctcaattattgacagtggtattggcatgaccaaagcagatttggtgaacaacttgggaaccattgcgaggtctggaacaaaagagtttatggaggcgcttcaagctggagctgatgtaagcatgataggacaatttggtgttggtttctactctgcttatcttgttgcagagaaggttgttgtcactacaaagcacaatgatgatgaacaatacgtttgggagtctcaagctggtggttccttcactgtcactagggatgtggatggggaaccacttggtagaggaactaagatcaccctcttccttaaggacgatcagcttgaatacttggaggagaggagactcaaagacttggtgaagaagcactctgagttcatcagttaccctatctacctttggaccgagaaaaccaccgagaaggagatcagtgacgatgaggatgaagatgaaccaaagaaagaaaacgaaggtgaggttgaagaagttgatgaggagaaggagaaagatggtaaaaagaagaagaaaatcaaggaagtctctcacgagtgggaactcatcaacaagcagaaaccgatctggttgaggaagccagaagagatcactaaggaagagtatgctgctttctacaagagcttgaccaatgactgggaagatcacttagccgtgaaacacttctcagtggagggtcagctagaattcaaggccattctctttgtaccaaagagagctccgtttgatctctttgacacgaggaagaagttgaacaacatcaagctttatgtcaggagggtgttcattatggacaactgtgaagagctaatcccagagtacctcagctttgtgaaaggtgttgttgactctgatgacttgccactcaacatctctcgtgagacgcttcaacagaacaagatccttaaggtgatcaggaagaatctagtgaagaagtgcattgagatgttcaacgagattgctgagaacaaagaggactacaccaaattctatgaggctttctccaagaatctcaaattgggtatccatgaagacagtcagaacaggggaaagattgctgatcttctacggtaccactccacaaagagtggtgatgaaatgacgagcttcaaagattacgtcacaaggatgaaggaaggtcaaaaggacattttctacatcactggtgaaagcaaaaaggcggtggagaattctcccttcttggagaggctgaagaagagaggatacgaggtactttacatggtggatgcgattgacgaatacgctgttggacaattgaaggagtatgacggtaagaaacttgtttctgcgactaaagaaggcctcaaacttgaagatgagaccgaagaagagaagaaaaagagggaagagaagaagaagtccttcgagaatctgtgcaagacgattaaggaaattctcggggacaaggttgagaaggttgtggtctcagacaggattgtggactctccctgctgtctagtaactggtgaatatggatggactgcaaatatggagaggattatgaaggcacaggcgttgagagatagcagcatgagtggttacatgtcgagcaagaaaacaatggagatcaaccccgacaacggtataatggaggagctcaggaagagagctgaagcagacaagaatgacaagtctgttaaagatcttgtcatgttgctgtatgagacagctttgttgacgtctggattcagtcttgatgaaccgaacacttttgctgctaggattcacaggatgttgaagttgggtctgagtattgatgaggatgagaacgttgaggaagatggtgatatgcctgagttggaggaggacgctgctgaagagagcaagatggaggaagtcgactaa

SEQ ID NO: 239 - DNA, 507 bp, Arabidopsis thaliana
atgcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacaggaaacaagagaggaggtggtggtggttctaatgctgatgcaagcctttga

SEQ ID NO: 240 - DNA, 720 bp, Arabidopsis thaliana
atgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaaaggttaaacctttaaggcttttagatggatcatcagactttgtactcacttatgaagataaggaaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttag

SEQ ID NO: 241 - DNA, 594 bp, Arabidopsis thaliana
atggagaaggaaggactcgggcttgagataacggagctgagattggggcttccggggagagatgtggcagagaagatgatgaagaagagagctttcacggagatgaatatgacgtcgtcgggtagtaatagtgatcaatgtgaaagcggcgtcgtttcatctggtggtgacgctgagaaggttaatgattcgccggcggcgaaaagccaggtggtggggtggccaccggtttgttcttaccggaagaaaaacagctgtaaggaagcttcgaccacgaaagtggggttagggtatgtgaaagtgagcatggatggtgtgccttatttgaggaagatggatcttggttcgagccaaggctatgatgatctagcctttgctcttgataagctcttcggtttccgtggcatcggtgtggccttgaaagatggtgacaactgcgaatacgttaccatatacgaagacaaagatggagactggatgctcgccggtgatgtaccttgggggatgtttctagagtcatgcaagaggttgagaataatgaaaagatcggatgctaccgggtttgggctgcagcctagaggagtagacgagtga

SEQ ID NO: 242 - DNA, 525 bp, Arabidopsis thaliana
atggcgtacgagaaagtcaacgagcttaaccttaaggacacagagctatgtcttggattacccggaagaacagagaagatcaaagaagaacaagaggtttcttgcgttaaaagtaacaacaagcgtctatttgaggaaactcgtgatgaagaagaatctacacctcctaccaaaactcaaatcgttggttggccaccagtgagatcttcccgtaagaacaacaacagtgtgagctacgtgaaagtgagtatggacggagctccttaccttcgcaagatcgatctcaagacatacaaaaactaccccgagcttctcaaagcgttagagaatatgttcaaagtcatgattggtgaatattgtgagagagaaggatacaaaggatctggatttgtaccaacatacgaagataaagatggtgactggatgttggttggtgatgttccatgggacatgttctcttcttcttgtaagagactcagaatcatgaagggatccgacgctcctgctctagactcttccttatga

SEQ ID NO: 243 - DNA, 3150 bp, Arabidopsis thaliana
atgaaagctccttcatcaaatggagtttctcctaatcctgttgaagaaaggagaaatataaactcagagctatggcacgcttgtgctgggccattgatttcgttgcctccagcaggaagtcttgttgtttacttccctcaaggtcacagtgagcaagtcgcggcttcaatgcagaagcagactgatttcataccaagttacccgaatcttccttccaagctcatatgcatgctccacaatgttacactgaatgctgatcctgagacggatgaggtctatgcgcagatgactcttcagccagtaaacaaatatgacagagatgcattgcttgcttctgacatgggtcttaagctaaacagacaacctaatgaatttttctgcaaaaccctcacggcgagtgacacaagtactcacggtggattttctgtaccccgacgagctgctgagaaaatctttcctgctctggatttctcgatgcaaccaccttgtcaggagcttgttgctaaggatattcatgacaacacatggactttcagacatatttatcgaggtcaaccaaaaaggcacttgctaactacaggctggagtgtgtttgtcagcacgaaaaggctctttgctggagactctgttctttttataagagatggaaaggcgcaacttctgttggggataagacgtgcaaatagacaacagcctgcactttcttcatctgtaatatcaagtgatagcatgcacatcggagttcttgcagctgcagctcatgctaatgctaataacagtcctttcaccattttctacaacccgagggctgctcctgctgagtttgtggttcctttagccaagtataccaaagcgatgtacgctcaagtttccctcggtatgcggtttagaatgatatttgagactgaagaatgtggagttcgtcggtatatgggtacagttaccggtatcagtgatcttgatccagtgagatggaaaaactctcagtggcggaatcttcagattggatgggatgagtcagctgctggtgataggcccagtcgagtttcagtttgggacattgaaccggttttaactcctttctacatatgtcctcctccatttttccgacctcgcttttctggacaacctggaatgccagatgatgagactgacatggagtctgcactgaagagagcaatgccatggcttgataatagcttagagatgaaagacccttcgagtactatctttcctggtctgagtttagttcagtggatgaatatgcagcagcagaacggccagctaccctctgctgctgcacagccaggtttcttcccatcaatgctttcgccaaccgcggcgctgcacaacaatcttggcggcactgatgatccctccaagttactgagctttcagacgccgcacggggggatttcctcctcaaatctccaatttaacaaacagaatcagcaagccccaatgtctcagttgcctcagccaccaactacgttgtcccaacaacagcagctgcagcaattgttgcactcctctttgaaccatcaacaacagcaatcgcagtctcaacaacagcaacaacaacaacagttgctgcagcagcaacaacaattgcagtctcaacaacacagcaacaacaatcaatcgcagtctcagcaacaacaacaattgctccagcagcaacaacaacaacaactgcagcaacaacatcaacaaccgttacagcaacagactcagcagcagcagctaagaacacagccattgcaatctcactcgcatccacagccacaacagttacaacaacataagttgcagcaacttcaggttccacagaatcagctttacaatggtcaacaagcagcgcagcagcatcagtcgcaacaagcatctacacatcatttgcaaccacaattagtttcgggatcaatggcaagcagtgtcatcacgcctccgtccagctcccttaatcaaagctttcaacagcaacaacaacagtctaagcaacttcaacaagcacatcaccatttaggtgctagcactagccagagtagtgtaattgaaaccagcaagtcttcatccaatctgatgtccgcaccgccgcaagagacacagttttcacgacaagtagaacagcagcagcctcctggtctcaacgggcagaatcagcaaacacttttgcagcagaaagctcaccaggcacaggcccaacagatattccagcagagtctcttggaacagccgcatatacagtttcagctgttacagagattacaacagcaacagcagcagcaatttctttcgccgcagtctcagttaccacaccatcaattgcaaagccagcagttgcaacagctgcctactctctctcaaggtcatcagtttccgtcatcttgcactaacaatggcttatcgacgttgcaaccacctcaaatgctggtgagccgacctcaggaaaaacaaaacccaccggttgggggaggggtcaaagcttattcaggcatcacagatggaggagatgcaccttcctcttcaacgtcgccttccaccaacaactgtcagatctcttcttcaggctttctcaacagaagccaaagcgggccagcgatcttgatacctgatgcagcgattgatatgtctggtaatcttgttcaggatctttacagcaaatccgatatgcggctaaaacaagaactcgtgggtcagcaaaagtccaaagctagtttaacagatcatcaactagaagcatctgcctctggaacttcttacggtttagatggaggcgaaaacaacagacaacaaaatttcttggctccaacttttggccttgacggtgattccaggaacagcttgctcggtggagctaatgttgataatggctttgtgcctgacacgctactctcgaggggatatgactcccagaaagatcttcagaacatgctttcaaactatggaggagtgacaaatgacattggtacagagatgtctacttcagctgtaagaactcaatcttttggtgtccccaatgtgcccgccatttcgaacgatctagctgtcaacgatgctggagttcttggtggtggattgtggccagctcagactcagcgaatgcgaacttatacaaagagaattcgtaaactgtgttcagagcattaa

SEQ ID NO: 244 - DNA, 1125 bp, Arabidopsis thaliana
atgggagcagcgaagaatatctgggcattagccaacgccgaagatgcagctaacgacgccgaacaaatcccttattcttcgttcgtcgtcgacacgtctttgcctcttcctctcatgattcctcgtatcatagagttatgtaaagatctgttcaagaattggggagagcttgatgattcactcttctctgttgagagagtatctggaggcattacaaatcttttgctgaaggtttctgtgaaagaggacactaataaagaagtgtctgttacagtgagactgtatgggcctaacactgagtatgttattaaccgggagagagagattctggctatcaagtatctctcggctgccggatttggtgccaagttgcttggtggttttggaaatggcatggtgcaatcgttcatcaatgcaagaaccttagagccatcagacatgagagagccaaagattgctgcacaaattgccagagaacttggaaagtttcataaagtggacataccaggttccaaggaacctcagctgtgggttgatatcttgaagttctatgaaaaagcatctactcttacgtttgaagaacctgataagcagaagctctttgagactatttcgtttgaagaactccacaaagaaattattgagctaagggaattcacaggcttacttaacgcacctgtggtgtttgctcataacgatttactatcaggaaacttcatgctgaatgatgaagaagagaaactatacttgattgatttcgagtatggatcatacaactatagaggctttgacatcggaaatcacttcaatgaatatgcaggatacgactgtgattacagcctgtacccaagtaaagaggaacaatatcatttcatcaagcattacttacagccagacaaaccagacgaggtcagtatcgctgaagtagaatcagtctttgtagagacagatgcgtataaattagcatctcatttgtactgggcaatatgggcgatcatccaggcaaggatgtctcccattgagtttgaatatttgggttacttctttttgcggtacaatgaatacaagaagcagaagccacttactttttcacttgttacatctcacctctcagcatcgctgtag

SEQ ID NO: 245 - DNA, 675 bp, Arabidopsis thaliana
atggagagtagcaacttttcttctggtgtcagaaccgagagtagtgtgaagccaagaggagcattgatagttctagaaggtcttgatcgcagcgggaaatcaacacagtgtgctaagctactctctttcttgaatggtttaggacatccgaccgagctctggagattccccgatagagagacgagtgtcggtcagatgatatccgcgtatctttctaataagtcgcagttagatgatcacacaattcatctccttttcagcgccaatcgttgggagaaaaggtcgttgatggaggaaaagctaaaaacaggaactacgcttatcgtggatcgttattcgtattctggtgttgcattctcatcagctaaaggtctcgatatcgaatggtgcaaggctcccgaaatcgggttactggctccagattctgtactttacctggacatttcacctgaaagagctgctgagagaggtggatatggagatgagaggtatgagcgagtggagtttcagaagaaagttgcagacttttatcaaacccttggcgattcttcatggaagataatcaatgccagtgatgccatggaggaagtagagaagaagattcaacaagtggtattagatcaagtcaaagaatgtactgaaggaaagcctctgtctctcctatggtcgtcatag

SEQ ID NO: 246 - DNA, 1662 bp, Arabidopsis thaliana
atgaagtatgtggttgtttcaggaggagtagtgagtggactcggcaaaggagtcacggcaagtagcatcggactcatcctcaaatcctgtggcttccgagtcaccgccattaaaatcgatccttacttaaacattgatgctgggaccatgtcacctattgaacatggtgaagtttacgtcttggatgatggtggcgaggttgatctggatcttgggaactatgagaggttcatggatattaagctgactagtgaaaacaacataactactggaaaagtttataagcatgtgcttgagaaagagaggagaggagattatcttgggaagactgttcaggttgttcctcatattactgatgctattcaaaaatggattgagcgtgcagctaggattccagtggatggacagtcaggtccagctgatgtttgtgtcatagaacttggaggaactataggagatatagagtccatgccttttattgaagctcttgggcagttctcatatcgcgtgggcactgacaatttttgcttgatccatgtcagtcttgtgcctgtattgaatgttaagactaaaccaactcaacatagcgttagagacttaagaggccttggcttgagccctaatatcttggcttgccggagcacaaagccacttgaagataatgtgaaggccaaactctctcagttttgccatgtcccgatggaaaacgttgtcactctctacgattgtcccaacatttggcacataccattgcttctcaaagtgagtaactttctcatccaccatagtttcaaagtttcagagcctgcattagaggaatggtctttgatggctaaaatgaccgacaaattgcatgttccggtaagaattgctgtggttgggaaatacactgagctcttggattcgtatctttccattcacaaggctctcttgcacgcttctgtggctaggcgcaagaaacttatcatagattggatttcagctagtgatcttgagcaaggtgcaaaaaaggagaatccggatgcatataaggccgcctggaagttactcaagggtgctgatggcgttcttgtgccgggaggttttggcagtagaggtgtagaaggaaagatgctggcagcgaaatacgccagagaaaacagaattccataccttggtatctgtctaggtatgcaactcgctgtgatcgagtatgcaagaaccatactcggtttggcagatgcaaatagcactgaacttgatcccaacaccaaaaacccctgtgttattttcatgcctgaggggtcgaaaacgcatatgggaggcactatgaggttaggctcaagaagaacttattttcattctaaggactccaaatcagcaagactatatgggaacaaaagttttgtagatgaaagacaccgacacagatatgaggtgaatccagccatggttccacgttttgagagctctggactcacattcacaggaaaagacgagacagggcagcgaatggagatcattgaactgcctaaccatccgttttacgtcggagctcagttccatcccgagtacaaatcaagacccggaaaaccatctcctctgtttctaggtgaagagaaacataaaaataatgcaaaagccctcggtttctttcttcgtgtaagcacataccttaactaa

SEQ ID NO: 247 - DNA, 291 bp, Arabidopsis thaliana
aatgggtgatacagatatgaagcaaacaatgaaggaagatgctcttagtttggcctccaaagcccttgattgctttgatgtcaccgaacctactcaaattgcccgtttcatcaagaaggaatttgatagaagttacggatcggggtggcagtgcatcgtggggacgcatttcggatctttcgtgactcattgcagtggctgcttcatccatttctcagttggcagccttaccattttgctttttaagggatcagtcggtgaaccggcccccccggaccgatgctctagcta

SEQ ID NO: 248 - DNA, 1974 bp, Arabidopsis thaliana
atggcgagaccatcgatcgccacgtgtgatccaagcgcacgaccttgtttagcgacgcgtggctcacttcctcgtagccgtacatgcgcgccgcttttattcctctgcctcctcctaggtttaacggtcttttgtgcggacgcaaatccttctgactcgaagcttctctgctcccgtcttcttccatgtgagccttctattgaaatggtgagaaattgtaagaatctgtggaaactcttggaccggaaagtgagtgttccttgccgtaagattacaactttgacgaggacagttactctaactgaactaccagataagactatggaagctaagtgtcttcagggcatgtttgagttgattgattctgcattcttcaatgaaactaaagagattgcaaagggggctactgaaatgaatgttcctatatatcgagccaaccggaaactagtagctactaagaatggtgggttggaaaatccatccccgttggtgtttaatccgtcttggaacagagaagttcaacgagtgcaagacaagagattcaaatacccttcggcatccggagtaaaactccctagagatgaagaagatatcgccttcatgagcgttcttgaactcggagaacttataaagacgagacaaattacttccaaagaactcgttcggatttatcttaagcagttaaaacggtacaatcatgttcttgaagcggtagttacttatactgaagaactggcatacaaacaagccaaagaagctgatgatttactctctcaaggaacttatcttggacctcttcacgggattccatatggtttaaaggatatagttgcagttcccggatataaaacaacttggggttcaacttctttcaaagaccaatttcttgacattgaagcatgggtttacaaaagattaaaagcttcaggtgcagttttagtagcaaagcttgttacgggttctatggcttatgatgatatctggttcgggggacggactaggaatccatggaatatcgaggaattctctaccgggtcatcagctggacccgctgcatccacatcggctggtatggttccttttgctataggctcggagacagcaggctcaatgacataccctgcagcgcggtgtggcataacagcattgcgtccgacatttgggagcgttggtagaaccggagtgatgagcatatccgagagcctggataagctgggacctttctgtagaacagcagcggattgcgctgtaattcttgacgctatcaaaggaaaagatcccgatgatctctcatctagagagatcgcgtttgaagatcccttctccgttgatatcacaaaactcacagttgggtatacaaaagatgctgatatgaaggtggtggaagttcttggttccaaaggtgtcaatatggttccttttgagctaaattatactgtggaatcggttcaagggatattgaacttcacaatggatgtagatatgttggctcattttgatgaatggcaaagaaccggtcaagaagatctctatgaagctcaagatcaatggccggttgagttacgccgtgctcgtgtagttacagcagtagattacattcaggctcagagagctcgtggtaagttgattcgggaagtggagaagagctttacagtcgatgcgtttattggaaatgtgaccgattgggagaaagtctgtatgggaaacctagtcggtttgccggttctagtgattccgaccggtttcaagaacataacggatccaccaaccaacagttgccggagacggacaacgatcaatgccggaatttatgcccctccagaacgtgatcacattgctttggcattgggtatggcgtaccaatcggttaccgatgcacataggaagcgaccacctattgatgatcttggaccggatgactcgataccaaatcctcctcgggctttaatccctccccgtaggttacacatttga

SEQ ID NO: 249 - DNA, 2217 bp, Arabidopsis thaliana
atgccatggaggggtgctggtgtagcagttcccatgttctctgtaaggtcagaagatgatgttggtgtgggagagtttctcgatctgaagttgcttgttgattgggctgtagattccgggttgcatctagtacaacttttaccagtaaatgacacatccgttcataagatgtggtgggactcgtatccctacagctcgttatctgtgtttgcattgcatccattatatcttagagtgcaggctctctctgaacgtctgccagaagatatcaagagactcctaagcaatatattggctgacctttttcgttctctttcaggaagaaattcagaaggcgaagaatcaactggacaagaatgtaatgagtcccttgttagacgtttcatagattttcttacttttacgtccttgaaaaagatagcatcagataaacgggatatagtatttttaaatggtttgtgtctgtatcagcatgatgtgtttaaacgcctgcaagcaattggttcatatgatgttgattatgaggctaccatggaaactaagctttcaattgccaagaaaatctttgacatagagaaagaccagactttgaactcaagcaccttccagaaattcttctctgaaaacgagggctggttgaaaccatatgcagctttctgcttccttcgtgacttttttgagacttcagatcatagtcagtgggggaccttttctgactatacagacgacaagttgtcagcagcagcagaatatgcaaggaagaaaggagttgtgctgaaaggagacctacctattggcgttgacagaaacagtgttgatacgtgggtttacaggaatctgtttcgcatgaatacgtcaactggagcacctccagactattttgacaaaaatggtcagaactggggatttcctacttataactgggaggaaatgtcaaaagacaactatgcctggtggcgtgctcgcctaacacagatggggaaatatttcacagcatacaggattgatcatatattgggattcttcagaatctgggagcttccagctcatgctatgactggtttagtggggaagttccgtccatctattcctttaagtcaggaagagttggaaaaggagggaatatgggattttgaccgcttaagcaagccctatatccagaagaagtttcttgaggagaaatttggagatttttggccttttattgcatcaaactttcttaatgaaactcagaaggacatgtatgagttcaaggaggactgcaacacagagaagaagattgtagcaaagctgaagtcattggctgagaagtctttgttgctagaaaatgaggacaaagttcgacgtgatgtctttgacattttacggaatgttgttctgatcaaagatccagaggatgcaagaaaattctatcctcgctttaatattgaggatacttcaagcttccaggatttggatgatcacagcaaaaatgttctgaagaggctatactatgactactatttccaacgccaagaggatctatggagaaaaaatgctttgaaaaccttgcctgctctgttgaattcatctaatatgctggcatgtggggaggatctgggtctcattccatcttgtgtacatcctaagcatatgctaaaattaatagttactcaggttatgcaagaactgggattggttggccttcgcatccagcgcatgccaagtgagtccgatgtgaagtttgggattccgtctaattatgactatatgacggtgtgtgctccttcatgccacgactgctctaccctgcgagcttggtgggaagaggacgaagagagaagacagcagtacttcaaggaagtgattggtgtagatggaatccctccaagtcagtgtattccagagataactcatttcattctgaggcaacatgttgaagctccatcaatgtgggctattttcccgcttcaggatatgatggctctgaaagaagagtacactactcgtcctgcaacagaggagacaatcaatgatccaacaaaccccaaacactactggagataccgcgtacacgtgactttggactcgcttctaaaggacactgacctgaagtcaaccatcaagaacctcgtttccagcagtggaagatctgttcctgctaatgtttctggtgaagacatcaacaaaagccgaggagaagttatagccaatggctcgactaagccaaacccataa

SEQ ID NO: 250 - DNA, 2382 bp, Arabidopsis thaliana
atggacgcttttggaatcgggagtagtttaaatcaagctcccgtaactcaggatcttaagaaatttggagataattctacaggtaacacaatgtttgatgcatctcaatatgccttttttgggaacgatgttgtcgaggaggttgagctgggtggattggaagaagaagatgagattttgtctttcactggaatagcagaagacttttcatttgataaggaagaggttggagattctagacttctgtctgacgttgatgatcttgctagtactttttcaaagttgaatagggaacctgatgtgtatagtaatacggggccaatcactgataggcgatcaagtcagaattctttagctgctgagtggacccatggggaagagttaccaaattggtacggccggcaaatactggactctgatgccattaaagatgacaaggtgtggtcagcacagccattttcatctctggaccgtgttgagcagagaatccctgacagaacaaaattgtatccagaaccacaacgtcaactgcatcaagaccataatcaacaacagttttccagcgaaccaattcttgtcccgaagtcatcttttgtttcataccctcctccaggcagcatatcaccagatcagcgtttaggacaccctaatataccatatcaatctggtgggcctcaaatgggatcgccaaacttttctccttttccaaatttgcagcctcagttgcctagcatgcatcatggatcaccgcagcatactggaaacaggcctcagtttcgtcctgctcttcctctgaataatctccctccagctcaatggatgaatcgtcaaaatatgcatcctggggatagttccgggatcatgaataatgcgatgctacaacagcctcctcatcaaaacggtttgatgcctccacagatgcagggctctcagaataggttaccacatccgatgcagcctcctctcgggcatatgccaggaatgcagcctcagttatttaattcccatctttctcgatcatcatcctctggaaattatgatggaatgcttgggtttggtgatctgagggaagtaagaccaggatcaggtcatgggaacagacagaatgtgcgttttccccaacaaggctttgatgctggcgttcagagaagatatccattccggtctaaatatatgtcagctggtgagatagagaatatactgagaatgcagcttgttgctacacacagcaatgatccttatgttgatgattactatcaccaagcctgtcttgctaagaaatctgcaggtgcaaaactgaagcatcatttctgtccaaatcatttgagggaccttcaacagcgtgcacggtcgaacaacgagccccatgcttttcttcaggttgaggctcttggtagggttcctttctcttcaatccgcaggcctcgtcctctgcttgaagtggaccctccaaattcagctaaatttggtaatgcagagcataaacctacggataagccccttgatcaagagccgatgcttgcagctagagtgtacattgaggatggtctttgtctcctccttgaagttgatgatatagatcgtttcttggagtttaaccaactccaggacggaggacaccagttgaaacaaagacgacaagcattgttgcagagccttgcggtttcacttcagctcggtgatcccctcgccaagaatgggcaaagccagtctcttgatgattttctctttctaagggttatctctcttccaaagggtcgaaagctacttataaggtatcttcagctaattttccctggcagcgacctaatgcggatagtttgcatggccattttccgtcatttaaggtcattgttcggagtcctttcatctgaccccgatatcatcaaaaccacaaataagcttgcaacagttatcaacttgtgcattcaaaacatggagttaggaccggtaagcacgtgtctagcagcggtgtcttgttcttctgagcaggcaccgctccgccccttaggcagtcctgttggagacggagcttccacagtattgaaatcaatactcgacagagcttccgagcttatccgggctaataatttcaacaacgcagggatagctctatggcgcgcttcctttaatgagttctttaatatgttgatgaggtactgcatcagcaaatacgatagcatcatgcagagtttgcaattgccaccgcattttgccactgagatatctgaagaagctgcaaaagccattgtccgcgaaatgccaatagagcttctacgttcaagtttcccacacattgatgagcagcaaaagaggatactgatggagtttttgaaacgatctatgctcggaagccagaaaaccgagccagtattaagttga

SEQ ID NO: 251 - DNA, 369 bp, Arabidopsis thaliana
atgggtaacggagacaaagtcatgagccactggagcttccacatcccacgtctccatcatcatgagcatgatcatgaaaaggtaccaaaagggtgtttggcagtgaaggtaggacaaggagaagagcaagagagatttgtgattcccgttatgtactttaatcatcctttgtttggacaactcttgaaggaagctgaagaagagtttggttttgctcaaaaagggacaatcacgatcccttgtcacgttgaggagtttaggtatgttcaaggattgatcgatcgagaaaacactagatttctcggtactaatctccttgatcatcaccatcatcatcacaaccatctcatccggtgttttagggtttga

SEQ ID NO: 252 - DNA, 1830 bp, Arabidopsis thaliana
atgaaaatggtgattgaagttgatctgcaaggtttagggtttcaagtgatgatggccggaggtaacgtacggtttctgccgatctcagactctcaccgatctgcggctctggatgtcttcgtaccagtcgatggatcatacaaaagcttggaggaggcatatgaagcattaaagactttggagattcttggaattgataaaaagtctgatcttagctcaaagacttgtgagaatgtggttaaagttcttcagtcgtcttcttctactcttaaggatgcattttatgcgttaaacgttaatgggattctaaaatgtaaaattggtgaagctggtcctaaggacattgtttctcaacttcaagctggtgttaaagatgcgaagctattgcttgatttctattattctgtcagaggcttggtgctggctaagtcggtgaagacgggtatcctgaagctttctgacagtatccaaaaatatgatgatgggacattttattttgatgagaagtctgttgatgcaagtcaaggcccgatctcaacaactgcatcagttattagagggctcacgtcatttgcagcttcagaatccacaggattgaacgtatgtaatacccatgttttcatgtatcctattctgacaaatcttccaggtgataagatagttggtctggccaaattctttctgggtgttggaattcctggtgatgccaaggacttcttcaaccaaatagatgcactagcttgtttggaagacaacaagttttctgttccactcatcttgtctcttccatccactgtcatttcattgacaaagaaagagcctctgaaggttaaagttagcactgtactgggttcgaaggcaccagctcttagtgtgaagcttacacaagctctaagttctaagtcagtggattcatctgtaattaataaccaggagcttaagtttgacgctgacagtgcaacgtacttcctggactcctttcccaagaactttgacattggaaaatatacttttgtatttaagattgtgctggatgaatcagcacatgagaaagtatacataactgaagctcaaacaaaagtgcctatagctgccacaggagctattagcattgaaaatgcagaaattgctgtacttgacagtgacattggaagcgttgaatctcagaaaaagctagatttaactaaagatggagcggtatcattatcagcaaaccaccttcaaaagctacgcctgtcattccagttaactactccacttggcaatgcgtttaagccacaccaggcatttttcaagctgaaacatgagtcacaggtcgagcatatctttctcgtgaaaacttctggaaagaagtctgaattagttctagattttcttggattggttgagaagctctactacctctctggtaaatatgagatacagctaaccattggagatgcttctatggagaactctttactgagtaatattggtcacattgaactagacctaccagagcgtccagagaaggcgactcgtcctcctctacagtctactgagccttactcaagatatgggccaaaagctgaaatatcacacatattcaggattcctgaaaagcttccagcaaagcagctctcactagttttcttgggtgttatcgttctcccattcatcggtttcctgattgggcttacgcggttgggagtgaacataaagagcttcccatcgtcgactggatctgcaatatccgctttacttttccactgcggaattggagctgttttgcttctatatgtgctattctggttgaaggcaagttttcataaccgattattgtttgtttga

SEQ ID NO: 253 - DNA, 2247 bp, Arabidopsis thaliana
catgaacagaacggtggtctcgggagctgttgaatcgagtttctcattgactgatgctgttggcacggaagctctaaatatgcagaggagcagtggcatcaataataatatgcgtatcccaacatcaccgatgtctttctcctcgaatagcgttaacataccgggttcattggttcttgatggctctgctgcttcaatgcaacacttacctcagcagcagcagcagcaactactacaacagcaaacaggacaaggttctgttccaatgagggagaacagttattcccatgtagataagaaacccagattagaagtgaagcaagaagatatgttgcagcagcagattttacagcagttgatccagcgtcaggaccccacggggaggaatccgcagatgcaagctttgcttcagcagcagagactgaggcaacatcagcagatgcttcaatccatgtcaccctctcagagactccaacttcagcaacagcagcagctgagacagcagttacagcaacaaggaacccaacagattcctcctaatgtacgtccttatgaagttggcgtctgtgctcggaaattgatgatgtacttgtatcatctgcagcaacggcctgcggaaaattgcattacctattggaggaaatttgtggcagaatacttttcacctcgtgcaaagcagagattgtgcttgtcacagtacgaaagtgctgggcaccatgcgcttggcatgttcccacaggcagctccggatatgtggcagtgtgatctttgcggcaccaagtctggaaagggatttgaggcaacgtttgatgtgcttgccagactaattgaaatcaaatttgcaagtggtattattgatgagctgttatatctggatcaccctcgagaaaacagatttcccaatggactgatgatgttagaatatagaaaagcagttcaggaaactgtacacgagcagtttcgtgttgtccgtgagggccatcttcgcatcatattttctcaagatttgaagatactttcttgggagttttgcgctcggcgtcatgaagagcttcttcttcgcagacttattgctccacaggtgaaccaattgcttcaggttgcacagaaatgccagagcacgatctcagagagtgggtcagagggggtttctcagcaggatttacagtcaaatagtaacagggtcttgggagcaggacggcaactggcaaagttcatggaactacagtcgctgaatgatcttggctatccaaaaagatatatcaggactctgcagatatctgaagttgtcaagagcatgaaggatctgatgaatttcactggcgagcaaaaaatcggtcctattgaggggttgaaacggcttttggaacagacggtgacagtgaagctacagaaacagaaaatgcaagagatggagcagtttgggaataatggagctataaatgggccagttcaagctcaaatggtgttaacttcaggaacgatgaatggctcaacgggcaataacaccaataatcaccatcaaattgttggtcgtggagctatgagtgggccagctgaaggtcaaatggtgatatcttcaggaacggtgagcggcgcaactgccaacaacaactccaataatcacaatcaaattgttggtcgtggagctatgaatggctctgctcaagccgcagcagctctgaccaactaccaaagcatgcttatgaggcaaaatgctatgaataacccaaactcaaatacgggtaaacaagaggggttctcgagtcagaacccaaccccaaactcaaaccagagtccatcttcttcatcccagcagaggcataacttagttacaggtggatttcccaactctcctcaaatgcaacagcagcagcgcaccatgaatggccctaccaacatacttccgcagaatcatcctcatcagttacaatcaccacattcacatggtaacactccggagcagcagatgcttcatcagctgttgcaggagatgtctgaaaatggagggagtgtgcaacagcaacaagccttttcgggtcaaagtggtagcaacagtaacgcagagagaaacacaactgcctctacttccaacatctcaggaggaggccgagctccaagtcgaaacaacagttttaaagcagcctcgaacaacaaccttcatttttcagaagatatatcgatcacagaccatgatttctcagaagatggcttcttcaacaacaatgatatctatggtggcttgta

SEQ ID NO: 254 - DNA, 1542 bp, Arabidopsis thaliana
atggagaaaaaaccgatagggatacgattcttggaacgtatcaaaggctcaaagctctcttacagtgcttatcaagccatagtgttgatcgtgacgtttctcgcttacgctagctatcacgctgcaagaaaaacaacaagtattgtcaaaagtgctcttgatcctcaatctccagatacaggactaaactcacttcttttgagatttacttcgtttggttcctctgtaaaagaagaaggtggttgggctcctttcaatggtcctgatggtacggttttgctcggtgagatcgatgttgcgtttcttgcggtttacgctttcggaatgtatttcgctggacatttgggggataggatgaatcttaggatcttcttgactgttggaatgataggaactggattgtttacttctctgtttggagttggttattggggtaacattcatagcttttactatttcttgataatgcaaatgttagctggtttgtttcaatcttcgggttggccatcggttgttgctgttgttggaaactggtttaacaagaagaagagaggtttgatcatggggatatggaatgctcatacttctgttgggaacattactggctcgttgatcgctgctgctatgttgagatatggttggggatggtcttttgttgttcctggtgttatcattgtggtgattggtttggtgaattacgctttcttgcctgttagtccagagaatgttggagcagagcgagacgaggttcttgattcttcgtctgagaaaatcggaaactctgttaatgagccgttactattgagctcgtcggattcggaaaccgatgacaagaaacgagctgttggattcattgaagcgtggaggattcccggagttgcgcctttcgcgctctgtctcttctttgctaagttggtcgcttacactttcctctactggctcccattttacgttagccatacagcgattgaaggcgaatatttatcggacgaaacagcgggaaatctttcgacaatgttcgatgtaggaggtgtggttggtggaatcatggctggttacatttcagaccgaattggtgcaagagctattacggctgcgagtttcatgtactgctcaattccagctttgttcttctaccgtagctacggacatgtatcgttattagccaacgcgtctctcatgttcttgaccgggatgttggttaacggtccttacgctttgattacaacggcagtttcagctgatcttggaacacacagctcgttgaaaggaaactcgagagctttggctacggtaacggctattatcgatggaacgggatccgttggagcggcggtcggacccttactaacgggttacatatcgtcgaggggtagctggaccgcggttttcacaatgttgatgggagctgcgtttgtggctggactattgttgacgaggctggtaatggccgaagtagcggagaagatagctgagtctaggccatcggaagaatgtagatctccggtggactatgtccaagatcatgtgatggaagtgtga

SEQ ID NO: 255 - DNA, 1578 bp, Arabidopsis thaliana
atggcggttcctcatccttcttcttcctcctctagatctcatcctttcctctcccatgtctatcacactagcttccatcatcatcatcatcataatcatccatcgcttgtgctcttctggtgcctcgtgttttctctattatctcctctcgctctctcatcatcatcttcgtcttcttcttcttcctcagactcgtcgtcatcatcgtcctcccatatctctttaggaatcggtgaaacagaagggacgaagcatgatctgcatcaggcgatcctaagggacgaagctgtagcaagattacacgagcttggacaggtgagtgatgcagctacccacttagagaggacttttatgagtccagcatccataagagcaatacctcttatccgtggatggatggaagatgccggtttatcaacatgggttgattacatgggaaatgtacatggtcgagtggaacctaagaatggaagttcacaggctcttctaattggttcccatatggacactgtgattgatgctggtaaatatgatggctcattaggcatcatttctgcaatctctgcattgaaggttctgaaaatagatgggagattgggagaactaaagcggcctgttgaggtgattgcgtttagtgatgaggaaggagtgaggtttcagtctactttcctaggcagtgctgctttggctggaatcatgccagtttctcggttggaggttactgataaaagtggtatttctgtgcaagatgctcttaaagagaactctatagacataacagatgaaaacttgatgcagttgaagtatgatcctgcatctgtttggggatatgtagaggttcacattgagcaagggccggtgcttgaatgggttggttatcctttaggtgtagtaaaaggaattgcaggacagacaagactcaaggttactgtaaaaggatctcaaggacatgctggtacagttccaatgtcaatgcgtcaggaccctatgactggtgctgcggagctgattgtactattggaaagtgtttgcaaaaaccctaaagattacttatcttgcaacgttcaatgcaacgaggatacagtagaatcccttgctaattcacttgtttgtactgttggagagatctcaacatggccaagtgctagcaatgtcatcccaggccaggtaactttcactgtggatttacgtacgatagatgatgtaggacgcaaggctattctccatgacttatcaactaggatgtaccagatatgtgacaaaagatcgcttttgtgctccattgaacgaaagcacgatgcagacgcagtaatgtcagacccgcaattgagtttacagctgaaatcagcagctcagagtgcacttaagaagatgacaggagaggttcaagacgaggtccccgtgctaatgagtggagcaggacatgatgcaatggctatggcacacttaaccaaggtgggaatgttgtttgtccggtgtcgtggaggaataagtcattctccggcagaacatgtattggatgacgatgttggtgcagccggtttggccatcttggagtttctagagtctcaaatgtaa

SEQ ID NO: 256 - DNA, 1248 bp, Arabidopsis thaliana
atggaggtatttagacttggagagctgagacacctactggtgacggttttcttgtcggggctcgccgaatacttgataaggccagtgatgactgacgtcaccgtagccgcggtttgctccggcctagacgattcatgttctttggccgtctatctcaccggagtacaacaagtgacggtaggaatggggacaatggtaatgatgccagtgatcggcaatctatcggacagatatggaatcaaagcaatgctcactcttcccatgtgcctctctgttcttcctccagcaatattagggtacagaagggataccaatttcttttacgcattttatgtaatcaagaccctattcgatatggcaaaaaatgttcatggcacaaaaagaatatcaatgttcggaattttagcaggtgtcagctcgatttccggagtttgtgcatcactatcagctcgttttttatccatagcttcgacttttcaggttgcagctatatcattattcattggcctggtgtatatgagggttttcctaaaagagaggttacaagatgctgatgatgatgatgaagctgatagtggtggttgtagaagtcatcaagaggttcataatggtggtgatctaaagatgttaactgagccgatactaagagatgcaccaacaaagacacatgtcttcaacagtaagtattcgtcttggaaagatatgtattttctgaaagctcgttttgggttcaacaaaaatgactttgctgagctattcttgttggttaccatcattggctccatctcccagctatttatattgccgactttaagttctaccattggagaacgtaaggtgttatcaacggggcttcttatggaattcttcaacgcgacttgtcttagtgttgcatggtcaccatgggttccttatgccatgaccatgcttgtacccggagccatgtttgtgatgccatctgtttgtggtattgcgtcaagacaagttggatccagtgaacaggggaaggtccaaggatgtatatccggggtaagggcttttgctcaagttgtggctccatttgtatatagtccattgacagctctatttctctccgaaaatgcaccattctatttccctggattcagcattctatgcatcgccatctctttgatgatcggattccttcagagtcttctgataaaagatcatccttctttgcccttagtgaacataacaatcaacaacccttcaaaagcggaagcttga

SEQ ID NO: 257 - DNA, 531 bp, Arabidopsis thaliana
atggcttcttcttcacttcacgttgctatcttctctttaatcttcttattctcactcgccgctgcaaatgaagtcaccgtcggtggaaaatccggcgactggaagatccctccttcctcttcttactcattcactgagtgggctcaaaaagctcgcttcaaagtcggcgactttattgttttccggtatgaatctggtaaagactctgttttggaagtaacaaaagaagcttacaacagctgcaacaccacgaaccctttggctaactacactgatggagaaaccaaggtgaaattggacaggtctggtcctttctacttcattagtggagctaatggtcactgtgagaaaggtcagaagctgagccttgttgtgatcagtcctcgtcacagtgtcatctctccagctccttctccggttgaattcgaagatggtccagctttggctccagctcccattagcggctcagttaggcttggtggttgttatgttgtgttaggtcttgttcttggtctatgtgcttggttctga

SEQ ID NO: 258 - DNA, 609 bp, Arabidopsis thaliana
atggcaaaacaaatattctacactctctttctattcctcttatccacggctattctcacggcgtcgtcctccgcccccagagccgcaataacttcaaaacgtgctataaacttcatacaagcctcttgcaaagccacaacatacccaaccgtatgcgtcaactctctcaccggttacgccaactccatccaaacaagccctcgacgtctagccgagaccgcactcaatgtgaccgtgactcaggcccagtccaccaaggtcttcgtctggcgcttggggcgtttcactagtctcaagaaacgagagattcaagccgttaaggactgcatcgaggagatccatgatgccgttgaccgtttgaccatgtcgatccatgaagtgaagatgtgtggtagtgctaaaggtcgtgaccagttttggttccacatgagcaatgctcaaacgtggaccagcgctgctttgactaatgcaaacacttgctccgatgggtttgcgggtcgggtcatggatgggcgggtaaagaactcagtaagggcacggatcttgaatttgggaagaggaactagtaacgctttagccttgatcaatgctttcgctaaaaaatactaa

SEQ ID NO: 259 - DNA, 693 bp, Arabidopsis thaliana
atggcgaagatcaaacctcaagcattgttgcagcaaagcaagaagaagaaaggaccgtctcggataagcataaccaacatcgtcatttacactttggctgtgcttttgcttgtctttgttctcttctctgcttacagacgttggactcacagatctgagatcccaacgcacaatggtagatcagttcttgaggatgcagccttccctggaatgaagaatgttgatcttccgcggtttgctaccttagatacgggcaaaggttcagtgaccattgaactcttcaaggatactgctcccaatgtggttgaccagttcatgaaattctgtcaagatgggtatttcaaaggtttcttattcagtcgagttgtaaagcattttgtgattcaagccggtgactctgcggagttcgatgctgtcaaagattgggcactcgacagaaagaacattgataccagtttgaaacatgaagaattcatggtgggaactcctaaagctaaaaacgagcaaggaggattcgagttcttcattgtgtctgctcagatcaaagatctgaacgagaaattgactgtctttggtcgagtttctaaaggacaagacgttgttcaggagatcgaagaggttgagacagatgatcagtatcaaccaaagtcgccaatagagatcatgtccgtcactttgcttcaagacatgtaa

SEQ ID NO: 260 - DNA, 1941 bp, Arabidopsis thaliana
atgttctttgcagagatgtctccagcaacaaagtcaaagtctaaggataaaaaaactggtaaagaagctcaaaaggcatcaccaaagccttcactttcggttaatgggaatagcagcttggcagctagtggttataatcctcttttaggaacatttcaagctcttgattcagtgtcgatagcttctatctcaccattacagtatagtcgtttccggagtatagatgaggcagatgtaaatgggattgagtctgattcagtttcgaataatggtagctgttctggtgagtcagaagatcacaaggagaaaacaactaatctgccccttaagcaggaggtgataccaggtgcagataatgacaagcgagaaaaagttcgtcaaaagaatgagagaaaacatcaacgccagaaggagaggagggctcaggagttgaatgagaagtgtagcacatatcttatttccagaaagcttgaagcccgtacacagcaaattgtggcaatgggaatatctcaagagcatgcgacaacggcattaatgatgaatgatggtaaagtagaggaatctgttcattggttgtttgataggcttgaggaagaaatagagaagcaaagcattcagagtcctgggaatttgaaaatagacataacagaagagctagctaggattacaaaaatggagttgcaacttaagtgtacaaggcaggaaatagagcgtgcggttgttcaagcagagggtgatttggacagagcagaagaagtcttgaaaggcacaaagtatgaagagttttctgtgccagtgaaacaagaggaatgtggtgatcctcttacacccagtaatggaaaacttatagtaggaataggttatcagaattcggatgtagaaaggtcagaaattccgtcacctggcttacatccaacaagagatgacaagaactttaactatacaaaatcaccctccacaactgaatccgtgaacaaaatgttggctcagcctatgaaacgacccgaactgaagttagattggccaaaacctcagcaatctgctgctttggctgataaaaggtggccaccaaccacaggacaggttccttcggcttcttactctttgccatcatcgccatcaccgtcacctcagcctgctgtgagggtcgaagctcgctatttagctagtggaaatgaatttaagaacttccagcagcagcagcagcagcctgcaaatagagaatcagtcatggtgatgaggcagcggccacaggttgtaatcacaaatcccgttccaacctcaagcatgagtgcaccccctaccagttggcatcctgcagcgagcatagagataatgaagtcaaatgggttcatgcaaacacataatatccctagtgcgcgaagcccaagtccaaaccatctgaatccaaatcaggtctaccagcaacttcagtatcaaaaccagaagcgattcactaacaacaaccaagtggatccacatggtagtatggccagagggaatggcgggcaatggactagaaatacagcatcatctccacccatatctgctgcgtcttcgctgggattattctctgcggttggttcagctggaacatcgggtgcatcttcacctatagattggatctctggcggttcagtggactacacaaacatagactggagtctagatcaaagtttatcacaaaatagtagagtcaatggaaactggtccgggttaaagagcagcagccaaatatatgatgagaacatgaaccggtacagtctaaatggttccatgggaggtagactcaacaacagcaacggtgtatctatggagaattcaggtgctggtgttatcgtggaaacacaacaagcagctacctctccagattggacttcaccatttgaaggaaaagatatctttagcttgtctagacaatatgtgtctccttctctgtaa

SEQ ID NO: 261 - DNA, 717 bp, Arabidopsis thaliana
atgggaagatcagctctgattcacttgcttcgctcccaatcccgacgtctctcttcctccaccttcacttcaggatatcatcaccggtcaatagcaggatcatggtcatcatcagtgaacccgaaggtcagattccaggttccatcccttagccagagaagctgggcatcatttggagcaaagactagagaggacgatgatgagcacaagatcagcatcggaccccaagagaagaaagaagagaaggatggaggtgtggtttactatggaccaatctcatcaaccataaagaaagtgaaactcctctcactctccacttgctgtctatcagtctctcttggcccggtcatcactttcatgacttccccgggactgaatgtgatcatgaaaggtgctgttgcctctactgtgatcttccttagcgcatccacaaccgctgctctccactggtttgttagtccctacgtgcacaagctgaggtggcagcctggttcagacacttttgaggtcgagatgatgacttggctcggcacatttagcgcaaagacactgaaattctcagacatacgttatccagacacgcaaagaccgtatgtgagcttcaaggctgatgggaatttctactttgtggatgcagatcattgccctaacaaggcattgttggctaggctcactcctccaaaggatgctcatgactctgctttcaagaacttgtaa

SEQ ID NO: 262 - DNA, 846 bp, Arabidopsis thaliana
atggcgacacaaaatgcgattctgaaaaaagctctcatcattttcctctttactctaaccatcatgacaggaaccgcgttttcacaaaactgtggtacaaacgggtgtaaaggcaacatgtgctgcagcaggtggggatattgtggtaccacaaaagcctactgtggcactgggtgccagagtggaccttgcaactctaaacctaaacctactccgactccaagcggtagtggcggtctaaatgctggtcctcgtggtaccatagcaagcgttatcacaccagcgttcttcaacagcatcatgagtaaagtcggaagcggttgcccagcgaaagggttttacactcgccaggctttcatcgcagccgctgaatcgttcgcagcctacaaaggaactgttgctaagcgtgagattgccgccatgttggctcagttctctcacgaatctggaagtttttgttacaaagaagaaatagccagaggaaggtactgctcaccaagcacaacatatccttgtcaacccggaaagaactactatggtcgcggtccgatccaaatcacatggaactacaactatggtgcagccggaaagttccttggacttcctctcttgaaggacccagatatggtggctcgtagcccaactgtggctttccagtgtgccatgtggttttggaacaagaatgtgcgtccggttttgagccaagggtttggtgcaaccacgaggaggatcaacggtggtgaatgtaatggtgggcgtccagctgcagtgcagagcagggttaaccattacttggacttctgcaagaagcttggggtcactcctggaaccaatctctcatgttga

SEQ ID NO: 263 - DNA, 3861 bp, Arabidopsis thaliana
atggataatgacggtggtgctcctcctcctccgccgacactagtggtggaagagcctaagaaagcagagattcgtggagttgcttttaaagagctattcagattcgccgacggattagattatgtattgatgggaattggctctgttggtgcttttgtccatggctgctctttacctctgtttcttcgattcttcgccgatcttgttaattcctttggttctaattctaataacgttgaaaagatgatggaagaagttctcaagtatgcgctttactttttagtggttggtgctgcaatctgggcttcctcttgggcagagatttcgtgttggatgtggagtggagagagacaaacaacgaagatgaggattaagtatttagaagcagctttgaatcaagacattcagttctttgatacagaagttcgaacttcagatgttgtcttcgccattaacaccgacgctgttatggttcaagacgccattagtgagaaacttggtaatttcatccattacatggcgacttttgtttctggattcatcgtgggtttcactgcggtgtggcaactagctttagtgactctcgcggtggttccgttgattgctgtgatcggaggaattcacaccactactctctctaaactatctaataagagtcaagagtctctttcacaagctggtaatatcgtcgaacagacagtggtacaaatcagggtagtgatggctttcgttggagaatcaagagcttcacaagcttattcatcagctttgaagattgctcagaagcttggttacaaaacaggtttagctaaaggaatgggacttggtgctacatacttcgttgtcttttgttgttacgctctcttgctttggtacggtggttatctagttcgccaccatttgaccaacggtggtctcgctattgccacaatgttcgccgttatgattggtggattggcattgggacaatcagcaccgagcatggctgcatttgccaaagcaaaggttgctgctgcaaagatctttagaatcattgatcacaaaccaacgatagagcgtaacagcgagtccggtgtggagttagactcagtcacgggtcttgtcgagcttaaaaatgtggacttttcgtatccgtcaaggccagatgttaagattcttaacaacttctgcctctctgttcctgctgggaagaccattgctttggttgggagcagtggttcaggaaaaagcacagtcgtttcgcttatagagcggttttacgacccgaactcaggacaagttttactagatgggcaagacctgaagacgctgaaactgagatggttaaggcaacagatagggctagtgagtcaagaacctgcattattcgccacttctatcaaggagaatatactcttaggccgtcctgacgcagatcaagtcgagatagaggaggctgctcgagtcgcaaatgctcattcctttatcatcaaactacctgatggcttcgacacacaggttggggagagaggattgcagctgtctggtgggcagaagcaaagaatagcgatagcaagagcgatgttgaagaacccggcgatacttctattagatgaggcgacgagtgcattggattctgaatcagagaagcttgtacaagaggctttggatcgtttcatgattggaaggactactctcatcattgctcatcgcctttctaccattcgaaaagctgaccttgttgctgtgctacagcaaggaagtgtctctgagattggaacgcatgatgagcttttttccaagggagaaaatggagtctatgctaagctaattaaaatgcaagaagcagctcacgaaaccgccatgagcaatgcaagaaagagtagcgcaagaccgtcgagtgctagaaactcggttagctcgccaataatgactcggaattcgtcgtatggaagatcaccttattcacggagactatccgatttctcaacttctgattttagcctctccattgacgcttcgtcctacccaaactatagaaacgagaagctggccttcaaggatcaagccaattcattctggcgactagctaaaatgaactctccagagtggaaatacgctttgctcggttcagtaggctctgtcatttgtggctcccttagtgcattcttcgcatatgtcctcagtgcagtcttaagcgtctactacaacccggaccacgaatacatgatcaaacagattgataagtactgttatctcttaatcggtctctcttccgcagcacttgtcttcaacacgctccagcattctttctgggacattgtgggtgagaatctgaccaagagagtccgtgagaagatgctgagcgctgtactcaagaatgagatggcttggtttgatcaagaggagaacgaaagtgcaagaatcgcagcaagattagctcttgatgctaataatgtgagatctgcgataggagatagaatatcggttattgtgcagaacacagcactgatgcttgttgcttgcactgccgggtttgttctacaatggagactcgcacttgtccttgtcgcagtcttccccgtagttgttgctgcaactgtcttacagaaaatgttcatgactggtttctcgggagacctggaagcggcacatgccaagggaacgcagcttgctggtgaagccatagctaatgtcaggacagttgctgcatttaactcggaggcaaagattgtccgtctctacactgcaaacctcgaaccaccattgaaacgatgcttctggaaaggacagatcgctggaagtggttatggtgtagctcagttctgtctttatgcatcttatgctctcgggctatggtacgcatcatggcttgtgaaacacggcatctctgacttctccaaaaccataagagtcttcatggttctgatggtctcagccaatggtgcagcagagacactcacactggctcctgatttcatcaaaggtggtcaagctatgcggtctgttttcgaacttcttgaccggaaaaccgagattgaacctgatgatcctgataccaccccggtcccagaccggttacgtggtgaagtcgagctcaaacatatcgatttctcttacccttcaaggccagacatccagattttccgtgaccttagccttcgtgctagagctggcaaaaccctagctcttgtgggtccaagcgggtgcggaaaaagctcagttatctccctcatccagagattctacgaaccttcctcaggccgagtcatgatcgacgggaaagacataaggaaatacaacctgaaagccataaggaaacacatagccatagtccctcaagagccgtgcttgttcggaactaccatttacgaaaacattgcatatggacatgaatgtgcgaccgaagcagagatcatacaagccgcgactctagccagtgcgcacaaattcatatccgcgctaccagaaggttacaaaacgtatgttggcgagagaggcgttcagctctcgggaggacagaaacagaggatcgcgatcgcacgtgccctcgtgaggaaagcagagatcatgctgcttgacgaggctacaagcgctcttgatgcagagtccgagagatcagtccaagaagcattagaccaggcttgctctggtagaacatcaatagtcgtggctcataggctatctacaatcaggaacgcacacgtgatcgctgtcatcgatgatggaaaagtggctgaacaaggatcgcattcgcatcttctcaagaaccatcctgatggaatctacgcgcgaatgatacagttgcaaagatttacgcatacacaagtgattggtatgacgtcaggttcaagttctagggttaaggaagatgatgcttag

SEQ ID NO: 264 - DNA, 1194 bp, Arabidopsis thaliana
atgcagacatttagccagttatgtcattttaatttgaagaaaaaggtcatagagattctaatgactccatggaatatcatagaccagcctagattctcttaccgtggccttttaatcgatacatcccgacattatttgccacttccggttataaagaacgtgattgattccatgacatatgccaaacttaatgtgttacattggcacattgtggatacacaatcatttcctttagagataccttcttacccaaagctatggaacggcgcttactcttcctctcagcgatacaccttcgaagacgctgctgaaatcgtcaagattgatgttaaccacttatgtatgtgtatatatagttatgctcggcgacgagggatccatgtcttggctgagattgatgttccaggacatgctctctcatggggaaagggatatcctgccttgtggccctccaagaattgtcaagaaccacttgacgtgagcagtgacttcacattcaaagtcattgatggcattctctctgatttcagcaagatctttaagtttaaatttgtccacttgggtggtgatgaagtaaatacaacttgttggtctgcaacaccgcgaatagcccaatggcttaaaaaacatcggatgagtgaaaaagaagcctatcaatatttcgtgttgcgggcgcaaaaaatcgccttgtctcacggatatgaaattatcaactgggaagagaccttcatcaattttggaagcaaattaaaccggaaaaccgtggttcacaactggcttaacacaggacttgttgagaatgtgactgcgtccggtttaaggtgtatagttagtaaccaagaattttggtatttggatcatatagacgcaccttggcaaggcttttacgcaaacgagccatttcaaaacataacggataaaaagcaacaaagtctagtacttggtggcgaggtttgcatgtggggtgaacatattgatgcttctgacattgaacaaaccatttggcctcgcgctgccgcagctgcagagcggttgtggacaccctatgcaaaattggctaaaaatcccaacaatgtaacgacgaggttggctcacttcagatgtctattgaatcaaagaggagttgcagctgcacctttggttggtggcggacgagttgtgccttttgaaccaggttcttgtctcgctcagtga

SEQ ID NO: 265 - DNA, 885 bp, Arabidopsis thaliana
atggcgtcgtcgtcaagactttgcgattcgtgcaaatcgacggcagcaactctattctgccgcgcagacgccgcgtttctctgcggcgactgcgacggtaagatccacacagctaacaaactcgcatcacgtcacgaacgagtttggctatgtgaagtatgcgaacaagcaccagcacacgtcacgtgcaaagctgacgccgctgcgttatgcgtcacgtgcgaccgtgatatccactcagctaatccactctctcgccgccacgagcgcgtaccaatcactcctttctacgacgctgtaggtccagcaaaatccgcttcctcctccgtcaatttcgtagatgaagatggcggtgacgtcactgcttcgtggcttttagctaaagaaggaatcgaaatcactaatttgttctccgatcttgattatccgaagattgaggtaacgtcggaggagaatagctccggtaacgacggagttgttcctgtgcagaataagttgtttcttaacgaagattacttcaatttcgatctctctgcttccaaaatttctcaacaaggattcaatttcatcaaccaaactgtttcgacgagaacgatagatgtaccgttggtgcctgaaagtggaggagtgacggcggagatgacgaacacggagacgccagctgtgcagttatcaccggcggagagggaagcaagggttttgaggtatagagagaagaggaagaatcggaaatttgagaagacgattaggtatgcgtcgcgtaaagcttacgctgagatgaggccgagaatcaaaggacgttttgctaagagaacagattcgagagagaatgatggtggagacgtcggagtttatggcggattcggtgttgttccgagtttctga

SEQ ID NO: 266 - DNA, 1248 bp, Arabidopsis thaliana
atggcgacaagggttagtttcttcttagctctggtaatgacggtggtgattcttgctccttctgtcgtctctggagaaaatgggttttccgatcttaaaatccgtactcacttgaaacgactcaacaagccagctctcaaatcgattaagagcccagatggagatatgattgactgtgttccaatcactgaccaaccagcttttgctcatcctctgctcattaatcacactgtccagatgtggccaagtttgaacccagaaagtgtatttagtgagagtaaagtttcatcaaaaaccaagaatcagcagtctaatgctatacatcagctttggcatgtgaatgggaaatgtccaaagaacacaattcccatcagaagaacgagaagacaagatctttacagagcgagttccgttgagaattacggtatgaagaatcagaagagtatccctaaacctaaatcttctgagccacctaatgtccttacacaaaatggtcatcagcacgcgataatgtatgtcgaagatggggttttctacggggctaaagcgaagataaatgtatggaagccggatgttgaaatgcctaatgagtttagcttagctcagatttgggttttaggtggaaatttcaactctgatcttaatagtattgaagctggctggcaggtcagcccacaattgtatggtgataataggaccagactcttcacttattggactagtgatgcataccaaggcacaggctgctataatcttctatgctcaggatttgttcaaatcaatagagaaatcgcaatgggtggatcaatctctcctttatcaaactatggaaactctcaatatgacatcaccatactcatctggaaggatccaaaagaaggacattggtggttacagtttggagagaaatacataataggatactggccagcttcactcttctcttacttatcagaaagtgcatcgatgatcgaatggggaggcgaagtggttaactcgcagtccgaggaaggacaacacacaaccactcagatgggaagtgggaggtttgcagaggaaggttggggaaaagcgagttacttcaagaacgttcaagtagttgatggatcgaatgaactgagaaacccggagaatcttcaagtgtttactgatcaagagaactgttacaatgtgaaaagtgggaatggaggttcttggggaagttacttctactatggtggtcctggtcgaaaccctaattgcccttaa

SEQ ID NO: 267 - DNA, 1272 bp, Arabidopsis thaliana
atggaacaccaaggttggagttttgaggagaattatagtttgtccactaatagaagatctatcaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagattcgaaccaacgatcaggatcaaaccgaaggagtcgagcagctgaagttcataatctctccgaaaggaggaggagagataggatcaatgagagaatgaaggctttgcaagaactaatacctcactgcagtaaaactgataaagcttcgattttagacgaagccatagattatttgaaatcacttcagttacagcttcaagtgatgtggatggggagtggaatggcggcggcggcggcttcggctccgatgatgttccccggagttcaacctcagcagttcatacgtcagatacagagcccggtacagttacctcgatttccggttatggatcagtctgcaattcagaacaatcccggtttagtttgccaaaacccggtacaaaaccagatcatctccgaccggtttgctagatacatcggtgggttcccacacatgcaggccgcgactcagccgatggagatgttgagatttagttcaccggcgggacagcaaagtcaacaaccgtcgtctgtgccgacgaagaccaccgacggttctcgtttggaccactag

SEQ ID NO: 268 - DNA, 1347 bp, Arabidopsis thaliana
atgaacattcccttggctggtgtctctcttccaccaccactctctgaccatgttgagcctagcaaacttaagaccactactcttccaaatggtctgactatagccactgagatgtctccgaatccagcagcttccattggtttatacgttgactgtggttctatttatgagactcctcaattccgtggagcgacgcacttgcttgaaaggatggcattcaagagtacattgaacagaagccattttcgccttgtaagggaaatagaggctattggaggtaatacttcagcttctgcatcccgagagcagatgggttacacaattgatgctctcaaaacctatgttcccgaaatggttgaagtgcttattgatagtgtgaggaaccctgcttttttggattgggaagtgaatgaagagctccgaaaggtgaaagtagagataggagaattcgcaacgaatccaatgggttttcttttggaggcagttcattctgctggttactctggcgcattggcaaatccattgtatgcacctgaatctgcaattactggattgactggggaggtcttggagaattttgtttttgagaattacactgcttcacgaatggtcctagcagctagtggagttgatcatgaagaacttctaaaagtggttgagccattactatctgacctccctaatgtaccccgacctgcggagccaaagtctcaatatgtcggtggagatttccgtcaacatacgggtggagaggctacacattttgcgcttgcttttgaagtgccaggatggaataacgagaaggaagctatcattgcaactgttcttcagatgcttatgggaggaggtggctcattttctgcgggaggccctggaaaaggaatgcactcttggctctatcttcgccttttgaaccaacatcagcagtttcaatcatgcactgcattcactagcgtctttaacaataccggattgtttggaatctatggttgcacgagtcctgaatttgcttcacagggaattgaattagtagctagtgaaatgaacgctgttgctgatggaaaagttaatcagaaacatcttgatcgcgccaaagcagcaacaaaatctgcgattctgatgaatctggaatctcggatgattgcagcagaagacattggtagacagattcttacttacggagagaggaaaccagtagaccaattcttgaagacagtagaccaacttaccttaaaggacattgcagatttcactagcaaggttatcacaaagcctttgacaatggcaactttcggagacgtgttgaatgttccaagctatgactccgtaagcaaaagatttcgctga

SEQ ID NO: 269 - DNA, 3090 bp, Arabidopsis thaliana
atggtgtttctctcgattccaaacgggaagactttatcgatcgacgtgaaccctaattcaaccaccatctccgccttcgaacaattggcccaccaacgtagtgatgttccacaatctttccttcgttactctctccgtatgcgaaaccctagccgcgtgtttgtagattcaaaggattccgattcgatcttattgtccgatctcggtgtttctcgtttctctactgtgattatccatgtcctgcttttgggtggtatgcaagcggctccgccgaagcctcgtcttgatttcctcaattctaagcctccgtcaaattatgtagcgggtttgggtcgtggtgctactgggtttactactcgatctgatattggtcctgctcgtgctgctccggatcttcctgatcggtctgctttggctacagcggctgctccaggagtaggtcgtggagcagggaagccaagtgaagcggaagcggaggacgatgaagaagctgaggagaaaaggtacgatgagaatcagacgtttgatgagtttgaagggaatgatgttggtttgttcgctaatgctgagtacgatgaggatgataaagaggctgatgccatctgggagtctattgatcagaggatggattcgaggaggaaagatcggagagaagcgaagctgaaggaagaaatcgagaaataccgagcctcgaaccctaagattactgagcagtttgcggatttgaagaggaaattacacactttgtctgcggatgagtgggatagtattcctgagattggggattactcgctgaggaacaagaagaagaagtttgagagctttgtgcctattcctgatacgcttttggagaaggcgaagaaagaaaaggagcttgtcatggccttagacccaaagagcagagccgctggtgggtcggagacaccatgggggcagacgccggtgacagacttgactgctgtcggtgagggaagaggtacggtgttgtctctgaagcttgataacctatcagattcagtttcggggcaaactgtagtggatcctaaaggctacttaactgacctgaagagtatgaaaagaaccactgatgaagagatatacgatcgcaatagagctagattgttatacaagagtctgacccagtcgaatccaaagaatccaaatggctggattgctgctgctagagtggaggaggtggatgggaagattaaagcagctaggtttcagattcagaggggctgcgaagagtgcccgaaaaatgaggatgtttggcttgaagcttgtaggttagctaatccagaagatgccaagggggttattgcgaagggagttaagctgatacccaattcagtgaagctatggttggaggctgcaaagctggagcatgatgtggagaacaagagtagggtgttgagaaagggactggaacatattccagactctgtaagactatggaaggctgttgttgagttggctaatgaggaggatgcaaggattttgcttcacagggctgtggagtgctgccctttgcatctggagctatgggtggcacttgcgaggctcgaaacatatgctgaatcaaagaaggtgttgaacaaagcgagagagaagctcccaaaggagcctgcaatttggatcaccgctgctaagttagaagaagctaatgggaagctagatgaagctaatgataacacggctatggtgggaaagattattgataggggtataaagactctccagagagaaggggttgttattgaccgagaaaattggatgagtgaggctgaggcatgtgagagagttggatctgtcgctacatgccaggccattattaagaacacaataggtattggagtggaagaagaggatagaaagagaacttgggttgctgatgcagatgagtgcaagaagaggggttccattgagaccgcaagagcaatatacgcccatgctcttagtgtattcttgaccaagaaaagtatctggcttaaagcggcgcagcttgagaagagccatgggagtcgggagtcccttgatgccttgttgcgtaaggctgtaacatatgtcccgcaagctgaggttctctggctcatgggtgccaaagagaagtggctcgctggagatgttccagcagcccgtgctattctacaagaggcttatgctgcaattcccaactctgaggaaatctggcttgctgctttcaagcttgagtttgagaacaaggagccggagagggcaagaatgctgcttgcaaaagcaagggaaagaggagggactgaaagggtctggatgaaatcagccattgttgagagagaacttggcaacgtagaggaggagaggagattgcttaatgaaggtttgaagcaattcccaacattcttcaagctttggttaatgcttgggcagctcgaggaacggttcaagcatctagaacaggccaggaaagcttatgacactggtttgaagcactgtccccactgcataccactgtggctctcactcgctgatcttgaagagaaagtgaatgggctaaacaaagctcgggctattctcaccacggccaggaagaagaatcctgggggggctgagctatggttagctgctattcgcgctgaactgaggcatgacaacaagagagaagcagagcacttgatgtcaaaggctctgcaagactgtcccaagagtggtatcctctgggctgcggacattgagatggcgccacgtcctcgacggaaaacaaagagtattgatgctatgaagaagtgtgatcgcgaccctcatgtcaccatagctgttgccaagctcttttggcaagacaagaaggtggagaaagccagagcatggtttgaacgtgctgttaccgttggcccagatattggcgatttctgggcgttgttctacaaatttgaacttcaacatggctctgatgaggacaggaaggaagttgtggcgaagtgtgtagcttgtgagccgaagcatggcgagaaatggcaagccatctccaaagcggttgaaaatgctcaccagcctattgaagttatcttgaagagagttgtgaatgcgttgagcaaggaagagaattctgcttga

SEQ ID NO: 270 - DNA, 1887 bp, Arabidopsis thaliana
atgggaaacggaaactcaacggagacgaaagagtcgcgccgatcaaagatgcgtaagaagattcaaaactttcgcagccgccgccgtcttagtcgtccaggatccggaagcgtctctggattggctagtcagagatctgtgagcgcagatgatttcgccggcattgctcttctcactcttatcggcgcggagatgaagttcaaggacaagtggctcgcctgtgtttccttcggggaacaaactttccgttcggaaatttcagattccacagagaagccgatttggaactcgaccaatagactcttgaagaacaatatcgttggttattgtgagcttgatctacttgatttcgtagtacaggaacctgactctacttgcaagtcatttgacctgttagacccggcctcatctaacgttgttggcagcatgtttgtttcatgctccgttgaggatcctgttgaaaccgagacatgtttcgcgaagcgtattttgtccatagtggattatgacgaagatggaaaactctcattctcagagttctctgatctgatgaatgcttttgggaatgtagtggctgctaacaagaaagaggagttgttcaaagccgctgacctgaatggggatggtgttgttacaattgatgagttggctgcacttcttgccgttcaacaggaacaggagccaattataaatagttgtccggtttgcggtgaggctcttcaacttgacaagctcaatgcaatgatccatatgactctctgttttgacgaaggaactggtaatcaaatgaccggagggttcttgactgataggcaggcttcatatggatggatgttcaaactaagtgaatggactcatctatcaacttatgatgttggtttgaatactggttcaagtgcttcacatattgtggtgattgataggaagactaagaggctcgtggaagagttgattgattcaaagattgttatgtctatgagagctatttaccagtcaaaaataggactccggcttatggaccaaggagcaaaagagattttgcagaacctttctgagaaacaggggaaaaaaatgaactcagttgaatctgcccaaaatattcccagctttctcgagtttttcaaggatcaaataaacatggccgaagtcaagtatcctctggaccattttaaggtacgcaaaggcaactcatggtggtcattttacttgcagacgttcaatgaattcttcgtacgggagttaaagcctggtgcaagaccaattgcgtgcatggatcaggatgatgttgctgtatctgctgctgattgtcgattaatggcatttcaatcggttgatgatagcacacggttctggatcaagggccgtaagttttcaatcaaaggcctccttggaaatgatgtgcagtcggatgctttccttgatggatctttggtgatattccgattggcgccacaggactatcatcgttttcattctcctgtctctggtgtcattgaaaagtttgtcaatgtttctggaagcttatatacggttaatccgattgctgtcaatagcaagtactgtaatgtgttcactgagaataaacggaccatcgtaattatatcaacagcagagtttggaaaggtcgcatttgttgcgattggagcaacaatggttggtagtatcagctttgttaggcaagagggagaccatgtgaagaaaggggacgagcttggttacttttcatttggtggaagcacagttatatgcgtctttgaaaaggactcgattaagattgatgaggatctcttagctaacagtgctaggtccttggagacattagttactgttggaatgcaacttggtgtctcctttccaaagctggaaaactgtgtacttgagccctga

SEQ ID NO: 271 - DNA, 972 bp, Arabidopsis thaliana
atgttgcccacaacttccagatctcgttcttcatcttcttcatcccgagctaatccaatgttccttcagtactttcgtcgtatcgttaagtggcagcaaatggatgttgaatatactttctggcaaatgcttaacctttgtacatctccgaaagttgtctatcaacacactaagtatcacaaacaaactaagaaccaatgggcacgtgatgaccctgcgtttattgtgatctgtagcctgcttcttgttgttgcaactgtagcctattgtgtcacgtatgaccatagtagctctcatgccgtcgtcgtagtcgtttcagttttgttcacccatttcttaatcaccggagcagttatagctacatgctgttggtttttgacaaattcttaccttcgcgaggagactccaaacagtcatgtggtggaacaacgcgttgaatggctgtatacatttgatgttcactgcaactcgttctttccaatgtttgtgctgctctacgtcgtacattacttcttatcaccgctcctgatagcacacggattcatccctttactgctatcgaatctgcttttcatggtcggggcttcgtactaccattatcttaacttcctaggatatgacgtgcttccatttttggagcgaacaacattcttcctctacccaatcggagttgtcattgtcctgtctcctattcgtaagctcaatcagaatcattggtttcacagatatcttcttcctgaaaaggcttatcttaagcggattcaacccgtcaagatatttcatgaacatgtacttcagccaaaggttataaaaaaaacagccacatcagtggaatccttagggcttttgcactgcacatacatcattaaagtaaggaacaagaagattgagagagtaatgattttcccttttttacccgtaacagatcatcgtaatgctcagtttctggtacaacttcaaaaggctacttaa

SEQ ID NO: 272 - DNA, 1311 bp, Arabidopsis thaliana
atggatgatctctccaagcttctcttcttcctcctcctcactatctccattaccaccgcattacccgataaacccgggtcgggtcaaataaactcaaactccgtcctcgttgctcttcttgactcacactacacagaactagcagagctcgtcgaaaaagctcttcttctccaaaccttagaagaagctgttggtcaacacaacatcacaatctttgctcctcgtaacgatgccttagaaaaaaatcttgatcctgaattcaaatctttcttactccaaccgaaaaacctcaaatcattacaatctttattaatgtttcacattcttcccaaaagaatcacttctccacaattctcctccgccgtcgttagccaccgtactctctccaacgaccacctccatttcaccaacggaaaagtcaactccgctgaaataaccaaacccgatgatttaactcgtcccgatggaatcatccacggaatcgaacgtcttttaatcccacgttctgttcaagaagatttcaaccgccgtcgtagtctccgttcaatcgctgccgtattaccggaaggagcaccggaggttgatccaagaactcaccgtctcaagaaaaagccagcaccaattcccgccggagctccaccggttcttccggtttacgacgcaatgtcacctggtccgtcactagctccggctccggcaccaggaccgggtgggccacgccaccatttcaacggagaggctcaagttaaagattttatccacacgcttcttcattacggtggctacaatgaaatggcagatattctcgttaatctcacttctttagccaccgagatgggtcggctcgtgtcggaaggttacgttttaaccgttttagcaccaaacgacgaagctatggctaaattgaccacggaccaattgagcgaaccgggagctccagagcaaattatgtattatcacatcataccggaataccaaaccgaagagagtatgtacaattctgtacgccggtttgggaaaatccggtacgattcactccggtttcctcataaagtagaggctcaggaggcagatggttcggttaagttcggtcatggtgatggttcggcttatttgttcgatcctgatatttataccgatggacggatttcggttcaagggattgacggtgttttgttcccggaggaaaaaactccggtcgagaagaaaaccggcgttccagttgtcaagaaagcacctaaaccaagaagaggtaaattgatggaagtagcatgtacaatgctgggatcacaatttccaacatgtcaatga

SEQ ID NO: 273 - DNA, 681 bp, Arabidopsis thaliana
atgcaaatggattccgcacagaatcagttcaacaaacgtgctcgattgtttgaagatcctgaactcaaagatgctaaggtcatttatccatcgaaccctgaatctactgaaccagtgaataaaggttatggcggttctacagccatccaaagctttttcaaagaatctaaagctgaagaaacgcccaaggtacttaagaagagaggaaggaagaagaagaatcctaatcccgaggaagtaaactcttcaactcccggtggagatgactcagagaaccgctcaaagttctacgagagtgcttctgctagaaagagaactgtaactgcagaggaaagagagagagccgtcaatgcagccaaaacattcgaaccaacaaatccttactttagagttgttctgcgaccatcatatctatacagaggttgcatcatgtacttgccatctgggtttgctgagaaatacctaagtgggatatctggtttcatcaagctccagctcggtgagaaacaatggccagtgaggtgcctctacaaagcagggagagctaagtttagccaaggatggtatgagttcacactcgagaacaatataggcgaaggagatgtatgtgtgtttgagctactcagaactcgggatttcgttctcgaagtcaccgcctttcgtgtcaatgagtatgtgtga

SEQ ID NO: 274 - DNA, 1407 bp, Arabidopsis thaliana
atggatcgtgtggttggtggtaagttcaagctcggacgaaagcttggaagtggctcatttggtgaaattttcctaggagtgaatgtacaaactggagaagaagtggctgttaagcttgaacctctccgagctaggcatcctcagcttcattacgagtcaaagctttatatgcttctccaaggaggaactggtattcctcacctcaaatggtttggtgttgagggtgaattcaactgtatggtgatcgaccttctcggtcctagtatggaagaatttttcaactattgcagtcgatccttctctcttaagacagttctaatgctcgcagatcaaatgataaatagagtggagtatatgcatgttaaaggcttccttcatcgtgatattaagccagataactttttgatgggtcttggacgcaaagcaaaccaggtgtacatcattgactatgggcttgccaagaagtatagagatcttcaaacacacaagcatattccatacagggaaaacaagaaccttactggaacagctcgatatgcaagtgttaacacccatcttggaattgagcaaagtagaagggatgatctggaatctctaggctatctgcttatgtattttcttcgaggaagccttccttggcaaggccttcgtgcaggtaccaaaaagcagaagtatgacaagatcagtgaaaagaaaagactaacaccagtggaggtcctctgtaaaaactttccacctgagttcacatcgtattttctctatgtgcgttcactacggtttgaagacaaaccagattattcatacctaaagaggcttttcagagacctatttatccgagaaggttatcagtttgactatgtatttgattggacaatattgaggtatccacagttcggctccagttccagctcgaattccaaaccaagaccaactttaagaccagctatgaatattccagtaccatctgccgacaaagcggaaaagcctccaattggacaggacagccgtgagaggttctcaggtgttttcgaggcatacaccagaagaaatggctcaggaaccggcgttcaagctgatcagtctagtagaccaagaacctcagagaatgttcttgcatccaaggacacgcaaaaccaggagagaccaaactctttatctaggaacctgagttcgtcaagaaaagcaattgctgggtcaagtgttcgagccacttcctcagctgatttcacagagaatcgattaagcagactcatcccaaacaatgatcggtcttctacaactctgaggacccagttcgctccttcgtcctcctcagtagccacaaaagctgcaccaacgagagccgctcgtgacattaccctccagagccttgagctcctcagtattgggaacagcaagaggaagtga

SEQ ID NO: 275 - DNA, 2085 bp, Arabidopsis thaliana
atgaagcctctcactaatggcgatctgttcaaatccccaactctgatcaagatctccgccttagttttcgtcaccgtcgctttcttctacttaggcaagcattggtccgacgatggctaccaacagctcgtcttcttctcctcttccacttccggtagctcgatcccggaggtctccgtttcaccgaatagtaacagagtctttaatttatcagcgataattcctactaaccatacccagattgaaatccccgccacaatacgacaacaacctccgtcggtggtggcggacacggagaaggttaaggtggaagctaatcctcctcctcctccacctccttctccttcacctcctcctccgcctggtccggttaagagctttgggatagttgatgcgaacggtgtgatgtctgacgattttgaggtgggtgaggttgagagtgatacagtggaagattgggggaatcagactgagatcgttgaggcgaaaagcgacggtgattctaaggctagggttagaattaagaaatttgggatgtgtcctgagagtatgagagagtatataccttgtttggataatactgatgtgataaagaagcttaaatcgacagagcgaggtgagagattcgagcgtcattgtcctgagaaaggtaaaggcttgaattgcttagttccacctcctaaaggttaccgtcagccgattccatggcctaaaagccgtgacgaggtatggtttagcaatgttcctcatactcggcttgttgaagacaaaggaggtcagaactggatttcacgagacaagaacaagttcaagtttcctggaggtggtacacagtttattcatggggctgatcagtacttggaccagatgtctaagatggtttctgatattacgtttggcaagcatattagggttgctatggatgttggttgtggtgtggcgagttttggtgcttatctattgtctcgtgatgtcatgacaatgtctgttgcaccaaaagatgtccatgagaaccaaattcaatttgctcttgagcgtggtgtgcctgctatggcggcagcatttgcgacaaggcgtttgttatatccaagccaagcttttgatcttattcattgttcaagatgtagaatcaactggactcgtgatgatggaattttgctccttgagatcaatagaatgctgcgcgctggaggatattttgcttgggctgcacagcctgtttataagcatgaacccgctttggaagaacaatggacagaaatgctgaatcttactattagcctctgctggaaattggtaaagaaggaaggatacgttgcaatctggcagaagcctttcaacaacgactgctatttgagtcgtgaggctgggactaaacctcctctttgtgatgaatcagatgatcccgataatgtttggtacacaaatctgaaaccttgcatcagtcgcatacctgagaaagggtacggaggaaacgtccccttatggcctgcccgtctgcatactccacctgataggctgcagacgataaaatttgattcctacattgctaggaaagagctattcaaggcagaatcaaaatattggaatgaaataattgggggctatgttcgcgccttaaaatggaaaaagatgaaactaagaaatgttttggacatgagagcaggctttggcggatttgcagctgcactaaatgatcataaactcgattgctgggttctaagcgtggttcctgtcagtgggcctaacacattgcctgtcatttatgaccgtggactgttaggagtgatgcacgattggtgtgaaccatttgatacatacccacggacatatgacttcttacatgcctctggactcttctcgatcgagagaaaaagatgtgagatgtcaaccatattgttagagatggaccggatattaagacccggtggaagagcatacattagggattcaattgatgttatggatgaaattcaagaaatcacaaaggccatgggttggcatacttctctgcgtgacacatccgagggtcctcacgcaagttacaggattctaacatgcgagaagcgtctccttcgagcttaa

SEQ ID NO: 276 - DNA, 465 bp, Arabidopsis thaliana
atgtctccggctaaagttgatactaccaagaaggctgatcctaaggccaaggccttgaaggcggcaaaggctgtgaagtctggtcaagccttcaagaagaaggacaaaaagattaggaccaaggtcaccttccacaggccaaagactcttaccaagcctagaactggtaagtacccaaaaatcagcgctactccaaggaacaagttggatcactaccaaatccttaagtacccactcaccactgaatctgcgatgaagaagattgaagacaacaacactcttgttttcattgttgacattcgtgctgacaagaagaagattaaggatgctgttaagaagatgtatgacatccagaccaagaaagtgaacacactcatcaggcctgatggaaccaagaaggcttacgtgaggcttacaccagactatgatgctttggatgttgctaacaagatcggcatcatctaa

SEQ ID NO: 277 - DNA, 942 bp, Arabidopsis thaliana
atgggtctaaagggttttgctgaaggaggaatagcttcgattgttgcgggttgttcgacccacccgcttgatctaatcaaggtccgaatgcaacttcaaggcgaatcagctccgattcaaaccaatctccgaccagctcttgcttttcagacttcgaccaccgtcaacgcgcctcctctacgtgttggtgtaatcggagtcggatctcgtttaataagagaagaaggcatgcgtgctctgttttccggcgtctccgccaccgttcttcgtcaaactctgtattcaacgactcgtatgggtttatacgacatcatcaaaggagaatggaccgacccggaaacaaaaacgatgcctttaatgaaaaaaatcggtgccggagccatcgccggagcaatcggagccgccgttgggaatcctgctgacgtggcgatggtgaggatgcaagccgatggtcgtttaccgttgactgatagaagaaactacaaaagcgttttagacgcgatcacgcaaatgattcgcggtgaaggcgttacgtcgttgtggagaggatcgtctttgacgataaacagagcaatgcttgtgacgtcatcgcagttggcttcgtatgattctgttaaagagacgattttggagaaagggttgttgaaagatgggcttgggactcatgtgtcggcgagtttcgcggcggggtttgttgcgagcgttgcgagtaatcctgttgatgtgattaagacgagagtgatgaatatgaaggtggtggctggagttgctccgccgtataaaggagcggttgattgtgctttgaaaacggtgaaagcggaagggattatgtctttgtataaaggttttatcccgacggtttcgagacaagcaccgttcacggtggttttgtttgttacgcttgaacaagttaagaagttgttcaaggactatgacttttga

SEQ ID NO: 278 - DNA, 1173 bp, Arabidopsis thaliana
atggcggctacagcagcttcaagcttacaaattgctacacgaaggccgagcatgtcttcgcctagcaaaattcttaaagcaggaacctacattgttggtgccaatcctggaaacgcttcatgggataaactttcatgcactcgccaattatcaaaccttggatgtttgagaaaccacagtgctgttccaacttgtaagagacccttttctttttccacaagggcaatgtctgaatccagtgaaaacaaggctccttcagggcttccaattgatttgagagggaaaagagctttcattgctggtatagctgatgataatggctatggttgggccatagcaaaatctcttgctgctgctggagctgaaatattggttgggacttgggttcctgcacttaatatatttgagacaagcttgagacgtggaaaattcgaccagtcacgagtgttgcctgacgggtcattgatggagattaagaaggtttatgctttggatgctgtgtttgacaatcctgaagatgtgcctgaagatgtgaaaacgaataagcgatatgcaggatcgtcaaactggaccgtacaggaagctgctgaatgtgtgaaaaaagattttggaagcattgacattcttgtccattcccttgcaaatggcccagaggttagcaaacctcttctggagacatcaaggaaaggctatctcgctgctatctctgcttcgagttactcctttgtttccttgctgaggcattttctgccaattatgaacccaggaggtgcttcaatatctcttacttacattgcctctgaaagaatcattcctgggtatggtggaggtatgagttctgccaaagctgcactagagagtgacacacgggtgcttgcatatgaagctggaaggaaatcaaacattagggtcaacaccatctctgcgggtcctttgggaagccgagcagcaaaagccattgggttcatagacaccatgattgagtattcctacaataatgggcctattcagaaaacactgaccgcagatgaagttgggaatgcagcagccttcttggcatctccattggcctctgccataaccggtgcaaccatatatgtggacaatggtttgaatgcaatgggcgttgcactggacagcccggtgttcaaagaccttaacagcaagaattag

SEQ ID NO: 279 - DNA, 2649 bp, Arabidopsis thaliana
atggctgcgtggtcaccatcagttgggataggatcttgttgtctcaataatggcatcactagaacatggaagtttccttctgcaaggctttttactggtaggaagaacaagattaaacttggatccgagacactaatgtttacacgaaaacgtttcatgggtgatttggttacaagcgcgttgcaaagttatcagtttagtaagatatgtgcttcaaagacttccatcgagctgagagaggcattgtctagtagaagagctgaggctgatgacctgaagaaggtaacatcatattcattcaggacaaaagcaggtgctctggttaaagtcaaagttgaaaagaagagagaaaagtacagcattttggtttatgtctcatctttggaacttagtggtgatgacaagagtaggctggtgatggtttggggtgtctacaggtctgattcttcgtgttttttgcctctggatttcgaaaactcttcccaagactcacaaacccacacaacagaaactacatttgtgaaaagctccttgtctgagttaatgctagggctagaatttgatgggaaagaatctcctttctacttatcatttcacctgaagttagtgtcaggtagagatccggacggtcaagaaatgctgactcacagggacactgacttctgtatcccggttggttttactgctggtcatccattgccgctaggcctttcttccgggccagatgatgattcttggaatttttcgttcttttcaagaagctcaacgaacgtggttttatgcttgtatgatgatagcacaacagataaacctgctttagaacttgatcttgatccttatgtcaaccgaacaggtgatgtttggcatgcttcagttgacaatacatgggattttgtgagatatggctaccgttgcaaggagacagctcactctaaagaagatgtcgatgttgaaggtgagccaattgtcttggatccatatgccacagtcgttggtaaatctgtctctcagaaatatcttggaagtttatctaagagtccttcttttgattggggagaagatgtgtctccgaacatacctctggagaaacttcttgtttaccggttgaatgtgaagggttttacacaacacagatccagcaagttgcctagtaacgtagcagggacattttctggtgtagctgagaaagttagccatttgaaaacccttggaaccaacgctgttcttttggagccaatattctcattctccgagcaaaaaggtccttattttccatttcatttcttttcaccaatggacatatatggaccttccaatagccttgaatccgcagttaactcaatgaaagtgatggtgaagaaattgcacagtgagggaatagaggtacttttggaagtagtttttacacatactgctgattctggagctcttcgtggaattgatgacagttcctattactacaagggaagagccaatgatctagattctaaaagttacttgaactgtaactatcctgttgttcagcagttggtattggagagcttgcgttattgggtaaccgagtttcatgtagatggattttgttttataaatgcttcatctctcttgagaggcgttcacggtgaacagctctctcgtcctcctttggttgaagcaatagcttttgatccacttcttgcggagaccaaactaatagctgattgctgggatccacttgaaatgatgccaaaagaagtacggttcccacattggaagcgatgggcagaactcaacacaagatattgtcgaaatgtaagaaattttttaaggggaagaggcgttcttagtgatctggctacaagaatttgtggaagtggtgacgtatttaccgatggaagaggtccggccttctccttcaactacatttcaagaaactcaggactctcgcttgttgacatagtcagtttcagtggccctgagctagcttcagagctaagttggaattgtggggaagaaggagcaacgaataaatcagctgttcttcaaagaaggctaaaacaaatccgcaatttcttgtttatacagtacatatcacttggagttccagtgcttaatatgggagatgaatgtggaatctcgacaaggggctcgcctttgttggaatcacggaaaccttttgattggaacttgctagcttcggctttcggtacacagatcacgcaatttatctccttcatgacttcagtaagagcaagaagaagtgatgtgtttcaaaggagagactttttgaaacctgaaaatattgtttggtatgcaaatgaccaaacaactccaaagtgggaagatcctgcttctaagtttttggcattggagatcaaatcagagtcagaggaagaggaaactgcgtcattggctgagccaaatgagccaaagagcaatgatctgttcatcggattcaatgcgagtgatcatcctgagagtgtagtcttaccttcacttcccgatggaagcaaatggagaagattggtcgacacagctcttcctttcccggggtttttctctgtcgaaggagaaaccgttgtagcagaagaaccgttgcagcaactggttgtgtatgagatgaagccgtacagttgtaccctttttgaaaccatcaatactaccgcttag

SEQ ID NO: 280 - DNA, 924 bp, Arabidopsis thaliana
atggctccagcaagtccacgagtggtggtgaaggtggatttgaagaagaggccatggcagcagactcagccactgcacaatagatggcatcctgagataccatcagttgcagaggtcaagactggtgagttgtttagggtggaaatggttgactggacgggaggtgcagtcaaagaagatggctctgctggcgatattaagagcatagacctctctactgttcattacctgagtgggccgatcaaagttgtggatgaggatggtgttgcagctaggccaggtgatcttcttgctgttgagatatgcaacttgggtcctcttccaggagatgaatggggattcactgcttcatttgatagagagaatggcggtggtttcttgactgaccatttcccttgtgcgaccaaagctatttggtactttgaagggatttatgcctactctcctcaaattcctgaaggagctaatctaagcaccggtgacatgcatttctcacagggtgatggcgagatctcattctgtggagccatagagatgagtggatttctagaactcaagtgtgaaatcattagaaacgggatgcaggagtaccttacaccaatgggaccaaccactctccacgtaaacccgatctttgagatagggccagtggaaccaagattctcagagtggcttgtcttcgagggtatcagtgtcgatgagagcggaagacaacattacctagatgcaacagttgcatacaaacgagcagttctcaacgctatagactatctcttcaaattcggttactcaaaagaacaggatattcgtccaaagacccgaaaagttccaacaggagctcggatagtgaagaagccagacgttatgaagagcacatatgatggaaaacttccaattacaaagaattcaagttcttcctcttag

SEQ ID NO: 281 - DNA, 1599 bp, Arabidopsis thaliana
atgaaattccaaagcttctttagctctgttctgatcttcttcactactagtactttacttctatcaattcctcatccggtttcagctaaccggtctaatcaatccagtttcctccaatgtctatctctccagttaaacgactccaacatcgtctcaaaagtcatacacacaccaaacgacacttctttctcctcagtcttagcttcatcaatacaaaatcaaagattctctgctcctgatgtacctaaaccggttttaatcctaactccggttcaaccttctgatgttcaatcagcggttaaatgcgcacgccggttcggtatccacatcagaacccgaagcggaggacacgactacgaaggcctctcttacgttacacacaaacccttcgtaatcctcgatttaagaaacctccggtctatcacagttgacgtcgataaccggtcggtttgggtccaaaccggagccacgatcggtgaactatattacgaaatcggtaaaaagaatcgtactttagcgtttcccgccggagtttgccccaccgtcggcgtcggaggacattttagcggcggaggatacggtactttactgagaaaacacggtttagcagctgatcacgtgatagacgcacgtgttgtcgacgcaagaggaaggattcttgagagacgagagatgggtgaagatttcttctgggcgattcgtggaggtggtggatcaagcttttgcgttgttctttcatggaagatcggtttaatcaatgttccatcaacagtaactgtcttcaacgtcacgaaattctcagaacagagtgctttaaagatcattcatcgttggcaattcgtggctgataaagtctctgatgatttattcataagagttatgttgcagagatacaagaacatggttcgagcttcgtttccgggtttgtatcttggttcggttaagaatctgttgaaaatggtaaacaaagaatttcctgaattgggtttggaggaagatgattgtacagagatgagttggattgagtcagtaatttggtttgctgagttaggagaagaaccaatcaatgttcttactaaacgtacacgagcatcgttggctttcaaggctaaatctgattttgttcaagaaccgatgcctaaaaccgcgatttcgaagctttggagacggttgcaagaaccggaagcagagcatgctcagctaattttcactccatttggtggtaaaatgagtgagattgcagattacgaaacaccatttccgcataggaaggggaatatatatgagattcagtacttgaattactggagaggagacgtgaaagagaagtatatgagatgggtggagagagtttacgatgatatgagtgagtttgtggcgaagtctccgagaggagcttatataaatctgagagatcttgatttgggaatgtatgttggagttaagaggagtaagtacgaggaagggaagagttggggagtgaagtattttaagaataattttgagagattggtgagagttaagacaagtgttgatccttctgatttcttctgtgatgaacagagtattcctccttttacgtttgttgaagttatttga

SEQ ID NO: 282 - DNA, 1458 bp, Arabidopsis thaliana
atgtcggaaggagtagaagcgatagtagcaaatgacaacggaacagatcaggtaaacggaaaccgtaccgggaaagataacgaagaacacgacggctccaccggttctaacctaagcaatttcctatggcacggtggctctgtctgggacgcttggttcagctgcgcatctaaccaagtggctcaagtgttattgacattaccgtactcgtttagtcaactaggaatgttatcaggaatagtacttcagatcttctatggtttactaggaagctggactgcttatctcatctctgttctctacgtcgaatacagagctcgtaaagaaaaagaaggcaaaagcttcaaaaaccacgtcattcagtggtttgaagtacttgatggattacttggttcatactggaaagcactaggactcgcatttaattgcactttcctcttgtttggatctgttatccaactcattgcttgtgccagtaacatttattacataaacgatcatctggacaagagaacatggacttacatatttggcgcgtgttgtgcaaccactgtctttataccgtcgtttcacaattaccgaatttggtcattccttggccttggaatgaccacttacaccgcttggtacttagccattgcctccatcatccacggccaggcggaaggtgtgaaacattcaggtccaacaaagctagtgctttattttacgggagccacaaatattttgtacacctttggaggtcacgcggttactgttgagattatgcatgctatgtggaaaccacagaagtttaagtacatttacttgatggcgacgttatacgtgttcacgctaacgattccgtcagctgccgccgtttactgggctttcggagacgcacttctcgaccactccaacgctttctctcttatgcccaagaacgcgtggcgtgacgccgctgttatcctcatgctcattcatcagtttataacgttcgggttcgcttgtacacctttgtactttgtgtgggagaaagtgattgggatgcatgacacaaagagcatttgcttaagggctttggctagattgcctgtggtcatacctatttggttcttagctattatcttcccctttttcggtccaatcaattccgctgtcggtgctcttcttgttagcttcaccgtctatatcatcccatctctcgctcacatgctcacttaccgatctgcctccgctcgtcagaatgcggcggagaagccaccgttctttatgccgagctggacggcgatgtacgtgttgaatgctttcgtggtggtttgggttcttatagtcggatttgggttcggtggatgggctagtgtaaccaactttgttcgtcaagtcgacacttttggtctctttgccaagtgttaccaatgtaaaccagctgcagccgccgcacatgccccggtctccgctttacaccaccgtctttga

SEQ ID NO: 283 - DNA, 2226 bp, Arabidopsis thaliana
atggcttctacttcttctctagcgctctcacaagctctccttacacgagccatctctcacaatggctctgaaaactgcgtctctataccagctttctctgctctcaaatccacttctccacgcaccagtggcaccatctcttcccgtcgacgaaacgcctccacgatcagtcactctctccgccctctggttcgtgcagccgccgtagaggcaatcgtgacaagttctgattcgtccctggttgataagtcggtgaacacgatcaggtttctggcaatagatgcggttgagaaggcgaaatcaggtcatccaggtcttcctatgggctgtgctccgatgtctcacattttgtacgatgaagtcatgaagtataaccccaagaatccttactggtttaaccgtgatcgtttcgttctctctgctggacatggatgcatgttgcaatacgctctgcttcaccttgctggctacgacagcgttagggaggaagatttgaagagcttccgtcaatggggaagtaagactccaggacatcctgagaattttgagactcctggtgttgaagccactactggtcctcttggacaaggtattgcaaatgctgttggtttagctcttgcggagaagcatttggctgctagatttaacaaacctgacaatgagattgttgaccactacacgtattcgattcttggagatggttgtcagatggaagggatttcaaatgaagtttgctctctagctggtcactggggacttggaaagctaatcgctttctacgatgacaatcacatttccattgatggagacacagatattgcttttaccgagagcgtggacaaacgctttgaagctcttggatggcatgttatctgggtaaagaatggaaacaatggttatgatgagatccgtgctgccattagggaagctaaggctgtaacagacaagcccactttgattaaggtcactactacaattggttatggttctcccaacaaggcaaactcatacagtgtccatggagctgcgcttggtgagaaggaagttgaggctacccgaaacaatcttgggtggccatatgagccgttccatgtacctgaggatgtcaaaagccattggagccgtcacacgcccgaaggggctgctcttgaagctgattggaatgccaaatttgcagcttatgagaagaaatatccggaggaagctgcagagttgaaatctattatctcaggtgaattgcccgttggttgggagaaggcacttcctacatatacaccagactctccgggtgatgccaccagaaacctgtctcagcaatgtcttaacgcacttgcgaaagctgtgcctggttttcttggtgggagtgctgaccttgcatcttccaacatgacaatgcttaaagcattcggcaacttccaaaaagccacacctgaagaaagaaaccttagatttggtgtcagggaacatggtatgggagctatctgcaacggcattgcccttcacagccccggttttatcccttactgcgcaactttctttgtgtttactgactatatgagagctgcaatgagaatctcggctttgtctgaagctggtgttatatacgttatgacccatgactccattggtcttggagaagatggaccaacccaccaacccatcgaacacttatccagtttccgtgccatgcccaatattatgatgttccgtccagctgatgggaacgaaacagccggtgcatacaaaatcgctgtcacaaaacgtaagacaccttctgtcttagccttatctagacaaaagctgcctcaacttccaggaacatctattgagagcgtcgagaaaggtggatacaccatttctgacaactcaaccggtaacaaacccgatgtgatcttgatcggaactggatcagagctagagattgctgctcaagctgcagagaagttaagggaacaaggcaaaagtgtgagagttgtttcctttgtatgttgggagcttttcgacgagcaatcagatgcatacaaggaaagtgttttgccatctgatgtatcagctagagttagtatcgaagctggatcgacttttggatggggaaagatcgtcggaggaaaagggaaatcgattggaattgatacgtttggagcaagtgcaccagcaggaaagctttataaagagtttggtatcaccattgaagctatggttgaagcagccaagtcacttatttaa

SEQ ID NO: 284 - DNA, 621 bp, Arabidopsis thaliana
atggaaccaaagctaacccatctttgttattgccttctactttttcttccactactctgccaatccaccatagccaaaccttcatcatcaccaaaccctagcagcagcatcaacttcattgtctcatcatgccgcgtcacgcgttaccaaactctctgcgtcaaatgccttgccgcttttgcagacaaaatccgccgcaacgaaaaccagttagctcaaaccgctttagccgttactctagtccgggttcagtccacgacaatctatgtagggaagctgactaaagctaggagaatcaaaaggagagagtacttagccgtgaaggattgtgttgaaaatcttggagacggtttagagatgttggctcagtcgatgagggagttgaagcaagttggtcgatctggtcgtgatcgagacgagttcttgtggagactaagtaacgttgagacttgggttagtgctgccttaacggatgagacaacgtgtctggatgggttcgatggaaaggttatggacggtgtggtaaaatcagcgattagaagaagagtggttcatgtggctcgagttactagtaatgcattggctcttgtaaaccggttcgcggctaggcataagtcatag

SEQ ID NO: 285 - DNA, 621 bp, Arabidopsis thaliana
atggcggattcggaagcagataagccactgagaaaaatctcagccgctttcaaaaaactagcaatcatcgtgaattcaccgaatccggaagttcctgtaacgcaattctctcacgcttgctctctggtctcgcctctctttggttgccttggaatagcttttaagtttgcggaaatggactatgttgccaaggttgatgatcttgtgagggcgtcgagttcgatatcgacattagtggtaatgatggacaaagatattgaggcagattgtgtaaggaaagctggtagtcatacgagaaaccttttgagggttaagcgtggtcttgacatggtcaaagttctctttgaacagatcatagcttccgaaggagataactccttgaaggatccagcaactaagtcttatgctcaagtgtttgctccccaccatggatgggctatacggaaagctgtttctcttgggatgtatgctcttcccacaagggctcacctacttaatatgctcaaagaggatgaggcggcggctaagatacatatgcaaagctatgtcaattcatcggcaccattaatcacgtatcttgataatctattcctctccaagcaactcggtattgattggtga

SEQ ID NO: 286 - DNA, 1497 bp, Arabidopsis thaliana
atgatcttaaaaggaatactgtggcaggtatggttccttggagaaaatgcaaactacgccgcatcagaatatgcatgggaatctgcaactccaccaggcacagcacttatgatgttggatgcagataaaatggttgctgctgctagttctcgcaatcctactctagctggtgcattaactcgcctccagaggtgtgcatttagtggaagctgggaggtcagaattgttgcaattcaagctcttactacaatagccattagatctggtgaacctttcaggctgcagatatacgagtttttgtacaccttagcagagggtggtgtacagtctcaactttctgaaatgcacctgagtaatggggaagaccaaggagctagtggtacaggtcttggagttttaataacaccgatgttaaaagttcttgatgaaatgtatgttggacaagacgaattaatcaaggatatacgccatcacgataatgcaaacaaagaatggaaggacgaggagctgaaaaaactctacgaaaaccatgagaggctgctggattttgtttcaatgttttgctttattcctagagccaagtatttaccactgggcccgataagcgcgaagctcattgacacataccgtacaaagcacaatatcactgcatctactgggtccaccgatccagctgttgttgctactgggatctcggacttaatctatgagtccactcagcctgcccccgctgcctcaaactccagtggtctggatgatgatttggtgaatgcttgggctgcaaaccttggtgatgatggtcttcttggaaacaatgccccagcaatgagtaggaaatggaactcagacctatataatacttgtcaggtcaatgaattcattgctggagtcggaacagatgcaccggatgttgaggaggagaatgtcttctctagaccttcggttgggtatgatgacatgtgggctaaaactcttttagaaacttcagaattggaggaagaagatgcgagatcaggttcatcgtctccagattctgctggatcagtggaaagctcaatatcctctcactttggtggaatgaactacccatcattgttcagttcaaagccttcctcacaagcaacggcaaaatcaggtggaagtaaataccagtccacatatgaaggctatggttccccaattagagaagagcctcctccgccttattcgtattctgagccacaaagtcgtgaatcgtttgagaaccctgtagcagggtctggttctcgaagttatgaatcagatgatgaagaacctaggaaatctactggtacaagatttggaacagcgctctatgacttcacagcaggaggagatgatgagctaaacttgacggcagaagaggaattggagatagagtatgaagttgatggctggttttacgtaaagaagaagcggcctggaagagatgggaagatggcgggacttgttcctgttctatacgtcaatcaatcttga

SEQ ID NO: 287 - DNA, 468 bp, Arabidopsis thaliana
atgggagtcgctgttcttcatcctcatgattctataatcaatcatttctccacaaacacgtcccctcctctccgtcataaaaaaccgatcaccaatcgccgtcgccggagtccgtcaagtcaccaatcccagatctctcatcctcctccgtctcctcataaccacaccaatcatgtacgaattctgaagcgtggcgaagatatcaacgttaagataccgattgaaaaaccagatctgaaatctaatcgtcagatcggatcagatccgatgaaaatttcgactccgatcagaatttcaaatcggaaatccatgccggctttgttttacgctggtccagtcacatcaacatctccgccgccgagtgaagtccctttaccggctttcttcgctaataaaaccgtcgccggattcaaaccgaccgatgcaaccaacgatctgatcaaaatcctgcgattagatatcgcatga

SEQ ID NO: 288 - DNA, 855 bp, Arabidopsis thaliana
atggcgagtggactaagcgagatcgggagcacgaagatgttcgatggctacaacaaaagatacaaacacttcagtgagacacttggatgttccatgaccttttccatctacttccctccttctgcttcttcttcccataaatctcctgtgctttactggctttctggcctcacctgcacggacgagaacttcattatcaaatcaggagctcaacgtgctgcttctactcacggcattgctcttgttgctccagacacttctccaagaggactaaatgttgaaggggaggcagacagttacgactttggtgtaggagccggattctacctcaatgctactcaggaaaagtggaagaactggcgtatgtatgactatgttgtcaaagagttgccaaaactcctgagtgaaaacttttcccagcttgacacaacaaaagcatctatatctggacactccatgggtggacatggagctcttactatatacctgaggaacctcgataaatacaagtctgtatctgcgtttgcaccaatcacgaatcccataaattgtgcatggggacagaaggcattcaccaattatctaggtgacaacaaagctgcttgggaggaatacgatgccacttgtcttatttcaaagtacaacaatctttctgcaacaattctaattgatcagggagaaaacgaccagttctaccctgatcagttattgcccagcaagtttgaggaggcgtgcaagaaagtgaatgcaccgctcttattgcgcctccatccaggatacgaccactcctactatttcattgccaccttcatcgaagaccacattagtcaccatgctcaagcccttgagctatag

SEQ ID NO: 289 - DNA, 1959 bp, Arabidopsis thaliana
atggaaactcccaaaggcactatcattttcaccaccgtcggtcgaactcactacggcttcgacgtcttctctctcaacatagccacctccgtcgaacgccgtttaacagacggcgtttccgtgaacttcaacgctcaattcgtcaacgataaaagcgatgatgtcgtctttgtttcggaaagaaacggatccgccaggatttacaaaacccgatccggaatttctaagcccgagcagattcccggagctccagagagctacttccacgaccgtcctatcatcactcaaaacaacagactctatttcatctctgctcacgagcaacctgatcgttatttcaagaattggtctgcgctttacaccgtggagctcaacagcgcaaagagagaagttacacgtgtcactccaccagacaccgccgactttagtccggcggtttctcaatctggagatttcttagccgttgcttcttatggaactcgctcttggggtggtgagtttcacgagatcaacactgatattactgttttcaaagcatcaaaaccagagacaagagtggttatctgcgagcgtggtggatggccgacttggtccggcgattcaactgttttcttccaccaccaagcagacgacggttggtggagcatcttccgggtagatataccggagaatttcacggaatataccgatttcccaatcacaccaatccgagtcactccatctggactccattgcttcactcctgcagctttccgcgacgggaaacgaatcgccttagcaactcgccgtcgcggcgtcaaccaccgtcacatcgagatttacgaccttgaaaacacaacgtttcagccggtgactgagtcactcaatccgagtttccaccattacaaccctttcgtgtctccagactccgagttcctcggctaccaccgattcagaggcgagtcaactcaaggcgagtcaatcgtacctaacatcgaatccatcgtttcaccaatcaaaaccctccgattactaagaatcaacggatcgtttccatcatcatctcccaacggtgatctaatcgcattgaactccgatttcgacatcaacggtggaatcaaagtatctaaatccgacggttcaaaacgatggacgttgatcaaagaccgtacagctttctacaattcatggagtccaacagagcgtcatgtaatctacacatctctaggtccaatcttctctccggcgagaatcgcggttcagatagctcgaatcaagttcgatccatcagatctcaccgctgataaagaagatcttccatgtgatgtgaagattctcactctagagaacactgggaataacgcttttccgtcttgctctccggacggtaaatcaatcgtgttccgatctggtagatcaggtcataaaaatctctacattgtagacgccgttaacggagaatctaacggcggtggaatacgacggttaacggatgggccatggattgacactatgccttgctggtctccgaaaggagatctcatcggattctcatctaatcgtcataatccagagaacacggccgtgttcggtgcttacgtggtgagacctgacggtactggtttgaggaggattcaaatttcgggaccggaagggtctgaggaagcggcgagggagagagttaatcatgtgagtttcaataaagatggtgattggcttgttttcgcggcgaatttgagcggagtaacggcggagccggtgacgatgccgaatcagtttcagccttatggggatttgtacgttgtgaaattagacggaacgggattgaggaggctgacgtggaatgggtatgaagatgggactcctacgtggcatactgctgatgaattggatttgagtcagttgaatttgaacggtcaagatggtgacaagcttgaaggtcagtttgaggagccgttgtggatttcttgcgatatctga

SEQ ID NO: 290 - DNA, 165 bp, Arabidopsis thaliana
atgttcccaggaatgttcatgcgaaagccagacaaagccgaggctctgaagcagctacgcactcatgtcgctctttttggcagctgggttgtcattatccgtgctgctccctacgtcctctcctatttctccgattccaaagatgagctcaagatcgatttctaa

SEQ ID NO: 291 - DNA, 1209 bp, Arabidopsis thaliana
atggagggactagttccggtacagagacttccaattaaagtggcttcaccttctctgtatcggtgtaacaattctgtctcaatcagacgttcaatttcaggttttgccatggacaggaagataaactttagggctccgtcgcaattctcgatccgagctcaacagtcggatttgaaggaaagcttagctgtgtcttcttcatcagtagaggataaaggaaatgttcttagaatcaaggaatgggaagtagagatgtatcaggaggaattagctattagtcaaggtattaggataaggagaaaaccaccaagtaaggctcctttgggatactctggaccatttgagttgagattgcataacaatgatgctgattctcctcgtaatatcttggaggagatcacatggtacaaagacgtagaagtttcccggatgaaggagctaaatccgcttgacgtgctgaagaaagctgtagaggatgctcctcctactagggattttgttggggctcttaggatggctcataaaagaactggcttccctggcttgatagctgaggttaagaaggcttctccaagtagaggaatcttaaaagagaattttgacccggtcgagattgctcaagcttatgaaaaaggcggagcagcatgcctcagcgttttgacagaccagaagtatttccagggaggctttgaaaacttggaagcaataaggagcgctggtgtgaagtgtccactattatgcaaagagtttgttgtagatccatggcagatctactatgctcggactaaaggcgcagatgcagtactgcttattgctgctgtattggctgacctagaaataaccttcttgcttaagatttgcaagaagcttagcttggctgcccttgttgaggtacatgatgagagagagatgggtcgtgtacttggaatagaaggaatcgagcttgttggcatcaataaccgaagtcttgaaacatttgaagtggacatcagtaatacaaagaagcttcttgaaggagagcatggtagacaaatccgtgagagagacatgattgtggttggcgaatctggtctgtttacaccagatgacattgcctatgtacaagcagccggagtcaaagcagttttggttggagaatccattgtgaagcagaacgaccctgagaaaggaatagctggactttttggcaggaacatttctcatacttag

SEQ ID NO: 292 - DNA, 876 bp, Arabidopsis thaliana
atgtctactgcttcactatttagcttcccttcatttcatctcagatccctccttccttctctctcttcttcttcttcttcttcctcttcccgatttgcccctccccgtctttctccgatccgatctccggcgccgaggactcagctgtctgttcgcgctttctcagccgtcaccatgaccgattctaacgatgctggaatggatgctgttcagagacgactcatgtttgaagacgaatgcattctcgttgatgaaaatgatcgtgtggtgggacatgacactaagtataactgtcatctgatggaaaagattgaagctgagaatttacttcacagagctttcagtgtgtttttattcaactccaagtatgagttgcttctccagcaacggtcaaaaacaaaggttactttcccacttgtgtggacaaacacttgttgcagccatcctctttaccgtgaatccgagcttattgaagagaatgtgcttggtgtaagaaatgccgcacaaaggaagcttttcgatgagctcggtattgtagcagaagatgtaccagtcgatgagttcactcccttgggacgcatgctttacaaggcaccttctgatgggaaatggggagagcacgaagttgactatctactcttcatcgtgcgggatgtgaagcttcaaccaaacccagatgaagtggctgagatcaagtacgtgagcagggaagagcttaaggagctggtgaagaaagcagatgctggcgatgaagctgtgaaactatctccatggttcagattggtggtggataatttcttgatgaagtggtgggatcatgttgagaaaggaactatcactgaagctgcagacatgaaaaccattcacaagctctga

SEQ ID NO: 293 - DNA, 1746 bp, Arabidopsis thaliana
atggcgatgatagggatgaacattattgggctattcatggttcttatgttgcttctcatctccctcatcatccttttcgcctgcaagccatggcgatatttttctcgtttccgatcctcctctcgtttttcttctaccttcaaggtgggggatttgcagagaccacttatttctgatgatggaaatttgatccaaggacaaaccagtgaggtaacaagggaatatgatttagagggagcttgctaccaaaatgatggacttttgcattcatctctgactgagggacggttttacaaacaaaggcttccttcgtcatctccccatttctcccaaggtgaaagctttgttctagaagtaatttctgaaccttctgacaatgctttggtgggccaaacgcttaaacttccagctgaaaaaggttccttggcagaagtgcaaacatatgactggcagaataacagaaatgaaaacttgcaatataatctggaaaaggatcgacttattaatctttctccgaggctcgtggaagatcaaagaagttggctgttcctggaagtcatcgcgggtcctgccattgggcttcaacatgctgtgaactccacaagttcctccaagctgccagtgaaacttggaagggtttctccttctgatttggcattgaaggactcagaagtctctgggaaacatgcacagataacatggaactctactaaatttaaatgggagctggtagatatgggtagcctaaatggaactctcgtaaactctcattcaataagtcatcctgatttaggcagccggaagtggggtaaccctgtcgagcttgcaagtgatgatataataactttgggaacaacaacaaaggtctatgtccgtatctcctctcagaatgagtttcagatacccttcaaaattggtgtggcctcagatcccatggctatgcgtcgaggaggcaggaaacttccgatggaagatgtttgtcattacaagtggccgcttcctggggctaataagtttggactgttttgtgtttgtgatggacatgggggatcaggggctgctcaatccgcaatcaaaattattccggaggttctagcgaatattttatcagactcgctgaggaaggagaaagtgttatcaaaaagggatgcttcggacgtccttagggacatgtttgctaaaacagaagctcgcctcgaagaacaccaatatgagggttgtacagctactgttctcttggtttggaaagacaatgaagaaaacttcttcgcacaatgtgccaatcttggggattcagcatgtgttatccatcttggtggcagatatatacaaatgactgaagatcatcgagtggttagcttgagcgagagaaaacgattccaagaagcaggactagccttgagagatggagagactcggctttttggtataaaccttgcgaggatgcttggagacaagtttccaaagcaacaagacagccgtttcagtgcagagccatatataagtgagcctttgcgtatcgatcaatctagtaaagacgtatttgctgtattggctagtgacgggttatgggacgtggtaagtccgaagaaagctgtgcagcttgtacttcagatgagagataaagagagagggagagagagtagtgcggagaagatagcaaacggtctgctgaatgaagctagagcgatgcgtacaaaggacaacacctccattatttacttagatttcgatacttccctgtaa

SEQ ID NO: 294 - DNA, 987 bp, Arabidopsis thaliana
atgcagtacaagaatctggggaaatcgggtttaaaagtgagcacgctctcgttcggagcgtgggttacgttcgggaaccagctcgatgtgaaagaagcgaaatcgattcttcagtgttgtcgtgatcatggagtcaatttcttcgataacgctgaggtttacgctaatggtcgcgctgaggagattatgggtcaagcgattcgtgaactgggttggcgtcgatccgatatcgtcatctctaccaagatcttctggggtggtcctggtcctaacgataagggtttatctaggaaacatatcgttgaaggcactaaagcttctctcaaacgacttgatatggattacgttgatgtgctctattgccacaggccggatgcttcaactcctatcgaagagactgtgagggcgatgaactacgtgattgataagggttgggccttctattggggaaccagtgaatggtcagctcaacaaattacggaggcatggggagctgctgaccggttggatttggttggtccaattgtcgaacagccagaatacaacatgttcgctaggcacaaagttgagacagagtttcttcctctgtacaccaaccatggtataggtctcactacctggagcccacttgcatctggtgtgctcactggtaaatacaacaagggagctattccctcagacagccgatttgcattggagaactacaaaaaccttgccaatagatcacttgtggatgacgtgctgaggaaagttagcggtctcaaacccattgcagatgagctaggtgtaaccttggctcagcttgcaatcgcatggtgtgcttcaaatcctaatgtgtcatctgttatcactggtgccacaagggagtcacagattcaagaaaatatgaaagctgttgatgtgatcccattgttgacccctattgttctggacaagattgagcaagtgatacagagcaaaccaaaacgtcctgaatcatataggtaa

SEQ ID NO: 295 - DNA, 1197 bp, Arabidopsis thaliana
atggaagaataccagcatgacaacagcaccactcctcaaagagtaagtttcttgtactctccaatctcttcttccaacaaaaacgataacacaagtgataccaacaacaacaacaacaataataatagtagcaattatggtcctggttacaataatactaacaacaacaatcatcaccaccaacacatgttgtttccacatatgagctctcttctccctcaaacaaccgagaattgcttccgatctgatcatgatcaacccaacaacaacaacaacccatctgttaaatctgaagctagctcctcaagaatcaatcattactccatgttaatgagagccatccacaatactcaagaagctaacaacaacaacaatgacaacgtaagcgatgttgaagccatgaaggctaaaatcattgctcatcctcactactctaccctcctacaagcttacttggactgccaaaagattggagctccacctgatgtggttgatagaattacggcggcacggcaagactttgaggctcgacaacagcggtcaacaccgtctgtctctgcctcctctagagacccggagttagatcaattcatggaagcatactgtgacatgttggttaaatatcgtgaggagctaacaaggcccattcaggaagcaatggagtttatacgtcgtattgaatctcagcttagcatgttgtgtcagagtcccattcacatcctcaacaatcctgatgggaagagtgacaatatgggatcatcagacgaagaacaagagaataacagcggaggggaaacagaattaccggaaatagacccgagggccgaagatcgggaactcaagaaccatttgctgaagaagtatagtggatacttaagcagtttgaagcaagaactatccaagaagaaaaagaaaggtaaacttcctaaagaagcacggcagaagcttctcacgtggtgggagttgcattacaagtggccatatccttctgagtcagagaaggtagcgttggcggaatcaacggggttagatcagaaacaaatcaacaattggttcataaaccaaagaaagcgtcactggaaaccatctgaagacatgcagttcatggtgatggatggtctgcagcacccgcaccacgcagctctgtacatggatggtcattacatgggtgatggaccttatcgtctcggtccataa

SEQ ID NO: 296 - DNA, 813 bp, Arabidopsis thaliana
atggcttttgccattgcttctgctctcacttccacactcacattatccacgagcagagtccaaaatcctacccagagaagaccacatgtagcgtccacatcatccaccggtggaagattaatgagagagcgcttggtggtggttcgtgccggcaaagaagtttctagcgtctgtgaaccacttcctccggaccgtcctttatggttccctggtagctctccacctgaatggctcgatggcagcttacctggtgatttcggtttcgatcctctcggtttagggtctgatccggacaccctcaaatggtttgcacaagctgagcttatacatagccggtgggcaatgctggccgtgaccggtatcataataccagaatgtctcgagcggttaggtttcattgaaaatttctcatggtatgacgcagggtctcgtgagtacttcgcggattccactacgctgtttgtggctcaaatggttttaatgggctgggcagaaggtagaagatgggctgatttgattaaaccggggtctgttgacatagaaccaaagtacccgcataaagtaaatcctaaaccggatgttggttaccctggaggtttgtggttcgattttatgatgtgggggagaggttctcctgaaccggtaatggttttgaggactaaagagattaagaacggacggctcgcgatgcttgctttccttgggttctgtttccaagctacctacactagccaagatccaattgagaatctcatggctcatctggctgatcctggtcattgcaacgtcttttcggcatttacatcacattaa

SEQ ID NO: 297 - DNA, 2709 bp, Arabidopsis thaliana
atgatggcttcattgtcttgtgttgaagacaagatgaaaacaagttgtttggttaatggtggaggaactataacaacaacaacatctcaatctaccttgcttgaagagatgaagctgttgaaagaccagtcaggtacaagaaagccggtaataaactcggagctatggcacgcttgtgcaggccctttggtgtgtctccctcaagttgggagcttagtgtattacttctcacaaggtcatagcgagcaggttgctgtttcaaccagaagatcagcaacaacacaagttcctaattatccgaaccttccatctcagttgatgtgtcaagtccataatgttactcttcatgctgacaaagacagtgacgaaatctatgctcagatgagtcttcaacctgttcactctgagagagatgtgttccctgtaccagactttggaatgctgagaggaagtaagcacccgactgagtttttctgcaaaacacttactgcaagtgacacaagcacacatggaggtttctcagtgccacgtagagctgcagagaagctatttccaccattggactactcagcacagccgccaacgcaagagcttgtagttcgagatcttcatgagaatacttggacatttcgccatatctaccgagggcaaccaaagagacatctcctaactacaggatggagtttgttcgttggatcgaagagattgagagctggggattctgttttgttcatcagggatgagaagtcacaacttatggtcggtgttaggcgtgccaatcgccaacaaacagcacttccttcatcagttctctcagcggatagtatgcacatcggtgttcttgctgctgctgctcacgcaaccgccaaccgtactccttttttgatattctataatccaagagcttgtccagcagagttcgtgatccctctagctaagtaccgtaaggcgatatgcgggtctcagctctcagttggtatgagatttggaatgatgtttgaaactgaagattccgggaaacgaaggtacatgggaactattgttggaatcagcgatttggatccgttgagatggcctggttctaagtggcgtaaccttcaggtagaatgggatgagcctggatgtaatgataaacctactcgggtcagtccatgggatatcgaaacacctgaaagtctcttcatttttccttctctgacctcaggactcaaacgtcagctccatccatcttactttgctggtgaaactgaatggggtagcttgataaaacggccacttatacgtgttcctgattccgcgaatgggattatgccatatgcatctttccctagtatggcttcggagcagcttatgaaaatgatgatgaggcctcacaacaaccaaaatgtaccatctttcatgtctgagatgcagcagaatattgtaatggggaatggaggtttgctaggagatatgaagatgcagcaacccctgatgatgaaccagaaatctgagatggtgcagccacaaaacaagctaacagtgaacccatctgcttctaatacgagtggccaagaacagaatctttcacagagtatgagtgctcctgctaaacctgagaactctacactctctggttgcagctctggtagagtccaacatggacttgagcagtcaatggaacaggcaagccaggttactacatccacagtgtgtaatgaggaaaaggttaatcagctacttcagaaaccgggtgcttcgtcgcctgtacaagctgatcaatgtcttgacattactcatcagatttaccaaccacagtctgatccaataaatggattctctttcctggaaactgatgagctgacatcacaagtctcttccttccagtctcttgccggatcatacaagcaaccattcattctatcctcccaggattcttcagctgttgtgttaccggattccacaaactcaccgctgtttcatgatgtgtgggacactcagttgaacggtctcaagtttgaccagttcagtcccttgatgcagcaggacctttatgctagtcagaatatctgtatgagtaatagcacaaccagtaacattctagatcctccactctcaaacacagtccttgatgacttctgtgccatcaaagacactgatttccagaaccacccttctggttgtttggttggaaacaacaacactagctttgctcaagatgtccagtcgcagatcacatcagctagctttgcagactcacaggccttctctcgccaagattttccagataattctggaggcactggtacatcttcaagcaatgttgattttgatgattgtagtctgcggcaaaatagtaaaggctcatcatggcagaaaattgcgacaccccgcgtccgaacctacactaaggttcaaaaaaccgggtcagtcgggagatcaattgatgtcacaagctttaaagactacgaggagctaaaatctgctatcgaatgcatgtttggattggaaggactactaactcacccacaaagctcgggttggaagcttgtatatgttgattatgagagtgatgttctgcttgtaggagatgatccatgggaagagtttgtgggatgcgtaaggtgcataaggatattgtcgccaactgaggtccagcagatgagtgaagaagggatgaagcttttgaacagcgcaggcattaacgatcttaagacttctgtttcataa

SEQ ID NO: 298 - DNA, 1248 bp, Arabidopsis thaliana
atggcagatgaaggtaaggaggagacaggaatgggtcaggtcgaggaagatttttctgtgtggaagaagaacacaccatttctctacgatcttttgatctctcacccactcgaatggccatctctcaccgtccattgggttccatcgacgccaaatccttacgtagcagactcttacttcggtgtccacaagcttatactcggtactcatacttccggtagtgctcaagattttctcatggtcgccgacgtcgttaccccgacaccaaacgcagaacctgggataggcggcgctaatcaggatccctttattcctaaggtggagattaggcagaggatacgtgttgatggagaagtgaacagagcgcggtgtatgcctcaaaagccgacgcttgtgggtgcaaagacgagtgggtgtgaggtgtttctgtttgattacgccaaacatgctgcaaagtctcaaacgagtgagtgtgatcctgatctgaggctagtgggacatgacaaggaagggtatggattgtcttggagtcctttcaaggaaggttatcttttgagtggttcacaggatcagaagatctgtctttgggatgtttcagctacaccgcaagataaggttttgaatgcaatgtttgtgtatgagggacatgaaagtgctatcgcagatgtgtcatggcacatgaagaatgagaacctttttggttctgcgggtgaggatggccgattggtgatatgggacacacggacaaaccaaatgcaacaccaagtgaaagttcacgagagagaggtcaactatctatctttcaatccgttcaacgaatgggtattggccacagcttcctcagactccactgttgctttgtttgacctccggaaacttaatgcgccattgcatgtcatgagcagccatgagggagaggtcttccaagtggagtgggatcctaaccatgaaacagtactcgcatcttcaggggaggacagaaggctgatggtctgggacctgaacagggttggagaagagcagcttgagatagagttggatgcagaagatggtccaccagagttactcttctctcacggaggccacaaggctaagatatcagactttgcttggaacaaaaacgagccttgggtcattgcaagtgtagctgaagacaacagtcttcaggtgtggcagatggcagaaagcatctatcgcgatgaagaggatgccgaggacatcaaagaagatattacacaacaatcatga

SEQ ID NO: 299 - DNA, 1275 bp, Arabidopsis thaliana
atggcggcagaagagggtaaagatgaggcgggattggatcaggtggaagaagagttctctatttggaaaaggaacacaccttttctctacgatcttatgatctctcacccactagaatggccttctcttactctccactgggttccttcgacgccgattccgtactcgaaagatccttactttgccgtccataagcttatccttgggactcatacctccggtggtgcccaagattttctaatggtcgccgatgtcgttattccgacacccgacgctgaaccaggattaggtggaagagatcaggaacctatcgtccctaaggtggagattaagcagaagatacgtgttgatggagaagtgaacagagcgaggtgtatgccacaaaagccaactcttgtgggtgctaaaacaagtggctctgaggtgtttctgtttgattacgccagactctctggaaagccccaaacaagtgagtgtgatcctgatctgaggctaatgggacatgaacaagaaggttatggattggcttggagttcctttaaggagggttatcttttgagtggctcacaagatcagagaatctgcctttgggatgtctcagcgactgccactgataaagttttgaacccaatgcatgtgtatgagggacatcaaagtatcatcgaagatgtagcatggcacatgaagaatgaaaacatattcgggtctgcgggtgatgattgtcaattggtgatatgggacttacggactaaccaaatgcaacaccaagtcaaagttcacgagagagagataaactatctttctttcaatcccttcaatgaatgggtactagccacagcttcctcagactcaactgtcgccttgtttgaccttcgtaagctgactgcgccattacatgtcctgagcaaacacgagggagaagttttccaagtggagtgggatcccaaccatgaaacagtgcttgcatcttctggcgaggacagaagactcatggtctgggatatcaacagggttggggatgagcagcttgaaatagagttggatgcagaagatggtccacctgagctgctcttctctcatggaggccacaaggccaagatatcagactttgcctggaacaaggacgagccttgggtcatctcaagtgtagctgaagacaacagtcttcaagtctggcaaatggcggaaagcatctaccgcgaagatgacgaggatgaggatgatgatgatgaaggcaaccaaaatgcacaacattccaatgaaaaccagaaatga

SEQ ID NO: 300 - DNA, 1524 bp, Arabidopsis thaliana
atggagagcgacgaagcagcagcagtgtctcctcaagcaacgacaccgagcggaggaaccggagcttctgggccgaagaagagaggtcggaaacctaaaaccaaggaagattctcagacgccgtcgtctcagcaacagagcgatgttaaaatgaaagaaagtgggaagaaaacgcagcagtcgccgagtgttgacgagaagtactctcagtggaaaggtctcgtccccattctctacgactggctcgctaaccataacctcgtctggccttcactctcttgcagatggggtccgcagcttgagcaagcaacctacaagaatcgccagcgtctgtacctctcagagcaaactgatggaagtgtgcccaatactttggtcatagcaaattgtgaagttgttaagccaagggttgctgcagcagagcacatttctcagttcaatgaagaagcacgttctccatttgtgaagaagtacaagaccatcattcaccctggagaggttaacagaatcagggaactcccacagaatagtaagattgttgctactcacaccgacagtcctgatgttctcatttgggatgttgaaacccaaccaaaccgtcatgctgtgcttggagctgcaaattcccgtccagatttgatactaactgggcaccaagataatgctgaatttgctcttgccatgtgcccaacggaaccctttgtgctctccggaggcaaggacaagtcagttgttttgtggagtatccaagatcacatcacaacgattgggacagattccaaatcatctggatctatcatcaaacagactggtgaaggtactgataagaatgagagtcctactgttggcccacgaggtgtatatcatggccatgaagatacagttgaagatgtggcattcagcccgacgagtgcacaagaattctgcagtgttggtgatgattcttgccttatactatgggatgcgagaactggcacaaaccctgtcacgaaggttgaaaaagcgcatgatgctgatcttcattgtgttgattggaatcctcatgacgacaatctgatcctgacagggtcagcagacaacactgtccggttgtttgatcgtaggaagcttaccgctaatggagttggttcgcctatttacaaatttgagggacacaaagctgctgttctttgtgttcagtggtctcctgataagtcatccgtctttgggagctctgcagaagatggtctcttgaacatctgggattatgacagggtcagtaagaagtctgatcgtgcagctaaaagccccgctgggctcttcttccagcatgctggtcacagggacaaagttgttgatttccactggaatgcttcagacccttggactattgtcagtgtttctgatgactgtgagactactggtggaggtggaacattgcagatatggcggatgagtgacttgatttacagaccagaagaagaagtcgtggcagaattggagaagttcaagtcgcatgttatgacttgtgcctccaagccttaa

SEQ ID NO: 301 - DNA, 1350 bp, Arabidopsis thaliana
atgttctctctcaaatccttaatctcctcacctttcacacaatccaccactcatggattattcaccaacccgattacccgacccgttaatccattaccacgtaccgtttccttcaccgttaccgcttccatgatacccaaaagatcctcagctaacatgattcccaaaaaccctccggcgaggcaacagctctaccaaccgttccgaccaccgtcatctcccattccaacccaattccgttcactcgactccgccggtaaaatcgaaatcctcgccggtcgaatggctctctggttcgaatacgcacctcttatctcttctctttacaccgatggtttcactcctccaaccatcgaagaactcaccggaatctcaagcatcgaacagaaccgtttaatcgtcggtgcgcaagttcgtgactcaattcttcaatctatccatgaaccggagctcatttctgcgttcgacaccggtggtgcagagcttctatacgaaattcgtctccttagcaccacgcagcgtgttgcagccgccacattcatcattgatcgtaatattgattcgaaaggagcacaggatttggcacgagccatcaaggattatcctaaccgtcgtggagacgttggatggttggattttgattacaacttaccaggagattgtctttcattcttgtattacaggcagagcagagagaataagaatccatcggatcagagaacctcgatgcttctacaagcattgggggttgcagaatcagaaaaggctaagaacaggttgaacacagagctatacggggacaaggaagcagagaaggagaaggagaagaagaagaaggaagaggaagtcaaagctattcggattccagtggtgaggcttaagtttggagaagtagcagaagcgacctcggtggtagttttaccggtttgtaaagcagaggaaggggaaaagaagattcttgaagctccaatggagatcatagccggaggggattttaaggtggttgaggcggagaaaggatggaagagatgggtagtgcttccgtcgtggaacccagtggcagccattgggaaaggcggtgtggcggtttctttcagggatgatagaaaagtgctgccttgggatggaaaggaggagcctttactggtagtggccgatagggtgaggaatgttgtggaggctgatgacgggtattatctcgtggtggctgagaacggacttaagctagagaaaggatcagatttgaaggcgagagaggtgaaggagagtttagggatggttgttttggtggtgaggccgccaagagaagatgatgatgattggcagacaagtcatcagaactgggactga

SEQ ID NO: 302 - DNA, 1476 bp, Arabidopsis thaliana
atgagcaatcttgaagaatctttgagatctctatcgttggatttcctgaacctactaatcaacggtcaagctttctccgacgtgactttcagcgttgaaggtcgtttagtccacgctcaccgttgtatcctcgccgcacggagtcttttcttccgcaaattcttttgtgggacagactcaccacaacctgtcacaggtatagacccgacccaacatgggtccgtacccgctagcccaacaagaggctccacggccccagctggaattataccagtgaactcagtcggttatgaggtttttctgttgctacttcagtttctttatagcggacaagtctccatcgtgccgcagaaacacgagcctagacctaattgtggcgagagaggatgttggcacactcattgctcagccgccgttgatcttgctcttgatactctcgccgcctctcgttacttcggcgtcgagcagctcgcattgctcacccagaaacaattggcaagcatggtggagaaagcctctatcgaagatgtgatgaaagttttaatagcatcaagaaagcaagacatgcatcaattatggaccacctgctctcacttagttgctaaatcaggtctcccaccagagattcttgccaagcatctccctattgacgtcgtcaccaaaatagaagagcttcgtcttaaatcttctatagctcgccgttctctaatgcctcacaaccaccaccatgatctcagcgtggctcaagacctagaagatcaaaagattagaaggatgagacgagctttggattcatcagacgtggaactagtgaagctgatggtaatgggagaaggactcaatcttgatgagtcgttagcattgcattacgctgttgaaagctgtagtagagaagttgtgaaggctttgcttgagcttggagctgccgatgtgaattatccggcgggtccggcagggaaaacacctttgcacatcgcggctgagatggtctctccagacatggtggctgttctgttagaccaccatgctgatcctaatgtgaggacagttggtggaatcacgcctcttgatatccttagaacattaacttcggatttcttgttcaagggggcagttcctggattgactcacattgaaccgaataaacttaggctttgcctcgagcttgttcaatccgctgcaatggtgatatctcgagaagaaggaaacaatagcaacaaccaaaacaatgataacaataccgggatttaccctcatatgaatgaggagcacaatagtggaagcagtggagggagcaataacaatttggattcaagattggtttatctcaatcttggagcaggtacgggtcagatgggtccaggtcgagatcaaggggatgaccataacagtcagagggaaggtatgagtcggcatcatcatcatcatcaagacccatctacaatgtatcatcaccatcatcaacatcacttctag

SEQ ID NO: 303 - DNA, 1761 bp, Arabidopsis thaliana
atggaaaaagatagtattatgtgcagtggaccaaagagcaatctctgctcttcaagaaccttaacagaaatcgaatcaaggcaaaaggaagaagaaacaatgcttctcctcgaattcgctgcttgtgatgatcttgactcgttcaagagagaggttgaagagaaagggcttgatttggatgagtcagggttatggtattgcagacgtgtcggttctaagaagatgggtcttgaagaaagaacacctttaatggttgcagctatgtatggaagcataaaggttttgactttcatcgtttccactggaaaatctgatgtgaacagagcttgtggtgaagagagagttactccgcttcactgtgctgttgctggctgttctgtgaatatgattgaagtcatcaatgtcttgcttgatgcttctgctttggttaactctgttgatgctaatgggaatcaacctttggatgtgtttgttcgagtttcgaggtttgtggctagtccgaggaggaaagcggttgagttgttgctgagaggaggaggtgttggaggattgatcgatgaggcggttgaagaagagatcaagattgtctctaagtatccagctgatgcttctttaccggatataaacgaaggggtttatggaagtgatgagtttaggatgtatagctttaaggttaagccatgttctagggcttattctcatgattggaccgagtgtgcttttgttcatccgggagaaaatgcgaggaggagagatccgaggaagtatccttacacttgtgtcccctgtcccgagttccgtaaaggatcatgcccgaaaggagattcttgcgagtatgctcacggggttttcgagtcgtggcttcaccccgcgcagtataaaacccggctttgtaaagatgaaacgggttgtgcaaggaaagtttgtttctttgctcataaacgcgaagagatgagacctgttaatgcttcaactggctctgccgtggctcagtctccgtttagcagcttggagatgatgccagggttgtctcctcttgcttattcttcaggagtttcgactcctccggtttctccaatggctaatggtgttccttcctctccaagaaacggcggatcatggcagaacagagtcaatacccttactccaccggctttgcagctcaatggtggaagcagattgaagtccacactgagcgctagagatatcgatatggagatggagatggaattgagactccgcggttttggcaacaatgtggaagagacgttcgggtcttatgtttcctctccaagtaggaattctcaaatgggtcaaaacatgaaccaacattatccatcttccccggtgagacaaccgccatctcaacacgggttcgaatcttcagcagctgcagcggttgcagtgatgaaagcgagatcaaccgcctttgcgaaacgtagcttgagcttcaaaccagctactcaagcagcaccacagtcgaatctctcggattggggatctccaaacgggaagctggaatggggaatgaaaggagaagagctgaataagatgagaagaagtgtttcctttggaatccatggaaacaacaacaataacgcagctagagactacagggacgagccagatgtgtcatgggttaactctttagttaaagacagtactgtggtgtctgagagaagctttggaatgaatgagagggttcggataatgtcgtgggctgagcaaatgtacagagagaaggagcagactgtggtgtaa

SEQ ID NO: 304 - DNA, 414 bp, Arabidopsis thaliana
tggctttcgagcggccgcccgggcaggtaacccacctttattaccattcaggtttcagaacctaggtgagatgatgactcttggaagatatcattctgctatatccccaagtttcattgaagggcttacccttgaagtttcaattggtcacgcagcgagaaaactggcgtatttgattagacttccaactgatgaaccccggtttaaggtcggaatcagttggtttgctaaatctgctgttgattcaattgctttacttcagagcaatctaaccaaggttttgtctggttcttgatctccgtttgttttgctttggagattaattcgcttccgtatgaaagacaaatggggagtgtccctttgtatcctttattggaatatccttgtattaaaaaaaaaaaaaaaaaaaaaaaa

SEQ ID NO: 305 - DNA, 768 bp, Arabidopsis thaliana
atggaaaacaaagagaccaagcaagaaccagcagcagcagctgagcaaaagaccgttccgttgatcgaagatgagatcgagaggagcaaagtcgggatcatgagagctctctgcgaccgacaagatcctgaaactaaggaggtggatgatctgatgataaggaggtttctgagagcgcgtgacctggacattgaaaaggcttcaacgatgtttctaaattacctgacttggaagagaagcatgctcccaaaggggcacataccagaagcagagattgcaaatgatctatcgcataacaagatgtgtatgcaaggtcatgacaagatgggtcgacctatcgctgttgccattgggaacagacataacccttccaaaggcaaccctgacgagttcaagcgttttgttgtctacacgctcgagaagatttgtgctagaatgccgagaggtcaagagaaattcgtagcaattggagatctgcaaggctggggatattctaattgtgacatccgtggctaccttgctgctctttccactttgcaggattgttacccagagagattagggaaactctatatagttcatgccccctacattttcatgaccgcatggaaggtcatttatccttttatcgacgccaacaccaagaaaaagattgttttcgtggagaacaagaaactcactccaacgctgcttgaagacatagacgaaagccaacttcccgacatctacggaggcaaattgccacttgttcctattcaggagacctga

SEQ ID NO: 306 - DNA, 1260 bp, Arabidopsis thaliana
atggcgcttcatctcgccagacgccaccaaaggttaccatcaaacacatctttgattcgatttttctccaattcctcatcggactcacctccccaattcacgaacgcaccggttgaaaaaccgtctcagtcaccatcttctccgtcaccgtcagactcttctccgatcttcgacatcaagaacactctgaaactgaaattacagaaccagcaggagcaaggaaggaaaccatttgacagatccgatgcacaatctcagaatcgcggatcgactagtttctcccaaaacttggggaagaatctcgccaagtttcagcggagatccaccgttccacctccgagggattcaggcggcgtacagcctccgtcttatatttccttagcgggcctctataagcagagcgctgcaacaaactcatcggatcctagaaattcgaaagctcagggtttcaattcaaacactgtaagtgaaactttaaagaatttgaggacgcagattaacacttcaaacaacatggggaagagaggaggggttttaggaagtttcaagagcactgtaggtgaagcattgccaaaatacctgttcgaaacacaaatggatgagagtaagggaagtgaaggtgaaacagaggaggcgatgacggagttcttaatgttttataacgaagaagaattaggtgagaaactaaggacgcttaggccagaaggagagaaaaaagaaggatggttctcattggaggagttgaatcagagattggttaagctaaggcaagttgaagagaaagaggcacaatatcggactaagaactttgcccaactcagaaatgttatttcatcatttaagaatgagaattctgaagctagttcccagcagaatgtcgccattatgggccatctcggtggtatccctgaatacaagcttcttcctccaaaagaggatctagttgacacttatttccacccagataacatgtcctctgcggagaagatgaaaattgagctctcgaaagtcagggaagagttcaagatgtcagaatcagactgtggttctgcacgtgtgcaagtggcacaactcactactaagatcaagcatttatcctcaagtttgcacaaaaaggacaagcattcgcggaagggacttttaggaatggtgcagaaacggaagaaactgttgaaatatctaagacgaactgactgggattcttactgccttgtcctgtcaaaactcagccttcgtgacaacccggattacaagtgctaa

SEQ ID NO: 307 - DNA, 936 bp, Arabidopsis thaliana
atggagactgaatacgaccaagttcttcgatccgttgctcaggtgaacatcgccgaccaaatcggagaatccgacgacgtagaaagagacggaaacggcgtaaaagtttcgtgcttcactgaagttttcgatgatgttactatccagttccagatcatccgtctcgcgaaacagatttacgtatgggtcggttgcaattccgccaaatttgggagtttgtacgcagccgcttcaacacgaccgagcaatacagtgagtgttacatcggtacttggtggaacatctgataacactggatctggcattgcgcgtagattagtgttgaagactggtctcaatataatactggcttgcaacatccctaaaaacaatcccttgcttgaggcaaaagctgagaaagtgttgattagaaagctgattgatcttggttacacaatgtcaaaacctgctaaacttgctctggaggctcttgaagttcccgtgggatgtgtttttcttgaggacggtaaggtcattgcttcagggcgaaaccgaacaaatgagacacgcaatgccacaagacatgcagagatggaagcaattgatcagcttgtcggacagtggcagaaagatggactctcaccttcacaagtcgctgagaaattctcgaaatgtgttctttatgtaacatgtgaaccttgcataatgtgtgcatcggccttatcgtttctcggtatcaaggaagtgtattatggatgtccaaatgataaatttgggggatgtggttccattttgtcgcttcacttaggtagtgaggaagctcaaagaggaaaaggatacaagtgcagaggaggaataatggcagaagaagctgtctctcttttcaaatgtttctatgagcaaggcaatcccaacggtaatagctctccctttaacttgtacacttctattccttga

SEQ ID NO: 308 - DNA, 1041 bp, Arabidopsis thaliana
atggctgcttgcgctactcactcctctctcatgctagcatacgccgccgcatccactcgttcccaggaccttacccctactccatctcttttctcttttgccagctccagacccaaccacttgagcttcccgcttcttctccttgggggttccagggaccggagatgtgctgctattgacagagcttccaaccacaagtttattgtctccgccgtggccgctgaggctgacctcgacacggaggaggacctggagcagaccgccaccgccgtccttgatccgcccaagcctaagaaaggaaaagccgctttggttctcaagagagatagaacaaggtctaagaggtttttggaaatccaaaagctaagggaaaccaaaaaggagtatgatgtcaacactgctatctctttgcttaaacaaactgccaacacaaggtttgttgagtctgttgaagcccatttccgtctcaacatcgatcctaagtacaatgaccagcagctgcgtgcaacggtgagcctgcctaagggaactggccagactgttatagtcgctgttcttgcacaaggtgagaaggttgatgaagccaaaagtgcaggggcagatattgtgggcagtgatgatttaatcgaacagattaaaggaggcttcatggagtttgacaagctgattgcatccccggatatgatggtcaaggttgctggcctgggaaagattcttggaccacgggggctcatgccaaatcccaaggctggtacagtcacagcgaacattccccaggctattgaagagttcaagaaggggaaagttgaattcagagcagacaaaactgggattgttcacattccatttgggaaagttaattttacagaggaagaccttctcataaacttccttgcagcagtgaaatcggtggagacaaacaagccaaagggagctaaaggagtgtactggaaaagcgctcacatatgctcgtcaatggggccttccatcaagttgaacataagagagatgatagacttcaagcctcccactgcgaactaa

SEQ ID NO: 309 - DNA, 426 bp, Arabidopsis thaliana
atggcgatgtctttatcaggagctgttctcagtggcatgggttcttctttccacaacgtaggagcaaagcagagtggtgttggtaccgtcagagttggccggaagagtgagctcgtcgtcgttgctcagcgcaagaagtcgttgatatacgccgttaaaagtgacggcaacatcctcgatgacctcaacgaagccacaaagaaagcttctgatttcgtgacggataagacgaaggaggccttggcggatggcgagaaaacaaaagactacattgttgagaaaaccattgaagccaatgaaactgcgactgaggaagctaagaaagctttggattatgtgactgagaaaggaaaagaagccggaaacaaggcggctgagttcgtagagggtaaagcagaagaggctaagaatgccacaaagtcctga

SEQ ID NO: 310 - DNA, 789 bp, Arabidopsis thaliana
atgggaggagaaggtggtgctgagcccgtaattcactttgtgtttgttcatggagccagtcacggagcttggtgttggtataaactcaccactcttctcgacgccgccgggttcaaatcaacctccgtagatctcaccggcgctggcatcagcctcatagactctaacatcgtcttcgactccgaccaatataaccgtcctctcttctctctcttgtccgatctccctcctcaccacaaagtcatactcgttggacatagcatcggtggaggaagtgtcaccgaagctctttgcaagttcactgacaaaatctccatggccatttacctcgcggcttccatggttcaacccggatccatcccttctccgcatctttcaaacatacatgtgggagaagaagatatatgggagtacacatatggtgaaggtaccgataaaccacccaccggagtcctcatgaaaccggagtttatacgccattattactatagccaaagccctcttgaggacgtaactttgtcatctaagctgttgcgtcctgctcctatgagggcctttcaagatcttgataagctacctccaaatcccgaggccgagaaagttcctcgagtttacatcaagactgctaaggataatctatttgattctgtgcgtcaagaccttttggtggagaattggccaccttctcagctgtatgtcttggaggatagtgaccattctgctttcttctctgtcccaactaccttattcgcgtatctcctccgtgcggtttcttttcttcaacgataa

SEQ ID NO: 311 - DNA, 708 bp, Arabidopsis thaliana
atggaggtgtttcatacggtctcagaattgtgtcctctgataactgggtggcgaatttatgtctttgtcgtgagagtcttcaagaaggttatatcgcccaacgtcttcgaactcggccttatcctggcagattacgagaataaccgtattgaggccaccgttgatcgtcgccttgctccgttttacgaagaccgattcgttgaaaatgagtggaagacgatcacctctttcttggtccgtaagtcaactgacttagtcagagcaacaaagcataaatacggcatactgtttatggatcggaccatcgtcgttcatgccccaccgagatcaccaccagttccagatttcgatttcactcccttcgactacattttggataaatctgcttacaagaacgttttagtcgatgtcattggagcgttggttgatgttggcgcattgactacagactattacggtctcaaactgagtttcaagttaaaagatagatacaatgaagtcttggagtgcgaagcccgcaatcaacaggcggagtacttggatggttactttcagagtttgggtaagggaaattttgttgtcgcactcagcttttggcgtctagccgaactgtctaacccgaagcttgagagccatggtgctatttcaaaggtggttgccaatccggacagagcagaagttgcggatatctcgatggtggttttttag

SEQ ID NO: 312 - DNA, 1059 bp, Arabidopsis thaliana
atgaagaatccgacactctttgctccaaaaagtccacactttttccagcctattcttcccggtttcaagagccacatcaaaatccctgtgaagttcttctccaagcatatagagggaaaacacgagggaaatactgtctatttgagatcatatccttcgaggagaacgtggaaagtgaagatggagggccataaactcactgaaggttggaaagagttcgtggaggcacatgatcttcgagtcggtgacttcgtcgtcttcaaacacaaaggagacatgttgttccatgtgactgctataggacccagttgctgtgaagtccaatacgcaccatctcgtagccacgacagaaacgaagagagtgatgaaattggggaatcttcaagaaatgagaaaattattgaggagaatgtgaaaacagaacctgatcagttttcaccagatctaacatgttttagccaatctgtgaccgcttcaaacctaacgagagatttagtgggtattcccagagatttcgcaaagcgatatggtttgaacataggtaggcatgagatagttttgatggacgaagaaggaaatacatgggaatcagaagttaaaagttacaagtctggtcgggtttttatagctggaggttggacaagtctctgcactgcaaataaattagaagttggagattcttgtacatttaaactgctccgcaacccgaaaattcccgtgtttcggctctgcagccgcccaaaggctggagcagaggctcggccacacaagagatctcgagtccaaagtagcagcggggggagtagacagaagcatgacgtgaggcagaagttagatgaagaaggagggccatctcgttgcactcggtcatctaacaaggctactggtgatcaagaaaagttgcagcaaacgcaatcttgctttatctttgatcatgtggctaaggtgaaacagagcgttgaagatactttaaatagtattagacggttccgggctaaactcgagacaaaggaacataatttggaagctttgttacaggaaacgaaaactaagttatga

SEQ ID NO: 313 - DNA, 990 bp, Arabidopsis thaliana
atggggaataagcgaaatctcggatttgtgatcttcttctgggctctggtggttgcagtagtagccacggccatcgagcatcgtcgcaatgagaggactaaaggcgtcaatggtcttgacaagatcatcatccgcgaccgtcgtggccgatctgctgaggtttacttgtatggaggtcaagtcagttcttggaaaaatgagaatggagaggagttacttgttatgagtagcaaggctatattccagcctccaacaccgattcgtggaggaattccagtattgtttccgcaatacagtaacaccggtccacttccctcacatggatttgtaagacagaggttctgggaggttgagactaaaccacctcctttgccatcactttctactgctcatgttgacctgatcgtaagatcatccaatgaggatttgaagatctggccgcataagtttgagtatagactgagagtagcattgggacatgatggagatttgacgttaacatctcgtgttaagaatactgatacaaaaccatttaacttcacatttgctcttcacccctacttcgctgtttccaatatcagtgaaatccatgtcgaaggattacacaacttggattaccttgaccaacaaaagaacagaacacgtttcactgatcatgagaaggttataactttcaatgctcaatccatcactaaaaaaaaacacaccttgcaaaaaaagcttgacaggttgtacctaagcactccagatcaactaagaatcgtggaccataagaaaaagaagactattgttgtacacaaggagggacaagttgatgccgtggtgtggaatccatgggataagaaagtatccgatttgggagttgaagactataagcgttttgtaacggtggaaagcgcggctgtcgcgaaaccgatcacagtgaaccccggcaaagaatggaaaggaatactccatgtttctgtggttccatcaaatcggaaagcttga

SEQ ID NO: 314 - DNA, 1242 bp, Arabidopsis thaliana
atgttcatttccgacaaatctcgtcctactgatttctacaaagacgatcatcacaattcctccaccaccagcaccacacgcgatatgatgatcgatgtactcaccactaccaacgaatcagtagatctacaatctcaccaccaccacaatcaccacaatcatcatctccaccaatctcagccacaacaacagattctcctcggagaaagcagtggagaagatcacgaagttaaagcaccaaagaaacgagcggagacatgggttcaagacgaaactcgtagcttaatcatgttccgtagaggtatggatggtttattcaatacatccaaatctaataaacatctctgggaacagatttcgtctaagatgagagaaaaagggtttgatcgatctccgactatgtgtactgataaatggaggaatctgttgaaagagtttaagaaagctaagcatcatgatagaggaaatggatcggcgaagatgtcgtattacaaagagattgaagatattcttagagagaggagcaaaaaagtgacaccaccacagtataataagagccctaatacaccacctacatcagccaaagttgattcctttatgcaatttactgataaaggttttgatgatacgagcatttcttttggatccgttgaagctaatggcaggccagccttaaaccttgaaaggcgtcttgatcatgatggtcatcctcttgcaatcactacagcagttgatgctgttgcagcaaatggagttactccttggaattggagagagactcctggaaacggtgatgatagtcatggtcagccttttggtggtagggtcataacagtgaaatttggtgactatacaagaagaatcggtgttgatggtagtgcagaagcaatcaaagaggtaatcagatctgcttttgggttaagaactcgaagggctttttggttagaagatgaagatcagattattcgctgtcttgaccgagacatgcccttagggaactatctactccgtctggatgatgtatgcaaaacccatcttgcaggactggccattagggtttgccattatgatgaatccaaccaattaccagtccattcagaagagaaaatcttctacactgaagaagactaccgcgagtttctggctcgacagggatggtcaagcctgcaagttgatggttttaggaacatagaaaacatggatgatcttcaacctggtgctgtgtatcgaggtgtgagatga

SEQ ID NO: 315 - DNA, 891 bp, Arabidopsis thaliana
atgagatcagtatcaccaccgcagcagtaccaacccaactcagctggtgagaattctgtcttgaacatgaacttgcccggaggtgagtctggaggcatgactggaactggaagtgagccagtgaaaaagaggagaggtagaccgaggaaatatgggcctgatagtggtgaaatgtcacttggtttgaatcctggagctccttctttcactgtcagccaacctagtagcggcggcgatggaggagagaagaagagaggaagacctcctggttcttctagcaaaaggctcaagcttcaagctttaggctcgactggaatcggatttacgcctcatgtacttaccgtgctggctggagaggatgtatcatccaagataatggcgttaactcataatggaccccgtgctgtgtgtgtcttgtctgcaaatggagccatctccaatgtgactctccgccagtctgccacatccggtggaactgttacatatgaggggagatttgagattctgtctttatcgggatctttccatttgctggagaacaatggtcaaagaagcaggacgggaggtctaagcgtgtcattatcaagtccggatggtaatgtcctcggtggcagtgtagctggtcttcttatagcagcatcacctgttcagattgttgttgggagtttcttaccagacggagaaaaagaaccaaaacagcatgtgggacaaatgggactgtcgtcacccgtattaccgcgtgtggccccaacgcaggtgctgatgactccaagtagcccacaatctcgaggcacaatgagtgagtcatcttgtggaggaggacatggaagccctattcatcagagcactggaggaccttacaataacaccattaacatgccctggaagtag

SEQ ID NO: 316 - DNA, 957 bp, Arabidopsis thaliana
atgcaggcaagtgaaacagagaacatcaagtatgaagagagtttcatcaagaacactcgaggaatgaaactgttcacgtgcaaatgggtaccagcaaagcaagagccaaaggctttagtctttatttgccatggatatgcaatggaatgtagcatcaccatgaacagtactgcgaggaggctggtgaaagcaggatttgcggtatatggaattgattacgaagggcatggaaaatctgatgggcttagtgcttatgtcccaaactttgaccatctcgttgatgatgtctctactcactacacaagcatttgcgagaaagaagagaataaagggaagatgaggttcttgttaggagaatcaatgggaggagcagtgcttttgttgttacacagaaagaagcctcagttttgggatggggctgtcttggttgctccaatgtgtaagattgctgaagaaatgaaaccaagccctttggtaatttcgatattggccaaacttagtggagtgataccttcgtggaaaatcatccctggccaagatatcattgagactgcttttaagcagccagaaatcaggaaacaggttagggaaaatccctactgctacaagggacgtccacgtttgaagactgcttatgagcttttgagggttagcaccgatctcgagaagaggcttaatgaggtttcattaccgttcatagttttgcacggtgaagacgataaagtcacagataaagcggtgagtcgacaactgtatgaagttgcatctagttcggacaagactttcaagttgtaccctgggatgtggcatggtttactctatggagagacaccagagaatatcgagactgtttttgctgacatcattggctggttggataagaaagttgctgatgaaagtggaggctttgaatccgagcttaaacgtaaaaatgatggtattcctttgaaagggtag

SEQ ID NO: 317 - DNA, 2139 bp, Arabidopsis thaliana
atggcttctaactcattactacgttcttcttcaaatttcttcttaggatcccatatcataatctcatctcccacccctaaaaccaccagaaaaccctctttccctttctccttcgtctcccgtgctaaataccaaatcactcgatcgtctcaagacgaaaattcgccaaatggtaaacccaattcgccattctcgtcgcaagtagccttagcagctattctactatcttcaatttcatcttcgccgctagctttagctgtagtggacgaaccagcttctccgtctgtcgttatagaatctcaagctgtgaagccatcgacgccatcgccattgttcattcagaacgagatacttaaggctcctagtcctaaatcatcggatctcccagaaggatcacagtggcgatacagcgagtttcttaacgctgtgaagaaagggaaagtcgagagagttagattcagcaaagatggttctgttgttcagcttactgccgtcgacaatcgccgtgcttcagtcatcgtccctaacgaccctgaccttattgatatcttggctatgaacggagttgatatatccgtctctgaaggagaatcctcaggcaatgacttgttcactgtcattggaaacttgattttcccgcttttggcctttggtggactcttcttgcttttcaggcgagctcagggaggccctggtggtggtcctggtggcttgggtggtcctatggatttcggacgttctaaatccaagttccaggaagtgcctgagactggtgtatcatttgcagatgttgctggggctgatcaagctaagttggagttacaggaagttgtggatttcttgaagaatcctgataagtacacagccttgggtgctaagattcctaaagggtgtttgcttgttggaccgcctggtacgggtaagacactcctggctagggcggtggctggggaagctggagtgccgttcttctcttgcgcggcctcggagttcgtagagctttttgtgggtgtgggtgcatcgagagttagggatttgttcgagaaggctaagtctaaagccccttgtattgtattcattgatgagattgacgctgtgggtaggcagagaggagctgggatgggaggaggaaatgatgagagagaacagactattaatcagctgttgacagagatggatggattttctggcaactctggtgtgatagttttggcagctacgaataggccggacgttcttgattcggctttgttgaggcctggaaggtttgatcgacaggtcacggtggataggcctgatgtggctggcagagtcaagattcttcaggttcattctagggggaaggcactcggtaaagatgtggactttgacaaggttgccagaaggacccctggtttcacgggtgctgacttacaaaacctgatgaatgaagcggcgattcttgcggctaggcgtgagcttaaggaaataagcaaggatgaaatctctgatgctcttgagaggatcattgctggacctgagaagaagaatgcagttgtctctgaagagaagaagagacttgttgcataccatgaggctggtcatgctctagtgggtgctcttatgccagaatatgatccggttgcaaagatttctatcattcctcgtggccaagctggtgggctcactttttttgctccaagcgaagaaagacttgagtctggattgtacagtaggagctaccttgagaatcaaatggctgttgcacttggcggaagggttgcagaggaggtgatctttggggatgagaatgtgacgactggagcatcaaatgatttcatgcaggtgtctcgtgtggcacgtcaaatgattgagagatttgggttcagcaaaaagattggacaagttgctgttggtggccctggtggaaatcccttcatgggtcaacaaaaagattactcaatggcaactgcggatattgtagatgctgaggtgcgagagttagttgagaaggcatacaagagagcaacggagatcataacaactcatattgatatcctacacaagcttgcacagctcctgatcgagaaagaaactgttgacggtgaagagttcatgagtctctttattgacggccaagctgagttgtatatttcttga

SEQ ID NO: 318 - DNA, 735 bp, Arabidopsis thaliana
atggatcaaacagtatcggaaaatctcattcaggtgaagaaagaatcaggcgggatcgccgtcatcacaatcaaccgtccgaaatctctcaattcactcacgagagcgatgatggttgatctcgccaaggcattcaaggatatggactccgacgaatcggtccaggtcgtgattttcaccggatcaggtcgatctttctgctctggcgttgatttgactgcggcggagtctgttttcaaaggagacgtgaaggatccggaaaccgacccggttgtgcagatggagcggttacgtaaaccgatcatcggagctattaacggttttgccatcaccgccgggtttgaactcgccttggcctgtgatattttggtcgcttctagaggagctaagttcatggatactcacgccaggtttgggatatttccttcatggggtttgtctcagaagctgtcgaggatcatcggagcaaacaaagctcgagaagtttctttaacatcgatgccactgacagcagacgtggctgggaagttagggtttgtaaaccatgtggttgaagaaggagaagcgttaaagaaagctagagaaatcgcagaggctataatcaagaatgaacaaggcatggttctgaggattaaatccgttatcaatgatggacttaagcttgatcttgggcatgctctcacactagaaaaggttaaacattctgccatttttaacttgttgatcaatttgtga

SEQ ID NO: 319 - DNA, 1593 bp, Arabidopsis thaliana
atgagagagctttttatgtatctatttcttcttttcttagttctatgtgtcaaatctgtttattctactccgacaagagaacaattccaaaattgcttgtccacaaaacaattcaattctaccctcaaaaaccctataaatctcaccactcatacactagattcccgagttcacaccgacttttccgagtcttcatctccaaattctagtttcctcaacttgaatttcacaagcttgaagccgattctcatcgttaagccaaaatccgaatccgaaataaaacaatcgattttatgcagcaggaaacttggagtgcaagtaagaacaatgagtggtggtcatgactacgaaggtctatcttacctctcactatcacctttcataatcgtcgacctcgttaacctcagatcaatcagcatcaacctcacagacgagaccgcttggatccaatcgggcgcaacactcggcgaagtctactacaagatcgccaaaaccagcaagatccatgcctttgccgcagggatatgtccaagtgttggtgttggtggacatattagcggaggaggattcggtacaataatgaggaaatacggtttagcgtctgataacgttgtggacgcacgtttgatggatgtaaatgggaaaactcttgaccggaaaacgatgggagaggatttgttttgggcgcttagaggcggtggagctgcgagttttggcgttgtcttgtcgtggaaggttaagcttgctagggttcctgaaaaggtaacttgtttcataagtcaacatccgatgggacctagcatgaacaagcttgttcatagatggcaatccataggatcagagctagacgaagatttattcatcagagtcattattgacaacagtctagaagggaatcaaagaaaagtgaaatcaacatttcaaactctatttcttggtggaatcgatagactgattcctctgatgaaccagaagtttccggaactcggcttacgatctcaagactgttcggaaatgagctggatcgaatcgataatgttcttcaactggagatcaggacagccgttagagattttgctcaacagagacctaagattcgaggatcagtatttcaaagcaaagtcagattatgttcaaaaacccgttcctgaaaacgttttcgaagaagtaaccaagagatttctcgagcaagatactccactgatgatctttgagccattgggtgggaaaatcagcaagatttcagaaacagaatctccatatccacacagaagaggtaatctgtataatatacagtacatggtgaaatggaaagtgaatgaagtcgaggagatgaacaaacatgtcaggtggatgagatcgttacacgattacatgactccgtatgtttctaaatcgccgagaggagcttatttgaattacagagatcttgatttgggctcgaccaaagggattaacacgagtttcgaagatgcaaggaaatggggtgagacttatttcaaaggtaatttcaagagattaggtttggttaaagggaagattgatccaacaaatttcttcaggaacgaacagagtattcctcctctgttttga

SEQ ID NO: 320 - DNA, 1644 bp, Arabidopsis thaliana
atgatgaagaatcttccggaggttggtaatggcggtggctcgggttttccggcggtctctgtcggaaataagaagaataagtatcagagaatggactccgacgcggaggaatcgcagaatcatcgtgaagcagaggctagaaacagtagaaccagaaaatacgttatggcttgtgccttttttgcatccttgaacaatgttcttctcggctacggtcggttttacttatataatcggattcttcttcttcttctttactttgttgacttacaaaaagatgttggggtaatgagcggtgcggtgttgttcatacagcaggatctcaaaataacggaggtgcagacggaagtgctcattggtagccttagcatcatctcactctttggcagcttagccggcggcagaacctctgactctatcggtagaaaatggaccatggccttggctgctctcgtcttccagactggtgctgccgtgatggctgtcgctccgtctttcgaggttttgatgatagggagaactttagccggcattgggattgggcttggtgtcatgatcgctcctgtctacatcgccgagatatcccccaccgtagctagaggatttttcacttcgttccctgagatcttcataaatctagggatcttgctgggctatgtttcgaactacgctttctcggggctttccgtgcatatcagctggaggatcatgcttgcagttgggattcttccttcggtgttcataggatttgcgctgtgtgtgatccctgagtcgccgaggtggctggtgatgaaaggccgagtggacagtgcacgagaggtgctcatgaaaacgaatgagcgagatgacgaagcggaagagcggcttgcagagatacaactggcggctgcacatacagaaggcagcgaggacaggcccgtgtggcgtgagcttcttagcccatctcctgttgtacggaaaatgctgattgttggatttggaatccagtgtttccagcagatcacaggaattgacgccacagtctactatagtccagagatcctgaaagaggctgggatacaagacgagaccaaactgctcgctgcaactgtcgctgttggtgtcacgaaaacagtgttcatactatttgccaccttcctgattgatagtgttggccggaaaccgctgctttatgtgagcacaataggaatgactctgtgtctcttttgtctaagctttacgctcacattcctcggccaaggaacgcttgggataaccttggcgcttctctttgtttgtggaaacgttgccttcttctccataggaatgggacctgtttgctgggtcttgacatcagagatctttccattacgattaagagcccaggcatctgcgcttggggcggttgggaacagggtgtgcagcggtctggtggccatgtccttcctctctgtgtcacgtgccatcactgttggaggaaccttcttcgttttctccctcgtgtctgcactctcagttatcttcgtgtatgtgctagtccccgagacaagcgggaagtcactggagcagatagagttgatgtttcagggtgggctggaaagaaaagacggtgaagttgagcttggagatgctgagcgtcttgtgcgcaaggaacaggagttttga

SEQ ID NO: 321 - DNA, 2208 bp, Arabidopsis thaliana
atgaagcccacgaccaatggtgggctcttggcttctcaatcatcttcctccttctcgtttccgagattccgcggccaacttccgattatcttctcagccaataataatcagaagaagaagaatcttccaaatccaaacgtcgtcactctttgtctccactctcattccaatgtctcctcctctcaaatcgccgtcactcgccgcgcaattctcgtcgcaccaccgctcctcgccgccgccgcttcgttgtttctctctatttcctcagctgcctctgctgagacttctgcggaatcagtagctcttcctcctgttgctactgctcctcctcctccgcctgtggagaaggaagaggcgataacttctagaatctatgacgcgtctgtgcttggtgagccgatggctgttgggaaagataagaagagagtgtgggagaagctattgaatgcgaggattgtctatctcggagaagcagaacaagtgcctacaagagacgacaaggttctcgagctcgaaatcgtgaggaatttgaggaagcgatgtattgagagcgatcgtcagttatctttagcattggaagcatttcctcttgatttgcaggaacagttaaaccaatacatggacaagaggatggatggagaggtattgaagtcgtatgtatcacattggccagtccaacgttggcaagagtatgagcctctcttaagttactgccgcgataacggagttaaactcattgcttgtggcactccgctcaaggttttaagaactgtccaagctgagggtatccgtggtctatcagagtctgagcgtaaattatacactcctcctgcgggttcagggtttatctcagggtttacttccttctcacgtagttcttcactcaatatgaatccactcacacagattgttccatttggaccgagttcttatttgtcggcacaagctagagttgttgaagaccatacaatgtctcaagttattgtacaagcagttgcagatggaggtggaactggtatgctggtagtggtgacaggggcaaaccatgttgagtatgggtcaaggggaacaggattgccggcaaggatctctaggaagattccgaagaaaagtcaacttgttgtgttacttgatcctgaaagacagtttttgcggaaagagggtgaatctccagttgctgatttcttgtggtattctgcggccagaccctgcagcagaaactgctttgaccgagcagaaatcgctcgggtaatgaatgcggctggtaggagacgagatgcccttccccaagacattcaaaaaggattagaccttggtctggtgtcacctgagattctgcagaatttctttgatttggagcaatatcctcttatttcagagcttacacaacggttccagggattccgagaaaggttgttggcagatcccaaattcttgaatagattagctattgaagaagctatatcaataacaacaacacttgtagctcaatatgagaagcggaaagaaaatttctttgaagaactcgactatgtgatcactgatagcgtaagagcatcagttgttgattttttcacagtttggctccctgcaccaaccttgtcttttatctcatatgctgatgagacaattgggccaaacagcatagatgccttaagaggcctcctagggtccatacctgacaatgcatttcaaaaaagtctaggtggacaagagtggactctgagtcttaggattgcttcagttattatcggtggcttgaagcttgctggtgttggagttgtttccagttttgcagctgtgggatcttcaaatgctttgtatgcaatacgaaaattcattaaaccagagttgggtgttggtgagcaagcaaagaggtctcctatgctgaagacggcccttgtgtatggaggttatctgggaacatcttcgaatatccgttatcagataattgctgggttaatagagcatcgcatttctgacgagctttcttctcaacctctacttgtaaacatgatttcatttgttgttcgagtagctaactcctactttggaactcagcaatggattgatcttgcgcgctctacgggtctgcaaactcagaaaagtgtcacaacttccaaccaaatccccgaggttgcgagccaatccacagtggaatacagtacaactgaagaggcaagtatggatgatcttaagaatcaatga

SEQ ID NO: 322 - DNA, 2493 bp, Arabidopsis thaliana
atgatcgcagacggatcagaagatgaagagaaatggctcgccgccggtgctgctgctttcaagcaaaacgcattttacatgcaacgcgctattgactcgaataatctgaaagatgctctcaagtattcggctcagatgctaagcgagttacggacttcgaagctatcacctcacaagtactatgatctatatatgagagcttttgatgaattgaggaaacttgagattttctttatggaagaaactcgtcgtggctgctcagtcattgaactctatgagctggttcagcatgctggtaacatattaccgcgtttgtatctcctatgtacagcaggatccgtgtatatcaaaaccaaggaagctcctgccaaggaaattcttaaagatcttgttgagatgtgccgtgggattcagcatcctctacgtggtctcttcttaagaagttaccttgcgcagattagtcgagataaattacctgacattggttctgagtatgaaggagatgctgatacagtcatagatgctgtggagtttgtactactgaactttactgagatgaataaactctgggtcagaatgcaacatcagggacctgctcgagaaaaggagagacgggagaaagagaggggcgagcttcgtgaccttgttggaaagaaccttcacgtgctgagtcagttagaaggtgtggaccttgatatgtacagagatacagttcttcctagagtcttagagcagattgtgaactgcagagatgagattgcccaatattacctaatagactgtataattcaagtttttcctgacgagtatcacttgcagactctagatgtacttcttggggcgtgtcctcaacttcaggcatcagttgacatcatgacagtgctttcccgtttaatggagaggctgtcaaattatgctgccttaaatgcggaagtattaccttatttcctgcaagtggaagctttctcaaagttgaataatgcaattggaaaggtgatagaagcacaagaagacatgcctattctgagtgcagtaaccctatattcctcccttctcaagtttactcttcacgttcaccctgatcggcttgattatgcggaccaagtgttgatttcaggttcatctttgtttatcattcttgtagcggatattggttcaggaatttatgtattattctgttatataaaacttcctactacgtatcttatacgaattttttgctggaatagggtacattggggatcatgtgttaagcaactgtccggaaaaggaaagattgatgacactcgtgcaacaaaggagcttgtctcgcttttaagtgctcccttagagaagtataatgatgttgtcaccgcccttaaactaactaactatcccctcgtggtggagtaccttgataccgaaacaaagagaataatggctactgttatagttcgaagcattatgaaaaacaatactcttattactacagcggagaaggttgaagcattgtttgaactgattaaaggaattatcaacgatttggatgagccgcaaggtcttgaggttgatgaagatgattttcaggaggagcagaattctgttgcgcttctcattcatatgttatataatgatgacccagaagagatgtttaagatagtcaatgtcctgaagaagcatttcctgacaggagggccaaagcgcttaaaattcaccattcctccccttgttgtttctactctaaagctaatcaggcgattgccagtggaaggagacaatccttttggaaaagaggcttccgttactgctactaaaatattccaatttctaaatcagattatcgaagcgctacctaatgttccatcacctgacctggcattccggttgtacttgcaatgtgctgaggctgcggataagtgtgatgaagaaccaattgcatacgaatttttcacccaggcatacatcttatacgaagaagaaatttcggactcaaaggcccaggtgactgcgttacaacttataattggaactctgcagaggatgcaagtatttggtgttgagaatagagatacattaacgcacaaggctacggggtatgcagcgaaacttctaaagaaacctgatcaatgtcgagctgtttatgcctgttctcatttgttctggctggaagatcgtgagaccatacaagatggagaaagggttctactttgtctgaaacgagcgcttaaaattgcaaattcggctcaacaagtggccaacacagctcggggtagtacagggtctgttaccctcttcatcgagatactaaacaagtacctctatttctatgagaaaggggttccacagataacagttgaatcagtagaaagcctgataaaactgatcaagaacgaagaatcgatgccctctgatccatctgctgaatcattctttgcaactacgcttgagttcatggagttccaaaagcagaaagagggtgccattggtgagagataccaggcgatcaaagtatag

SEQ ID NO: 323 - DNA, 603 bp, Arabidopsis thaliana
atgtcttggaaaggagcccgaggaaaaccaaaaggctatggcggcgattatggcaagcctgagccttttgtgattttccctgaaattacgttaccagatccaaaatcaatctcaacagactcgcaattagttcaaagctactttactttcaataagttttggaggaattctccttatcacttaggcgatggtggtgtttctaagaaagagaaagagagtttgaacattgagaggtactcagattcgttgaagccgaagatgaagtctaataagaatggatctttctttgattttcttgttcttagacctgataacttccctaaagaacttcttggagatactcgaagagaacaacggcctgtgaagagagctaaatggagtcaagaagctgatttgcagaaattggatgtgtttgagaagcttgaagctaagtttaaggttgaaggcaaggaagagaaagaagaaggggaagatgatgaagaagttgtggaatcagaaggagaagaatctgataacggagattatgatcagaatcaagactttgatgatgatgacgacgattataataacgaggatgatggattagttgaagaggtgtattaa

SEQ ID NO: 324 - DNA, 360 bp, Arabidopsis thaliana
atgggagtattcacattcgtatgcaagaatggaggcggcgcgtggagcgcgaagcaacacgaaggagaacttgaatcttcagcttcttctacctacgagctccagcgtaagctcgttcaggtatctctctccgctgattcctccggtggcgttcagtcttcgttttctcttgtctcccctacctccgccgtattccaggtaattgttggtggtggtggtggtggaggattctctgctggaggagctgcctcaagtggaggtggtgcgggtgaagctgcagctgcccctaaggaagatgagaagaagaaagaagaatcagaagaggaagaaggagacttcggattcgatctctttggttaa

SEQ ID NO: 325 - DNA, 927 bp, Arabidopsis thaliana
atggagaagagtttccaaaggtctgctctccttgtgactttgtctctcttcttcttctccattccggtttcactctctgttccattcgttctgtttcacgggtttggaggtgaatgctccaatgacaaagtgagcaacttaacacagttcctcatcaaccactccggctaccctggaacttgcgtagaaataggagatggagtgaaagattccttattcatgccgcttaggcaacaagccagcatagcttgtgagaaaattaaacagatgccagagctgagtgaaggttacaacatagtggcagagtctcaaggaaacttggtcgctagaggcctaatcgagttttgcgataatgctccaccagtcatcaactatgtctccttaggaggacctcatgctggcgtcgctgcaatccccgaggggtgtgattcagcattttgcatactcatgaaggcgttttttgcagtgatttacagcgattttgctcaagatcatactgctccaagtggttatgtcaaaaaacctatggaaataaaaaattatttggaacactccaagtatctgccaaagctaaacaacgagagacctggcgagaaaaactccacttttaaagaccgtttcaccagcttgcaaaacttggttctcatcatgttccagaatgatacaatattggttccaagagaaacttcttggttcggatattacccggatggagcttcatcttcaacacctgttttgcctcctcaaaagacaaagctatacactgaggattggattggtctgaaaaccttggatgatgctggaaaagtgaggtttattagtgtccctggcggacacatcgaaataacggaagaagaccttgtcaaatacgttgtgccttacctccagaatgagtctttgttctcttctgaacacgagacaatatag

SEQ ID NO: 326 - DNA, 1587 bp, Arabidopsis thaliana
atggcggatagaggagctctttcgttaccgcgagcttctacttatcttagtttctcaaacctccatgtctggcgattccacaaccctagatcttatcctccctctcgttctcaactcctctgtttctcttcctcatgctctagagtaacttcggcgaagataattcagctgaaccgccggagattcagctataaaatatgcgccgccgctgatgacggtaggggataccgtttgacggaaaggggaaaaaggggaaggaagcggcgggagctatgggaagaactttttgaagataatgttgaagacgatgatgatgaagatgatggtggtggtggaattggtagtgctaattttgacctgtggaagatcttagaggaaattgtagataatgtttggattttaaaggcattcaaatcgtatggatatctcctcccattcatcatcttatcgcttttcttcagcaccggacccaaagctttcctcgtgtcactagccgtagcaatcgggccatcattgttattttatgcgttccagaagttgattggttgggataaacgcagaggtacatcaatagcaaatcaattcgggatagaggaagaagaagaagaagtggagagaagtagtagcaggattcgatacaacccatcaaccgttagaaacaatgtcaatggccgtggagttaaccgtagttcagctggaatggcttctaagtttggtgggtgggacgagttagacgggcttggtaccaccattcccgaacggccaacaagcgaaccgaagaagaaaccgttaccgaagaggaagagagtaagaagagaaaaggcagcagaaccattattgttgagattgttggtgtctttgtttccattcttaagcacatacacaaacatgctcaaaccttcttgttcgatttccatggcgaatttaacgacgaacgctaaaactcgcctgagaggtgttgtattcgatatggacggaaccctgactgttccggtcatcgatttcgccgcaatgtatagagctgttcttggtgaagatgcttacaagcgaatcaaagcagagagccctagtgggattgatattctgcatcatattgagtcgtggagtcctgataaacagcagaaggcgtatgaaatcattgctgattatgagaaacaaggaatagataagcttcaaatcatgcctgataacttgactgttgttacattttgtattttactttataggagggggctaattacacgcaatgttcaaaaggcaatcgacatcttccatcaacgttttgaggttatcttttctccagcactaggcagagagtttcgtccatataaaccaaacccagacccgctgttgcatatatgttctacatgggacatccaacctaatgaagtcatgatggttggtgacagcttaaaagatgatatagcatgtgggaaacgagctggagccttcacttgcttgctagatgaaaccggaaggtatggaccagacgatttttctgtttccggtctgcaacctgattttaaggttgattccttgtccaaaatccagaacctattggagacgaacttcgacctgaacccgtag

SEQ ID NO: 327 - DNA, 4986 bp, Arabidopsis thaliana
atgtctgtactgtgtctatgctggtcatttcattttgaactattttcctccattgagggttgccattttttatgtttgctttgcttacaatgcagatctcaatcaagtttagctttttggcgcgtggataattctgttggcagtttcttacctgcggatccctctacgctcaacttattaggaagaccctatgagctacgccacatattatttggatccactgcagtcttgccaaaagaatccagctacgtggatgatcgtactactcctgatgatattattcagcccacacggccacagccactgaattctgttaactctggtcatcgatttgaagctgttgccacctttgagttgatatggtggaataggggctcaggctcgcagaaaaaagtttcaatatggcgaccaatcgtttctgaagggatggcttattttggagatattgctgttagtgggtatgaacctccaaactcttgtgtggttcttcatgatactagcgatcaagagatcctcaaagccgctgttgatttccaacttgttggacgtgtcaagaaacacaggggagtagaaagtatatctttctggatgcctcaggctccaccgggttttgtttctttgggttgtgttgcatgtaaaggctcaccgaaaccatatgatttcaccaaattaagatgcgctcgtagcgatatggtagctggtgatcattttgcggatgaaagtttgtgggatacctctgatgtctggcagagggtagaaccatttagtatatggagcatagggaatgagttgaagacctttattgtccgtagtggtttgaaaaaaccaccaaggagatttgctttaaagctagcagaccagggtttgcctgggggaactgataacatggtcattcatgcagaaattgggactttttctgctgcgctatttgatgactatgggggactgatggttccattggttaacgtatctttgaacaatataagttttggattacttggcaaaaccgactacacaaattcaaccatcaacttctccttagcggccaggtcatataatgataagtatgaagcatgggagcctctcattgagcctgcagacggattcttaaggtaccagttcaaccctagatcctttggtgcggtttctcagttgcgcttgacatctacaaaggacttgaacgtgaacatctcagtttcgaatgctaatacaattatccaagcgtattctagttggaacagccttagcaatgtccatggataccataaagagagagtgagaacttttcttttggtccttctgtgccactcccttggtgaagcagaggcttattcagctttaccttctcttttgaagaagtcacgttttctttctctcttgatttacacttgctattttttacagggagcacttcctctagttgacaatggaaaatctgtcattgaggtgcatcagaagaaaaactatttcataattccacaaaacaaacttgggcaagatatatatattagagccaccgaaatcaaaggatttaaggatattgtaaagatgccatctggggacgtcagacctgtaaaagttcccgtcttgaccaatatgttggattctcacctcagaggagaactatgcagaaatcctagaatcatggttacagttattgtgatggatgcacagcttccaagaacttgtggattgtcttcgcatcaatacacaggagtcatacgcctgtctcccaatcagacctcccctgttgaatcagagcttcgtcagcaaagtgcacgtacttgtggaagtgtttcaaatatgttgtcctctgagctagaagtggtcgactggaatgaaatattttttttcagaatcgactccctggatgactttgtcttggaattaatagtgacagacgtcggaaaaggtgcccctgttgggagtttttcagctcctctaaaacagatagcacaatatatgaaggacaacgtataccagcacaattatgctaatgaccttgtctgcattaaccaaggggatcaaagaaagaactgcggaaaaataagatgtgctgtactgttgccagctaagtcgaaagtggaccaaagcaaatccttcagagaaaaaaaatctggatttcttcaagtaagtcctagcattgagggtccttggacgacagttaggctgaattatgctgctcctgctgcttgctggaggttgggaaatgatgtggttgcaagtgaagttagtatgcaggatggaaacagatacgtaaatgtcaggtctctagtttcggtggagaacaatactgactttctacttgacctctgcctgcagtctaaagtaaattcaattccagatattccaattgggttactgaaacctggtgatacgttaccggttcccttatcaggattgacacagtcggcatcttatgttctgaaactgaagtgtgtatttcctgatgggtcggatgagtattcttggagttctgtggtttcgaggcctgggggggcagaggtttcttgtgaatcagagcctgaaatatgtatatcggctctaactgaatccgagcacttgctattttgtactcagataaacagtacttcttccggagataatcaaaagttgtggttctgtttgaagacccaagcaacagaaattgcaaaggatatacgttcggaccctattcaagactggacccttgtggtcaaatcaccgttttctatagcaaattgtcttccatttggagctgagtactcagtgttagaggcgcaagctagtggtcattttatttgtcgctgtagaggtgtctttatttctggggaaactgtcaaggtgtatagtgttgatataagaaaccctttatacttttctttgcttccacaaagaggatggctaccaatgcatgtaaggaagaagcaaacaagaaaagttggtcttccctttcgaagtaaaaagaatgatgaagtagtcctagatgaggtaaccgaagaagaaatatatgaaggtcatacaattgcttctactttgaatttcaaacttctgggcctgtcagtgtctatatctcagtttggcaatcagcaacatggtcctgtcaaagatctttctgctctgggtgacatggatggatctttggatgtggatgcgtatgatcccgatggaaattgcatgcggctatttttatctacaaaaccttgtgcttaccagtcggttcctacaaaggtccggttaagagaaacagagtggtcatttcccgttcaagttacccgagaggacacaattgttcttgtattaaagagtaaaaatggtgcacggagatatgtgaaagcagagatacggggatttgaagagggatcacgttttatagttgtatttcgactaggaccaagcaacggtcctatgaggtatcttctctacaagcgacagacatccatgcttgtgaaacaatcactaatttcctcttctttttctgtgaaaacttttcaaaccagggttgaaaatagatcaactgtcaaaagcatcagtgttcggcaatctggtttgggtgaagattcgtgggttttgttggaacctcttacaacagaaaattttgcatgggaagatccttatggtcaaaagttcttggatgctaaggttgaaagtgatcaccgctctggggtattcaaagtagacatggaaaaaggtgctgtggattctgaattgtgtagggagttagaagtgaactttgatgttcaagaaattggtgacatcaagattgctagattcaccgatgatgacagtacttcacagagttctaacgaaatcatatctttgacatcgattggaaatcatggatattctactcctcagacacctacagaacacaagaccaccactctggaggtcataattgaaatgggactagtggggatctctcttgtagatcacatgcctaaagagttatcatatttttaccttgaaagagtatttgtatcttactccactgggtatgatgagggaagaactagcaggttcaaaatcattctgggtcgtttacagattgataaccagctacctctaactttaatgccagtactattggcaccagataacactggagatagtcgtcaaccagtgcttaagatgacaattacaatgtgtaacgaagaaactgatggcattcaagtgtatccatatgtgtatgtacgggtaacagataatacctggcgactaaacattcacgagcctatcatttgggcttcagctgacttctacaataagcttcagatggaccgtctccccaaaagttctagtgtcgcgcaagttgatcctgagatacatataaacctcatagatgtttcggaggtaaggctaaaggtctcactagaaacagcgccagctcagaggcctcatggaattcttggtgtttggagccccattttgtccgctgttggaaatgctttcaaaattcaggtggttgattttcctttgaagttactcccatttatgaaatggaatactcaacattggcctctcttagcaaagggtttgccgagctttcaactgatggtcaattcatgcaactacgggctaaacagtttgctcaaaagaggtgtgaatatgaatcaggtttggtcgaggcggatcaccggtgtaggtgatgcaattgttcaaggaacagaagccctggcacaaggtgttgcctttggggtttcaggagttgttacaaagcctgtagagagcgcccgagaaaatggtattctagggtttgcccatggggtaggacgggcgttcctaggatttattgtacaaccagtgagtggtgcattagattttttctcattgactgttgatggaattggagcaagttgtagcagatgtttggaggttttgagcaacaggaccgccttggaaagaattagaaatcctcgtgctgttcatgctgatggtatactcagggaatatgatgagaaggaagctataggccaggtactggctcagcttatttttcttgtctga

SEQ ID NO: 328 - DNA, 1653 bp, Arabidopsis thaliana
atgtggcacgaagcgagaagatcggagaagaaggttcacgatatgatggacgctgctcggaaaagagcacagcggcgagctatttacttagctaaacgccgtggagatcctattcagtcgattcaagccgttggttcccgctaccgagtattccgtgatgatggtctttaccaagccaccgaagatcaacagggcttatttgatggtcgtgctcttctggattttgtgcgtgaggctggttcgagaagtgtacgtccacataagaaaacggaagaggaagaagaacttgaagagtttgttaattttgagcgttatcgggatttgattaagcatcggcgtagaggatgtcgaacacaaccagctcaaccacctgcaaacaaaggcacatattcgcaggttggattttcttatgctggaaatggcaaagataattcattggatgcggacgaagatgatgttgatgacgacgaggatgatgaggatgaagaggaagaatttgacagtaatgacagtgatgatgaaggaatggaaacaattgcgaaacagtttggtattaagcgatatgggtggcttgtttatatggacaagaaggcaaaagaggaagagaaaaggcaaaaggaactcatcaaaggcgatccttcaattaagaaactaagtcgcaaggagagaagaaaagtttctaggatagagagggatagagaaagggaaacttcaaggagtgtcggaaggcaaataattcatcatgatccatacagatcaagatccagatcccgctcatattctccatcatactcaaggagaaatgggcgtggagaccattctgatgaaatcagcaaaccaaaaatcgaatatattacggaatttggaggaggctctggagatatgagaagtccaaagtttgaaggatattccccaccgcgttcaccaccatctcagtctgatctattaagccgaccatcgccaggccgtattcttgaggcgctgcatgttgatcctgcatctgatatatcccttgagaaagacaaagttgccaaaccagcaaaatcgacagtgagtacttccacagcactagcgaagctttcaaaagtagcaggtacctcctcttcgaagcagtcacaagcagagaagaaagaaactccccaagaacgactgaagagaatcatgaacaaacagctaacgaagcaaattaagaaagactctgcaacagaaacggctaagaaacgagaacaggagcgacaaaggctggagaaactagcggaaacaagccggttaagtcggaataggcagcgcagccgtaaagacacaggcgaagcagaagcagaagcggaagcaggagcaggagatcacgcaggcacagttcaaggtcacggtctaggtccccatctaggtcgttatcacgctctccgaaacgtcacgcagacgctctccatcttattcgaggtctcccaggcgaagaagcagcaggtcaaggcactgaagagaggaaactctaattgttgcggcagctttttttgttgcctctgttcattttttttttttttctgtgtgttttcgtatccttacgattcagtggtaaaatatggttttgtgggtttacatgggataataacaacgttttcatatgatgttttagaaatttataagatgttataa

SEQ ID NO: 329 - DNA, 969 bp, Arabidopsis thaliana
atgttggcgtcggtacgggtgaatcagctgcaaagacttcttctctctgctcgtcgattatcttcttcaccaataatacctccgtcgcgtttacttcaccagcggctattctcgacttcagacactgatgcttcggctgcatctttttcttcttcgcatccgaaaatacaaacgcttgaaggcaaagcttctaataaaagccgaagcacatcgtcaacaacatctttgaatgaagatgaacttgccaaattctctgccattgctgatacctggtggcattctgaaggaccctttaaaccgttgcatcaaatgaatccaactcggttggctttcatccgctcgaccttatgcaggcacttcagtaaggatccgagttctgctaagccttttgaaggactgaaatttatcgatataggttgcggtggcggactactttctgagcctctagcacggatgggagcaactgtcacaggagttgatgctgttgataagaatgtcaaaattgctcgtcttcacgctgatatggatccagtgacttcaacgattgaatacttatgtactacagcagaaaagctagcggatgaaggcaggaagtttgatgctgttctttctttagaggtcatcgagcatgtagcaaaccctgcagagttctgtaagtcgttgtcagcattgactatccccaacggggctacagtactttctacaatcaatcgcactatgcgagcatatgcatcaaccattgttggagcagagtacattctacgttggcttcctaaaggcacacaccagtggtcaagttttgtaactcctgaagaaatgagtatgatattacaacgtgcttcagtcgatgtgaaagagatagctggatttgtgtacaacccaataacaggaagatggttattgtcagatgatattagtgtcaactatattgcttatgggacgaaaaggaaggatcttggagacatataa

SEQ ID NO: 330 - DNA, 2088 bp, Arabidopsis thaliana
atgaagagagggaaagatgaggagaagatattggaacctatgtttcctcggcttcatgtgaatgatgcagataaaggagggcctagagctcctcctagaaacaagatggctctttatgagcagcttagtattccttctcagaggtttggtgatcatggaacgatgaattctcgtagtaacaacacaagcactttggttcatcctggaccatctagtcagccttgtggtgtggaaagaaacttatctgtccagcatcttgattcttcagccgcaaaccaagcaactgagaagtttgtctcccaaatgtccttcatggaaaatgtgagatcttcggcacagcatgatcagaggaaaatggtgagagaggaagaagattttgcagttccagtatatattaactcaagaagatctcagtctcatggcagaaccaagagtggtattgagaaggaaaaacacaccccaatggtggcacctagctctcatcactccattcgatttcaagaagtgaatcagacaggctcaaagcaaaacgtatgtttggctacttgttcaaaacctgaagttagggatcaggtcaaggcgaatgcaaggtcaggtggctttgtaatctctttagatgtatcagtcacagaggagattgatctcgaaaaatcagcatcaagtcatgatagagtaaatgattataatgcttccttgagacaagagtctagaaatcggttataccgagatggtggcaaaactcgtctgaaggacactgataatggagctgaatctcacttggcaacggaaaatcattcacaagagggtcatggcagtcctgaagacattgataatgatcgtgaatacagcaaaagcagagcatgcgcctctctgcagcagataaatgaagaggcaagtgatgacgtttctgatgattcgatggtggattctatatccagcatagatgtctctcccgatgatgttgtgggtatattaggtcaaaaacgtttctggagagcaaggaaagccattgccaatcaacaaagagtatttgctgttcaactatttgagttgcacagactgattaaggttcaaaaacttattgctgcatcaccggatctcttgctcgatgagatcagttttcttggaaaagtttctgctaaaagctatccagtgaagaagctccttccatcagaatttctggtaaagcctcctctaccacatgttgtcgtcaaacaaaggggtgactcggagaagactgaccaacataaaatggaaagctcagctgagaacgtagttgggaggttgtcaaatcaaggtcatcatcaacaatccaactacatgccttttgcaaacaacccaccggcttcaccggctccaaatggatattgctttcctcctcagcctcctccttcaggaaatcatcagcaatggttgatccctgtaatgtctccctcggaaggactgatatacaagcctcacccaggtatggcacacacggggcattatggaggatattatggtcattatatgcctacaccaatggtaatgcctcaatatcaccccggcatgggattcccacctcctggtaatggctacttccctccatatggaatgatgcccaccataatgaacccatattgttcaagccaacaacaacaacaacaacaacccaatgagcaaatgaaccagtttggacatcctggaaatcttcagaacacccaacaacaacaacagagatctgataatgaacctgctccacagcaacagcaacagccaacaaagtcttatccgcgagcaagaaagagcaggcaagggagcacaggaagcagtccaagtgggccacagggaatctctggtagcaagtcctttcggccattcgcagccgttgatgaggacagcaacatcaacaatgcacctgagcaaacgatgacaacaaccacaacgacgacaagaacaactgttactcagacaacaagagatgggggaggagtgacgagagtgataaaggtggtacctcacaacgcaaagctcgcgagtgagaatgctgccagaattttccagtcaatacaagaagaacgtaaacgctatgactcctctaagccttaa

SEQ ID NO: 331 - DNA, 750 bp, Arabidopsis thaliana
atgggaagagcaccatgttgtgagaaaatgggggtgaagagaggaccatggactcctgaagaagatcaaatcttgatcaattatattcatctttatggtcattctaattggcgagctctcccaaaacacgcaggtttacttagatgtgggaaaagttgcagacttcgttggatcaattatcttagaccagacattaaacgtggcaatttcactcctcaagaagaacaaactattatcaatctgcatgaaagcttaggcaacagatggtctgcgattgctgcaaaattgccgggacgaaccgacaatgaaataaaaaatgtttggcacactcatttgaagaaaagactcagcaaaaatctaaacaatggcggagacaccaaagacgttaacggaattaacgagaccacaaatgaagacaaaggatctgtgatagtcgacacagcctctttacaacaattttctaatagtattacaacatttgatatttcaaatgataacaaggacgatattatgtcgtacgaggatatttctgccttgatagatgatagtttttggtcggacgtcatatcggtagataattcgaataagaatgagaagaagatagaggattgggaaggattgatcgatagaaatagtaaaaaatgtagctatagtaattctaagttgtataatgatgacatggagttttggtttgatgttttcactagtaatcgtagaattgaggaattttccgacatacccgagttttaa

SEQ ID NO: 332 - DNA, 342 bp, Arabidopsis thaliana
atggacaaaatcagatgcagaccaaaagggtttgcttatgtcacattctcatctaaagaagaagccgagaaagctttattagaactcaacgcccagttggttgacgggcgggtcgtgatccttgacacaacaaaagctgcaaaacacaatccaccagacaccaagccaaatcatgcaggtgaaaaccttcaaaccagtttcgaggttatttggatttggggagttagttgtatcgaacacctagagttaggagctttgagtcatcatagaccagttttgcgttttgcgtttgatcatgtatacaagtcacgtgacttgagagtctttgagtcttttggatga

SEQ ID NO: 333 - DNA, 1095 bp, Arabidopsis thaliana
atggcgaggggaggaggagaatggaccggagggatcgccggaaccggagttctctctttcaaaagaatcactctacttgtttgctttttcaacattctcattgctctctttgttcttcgctttctctatgcttcttctctccacatctattccaataacgataatgttgttaagtacacagctgatgagattaggaaaatggaggaatctattcggattcgaagatcgaaggaacctactctgattcttcaattggtgaagaagctcaagcatgaggtttccactgcagaatctagtactgaactatctcctaatgttaaacacaaactagttgatgagatcctccagcgtttgaaaagctttgaggacaaatctaatgttactcagcttagagaagttgtagaaacgtggcgcaatgagaagctggaggaagctaaagagctaattcaagggcaaaatggagtaaattccacccttatagtggaggaagcagggatgcttgtaagagctttggagttggagtgggatgtgctgtctgaagaaatcggtttctggttacctgctgaggttaccaatgtagaacatgatgataaacctgaaggagaggaagagcctgaggaaatattggcaggcagaccagtgccagctgtatgtaatgcagagcttcacacagattatggtggtgctgcagtgagatgggggcttacacatcataaagagagtgcagctgattgttgccaggcttgcttagaccaggcaaagcgtgcgaaacctggagaaacgagatgcaatatttgggtttattgcccatctgagtttggttgtttctctccagatatttatgagcataaacatcaggagtgttggcttaaatacgtaagaacttacctcgtacacatactactttacccaattttcagtttccttgagattactcgtccaagttggactggaagcttggctcatatccaatatgtctatgtgaattgcaggcagagaagccaaaacagaatttcaaagacagatattctgagacatacagaaacaaccacccaaaagcgccatctatcgttccatgggtttcaggtgttgtaa

SEQ ID NO: 334 - DNA, 555 bp, Arabidopsis thaliana
atggcaaaccaaatctacttattctccttgatctgcttgtctgttttactttgccaatcatatacggtctcatctttccaaaaatcactagacctagcgaaaccatgcaagcgtttcgtcctccacctccatgacattgcgtacgatggtgataacgcggctaatgcaacgtcagcagcaattgtgaatcctttaggactaggagacttcagttttgggaagtttgtgattatggacgaccctgtgacaatggaccagaactatctctcgaaacccgtggctcgtgttcaaggcttcttctgctaccacggtaaggcaacatacgacgcttggatcgcttggacagtggtattcaactcaacacaacacaaaggggcattcaccataatgggtgaaaatccgtttatggagccgactagagacctaccgatcgttggtgggactggtgacttcatcatgactcgagggatcgctacgttaacgaccgatcacattgacggcagtaagtatttccgcgtcaagcttgatattaagctctacgaatgttaccattag

SEQ ID NO: 335 - DNA, 1299 bp, Arabidopsis thaliana
atggcttcttcttctctacctctttctcttccgtttccactccgatctcttactagtaccactcgatctctaccatttcaatgttctcctctctttttctctattccttcttcaatcgtttgcttctccactcaaaatcccgaccgcgaagaggtccggtggctccgggaagagcagagatggattcgcgaggagcaacgatggattcgtgaagaacagagatggatacgcgaacgtgaatcgcttctacaagagatttcggatctacagctcagaattcaatccctagagtcacgaaattcgcaattggggaattctattcccgatacgatttcgaatatcgctgctttgcttcaggttttgaaggagaagaatcggatttctgagagtggattgagcgcaacgccgatggtattggagagtacgagagaacaaattgttgaggaggtggaagaagaagagaagcgagtgattattgctgaagagaaagttagggtttcggagccggtgaagaagatcaagaggaggatattgaaagttggaagcgaaggcgacgatgttcaagctttgcaggaagctctgttgaaattaggattctattcgggcgaagaggatatggagttctcgagcttttcaagtgggactgcaagtgctgttaagacttggcaagcatcgcttggggtccgtgaggatggggtaatgacagcagagcttcttcagaggttgttcatggatgaagacgtagagacagataaggatgaagcaagtacaatgaagaaagaggtaaaaactgaaaccactaactacagctcagagaacttggaacatgaatattctgaaatttctcttaatttgcttaatacacctgttaagactggttctttatactggatctttcttttaattccattgattaaggaagctggtaatggggcggtatttacttcagtgacacaagtccctgagaagaagcaatcaatcgtgaaagatcaaagtgacagagaagttgacgttactcaaaatcgggtttttcttcttggagaaaacagatgggaagatccctccaggctcattggcaggaacaaaccggtagacagaagtgaatcaacaaacaccaaaacgaggtgcatcacttgtcgaggggagggtcgattgatgtgcctagagtgcgatggaaccggtgagccaaacattgagccgcagttcatggagtgggttggtgaagatacgaagtgtccgtactgtgaaggtcttggctatacagtttgcgatgtctgcgacggcaaaaaaaacttataa

SEQ ID NO: 336 - DNA, 816 bp, Arabidopsis thaliana
atggacaacgaaggcataggtctttacccgcttcatcgttgcaaaaccattcacctggtgagacatgctcaagggattcataatgtggctggtgaaaaagatcacagtgcttactcttcggaggattactttgatgctcatcttacccctcttggttggcaacaggttgataatctaaggaaccatgttcgtgcagctcaactcttaaacaaggttgaacttgtcattgtttcccctatgcttagaactatacaaacagctgttggtgcttttggaggagaagaagatactaatggagcggatgcaacaccgttaatggtggctaatgctgggagcagcgatcgtcctgcgatttctagcttaaatagtcctcctttccttgctgttgagctttgcagggaaactatgggtgatcatccttgtgacaggcgaagaagcgtcactgagtacaaggctctctttcccgctattgatttctcaattattgaaaccgacaatgatgttctgtggaagccgagtccaagagagagccttgaagaagttgcagccagaggtgtagagttcatcaaatggatatggacaaggaaagagaaggagatcgcaattgtatctcacagtggcttcttgcacggtctcttgagttctttcgggaaggattgttgcgatgacctaaagaaagagttgtctatacatttgagcaactgtgagcttcgctcaatggttatcgtggatcgagggaacctggggactgactctgcagagaccacaaactatcctgggaaggttcctgaaggacttgataatcctagtggctaa

SEQ ID NO: 337 - DNA, 2577 bp, Arabidopsis thaliana
atggtttacacgatttcaggcgtacgttttcctcatcttccatcgattaagaagaagaattcgtctcttcacagtttcaatgaagatctcaggagaagcaacgctgtctcattctctctgaggaaggactctcgttcttctgggaaggtttttgctcggaagccatcgtatgattctgattcgtcttccttagctaccactgcatctgagaagctccgtggccatcagagtgatagctcttcatctgcctctgatcaagtacaatctcgggatactgtctctgacgatactcaggtgctcggcaatgtagacgttcagaaaactgaagaagcccaggaaacagagacactagatcaaacttctgcactctcaacatctggaagcataagttataaagaagattttgcaaagatgtcacactctgtcgaccaagaagttgggcagaggaagattccacctcctggagatgggaagagaatatatgacattgatcctatgttgaacagtcatcgtaatcatcttgattaccgatatgggcagtacagaaaactgcgtgaagaaattgacaagaatgaaggtggtttggaggcattttctcgtggttatgaaatatttggcttcactcgaagcgccactggtatcacttaccgggaatgggcaccgggagctaaggcagcatcactgatcggagattttaataactggaatgcgaaatctgatgttatggctcggaacgactttggtgtgtgggaaatatttctgccaaataatgctgatggctcaccagcaattccccatggctcccgtgtgaagatccgcatggataccccatctggtattaaagactccattccagcttggatcaagtattctgtccagccacctggcgagatcccatataatggagtatattatgaccctcctgaggaggataaatatgcgttcaaacatcctcgtccaaagaaacccacatcgctgcgtatatatgaatcacatgttggaatgagtagtacggaaccaaagataaatacatatgccaactttagagatgatgtacttccccgtataaaaaagctaggctataatgctgtgcagataatggccattcaagagcatgcctactatgccagctttgggtatcatgtgacaaattttttcgcacctagcagccgctttggaacacctgatgaccttaaatctttgatagacaaagctcatgagctaggtctggttgttctgatggatattgtgcacagccatgcatcaaaaaacacactggatggcctggacatgtttgatggtactgatggtcaatatttccactctggatcgcgtggttatcattggatgtgggattctcgtcttttcaattacggaagctgggaagtgcttaggtatcttctttccaacgcgagatggtggctggaagaatacaagtttgatgggttcagatttgatggtgtgacttccatgatgtacactcatcatggactgcaggtcgaatttactgggaattacaatgagtactttggatattctactgatgttgacgctgtggtctatctaatgctggtgaacgatttgattcatgggctataccctgaggctattgttgtcggcgaagatgttagcgggatgccagctttttgcgttcctgtcgaagacggtggtgtgggttttgactaccgtctacacatggcagtggcagataaatggattgagcttcttaagaagagagacgaggactggcaggttggtgatataactttcacgcttaccaacaggaggtggggagaaaaatgtgtcgtctatgcagagagtcatgatcaagcccttgttggagacaaaacgatagctttctggctaatggataaggacatgtatgatttcatggccgttgatagacaggccactccgcgtgtagaccgtgggattgctttacacaaaatgatccgtctcattacgatgggattgggtggagaaggatacctcaatttcatgggaaacgaatttggacacccagaatggatcgacttcccaaggaccgaccagcaccttcctgatggcagagtcatcgctgggaataatggtagttatgataaatgccgacgtaggtttgatctgggagatgcagaatatcttagataccatggactacaagagtttgatcgagcaatgcaaaatctagaggagacgtatggtttcatgacttcagagcaccagtacatatcccgcaaggatgaaggagacagagtcattgtattcgagagaggtaacttgctcttcgtcttcaacttccactggaccaacagttactctgactaccgtatcggttgctctgttcccggaaagtacaaaatcgttttggactctgataactctttatttggaggcttcaaccggctagatgactccgcggagtttttcacctctgatggaaggcacgacgataggccttgctccttcatggtgtatgcaccgtgcagaaccgctgtagtttacgctgcagtagatgatgatgatgatgatgaacgttcttctcttgtccccataggcctgttacccgaagatgtttag

SEQ ID NO: 338 - DNA, 2958 bp, Arabidopsis thaliana
aattctttagaaaaagacttcatacagatttgtttttcataacaatgttttttcttaaaaaaccactatgtaacaatgatttttcttaaaataacacgatatatttttttaaatatcatgtcttttagttaaatataacatgtgaaatttaaatgttacatgctattttgtaaaacctcacacaagtgtctcgcctactgttgaacttgcaacaaacgaaggattgttttgtcatttcacctcgtttgataatgtgagttcatgactaatttgcaacaaaaacctttctctctgctattttacgttgtgtttttttggctatttagtaatattatccttcttttatttatgatagaaccctgtaaaatactttgtaaactaaaaacacttattactagctagttgctaattgctatagtgaaaacttataaaaacatttttaaagtaaaacttgtaaaaacgtttttaaagtaaaacttgtactaatttgcatgtagcctaaactctttttttgtttggtttaataatttacagttttacactaacttgttaagctaacacacgtgaatgaaggaaactgataggagcaaggtacttcaacaagggctacgcagccgccgtaggacatctcaactcaagcttcgactctccacgtgatctcgacggccatggctcccacactctctccaccgccgccggagattttgttcctggagtcagcatcttcggccaaggcaacggcacggccaaaggtggctcccctcgcgccagagtggccgcgtacaaagtctgctggccgccagtcaaaggcaacgaatgctacgacgcagacgtcctcgctgctttcgacgctgccatacacgacggagctgacgtcatatccgtctctctaggcggcgagcctacctcgttttttaacgacagtgtcgctattggttcctttcacgccgctaagaagcggatcgtggttgtttgctctgccggaaactctggaccggcagatagtacggtttctaatgtcgcgccatggcagattaccgttggtgctagcaccatggaccgtgagtttgctagcaatcttgttctcggtaatggaaaacattacaaggttagatattaagtccaagaatatggatcatatctctatctcaaatcttgaaaatgaattcttgaaattgagcttgaatctttttcattcgtagggacaaagcttgtcatccacggcattgccacatgctaagttctatccaattatggcatctgtaaatgcaaaagctaagaacgcttcagctttggatgcgtgagtttggctaatctccttacttaattacgccaaatgttttatgttaattgttaattttgaatctctctctttgttgtagacaattatgcaaacttggatcgcttgaccctataaagacaaagggaaagatattagtgtgtctcagagggcagaacgggagggtggaaaagggtcgggccgtggctttagggggtggcatagggatggttcttgagaacacttatgtcaccgggaatgatttactcgctgacccgcatgtccttccagccacacagctcacttctaaggatagttttgctgtgtcaagatatatcagccaaaccaagtaggattcttgattcacactttacctaaacttgtttcaagttctgaaagaaaactttattttttgatgtaggaagccgattgcacacattactccttcaaggacagatttgggactaaaaccagcgcctgtaatggcttcattttcttcaaaaggtccaagcatagtggctcctcagattctgaagcctgacataactgctcctggtgtgagtgtgatcgctgcctacactggagcagtctctccaacaaacgaacagtttgatcctcgacgacttctgttcaatgctatttcaggaacctctatgtcttgtcctcatatctctggcattgcgggtcttctcaaaactcgttatccttcttggagccccgcagctatccgctctgccatcatgactaccggtaagaatgtatttcgattctagagcttacacattgttgacaaaattgaagtttaattctattttaccacttaaaacacattaacatctactggtcctggacttataaccaaatcttgtttcttccatggccatgttctgttttcttagttttaggttggaaatattggaatgagttttcttgaatcttacagttttttcacactttgtgtttccctttcagcaacaataatggatgacattcctggacctatccaaaatgcaaccaacatgaaggcaacacctttcagttttggggcaggacacgtccaaccaaatttagctgtgaatcccggtctcgtatacgatttaggcatcaaggattacctcaacttcttatgctcacttggatacaatgcatcacaaatctctgtattctcgggcaacaactttacttgttcaagccctaaaatcagtcttgttaacctcaactatccttccatcacagttccaaacttaacatcaagcaaagtcaccgtttcaaggactgttaaaaacgttggacgaccttcgatgtataccgtcaaggtgaataacccacagggtgtttatgtcgcggtgaagccaacgagcttgaatttcaccaaagttggagagcaaaagacgtttaaagtgatccttgtgaaaagtaagggaaatgtggctaagggctatgtgtttggagaattggtttggtcagacaagaagcatcgtgtgagaagtcccattgtggtgaagctctaactttgaatttgagtgccaattatgatatttgatctatgaagtttagttgcctatatgtttgaatttaaggcttacaaagaatggtgtaatgttgtgctgatcatataaaataatacctagactagcacccgtgctacaacacaggtttctagttcttattactgatat

SEQ ID NO: 339 - DNA, 1428 bp, Arabidopsis thaliana
atgtctgtgcaagagtatttagacaagcatatgctttctcggaaaatcgaagacgccgttaatgccgccgtaagggctaaaacctcagatcccgttctcttcatcgctaatcatctgaagaaagctgtatcatctgtgataacgaaggttaaagcacgacagatccttgacagcagaggaattccaacagttgaagttgatctgcacacgaacaaaggcgtttttcgtgcttctgttcccagtggtgattcttctggaacgtatgaagctattgagctacgtgatggagacaaaggaatgtatcttggaaacagtgtggctaaagctgttaagaacataaatgaaaaaatttctgaggcgttgattggtatggacccaaaacttcagggtcagatagatcaggctatgatagatttggataaaactgaaaagaagagtgaacttggtgctaatgctatacttgctgtgtcaattgcggcatgcaaggctggagctgctgagaaagaggtccctttgtgcaagcatctttctgatcttagtggcagagcaaacatggtgttacctgtacctgcgttcactgttttgagtggtgggaagcatgcttcgaatacttttgccattcaggaaattatgattctcccaattggagcaagtagatttgaggaggccctgcaatggggatctgagacatatcatcatttaaaggctgtcatttcagaaaagaatggtggtttgggatgtaatgttggtgaagatggtggtcttgctccagatatctcgagcctcaaggaaggtttggagcttgtaaaagaagctatcaaccgaacagggtacaatgataagataaagatagccattgatattgccgccactaatttttgtttaggtaccaagtatgatttagatatcaagtctccaaataaatctgggcaaaatttcaagtcagcggaagatatgatagatatgtacaaagaaatttgtaatgattatccaattgtgtctatagaagacccttttgacaaggaggactgggaacacaccaagtatttttcgagtcttggaatatgtcaggtggtaggtgacgatttgttgatgtcaaattcaaaacgagttgagcgtgccatacaggagtcttcttgtaatgctcttcttctcaaggtgaatcagattggtacagtaacagaagccattgaagtagtgaaaatggcaagggatgcccagtggggtgtggtgacatctcatagatgtggagaaacagaggactctttcatctctgacttatctgtgggtctcgcaacaggtgtgattaaagctggtgctccttgcagaggagaacgtactatgaagtataaccagttgctacggatagaggaagagcttggggatcaagcagtgtatgctggagaagattggaagctatctctctaa

SEQ ID NO: 340 - DNA, 1389 bp, Arabidopsis thaliana
atggcggtgaagaagaaagtttcatggagatcactaatcgttggatgtttaggagatccagaaaccctaatggcatcttcaaagaaacctaaaagaaaaaatgacgtcatcaagaaacagagctcttttcaaagactatcgatacttgatatgagcaatccaagttccaacactttgtcagaagatctatcgatttctttggccggatcagatcttcatgtgtttaccctagcggagcttaaagtcattacacaaagcttttcatcgaccaattttctaggtgaaggtgggtttggtcctgttcataagggtttcattgatgataagctacgtcctggtcttaaagctcagcctgttgctgttaaattgcttgatcttgaaggtcttcaaggtcaccgtgaatggctgacggaagttatgtttttgggacaattgaagcacaaaaatttggtgaaattgattggttattgttgtgaggaagaacatagaactcttgtttatgagttcatgcctcgtggaagcttagagaatcaacttttcagaagatactctgcctcgcttccatggtcaacaagaatgaagatcgctcatggagctgcaacaggacttcaatttctacacgaagctgaaaatcctgttatctatcgggatttcaaagcctccaatatcttgttagattccgattacacggcgaaactctctgacttcgggttagccaaagacggaccagaaggagacgacactcatgtgtcaactcgagtgatgggcacacaaggctacgcagctcctgaatacatcatgaccggtcatttaacagcaagaagtgacgtatacagctttggagttgtgttgctagagcttttgaccggacggagatcagtagacaaaaagagatcatcgagggaacaaaaccttgtggactgggctcgtccaatgctcaatgacccacgtaaactatctcgaatcatggacccgagacttgaaggtcagtactcagagacaggagcaagaaaagcagcaacattggcttaccaatgcttaagccatcgacccaagaaccggccatgtatgagtgccgtcgtctctatactcaatgatcttaaagactataatgatattcctatggggactttcacttacacggtgccaaacactccggacaataaagaagatgatggtcgtgttggtaataagccacgtaagagtagtcatcatcatcatcatcaacaacaacaaagtaatcatccccggtcgtctccatctccgacaaccaagtctccatctcccacggccaagtcgccgaggaattcaacggaaaatcaccggagaacgttgagaaatggagtgaattcgccgttgagaagtgaggcaggtggggaacggtactaa

SEQ ID NO: 341 - DNA, 2511 bp, Arabidopsis thaliana
atggcaatgtcttgcaaggatggtaagttgggatgtttggataatgggaagtatgtgaggtatacacctgaacaagttgaagcacttgagaggctttatcatgactgtcctaaaccgagttctattcgccgtcagcagttgatcagagagtgtcctattctctctaacattgagcctaaacagatcaaagtgtggtttcagaaccgaagatgtagagagaaacaaaggaaagaggcttcacggcttcaagctgtgaatcggaagttgacggcaatgaacaagctcttgatggaggagaatgacaggttgcagaagcaagtgtcacagctggtccatgaaaacagctacttccgtcaacatactccaaatccttcactcccagctaaagacacaagctgtgaatcggtggtgacgagtggtcagcaccaattggcatctcaaaatcctcagagagatgctagtcctgcaggacttttgtccattgcagaagaaactttagcagagtttctttcaaaggcaactggaaccgctgttgagtgggttcagatgcctggaatgaagcctggtccggattccattggaatcatcgctatttctcatggttgcactggtgtggcagcacgcgcctgtggcctagtgggtcttgagcctacaagggttgcagagattgtcaaggatcgtccttcgtggttccgcgaatgtcgagctgttgaagttatgaacgtgttgccaactgccaatggtggaaccgttgagctgctttatatgcagctctatgcaccaactacattggccccaccacgcgatttctggctgttacgttacacctctgttttagaagatggcagccttgtggtgtgcgagagatctcttaagagcactcaaaatggtcctagtatgccactggttcagaattttgtgagagcagagatgctttccagtgggtacttgatacggccttgtgatggtggtggctcaatcatacacatagtggatcatatggatttggaggcttgtagcgtgcctgaggtcttgcgcccgctctatgagtcacccaaagtacttgcacagaagacaacaatggcggcactgcgtcagctcaagcaaatagctcaggaggttactcagactaatagtagtgttaatgggtggggacggcgtcctgctgccttaagagctctcagccagaggctaagcagaggcttcaatgaagctgtaaatggtttcactgatgaaggatggtcagtgataggagatagcatggatgatgtcacaatcactgtaaactcttctccagacaagctaatgggtctaaatcttacatttgccaatggctttgctcctgtaagcaatgttgttttatgcgcaaaagcatcaatgcttttacagaatgttcctccggcgatcctgcttcggtttctgagggagcataggtcagaatgggctgacaacaacattgatgcgtatctagcagcagcagttaaagtagggccttgtagtgcccgagttggaggatttggagggcaggttatacttccacttgctcatactattgagcatgaagagtttatggaagtcatcaaattggaaggtcttggtcattcccctgaagatgcaatcgttccaagagatatcttccttcttcaactttgtagcggaatggatgaaaatgctgtaggaacctgtgcggaacttatatttgctccaatcgatgcttcgtttgcggatgatgcacctctgcttccttctggttttcgtattatccctcttgattccgcaaaggaagtatctagcccaaaccgaaccttggatcttgcttcggcactggaaattggttcagctggaacaaaagcctcaactgatcaatcaggaaactccacatgtgcaagatctgtgatgacaatagcatttgagtttggtatcgagagccatatgcaagaacatgtagcatccatggctaggcagtatgttcgaggtatcatatcatcggtgcagagagtagcattggctctttctccttctcatatcagctcacaagttggtctacgcactcctttgggtactcctgaagcccaaacacttgctcgttggatttgccagagttacaggggctacatgggtgttgagctacttaaatcaaacagtgacggcaatgaatctattcttaagaatctttggcatcacactgatgctataatctgctgctcaatgaaggccttgcccgtcttcacatttgcaaaccaggcgggacttgacatgctggagactacattagttgctcttcaagacatctctttagagaagatatttgatgacaatggaagaaagactctttgctctgagttcccacagatcatgcaacagggcttcgcgtgccttcaaggcgggatatgtctctcaagcatggggagaccagtttcgtatgagagagcagttgcttggaaagtactcaatgaagaagaaaatgctcattgcatctgctttgtgttcatcaattggtcctttgtgtga

SEQ ID NO: 342 - DNA, 1179 bp, Arabidopsis thaliana
atgaagtacattcgaagcaacagcttgaaacgtctcttctccttcaaacgacgcagtttcgactccgactcctcagaaaactcttctcctctcgctgcttcttccaccaaatgcgtcgagggttttcaagaaacagaccagtttcaaagacccaaatggaaatgtttctcctttcaagaaatctatgacgcaaccaacggttttagctcagagaatttggtaggtagaggtggatttgcagaggtgtataaagggatattgggtaaaaacggtgaagagatagcagtgaagaggataacaagaggaggaagagatgatgagaggagagagaaagagtttttaatggagattggaacaataggacatgtctcacatcctaatgtcttgtctcttcttggttgttgtattgacaatggtctctatcttgttttcatcttctcttctagaggctcccttgcttctctccttcatgatttgaatcaagcaccattggagtgggagacaaggtataagattgcaattgggacagcaaaagggcttcattatttacacaaaggttgtcagagaaggatcatacacagagacattaaatcctccaatgttctcttaaaccaagattttgaaccacagatatctgattttggattggcaaaatggctgccttctcaatggtctcatcattccattgctccaattgaaggcacatttgggcacttagcaccagagtactatacacatgggattgtggatgagaagactgatgtgtttgcctttggagtgttcttgcttgaactcatttctggtaaaaaacctgttgatgcttctcaccaaagcctacacagctgggcaaaactgataatcaaagatggagagattgagaagctggtggatccgaggatcggtgaagaatttgatctgcaacaacttcatcgcattgctttcgccgcgtctctctgcatccgatcttcttctctatgtcgaccttccatgatcgaggtcttagaagtactacaaggagaagatatagagaaagagaaatggaaaatggaagaggaagaagaagttaaagaagagttttggggatatgaagatcttgaggattgtgaatgtgattcttcaatctcactttctcctcctgactctatctctaatagaagttcttcgcatcgtagtcgctag

SEQ ID NO: 343 - DNA, 1287 bp, Arabidopsis thaliana
atggcggaagaggcgatactagggttccttcagaacaatgaacagatcactgattcgggtcaattctctgccgagttcaacatcgaccacaacgaactcgtcaatgtcatcaaaagtctccatggttttcgttacatcgatgttcaggacattaaaaaggagacatggattctgactgatgaagggaagaaatatgcggcagaagggtcaccagaggttcaacttttcttagctgttcctgaagaaggcagcatatcaaaagatgagctccagaaaaagttagctcctgcagtcttcaagatcggctgttctcaagctggaaaaaacaagtgggtggaaatgggaaagcaagtctcgaggaaggttaaagatgtagaagataaagtgaaaggccagcttttacaaatacaacaagggaagctgatatctttactacttctcaggatatggaaggggtattccgtaaagaaaggtcctaattatgctcccgagagaaagaaagtggctaccgatttgactcgagaaaatcttcaaaactggaaagagttagagtttaaggagtataacttcaaagctaaaggagcgcctcctcagcagcaccctgctcgtgattctcatgacaccttctttctaaaagttccctctactacaagaacacttccggaagattatgttgagagggtgaaacgtgttcatgagtctggtggttatggatcaagagggtataattatgattggaaaagagaagaagcaaacaagaatcttcttcgtacccacacaacggctgtctcatctaggatgctttatgcactagcacagaaaccttttgtgcccaagaagtacttttcgattgaccgtgtcttcagaaacgaggctgttgatcggacccaccttgcagagttccatcaaattgaaggtttgatatgtgatcggggccttacacttggagacctgattggtgtattagaagacttcttctcacgcttagggatgtcgaaattgcgtttcaagccagcttacaacccttacacagagccaagcatggagattttcagctaccatgaaggtttagggaagtgggtggagattggaaactctgggatgttcagacccgaaatgcttctaccgatgggtctccccgaggatgttagagtcatcgcttggggtctctctcttgaaagaccaacaatgatattatacggtatcgacaacatccgagatttgtttggacacaaggtggatctcgatcttattaaacggaatccgatctgccgaattggaatctaa

SEQ ID NO: 344 - DNA, 2724 bp, Arabidopsis thaliana
atgattttaatgtttgatgtgaaaaacgcagcttctgagcattcctacaaggatattttgacaagtcttcctaaacctggtggtggagagtatggaaagtactactcgttaccagctttaaacgatccaagaattgataagctgccattttctgtaaggatactattggaatcagcgattcgtaactgtgacaactatcaagtcacaaaggatgacgttgagaaaatccttgactgggagaatacatctactaagcaggttgaaattgccttcaagccagcccgtgttatcttacaggacttcactggagtaccagttctagttgatcttgcttctatgagggatgcagtgaagaatcttggtagtgatcctagcaagatcaaccccttggttcctgttgatcttgtcgttgatcactcgatccaagttgactttgcaaggtcagaagatgccgcacagaaaaatttggagcttgaattcaaaaggaacaaagaaagatttacgttccttaagtggggttcaacagccttccaaaacatgctggtcgttcctcctgggtctgggattgtccatcaggtcaacttggaataccttggacgtgttgttttcaactcgaaaggatttctctaccctgatagcgttgttggaaccgactcccacacaaccatgattgatggattaggagtcgctgggtggggtgttggaggaattgaggcagaggcagcaatgcttggtcagcccatgagcatggtgttacctggcgtggtcgggtttaagttggatggaaagttgaaggaaggggttactgctactgatttagttctcactgtgacccaaatattgaggaagcatggtgttgtcggcaagtttgttgaattttatggtgaggggatgagtgaactttcactggctgatagagccacaattgcaaatatgtctcccgagtatggagcaactatgggtttcttcccagtggatcatgttacactggagtacctgaagttgacaggaagaagcgatgaaactgtgaatcctctctctctctctctctcactttctctacttttttattctttcttttttggtaaacaagaaagagcatacacatcttatctgcagttagaattgggacatgttgaaccatgtatttctggtcctaaaaggcctcatgaccgagtgcctctgaaagatatgaaggctgactggcatgcatgccttgacaatcctgttggattcaagggttttgcagtgccaaaagaaaaacaagaagaagttgtgaagttctcatacaacggacaacctgctgagatcaagcatggtagtgttgttattgcggcaattactagttgtacaaacacgtcaaaccctagtgtcatgatcggagcagcactcgttgcaaaaaaagcttcagatcttggcctgaaggtaaaaccatgggttaagacaagtcttgctccagggtctagagttgtcgagaaatatttggatcgaagtgggctccgagagtccttgaccaagcaaggattcgaaattgtcggctacggctgcacaacatgcattgggaattctggcaaccttgacccagaagttgcatctgctatagaaggaactgatatcatcccagctgctgtgctgtctggaaaccgaaactttgaaggtcgtgttcatccacaaacaagagcaaactatcttgcgtcaccaccattagttgttgcttatgcccttgctggaacggtggacattgattttgagaaagagcctataggaaccagaagtgatggaaaaagtgtgtacctgagggatgtatggccaagcaatgaggaagttgctcaggttgttcaatatagcgtgctaccaagcatgttcaagagctcgtacgaaacaataacagagggaaaccccttgtggaatgaactctctgcaccgagttccacgttatattcttgggatccaaactccacgtacattcatgaacctccgtatttcaagaatatgaccgcaaatccacctggtcctcgtgaagtgaaggatgcttactgcttgttgaactttggggacagtgtaacaacagaccacatctctccagcaggaaacattcaaaaaactagtcctgctgcaaagtttctaatggaccgtggtgtgatttcggaagatttcaactcatatggaagtcgaaggggaaacgacgaggttatggctcgtggtacatttgccaatatccgtattgttaacaagctcttgaaaggagaagttggccccaacactgttcacattccgactggagagaagcttagcgttttcgatgcagcaagtaaatacaagaccgctgaacaggatacgatcatcctggctggtgctgagtatggaagtggtagctctcgggattgggctgcaaagggtcccttgcttttgggagtgaaagctgtaattgccaagagctttgagagaatccatcgcagcaacctggctggtatggggatcattcctctgtgtttcaaggctggggaggacgcggaaacccttggactcactggtcatgaacgctacacagtccaccttcctacaaaagttagtgacattagacccggtcaagacgtcactgtaaccactgacagtggcaaatcctttgtctgcaccctgcgttttgatacagaggtggaattggcatactatgatcacggcggtattctaccatacgtcatccggagtttgagcgccaagtga

SEQ ID NO: 345 - DNA, 1734 bp, Arabidopsis thaliana
atggcggattcttcacccgattcgtgtttcaaaggaggcaaatttagtgctccagggtttcgatttcatccaactgatgaagagcttgtgatgtattatttgaagaggaagatttgtaggaagaggcttagagttaatgttatcggtgttgttgatgtttacaaaatggatcctgaggaattgcctggtcaatcaatgttgaagacgggagatagacagtggttctatttcactccaaggagtaggaagtatccaaacgcagctaggtctaatagaggaactgaaaatgggtattggaaggctacagggaaggatcgagtcattgagtataattctagatcggtgggacttaaaaagactcttgttttctatagaggccgggctcctagtggtgagcggactgattgggtgatgcatgagtatacgatggatgaagatgaactagggagatgtaagaaccctcaggagtactatgctctttataagttgttcaagaaaagtggggctggtcctaagaatggtgaacagtatggtgctccgtttcaagaagaggaatgggttgatgatgataatgaagatgtgaatgctattgctgtagctgtgccagagcaacctgtggttcgttatgaggatgctcgtcgtgtggatgagaggagactttttaatcctgttattcttcagttagaggatatcgatgagcttctcaatggaatccctaatgcacctggtgttcctcaaagatgtattcctcaggtgaatagtgaagaagagctgcagagtacgttggtgaataattctgctagagagttcttgccaaacggtcagcaatacaacaggccctcaagttttgactcattagagaccgctgaggtcacctcagctcctctggtgtttgagaaggaagatttcattgaaatggatgatcttcttctgatccctgaattcggagcttcttcaactgagaaagccgcacagttctcgaaccatggtgaattcgacgattttaatgagtttgaccaattgttccatgacgtttccatgtctttggatatggaacctattgatcagggaacttctgcaaatctgtcttctctgagtgattctgctaactacacatcagaccaaaaacagcaactcctttatcaacagttccaggaccagactcccgagaaccagctgaacaacatcatggatcctagtacaactctcaatcaaatcactagcgatatttggttcgaggatgatcaggccattctatttgatcaacaacaatccttttctggagcatttgcttcaccctcatcaggtgtgatgcctgattccaccaatcctactatgagtgtgaatgcccaaggccatgaaatccaaaatggtggtggaacaacaagccagttctcatcggctttgtgggcattaatggactcaataccttcaacgccagcctctgcgtgtgagggtccccttaaccgaacctttgtacgtatgtctagcttcagccgtatgaggttcaatggaaaggctaatggaacgccagtgagtactaccatagcaaagaagggtattagaaacagaggttttcttctattatcaatcgtgggtgctttgtgtgccatcttctgggtgttggtagccacagttcgagtctcagctccggtgatctgtgtcgtgttgacggtgattgttatcccgatttgtggaactgttgccactgaggaaagagagtatgatccgtag

SEQ ID NO: 346 - DNA, 1215 bp, Arabidopsis thaliana
atggatcttgatttgaatcaagagccgtcttctgattcggagtctccgggtggtttgatgacggcgctttctccaatgttagaagagcttgaatctgctcaagagcggattcaagaacgcataagacagcttgaagtgatagtttcgagaatcagggaacgagaaataacaacaacaacaacaccggctttggtgtcgcctaacgaacatagagattcaactgctggagttatacatgagcgttctcgagagagacttgtcgaaaatggcgaaaacaagacttatttgatagccaaggcattgaacatggagaaaacaagctctgttcctggtggcttctttgactgcaacatatgtttagagaaagctgaagatccgattttgacttgttgtggtcatttgttctgttggggttgcttctatcagttgcctttaatttacttaaacataaaggaatgtccggtttgcgatggggaagtgactgacgccgaggtgattccgatatatggtaatggagatgattgtgatggtactaaaccaaagttagaagattgtggtattagtctacctccaaggcctaatgctaaaagagtggaaagtgttcgtcaaaagatcataaaccgagggaaccctttcttccctgggcacgaaaacgaagcaatcgaacatattagaagaactattgattccataggactacaagctttagctcaaggcgatgagtttggtttgacaaacataataaacaatggaggagacaatggtggacaacaacaacaacaacaacatcatcatcatcatcatccgccttttggacctttgaggttattgccaccatatgctactttcccaggtcttctagttgatacctcagacataccagcaccctttgatgatgatgcttttgatgttgatagttttgttgacacaactagtttgagaagaaaccgtagaagaccttcaccagccgtacgagcttcttatcagagaaaccgaagtaacaatgcttctcaaacgatttcgttcaggctcggttcttcagcttcatcagcacctagagagtttgctgttccaagctcctccattatgacgagaagccaaactgtaaaccctactgaagtggttacttcgagtacttcagcttcatcgtctaggagaagaacagaagatgtaaacaatggacctcggaccaggtctagaaggaggctgaggtaa

SEQ ID NO: 347 - DNA, 741 bp, Arabidopsis thaliana
atggcggcgaaaattcccggagtgatcgctttgttcgacgtcgacggtactctcacagctccaaggaaggaagctactccagaattgctcgattttatccgagaattgcgaaaggtcgtcactattggagtcgtcggtggatctgatctaagtaagatatctgagcagcttggcaaaacagtcacaaacgactatgattattgtttctctgagaatggtcttgtcgcccataaagatgggaaatccattggaattcagagcctgaagctgcaccttggagacgataaactcaaggagttgataaatttcacgctgcactacattgcagacctggatattccaattaagaggggaacatttattgaattccgaaatggaatgctcaatgtatcacccattggtcgcaactgcagccaagaagaaagagatgaatttgagagatatgataaggttcaaaacatccgaccaaagatggtagctgaacttcgtgagcggtttgcacatcttaaccttactttctcaattgggggacagataagcttcgatgtcttccctaaaggttgggataagacttactgcttgcaatacctcgaggacttcagtgaaatccatttcttcggtgacaagacctatgagggtggaaatgactatgaaatctatgaatcaccaaaaacaattggccattcagttacgagtccagatgacacagtggcaaaatgcaaggctctgttcatgtcttga

SEQ ID NO: 348 - DNA, 990 bp, Arabidopsis thaliana
atgcactgtgaaggctgcgctaagaagataaagcgaatggttaagcactttgatggagtgaaagatgtgacggcagatactggtggaaataagcttttggtggtcggaaagattgatccagtgaaactccaggagaagttggaggagaaaaccaagagaaaggtggttctcgcgaatccaccgccaaaggtagagggacctgttgctgccgccgttggagagaagaaagccgatggtggagataaggaggcggctcctcctgctcctgctccggcagctccaaaagagagcgtggtgcctttaaagatcagactacattgcgaaggatgtattcagaaaatcaagaaaataatattgaaaatcaaaggagtcgaaacagtggctattgacggagctaaagacgtggtgacggttaaaggaacgatagacgttaaagaacttgtgcctctactcactaagaagctcaaaagaaccgtcgagcctcttgttcccgccaaaaaagatgacggagccgccgagaataagaagacggaagctgccgctcctgacgcaaagaaagaggctccgtccgccggagttaacgaagcaaagaaggaaggaagtgacggtggagagaagaaaaaagaggttggagacggcggagagaagaagaaagaaggtggtgacggcggagagaaaaagaaagaagccggagacggaggagagaagaagaaagatggcggaggtgtgccggccccggtggcgatggtgaataagatggattattatgggtactcagcttatccaacggctcctatgcattggcaagaaggacacgtgtacggtcagagttattcgatgacaggtcagaattatccagtgggaggtcagagttatccaggttcaggatacaactacgcaagtgagagttacgtgccgtacgcgcagccaaacgtgaacgctcctggaatgttcagcgacgagaatcccaatggttgctctgttatgtaa

SEQ ID NO: 349 - DNA, 1131 bp, Arabidopsis thaliana
atgcaagcttttgctttaagtgggaagaaaaggattgtgaatcacggcatgtgtttttccaaaggaaatcttgatctcggttcacgcttgtctgagaattttatggatgatcctttgatcccgggattgcctgatgatgtcgctaagcagtgtctagcgcttgttccgcgtgctaggttcccatccatgggaagtgtatgcaagaaatggaggtttgttgtccagagcaaagagtttattactgtgagaagactcgctggtatgcttgaggagtggctttatgtcttaacgatgaatgctggtgggaaagataaccgatgggaggtgatggactgtttgggacagaagctatcatctcttccaccgatgcctggtcctgcaaaaacagggtttaaggttgttgtggttgatgggaaacttcttgtcattgctggttgttgtatgatcaacggttcgcttgttgcatctgctgatgtttatcagtatgatacatgcctcaatagctggagtagactagcagacctggaggtagctcggtatgatttcgcttgtgctgaggtgaacgggcatgtttatgttgtgggaggtcatggggtagatggtgagagtctgtcaagtgcagaggtgtatgatcctgagacgtgtacatggactttcatagagtctttaaggcgtccgaggtggggttgtttcgctagcgccttcaacgggaagctatatgtgatgggtgggagatccaacttcactattggaaactcaaaacttcttgatgtgtacaacactcaatgtggctcctggcatggtagcaaaaacggtttaacgatggtcacagctcatgttgaagtagggaaaaagctgttctgtatcgactggaagaaccaccggaagatgtcggtgttcaatgcggaagacgaaacctgggaagtggtggctcttccgctatcaggaagctcgagggccgggtttcagtttggtaagctgagtgggaagcttttgctattctcgtctcaggaagaaaccggtcaatgtactttactgtatgacccggatgcttcaccaggcacacagtggaaaacgtctgagatcaaactctctggttcttgcgtatgcagtgtcacaatcacagcctga

SEQ ID NO: 350 - DNA, 297 bp, Arabidopsis thaliana
atggcaggactcatcaacaagatcggagacgcactccacattggaggaggcaacaaggaaggtgagcacaagaaggaagaggaacacaagaaacacgttgacgagcacaagagtggtgagcacaaagaaggtattgttgacaagatcaaagacaagatccacggtggtgaaggtaaaagccacgacggagaaggcaaaagccacgacggtgagaagaaaaagaagaaggacaagaaggagaagaaacatcatgatgatggtcaccacagcagcagcagtgacagcgacagcgattaa

SEQ ID NO: 351 - DNA, 468 bp, Arabidopsis thaliana
atggatctagaatcggtgaaaaagtatctggaaggagatgaagacgaaaaggccaaggaaccaatggtggcgaaattaccacacagattcctcgaacgattcgtaaccaatggtcttaaagtggatctcatcgaacctggccgtatcgtctgctccatgaaaatccctcctcatctcctgaacgcagggaaattcttacacggaggagcaacggcgacgctggtggatttgataggatcagcagtgatctacacagccggagcttcacattccggagtttcagtggagatcaatgtttcataccttgatgctgcttttctcgatgaagagatagagatagaatcaaaggcattgcgtgttggtaaagctgtagcagtagtgagtgtggagctgaggaagaagacgactggtaagattattgctcaaggtcgtcataccaagtactttgctcctcgttccaacctttga

SEQ ID NO: 352 - DNA, 1056 bp, Arabidopsis thaliana
atgggatctctagagagatcaaagaagaaagctcaagtatggaagaaagctgtgatccatttctctctatgttttgtaatgggtttcttcactggcttcgctcctgctggtaaggcctcatttttctctaatttcgaaacgacttcttatacttctacaaaatctccgattcctccccaaccttttgaaaacgctacatacacacaacattccctcctcaatagaaccttgatcaattcccaaagccaagctccagctcccgcagagtcgcgagaagctgaaggagaaacaagatctctctccgagaaagaagatgagaatcaagtaaaagtgacaccaagaggactagtgattgttgtaactccaataataactaaagatcgctacaaaaacgttcttcttaggagaatggccaataccttgaggctagttccacctcccttattgtggatagtcgtggaaaaacactcggatggcgaagaaaaatcttcgtctacaatgttaagaaagaccggtatcatgtatagacgtatagtcttcaaggaagatttcacaagcttagaatcagagcttgatcatcaaaggaatctagctttgaggcacattgaacatcacaaattaagcggaatagttcattttgcgggactaaacaacatatatgatcttgattttttcgtcaagatcagagatatcgaggtatttggtacttggccaatggcattgttatcggctaataggaaacgagtggtagtagaagggcctgtttgtgaatcttcacaagtattggggtggcatttgagaaaaattaataacgagacagagacaaagcctccgattcatatatcaagcttcgctttcaatagttccatactttgggaccctgagagatggggtcgtccttcttctgttgaaggcaccaaacaggattcgataaaatatgtgaagcaagtagttttggaggacgatacaaagttgaagggacttccggcacaagattgttccaagattatgctttggcgtctcaaatttcccacaagaacacgtttaagcacctga

SEQ ID NO: 353 - DNA, 573 bp, Arabidopsis thaliana
atgggatcttcaccaccgaagaagacgactctgcaacggtacttgtcacagcttcaacaacatcctttaagaacaaaggcaataactgctggagttttgtctggtgttagcgatgttgtatcacagaagctctctggcatacagaagattcagctgagaagggttcttctcaaagtgatatttgctggtgggtttcttggaccagcagggcatttctttcatacatatttagataagttttttaaagggaagaaggatacacagactgttgcaaagaaggtaattctggagcaattgacattgtcaccattgaaccatttgcttttcatgatctattatggagtagtcatagaaagaactccctggacccttgttagagaaaggatcaagaagacttatccaacggtccagcttactgcatggacgtttttcccggtggtgggatggattaactacaagtatgtgccactgcacttccgggtcatcttgcacagcctggtcgcattcttttggggaattttcctaaccctgcgagcgaggtcaatgacactagctttggcaaaggctaagtga

SEQ ID NO: 354 - DNA, 996 bp, Arabidopsis thaliana
atgtcggacgctttgatcaatggattggctggagctggtggtgggatcattgctcagcttctcacttatcctcttcaaactgtaaatacgcgccaacagacggagcgggatctgaagagggagaagaggaaacttggaactatcgaacacatgtgtcaggttgtcaaacaagaaggatgggagaggttatatggtggattggcgccgtctcttgctggaacggctgcatcacagggtgtgtactactacttctaccaagtgtttcggaatcgagctgaagccacagctcttgcacggaagaagaaaggtttgggtgacggatcagttgggatgtttgcttcacttttagtggctgcctttgccggatcggttaatgttcttatgacgaatccgatttgggtgattgttacgcgtatgcagacccacagaaaaatgacaaaagatcaaacagcggcccccgagtcaccttcttctaatgcagaagctctggttgctgttgagccgcgtccatatgggacctttaatacgattcgagaggtttacgatgaagctggaataactggcttctggaaaggtgtaattccaacattgatcatggtaagtaatccgtcaatgcaatttatgttgtacgagacaatgctaaccaagctgaagaaaaagcgtgccttgaagggtagcaacaacgttaccgctttggagacatttcttctcggagctgtggcgaaactcggagctacagtcacaacttaccctctcttggttgtaaagtcgcgacttcaagccaaacaggtcacaacaggggacaaaagacaacaatacaaaggaacattggacgcgattctgaaaatgattcgatatgaagggctttacgggttttataaagggatgagcacaaagattgtgcagagcgttttagctgctgcggttctgttcatgatcaaggaagagcttgtcaagggagctaagctgttgctctcaaacgctacctctagctaa

SEQ ID NO: 355 - DNA, 486 bp, Arabidopsis thaliana
atgttgaagaaaaatcggtacgataaggttttcaaaccggttaagtgtgcgcattttggtcttttcaaccggattaggagggacaagaatgagtccatcgagctgtcttcgtcagaaacagaaagagtctcttcttcaatccaatctttttacaacattaggctgttgagacctgaaatctctaaggaagaagaaagaatgaacgtagacgaagagattcagaaactggaagaagagatccatcgtcttggttctcgtcagaccgatggctcttacaaggtgacgtttggagtgttgttcaatgacgatcgatgtgccaacatctttgaagcattggttgggactctgagagctgccaagaaacgcaaaatagtcgcatttgaaggtgaacttttgcttcaaggcgttcacgataaggttgagatcactctccgaccaacaccaccgccaccgcaagctgctgctgctactgcagcctcctcctaa

SEQ ID NO: 356 - DNA, 141 bp, Arabidopsis thaliana
atgatttaccgaaagtggagtttgctgtccggcccaccggttatcctcggcggagcggtaattgctgccgtcgccgtcggattcgtcttgcaaaacgtaacgaaaggggagcagaagaagaatgtctcaacaaacaagtga

SEQ ID NO: 357 - DNA, 3327 bp, Arabidopsis thaliana
atggaggacttggggaagtctttagggttaacattgaaggaagtacgtggatggttcaagagaagaaggagtagagggaaaggtgtaaaatccatggcgaatgatgggttgggagcaaagaatcctcagttatacgatagatccctcatgaggagttccacatcttccagatgcgttggagtagctgttgaggaaagatgtattgtgggaacaaggaaggccagttgtcaaaacttgttgccttcatcacacattttggctaaagtttttcgaaaggatggtccatcgcttggttctgaatttgatcatctcccgtctggagctcgcaaagcttcttggctgggcacttcttctgtcggtcaacagaaacagaaagtggcaagaaaaagaaagatttctgagctgatggatcataccagtcaggattgcattcaagagaatgctactgtgatgaaacatggtattggaaagggtttgatgactgtatggcgtgtaatgaatccaaacaggagggatgtatctccttgcgttgatttattggatgaaagagctacattacctcaaagctcagcacgtaatcccccacatcaaaagaaaaagcaaagacaattagcatcaatactgaagcagaaactgttgcagaagaggtcgacagaaaagaagaggcgttctatacatagagaggcggaattaaacaaagatgaaactcagagagaatttaaagaaaactgtgagcttgccgcggacggggaggtatttaaagaaacctgccagacaatttcgacactagtggatgacgaggaattagagatgcgtgagcgacatgagcgaggaaatccgttgacatgttcatgccatcatcctagtagtggatctcatggttgttttctttgcaaaggtattgccatgcggtcctctgacagttctttattgtttccagatttattgcccaagtttcccccaaactctgttcagatgaggatgccttttggtttgcatccatggaattcttctccagagtctgttaagaaactgtttaaggattccttgctccttggtaaaattcatctttccctgctgaagctgcttttgcttgatgttgaaaccgagctggaaaggggatctttttcaaacttgagtatatcatgcaagtttctagccctgcttcagtcggttgagagccaaattcttattcttgatatgtggagaaattcattaaattctcttacatggacggaactattgcggcagatattggttgccgctggttatggttcattgaagtgtgctgttcaatcagaagaactaagtaagcaactagcatctacttgttttgttcttggagatagatcagttatatgtggggaattgaaggctcttgctcgattatattttgttattgatgatatccacatgaaactcatgaaaaagtatggccttcgtcttggaacgttaaagggtgaattatttagaatgcttaatgggcaaggcaataatggcttgaaaatatccgagttagccgatgctccagaggttgctgtgctaaatcttgcaactgtaccagaagaacgagagaattcaatatgttcaactctagcaagtgatattacattattcgaaaagatatcagaatcaacgtatcgtgtacgtgttaattgtttctctgaggaccctgacaagagccagtctgattcggacgactccgggagtgttgatgatgaatctgatgattgctcaattagttctggtgatgaaattgaacatgtttcagaaaatcctgcacttcgaaaagttaagtgtaggaaaaggcggaagcataaaagtaaaatgcgggaagtatgtagtgagattgatgaaagccatcccggagaaccatggctgttggggctaatggaaggcgaatattcagacctaagcgttgaagagaagttagatgtttttgtggctttgattgatcttcttagttctggttccactatcagaatggaggatctaccgagagctgtggctgactgtgcccctagtatctatagtcatggttctggtggaaaaattaagcgatcctcctctaatcagtacagctatccacgtggatcatgggtccatggaggagagctttatggaataaaagcactatctaaatcgtctgattctcatccagttgattcttcatcaattgtgggggcatttgcaaagctggctggaaatagagcgaataatgttcaccctatgcaatctgtgtaccttggttctgatcgaaggttcaacaggtactggcttttcttaggcacatgcaatgcaaatgaccctggtcataggtgtgtgttctttgaatcttctgaagatggtcattgggaagttatcaacaacaaggaggctttgcgggcgctgttgtcagttttggacgataggggcagacgggaagctcgtcttattgagtcgttggagaaacgagaaagttttctttgtcaagccatgctgagtagacaggtgacccagtcggagacagcccatttcacagatatagttagagaggacagttcttcacctgtttctgatatagacaacaacctatgtctgaatgaaattgccaatgatcaattctcctcgcaacatgcggctatagtatttgagattggaagtaagcgggagaaaagcttattgtggagccttattcaggaatttgatgattggatatgggcaaattttaattttaatctcaattctgttaaacaccgccgaagatcctaccttgattcacttactaggtgtaagagttgccatgatttgtattggagagatgagaagcactgtaagatttgccatgccacgtttgaggttgatatagatcttgaagaaagatatgcgattcatgcggccacatgtatgaggaaagaagagtgtgatacatttccggatcataaagttctatcttcccagttgcaatcactaaaagctgcagtatatgccattgagtctgctatgcctgaagatgccttgattggtgcatggagaaagtcagctcataggttatgggcgaaaagacttcggcgaagctcatctgtgtctgaaattacgcaggtgattggcgactttgttggggcaatcaatgaagaatggctatggcactgtagtgatcaagggcagactttaatgggagaaatcataaattgcttcccttcgatgcctcaaacaacttctgcgattgctctctggttggtaaaattggataccttgattgctccctatgtcgaaaaagctccacctgaaagggatcaaccgttgtgcaggaccagaaatacaagtagacgagcgtctaagcggtag

SEQ ID NO: 358 - DNA, 960 bp, Arabidopsis thaliana
atgatttctgattcgatcaccaacgcttctgctacttcagctccaaccgccagggatttcggaaaaaagaaaaggacgaacaggtcggccaaattgaaacagagcaagctaggtcttcgtcgtgaacaatggctttctcaagttgcgatgattaacaaaggggataaggaggaaatggaatccaatcgaagaattgggagtgaaaagcctgatcagagagatcttccgcgtccggtggagaatttagatgaggataacaatggaacacatcgtcatgagagctttattgagtcactttctaatagccctaacagtattcttagtggcatgaattcaattcctaattttagcagcagcagtagcagtggaagtggtggctcttgctctggtaatataacagaggaggaagatgctgatgatgatggttgtttggatgattgggaagctattgctgatgctttagctgctgatgatgaaaagcatgagaaagagaatcctcctgagtcttgccaagagcatgaggatatcaagcaatcagctttaatcggtggagctgatgtggttttaagggatgcaaaggcggattctcagagaaggaagcaaaagagtaaccaggcgtggaggccagacgataagctccgtcctcagggtctgcctaatttggaaaagcagcgtagttttccggtcatgaatttgcattttagttctgtgactgtggtgccatcttcgtgccctatttgctacgaagatcttgacttaacagactcaaatttcttgccatgtccttgtggattccggctttgccttttctgccacaagacgatatgcgatggagatgggcgttgtcctggttgcagaaagccttatgaaaggaacacaatcaagtttgaagctagtgttcaaggtggtggtctgactattcggcttgctcgttcgtctagcatgttttgcaggtcatga

SEQ ID NO: 359 - DNA, 1497 bp, Arabidopsis thaliana
atggctgaaatctcggcgacttcgtttccttcttcttcttcctctgctctcgtcatccgtagctcccacaatggtagcttaaaatgtcagaatgtagctgttccaaaaactacttcccagttccaagaggtacatccatttgaaatcgatgctcatacttgttgtttcttcgatgatacaactaaattctgtatttgctttttactgaatttgcagttatctctgaaacgaagccagcttgttggcaatgccgttgttaccggtcatgttaccggatcccgcagctgcaagaatcaagctattcgagctgttctatccggtgatggaaccgccttgactactgattcaaaggaggctggacttcgtggaaaactgaaaaaggtcgttctagcttacagtggaggcttagacacctctgtcattgtgccatggcttaaggagaactatggttgtgaagttgtgtgcttcactgctgatgttggtcagggcataaaagagttagagggtttagaacaaaaggctaaggctagtggtgcttctcagttggtcgttaaggatctcacagaggagtttgtgaaagatttcatcttcccttgtcttagagctggtgccatctatgaacgaaaatacttgcttggtacctccatggctcgacctgtcattgctaaggttcggtttgagctcaccttcttttcattaaaccctgaacttaaagttgtggcaccatggagagaatgggaaatccaaggccgagaagatgctattgagtatgcaaagaagcataatgttcccgtcccagtgacaaagaagtccatttacagccgggacagaaacctgtggcaccttagtcatgagggtgatctattggaagatccagcaaacgagccaaagaaagatatgtacatgatgagtgtggatcctgaagatgctcctgatcagcctgaatacatcgagatcgggatagaatctggacttccagtggcgctgaacgggaaggctctgagtccagccacacttctggccgagctaaacacaataggaggaaagcacgggattgggcggattgacatggttgagaaccgtctggttgggatgaaatcacgaggtgtgtatgaaactcctggaggcactatcctctttgcagctgtacaggaactagaatccctcactctagacagagagagtattcaggtaaaagacacattagcactgaaatatgcagagatggtctacgcaggaagatggtttgatccgcttagggagtccatggacgctttcatggagaagataaccgagacaaccacgggatctgtgacactgaagctgtacaaaggatctgtgtcggttacagggcgtcagagtcctaacagtctgtatagacaggacatatcttcgtttgaagggagtgagatctacaaccaagcggatgcagccgggtttattcgtctttacgggcttccaatgaaaattagagctatgcttaagaaaattagctag

SEQ ID NO: 360 - DNA, 1596 bp, Arabidopsis thaliana
atgttagttacgaggcgatgggaatcgcatccggcgaactcgccggacctcatcttacagttttttgggaatgaattccacggctacggtgacgatatgcctgagacattgcggaggttgacggagttgctgggttatgagaaggaagaagacggcgccggaatgaatgcagccaagaaaatcgcggcggaattgaatcgccgaaaagatgatataccggctttcagacgcttgcggtgtctcgagcttgatcagttgaacgagtttcttttttctacgaagctcaatcccccgatcggtgaccaggttcatcatgacatgcatgctccgctgtcgcattacttcattcacaccagcctcaattcctacttcaccgggaatgtctttgggaaatacagcattttgcccatcattgaagcacttgaacagggtgtgagggtggttgaactagatctgtggccggatggtagaggcagcatctgcgttaggcctagctggaactttgagaagcctctgaaattgcaagagtgtttggattctattaaagaacatgcctttaccaaatgtacatatcccttgataattacgttcaaggacggcttgaaaccggaacttcaatccaaagctactcagatgatacaacagacatttaatcatatggtatatcaccatgatcctcatagtttggaggtttttccttcgccacaacaactgcgaaataagatactaatatcaagaagacccccaaaagagttgttatatgctaatgatgatgatggaaaggttggcgtacggaatggggttgagataagacaacacccggcagatccaaattaccagagtttagtttccttccatgtagtggagccaagaggcatgctacaaaacgtattaacaggcaaggctaacaaaatccaacgaccaggatggtacgaaacagatattataagcttcacccaaaagagattcttgcggacacgtccacaacggaaattgttgatctatgccccctataaaccccaaagagcgtggatgcacggtgctcaattgattgcactaagcaggaaggaggagaaagaaaaactttggttgatgcaagggatgtttagagcaaatggagggtgcggttatgtcaagaagccggatttccttttgaatgctggtcctagtggagttttctatccaacagtgaatccggtggttgtgaagatattgaaggtcaaaatctacatgggagatggatggattgtggacttcaagaagcgcataggtcgactgtctaagccggacttatacgttaggattagtattgccggtgtaccccatgatgagaacattatgaaaacaacggtgaaaaacaacgaatggacacctacatggggagaagaattcacattccctttgacctatcctgaccttgctttgattagttttgaagtttatgactacgaagtatcgactgcagatgcattttgtggtcagacttgtctaccggtttctgaactaatagaaggaattcgtgctgttccgctctatgatgaaagaggtaaggcgtgcagctcgacaatgctgctcacacgttttaagtggtcttag

SEQ ID NO: 361 - DNA, 1074 bp, Arabidopsis thaliana
atggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtga

SEQ ID NO: 362 - DNA, 372 bp, Arabidopsis thaliana
atggcgaggattaaggttcacgaattgagggagaagtcgaagagcgatcttcaaaaccagctgaaggaactcaaagctgagctcgctctcctccgtgtcgctaaagtcaccggaggtgctccaaacaagctctctaaaatcaaggtcgtgcgtaaatccatagctcaggttttgacagtgtcttctcagaagcagaagtctgctctaagagaagcatacaagaacaagaagttgcttcctcttgatctccgtcccaagaagacccgtgctattcgtagacgcctcaccaaacaccaggcctcgttgaagacagagcgtgagaagaagaaggagatgtatttcccaataaggaagtacgctatcaaagtttaa

SEQ ID NO: 363 - DNA, 1395 bp, Arabidopsis thaliana
atgagcataatgaggaatttcttgagtatgataattatgctttgcgtatgtctcaattggtgttttgctgaaggagctgagaaaagcgatagtggaaaggtacttgattcttacaccattcaagtcagctctctgttcccttcatcatcatcttgtgtcccttcttcaaaagcatctaataccaagtcgtcgctgcgcgtggtgcacatgcatggtgcgtgctcgcatcttagcagcgatgcgagagtcgaccatgacgaaatcatcagacgcgatcaagcacgtgtggagtccatctactcaaaattgtcaaagaatagcgcaaatgaagtcagcgaagccaagtcaacggagctaccggctaaaagtggaatcacactcggatcaggaaactacatcgtaacaatcggaatcgggacaccgaagcacgatctatcgctggtcttcgacaccggaagtgacctgacatggactcaatgtgagccatgtctaggaagttgctattcacaaaaggaaccaaaatttaacccttcttcgtcttctacttaccaaaacgtctcgtgctcatctccaatgtgtgaagacgctgagagttgttcggcttccaactgcgtatacagtatcgtttacggcgataagtcgtttacccaaggatttcttgcaaaggagaaatttaccctaacgaactctgatgttttggaggatgtttactttggttgcggtgaaaacaaccaaggacttttcgacggtgttgctgggcttctcggccttggccctggcaaactctcactaccggcgcaaacaacaacgacctacaacaatatcttctcctactgtctaccttctttcacaagtaacagtactggccatcttacctttggatccgctggaatctctgaatccgttaaattcacaccgatttcttccttcccaagcgcattcaattatggcatcgatatcataggtatcagtgtaggcgacaaggaattagcgattactccaaactcattctcgaccgaaggtgctataatcgactcaggcacagtgtttactcgcctccctaccaaagtctacgcggaactccgcagtgtttttaaggaaaagatgtcgagttacaagagtacgtcgggatacgggctttttgacacatgttacgatttcactggcttggatacggtgacatacccgacgattgcattctccttcgccggtagcactgtcgtagaacttgatggatcagggatttcgttgccgatcaagatatcacaggtttgtttggcgtttgcagggaatgatgaccttcccgccatctttggaaacgttcagcagacgacgctagatgttgtgtacgacgtggctggtggacgagtcggttttgctcccaatggttgttaa

SEQ ID NO: 364 - DNA, 456 bp, Arabidopsis thaliana
atggagtcatcatcgtcgacttttctcaccacgacaagcttagacaagaaaaaaccatctccggtttcaagaaaatcaccaaagcaaaagaagaagacgacttcgacgaataaacccatcaaagttcgttacatctcaaaccccatgagagttcaaacttgtgcttctaagttcagagagctcgttcaagaactcacaggccaagacgccgtcgatcttcaaccggagcccatctattccccttcctccgacgaccacaacctttctccaccggcggagaatcttgcgccacgtgttcttcatcaggagccgttcggtgagagagacagtgattgttatgagccgttgaatgcggaagacatgtttttacctgatcagatgtcggcaggtttttctgggtttttctctaatgggttttacaatgtcaatgactttggaagcatcgattctatgtga

SEQ ID NO: 365 - DNA, 3504 bp, Arabidopsis thaliana
atgcaactttactctgcaattttccgaggacatatcagacctaacgccgtcgtcggtgctgcctccatgtcaggtggattggttacgcattctcagaggtcaagggtcttgtgtgtgaaagcagctcgtggtgatgcttcttcttcgactcttggaatagagtggagagcagctaatttaccatattttcagaggcaaaactctggctatggacgtattgcttacaatgactatgaatcaagtgatgagtcggatagagatgttgggtcctctcagtctcagcaaatggcgggttcgactcttgataacattgatcaatggagatttaaactaactatgcttctccggaacaaagaagaccaagaagttgtttcaagggagagaaaagatcggcgtgattttgatcatatctctgctttggcaactaggatgggattacacagccgtcagtattcgaagattgttgtcattagtaaagctcctttgccaaattatagacctgatcttgatgataaacgcccacaaagagaggtggttttgccttttggtctacaaagcgaagtagatgcccatctacattctttcctcgatcagaaaaaaacattgattccggagatgcccaggcaaaatagtagtgaaagtttagcaaacggttatggaaactatgagacaccagagaccgtgatgcaaaatagtcttgctagggaaagaatactccgcccaagaagcttacaactgaagagcaagcaacagcaatgggtggattctccagaaggccagaaaatggtagggtttcgcaaaacccttcctgcttacaaagagaaagatgcactactgaaagccattgcagcaaaccaggtcgtagtggtttctggagaaactggatgtggtaaaacaacacagcttcctcagtacatattagaatctgagatcgaggctgcccgtggagctacatgcagcatcatatgtacccagcctagaagaatatcggctatttctgtttctgaacgagttgctgcagaacgtggagaacaaattggagaatctgttggctacaaagtgcggcttgaaggaatgagagggagagatacacgtcttcttttttgtacaactggtgttttacttagaaggttacttgtggatcgtagcctgaaaggtgtgactcatgtcgtagttgatgagattcatgaacgtggaatgaatgaagatttcctgcttattgtcctgaaagatcttcttcctcgtcgacctgacctaaagttgattttaatgagtgctactttgaacgctgagctcttttcttcttattttggtggtgcaccagccatgcatatcccaggttttacataccctgtccgagcccatttcttggaggattatcttgagacgagtgggtacaggctgacaacatataatcaaattgatgattatggtgaggaaaagacatggaagatgcaaaaacaagctcagttcaaaaaaagaaaatccctaatatcctctgcagtagaggatgctcttgaagctgcagacttcaaaggatacaactttcgtactagagattctttgtcatgctggagtcctgattcaataggctttaacctcattgaaaatgtactctgtcacatcgttaaaggagagagacctggtgctgttttggtattcatgaccggttgggacgatataaactccttgaagaatcagcttgaagctcattctcttctaggagacccgaacaaagttttgttacttgcctgtcatggatccatggccagctctgagcagaggctgatttttgatagacctccagaaggaattaggaaaatagtactggccaccaatatggctgagacaagtatcaccatcaatgatgttgtatatgtgattgattgtgggaaagcaaaagaaacatcttatgatgcgcttaacaataccccttgtctgcttccatcttggatttcaaaggcagctgctcgccaaagaagaggaagagctggtcgtgttatgcctggagaatgttatcacctctatcctagatgtgtctacgaagcttttgctgactaccagcagccggaacttctaaggacgccgttgcagtctctgtgtttacaaattaaaagcctaggacttggaagcatttcggagttcctctccagggcattgcaacctcctgaagcattatcggtccaaaatgctgttgagtatctaaaaatcattggggctcttgatgacgatgaaaatttaacacctttagggaaaaatctgtcaatgcttcctgtggagcctaaacttggaaaaatgcttattttaggggctatcttcaactgtctagatccagtaatgacagttgttgctggtcttagtgtcagagacccattccttatgccatttgacaaaaaagatctagcagaaacagcaaggtccaagttctctggccgtgattacagtgatcatttgacattggttcgagcatacaatggttggaaagatgctgaaagaacacattctggttacgactattgctggaagaactttctctcttctcaaactcttaaggccatggactctatgcggaaacaattcttcaatctcctcaaggaggcttctctgattgataacattgaaggttgcagtaagctgagtcatgatgaacatcttgtacgcgcaatcatttgtgctggcatgttccctggagtctgttctgttgttaataaggaaaagtcaattacgctcaagacaatggaagatggacaagtgcttctatactcgagttctgtgaatggcaatgtaccaatgattcccttcccttggctagtcttcaacgacaaagtgaaagttaattctgtgtttctgcgagactctactgctgtatctgactctgttcttcttttgtttggagataaaatctcttccggtggatttgatggtcatctcaaaatgcttggaggatatctggagtttttcatgaaacctactttagcatatacatacctttcgttaaaaagagagctcgacgaacttattcagaataagcttgtgaatccaaaacttgatattcaactatacgacaaacttatgactgccattagattacttgtgtcagaggaccaatgtgagggcagattcgtctatggccggaaagctctaagccctacaccagcaaagaagttaaaagatgtaggggctcagcttcagaacagcggtggtgaaaacaacaagaaccaacttcagacattacttgcccgagcaggacacggatcacctgtgtacaagacaagacagcttaagaacaaccagttccgctctatggttaccttcaatggattggatttcatgggaaagccatgtggtagtaagaaaaatgcagagaaggatgcagctcatgaggctttgttgtggttacaaggcgagtccaagtcaagtctgaatgatcttaaccacatgtcaatgctcttaaagaagaacaaaagtaaaaaccacgccaaggcatcaactaaatggggttaa

SEQ ID NO: 366 - DNA, 1950 bp, Arabidopsis thaliana
atgaagaaagaacctgtccatatccttcctctgtaccttccatgtctcttgatgtttcttctttcatcactccgtcaaatcaccggagacgcaagggctagagccgttaaagtcacttgctcacctttgcttgagcacaacgaaaccgcttatgtcccaaatttcgtagccacaatggagaaaatcagcacacaagtacaaacttccggttttggagttgctctcaccggtacaggaccagacgctaactatggtcttgcgcagtgctatggtgatcttcctttaaacgattgtgtactctgttacgcggaagcaaggacgatgcttccgcagtgttatcctcagaacggaggtagaatctttcttgatggatgttttatgagagctgagaattatagtttctataatgaatacaaaggacctgaagatagcatcgtatgtggaaacacgacgagaaagaataagacttttggtgatgcggtgagacaagggctgagaaatgctgttactgaggcttctgggactggagggtacgctcgtgcgtctgcaaaggcgggtgaatctgaatctgaatcagcgtttgtgttggcgaattgttggagaactttgagtcctgattcttgtaaacagtgtttggagaatgcctctgcttctgtggttaaaggatgtttgccatggtcagaaggacgtgcgcttcacactggatgtttccttcggtactctgatcaagatttcttgaataagataccaagaaacggaagatcaagaggctctgtggtagtgattgtggtgtcagtacttagctctgtggttgtcttcatgattggagtagcagtaagtgtttatatctgcaaacgtcggaccataaagaggaagagaagaggatcaaaagatgttgagaaaatggcgaaaacactaaaagacagtagcttgaatttcaaatactcaacactagagaaagccacaggttcttttgacaacgcgaacaagcttggacaaggcggatttggaactgtctataagggggttcttccagacggaagagatatcgctgtgaagcggttattctttaacaacagacatagagcaaccgatttctacaatgaagtcaacatgatcagcactgttgaacataagaaccttgttaggctgcttggttgcagctgctcaggaccagagagtctccttgtctatgaataccttcagaacaagagccttgatcgattcatctttgacgtgaacagagggaaaacattagactggcagagaagatacacgatcatcgttggaaccgctgaaggattggtgtatctgcatgagcagtcgtctgtgaaaattattcacagagacataaaagcaagtaatattctgctagattcaaagcttcaagctaaaatcgccgattttggtctggcgagatcattccaggacgataagagccatattagcactgccattgcagggaccttaggttatatggctccggagtacttagcacatggtcagctaacagagatggtagacgtttacagctttggagttcttgtactagagattgtaactggaaaacagaacaccaaaagcaaaatgtcagattactcagacagtttgatcacagaggcatggaagcattttcagtcaggagagttggagaaaatatatgatccaaacctcgattggaagagtcagtatgacagtcacatcatcaagaaagagatagcaagagttgttcaaatagggctattgtgcactcaagagatcccttcgctaagaccaccgatgtctaagttattacatatgctaaagaacaaagaggaggtcttgccattgccgagtaatcctccgtttatggatgaaagagtcatggaacttcgagatggttctgatggtgattcagctggttgtgcatctcttgccactgtctcacaaagttccttttatggtagatga

SEQ ID NO: 367 - DNA, 1860 bp, Arabidopsis thaliana
atggcgagagaacatgcgatcggagaagccaccggaaaacgaaagaaacgcggcagagttgaagaagcagaagaatactgtaacgatggaatcgaagaacaagtagaggatgagaagcttccgttagaggttgggatgttctattacccaatgactccgccttcgttcattgtttccgatgctctggagccagattttcctttgatctatgtcaacagagtcttcgaagtcttcactggctatcgtgccgatgaagttcttggtcgtaactgtcgattcctacagtacagagatcctcgagctcaaaggcgtcacccattggttgatcctgtggttgtatctgagattaggagatgtcttgaagaaggtattgaattccaaggagagcttcttaatttcagaaaagatggtactcctttggttaacagactacggcttgctccaatacgtgacgatgatggaaccattacacacgtaattgggatacaggtcttctctgaaacgactatagaccttgaccgtgtctcgtatcctgtgttcaaacataaacaacagcttgatcaaacatctgagtgcttgtttccaagtggaagcccgaggtttaaggagcatcatgaagatttctgtgggatattgcagctatctgatgaagttttggctcataacatcttatctcggttaactccaagggacgttgcttcaattggttctgcttgcaggaggttgaggcagttgacgaagaacgagagtgtgaggaagatggtatgtcagaatgcgtggggaaaagagataactggaacactggagattatgactaagaagctaagatggggtcggttagctagagagctcaccactcttgaagctgtgtgttggcgtaaatttactgttggagggattgtacaaccttcccgctgcaatttcagcgcgtgtgctgttgggaaccggcttgtgctatttggtggggaaggggttaacatgcagccattggatgatacttttgttctcaatcttgatgcagagtgtcctgagtggcagcgtgtgagggtgacgtcgtcgcctccaggacgttggggacacacactctcgtgtctcaacgggtcgtggttggtagtctttggagggtgtggaagacaaggattgcttaatgatgtatttgtgcttgatctagacgctaagcatcccacatggaaggaagtagcaggaggaactcctccattgccaagatcttggcacagctcgtgcaccattgagggctctaaactggttgtctcaggtggctgcacagacgctggagtgcttctcagcgacaccttcttgttggatctgacaacagataaaccgacatggaaagagatcccgacatcatgggctcctccttctagacttgggcattctttatcggtctttggtcggactaaaatcctaatgtttggcgggcttgcaaatagtggtcatctaaagctaaggtcaggggaggcatacactatagacttggaggatgaagaaccaagatggagagagcttgagtgtagcgcattcccaggcgtggttgtaccgcctccaagactagaccatgtggctgtgagcatgccgtgtggtagggtcatcatctttggagggtcgattgcagggcttcactctccttcgcaactgtttctaatagatcctgcagaagagaaaccgtcatggaggatcctgaatgtccccgggaaaccgcctaagttagcttggggacatagcacatgcgttgttggaggaactagagtattggtccttggtggtcacactggtgaggaatggatactcaatgaattacatgaactctgcttggctagccggcaagactcggatctgtaa

SEQ ID NO: 368 - DNA, 1782 bp, Arabidopsis thaliana
atggctactttgactgagccatcatcatctttgagtttcacatcttctcatttctcttatggttctattgggtccaatcacttctcatcaagctcagcttctaatcctgaagttgttagtctaaccaaactcagctccaatcttgagcagcttcttagtaattcagattgtgattacagtgatgcagagatcattgttgatggtgttccagttggtgttcatagatgcattttagctgcaagaagtaagtttttccaagatttgtttaagaaagaaaagaaaatttcgaaaactgagaaaccaaagtatcagttgagagagatgttaccttatggagctgttgctcatgaagctttcttgtatttcttgagttatatatatactgggagattaaagccttttccattggaggtttcgacttgtgttgatccagtttgttctcatgattgttgtcgacctgccattgattttgttgttcaattgatgtatgcttcctctgttctccaagtgcctgagctagtttcatcttttcagcggcggctttgtaactttgtggagaagacccttgttgagaatgttcttcccattcttatggttgctttcaattgtaagttgactcagcttcttgatcagtgtattgagagagtggcgaggtcagatctttacaggttctgtattgaaaaggaagttcctcccgaagtagcagagaagattaaacagcttcgacttatatccccgcaagacgaagaaaccagtcccaagatttcggagaaattgcttgaaagaatcggtaaaattctcaaggccttggattcagatgatgttgagcttgtgaagcttcttttgactgagtcagatatcactctagatcaagccaatggtctgcattattctgttgtgtatagtgatccgaaagttgttgccgagattcttgctctggatatgggtgatgtgaactacaggaattcccggggttacacggttcttcattttgctgcgatgcgtagagagccatcgatcattatatcgcttatcgataaaggcgccaatgcatctgagtttacatctgacggacgtagcgcagttaatatattaagaagactgacaaatccaaaggattatcataccaaaacagctaaagggcgtgaatctagtaaagccaggttatgcatcgatatcttggaaagagaaatcaggaagaaccccatggttctagatacaccaatgtgttccatttctatgcctgaagatctccagatgagactgttgtacctagaaaagagagtggggcttgctcagttgttctttccaacggaagctaaagttgctatggacattggtaacgtagaaggtacaagtgagttcacgggtttgtcacctccttcgagtgggttaaccggaaacttgagtcaggttgatttaaacgaaactcctcatatgcaaacccaaagacttcttactcgtatggtggctctaatgaaaacaggtaacaaaaagcttgctctctttgagactggtcgaaggttttttccatatggttcagaggttctagataagtacatggctgagtatatagacgacgacatcctcgacgatttccattttgagaagggatctacacatgaaagaagattgaaaagaatgagatatagagagcttaaggatgatgtccaaaaggcatatagcaaagacaaagagtctaagattgcgcggtcttgtctttctgcttcatcttctccttcttcttcttccataagagatgacctgcacaacacaacatga

SEQ ID NO: 369 - DNA, 867 bp, Arabidopsis thaliana
atggctgatcatttgagtttatgtaccgatcgtctcataacatctgagagcttggactcagagaaagattcagattcttcaggagaaagttcttaccggcctcaaggcacagacttggcttcttcatctgtgaatgaaactgaggttcctagagagtactacgcggttgcggatgaggaagaacctcttctccaatctgttgagtgtcgtatttgccaagaggaagatagtactaagaaccttgaagctccttgtgcttgtaatggtagtttaaagtatgctcaccgcaagtgtgttcagcgttggtgtaatgagaaaggcgacataacctgtgaaatatgtcaccagccttatcaacatggatacactgcacctccgcctcctcctcctgatgaaactataattcacatcggtgacgattgggagaacggagttccgttggacttgaccgacccgcgcattctggcaatggcggctgcagaacgtcatttcttggaagcagactatgatgaatattctgagaataactcaagcggagctgccttttgtcgctctgctgctctcatcctaatggcacttttactgttacgagatgcgctaaatctcacaacgaacccagacgacgaggacgatccaactgccttcttctctctattccttcttcgtgctgctggttttctcctcccatgttacatcatggcatgggccatcggtatactacaacgtcgaagacaaagacaggaagcagcggctctagctgccgcagaagttactttcatgatacacggtggtgggcctcaacgcagaggactgcactttgctgtagcaccgcagccgccgatatccaatgtcccaacaccagtttga

SEQ ID NO: 370 - DNA, 396 bp, Arabidopsis thaliana
atgagccgaagtttgggaataccggtgaagcttcttcacgaggcctcaggtcatatcgtgacggtggagctaaagagcggcgagctttacagaggaagtatgattgagtgtgaggataactggaactgtcagctcgaggatattacttataccgccaaggatggtaaggtatcacagcttgagcatgtcttcattcgaggcagtaaagtcaggtttatggtcataccagacattctcaaacatgctccaatgttcaagcggttagatgctagaatcaagggaaagagctcatcactgggtgttggcagaggtagaggtgcaatgcgagggaaaccggctgccgggcccgggcgtggaactggaggaaggggagcggtaccacctgtgaggagatga

SEQ ID NO: 371 - DNA, 828 bp, Arabidopsis thaliana
atgtcaacaggaatatccactgatctccatgtccattttggagctctaaatttctcaaaaacctacaaatctggtttaagcaatcgaacggtgtctttttcgagagtcgggtatgctcagaacaggaaattgagctgcagtgtttccaacacagagaatgtagctcctaaggatgatgaaagaggaaaggatagacctttggttaagatgtgtggcatcacatcagccagagatgcagctatggcagttgaggctggtgccgattttattgggatgattatttggccacattcaaaacgatctatttctctttctgtcgcaaaggatatctccaaagtggccagggaaggtggggccaaacctgttggtgtttttgttgaagatgatgagaacacgatactgagagcagctgattcctctgaccttgagcttgtgcagcttcatggtaatggttcgcgtgctgctttctcgaggttagtacgcaagaggagagtcatatatgtccttaatgcaaatcaggatggaaagctcttgaatgaagttcctgaagaggattgtcatcttgctgattggattcttgtggatagtgcaacgggtgggagtggacacggatttaactgggctcaattcaagttgccttccgtcagaagcagaaatgggtggctcttagctgggggaatcaatccaacaaatgtttcagaagctctttctatccttcaacctgatggaattgatgttagtagcggtatttgcggtacagacggtatccagaaggataagtctaagataagctcctttataactgcagttcgctctgtacactactaa

SEQ ID NO: 372 - DNA, 846 bp, Arabidopsis thaliana
atgaaacaagctttgttcttttcctcaggaatatccactgatctacacgtccattttggagctctgaatttctcaaaaacctacaaatctggtttaagcaatcgaacggtgtctttttcgagagtcgggtatgctcagaacaggaaattgagctgcagtgtttccaacacagagaatgtagctcctaaggatgatgaaagaggaaaggatagacctttggttaagatgtgtggcatcacatcagccagagatgcagctatggcagttgaggctggtgccgattttattgggatgattatttggccacattcaaaacgatccatttctctttctgtcgcaaaggatatctccaaagtggccagggaaggtggggccaaacctgttggtgtttttgttgaagatgatgacaacacgatactgagagcagctgattcctctgaccttgagcttgtgcagcttcatggtaatggttcgcgtgctgctttctcgaggttagtacgcaagaggagagtcatatatgtccttaatgcaaatcaggatggaaagctcttgaatgaagttcctgaagaggattgtcatcttgctgattggattcttgtggatagtgcaacgggtgggagtggacacggatttaactgggctcaattcaagttgccttccgtcagaagcagaaatgggtggctcttagctgggggaatcaatccaacaaatgtttcagaagctctttctatccttcaacctgatggaattgatgttagtagcggtatttgcggtacagacggtatccagaaggataagtctaagataagctcctttataactgcagttcgctctgtacactactaa

SEQ ID NO: 373 - DNA, 1848 bp, Arabidopsis thaliana
atggctagtaatgtatttgatcatccacttcaagaattagagggtgaagataatggtgtaaagagcgagaaagcgagtttattggaaacatctggttctgtagatactactcctgaggattctggtcatcgttcttctgatgggcataggggactagaccactgtgaaactgcacctgttggtctctatggagatatgcttatcaatgacagtgagattcagtactctcggtccttgacagagaaagggtctcctgcgattcataatcttaaattagatagattgtcggagcaagaaaagcaaaaactcattgttgagctagtcagaatacaaaatgacgggacagtggaagttatagataacggtactccggtgtcggagttatgggagtttgagccaacgaaagggcagtccacaatcacatatgaaaagtccttaactgagtcctttagatccattccaaggttaaaaattgctatacttgtggttggaactcgaggcgatgtgcagccttttctggccatggcaaagcgcctccaggagtttggtcatcgtgttaggttggcaactcatgcaaatttccgctcttttgtacgggctgctggagtagagttttatcccttgggcggtgatccccgagagttagctgcctatatggctagaaataaaggtctcattccctctgggccttcagaaatatcaaaacagagaaaacagttgaaggcaattatagagtctcttcttccggcatgcatagagcctgatttggaaactgctacgtctttcagagctcaagcgataattgcaaatcctcctgcatatggacatgtgcatgttgctgaagctcttggagtaccaattcatatttttttcacaatgccttggacgccaaccaatgaatttccccacccgttggcgcgtgttcctcaaagtgctgcatattggctgtcatatatagttgttgatctgatggtatggtggagcataaggacatatataaatgattttaggaagagaaagctaaaccttgcacctatcgcatattttagcacataccatggctcaatttcgcacttgcctactggttacatgtggagtccccatgttgtgccaaaaccaagtgattggggtcctttagttgatgttgttggctactgtttcctgaaccttggatcgaagtaccagcctcgcgaagagtttctccactggatagaaagaggatcaccgcccgtatatattggttttggaagcatgcctcttgatgatccaaaacaaacaatggacattatactggaaacattgaaagatacagaacagagagggatagttgatcgaggttggggtggccttggaaaccttgctactgaagttcctgaaaatgtattcttagtggaggactgtcctcacgattggttgtttcctcaatgttcagctgtggttcatcatggcggtgctggaaccacagcgactggactaaaagctgggtgtccaacaacgatcgtgccattctttggggatcagttcttctggggtgacaggatctatgagaaaggacttgggcctgcgccaataccgatagctcagctcagtgttgagaacctcagtagctccataagattcatgctacaaccagaggtgaaatcacaagtgatggagctagcgaaagtactggagaacgaggatggtgtagctgcagcagttgatgcattccacaggcatttgccaccagagctgccactgcccgagtcctcgtccgagaaaaaagatgaagatgatcgaccagacctgttacagtggttctttattcagattggcaagaagtgttgtcttccatgtggtggcgtgtga

SEQ ID NO: 374 - DNA, 3558 bp, Arabidopsis thaliana
atggctagttcatcttcatctgagagatggatcgatggtcttcagttctcttccttgttatggcctccgccacgagatcctcaacaacataaggatcaagtcgttgcttatgttgaatattttggtcaatttacatcagagcaattcccagatgacattgctgagttggtccggcatcagtatccatcaactgagaagcgacttttagacgatgtgctgggtatgatcaacatttatgatccacacttctctttttcgatgtttgtccttcatcatccggagcatggtcatgcagtcattcttccaatcatttcatgtcttattgatggctcgttggtgtacagcaaggaagctcatccgtttgcctctttcatatctttagtttgcccaagtagtgagaatgactattcggagcaatgggctttggcatgtggagaaatccttcgcattttgactcattacaaccgtcccatttataaaactgagcagcaaaatggagatacagagagaaattgtctgagcaaagctacaactagtggttctccgacttcagagcctaaggctggatcaccaacacagcatgaaaggaaacctttaaggcctttgtctccatggatcagtgatatactacttgctgctcctcttggtataagaagtgactatttccgatggtgtagtggtgtaatgggtaaatatgctgctggagagctcaagccgccaaccattgcttctcgaggatctggtaaacatcctcaactgatgccttcaaccccaagatgggctgttgctaatggagctggtgtcatactgagtgtttgtgatgatgaagttgctcgatatgagactgctacgctgacagcggtcgctgtccctgcacttcttcttcctccgccaacgacatccttagatgagcatctagttgctggccttccagctcttgaaccatatgcacgtttgtttcatagatactatgccattgcaactccaagtgctacgcagagacttcttcttggactcttagaagcaccaccgtcgtgggctccagatgcacttgatgctgctgtacagcttgtggaactccttcgagctgctgaagattatgcatctggtgtaaggctacccaggaactggatgcatttgcacttcttgcgggctataggaattgctatgtctatgagggcaggtgttgctgctgatgctgcagccgctttgcttttccgcatactctcacagccggcactgctttttcctccgctaagtcaagttgagggagtagaaattcagcacgcgcctattggtggctacagttcaaattacagaaaacagatagaagttcctgcagcagaagcaaccattgaagccactgcccaaggaattgcctcaatgctttgtgctcatggtcctgaagttgagtggagaatttgcactatatgggaagctgcttatggtttgatccctttaaattcttcggcggttgatcttcccgaaatcatagttgctaccccactgcaacctcctatcttgtcatggaatttatacattccactcctcaaagtacttgaatatcttccacgggggagtccttcggaagcatgcttgatgaaaatatttgttgccactgtggaaacaatactcagtagaacttttccgcctgaatcttccagggaactaaccagaaaagctagatcgagttttaccacaagatcagcgaccaaaaatcttgctatgtctgagcttcgtgctatggtccatgctctctttttagaatcatgcgctggtgtggaattagcttcacgcctactttttgttgtgttgactgtatgtgttagccatgaagcacagtctagtggtagcaagagaccgagaagtgaatatgctagtactactgaaaatattgaggcgaatcaacctgtatctaacaatcaaactgctaaccgtaaaagtaggaatgtcaagggacagggacctgtggcagcatttgattcatacgttcttgctgctgtttgtgctcttgcctgtgaggttcagctgtatcctatgatctctggtggggggaacttttccaattctgccgtggctggaactattacaaagcctgtaaagataaatgggtcatctaaagagtatggagctgggattgactcggcaattagtcatacgcgccgaattttggcaatcctagaggcactcttttcattaaaaccatcttctgtggggactccatggagttacagttctagtgagatagttgctgcggccatggttgcagctcatatttccgaactgttcagacgttcaaaggccttgacgcatgcattgtctgggttgatgagatgtaagtgggataaggaaattcataaaagagcatcatcattatataacctcatagatgttcacagcaaagttgttgcctccattgttgacaaagctgaacccttggaagcctaccttaagaatacaccggttcagaaggattctgtgacctgtttaaactggaaacaagagaacacatgtgcaagcaccacatgctttgatacagcggtgacatccgcctcaaggactgaaatgaatccaagaggaaaccataagtatgctagacattcagatgaaggctcagggagaccctcagagaagggtatcaaagatttcctcttggatgcttctgatcttgcgaatttcctcacagctgatagactcgcagggttctattgtggtacacaaaagcttttgaggtcagtgcttgcagagaaaccggagctgtctttctccgttgtttcactgttatggcacaaactgattgctgctcctgaaatccagcccaccgcagaaagcacctctgcgcaacaaggatggagacaggttgttgatgcgctatgcaatgtcgtatctgcaacgccagcgaaagcagcagcagcagttgtccttcaggctgaaagggagttgcagccttggatcgccaaagatgatgaagaaggccaaaaaatgtggaaaatcaaccaacggatagtcaaagtgttggtggaactcatgcgcaatcatgacaggcctgagtcactggtgattctcgcaagtgcatcagatcttcttctgcgggcaactgatggaatgcttgttgatggagaagcttgtacattacctcaacttgagctacttgaagccacggcaagagcaatacagccggtgctagcttgggggccatctggactagcagtggtcgacggtttatccaatctattgaagtgtcgtctaccagcaacaatacggtgcctttcacacccaagtgcacacgtacgtgccttaagcacgtcagtactacgtgatatcatgaaccaaagctccatacccatcaaagtaactccaaaactgccaacaacagagaagaacggaatgaatagtccgtcctatcgattcttcaacgccgcctcaatagactggaaagccgatatccaaaactgtttaaactgggaagctcacagcttgctctccacaactatgcctactcagtttctcgacactgcggctcgggaactcggctgtactatatccttgtcccaataa

SEQ ID NO: 375 - DNA, 285 bp, Arabidopsis thaliana
atgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatga

SEQ ID NO: 376 - DNA, 1242 bp, Arabidopsis thaliana
atgacctcgatgtgtcaagctgtgggtagcaacgtgtaccctttgattctggttccaggaaacggaggtaaccagctagaggtacggctggacagagaatacaagccaagtagtgtctggtgtagcagctggttatatccgattcataagaagagtggtggatggtttaggctatggttcgatgcagcagtgttattgtctcccttcaccaggtgcttcagcgatcgaatgatgttgtactatgaccctgatttggatgattaccaaaatgctcctggtgtccaaacccgggttcctcatttcggttcgaccaaatcacttctatacctcgaccctcgtctccgagatgccacatcttacatggaacatttggtgaaagctctagagaaaaaatgcgggtatgttaacgaccaaaccatcctaggagctccatatgatttcaggtacggcctggctgcttcgggccacccgtcccgtgtagcctcacagttcctacaagacctcaaacaattggtggaaaaaactagcagcgagaacgaaggaaagccagtgatactcctctcccatagcctaggaggacttttcgtcctccatttcctcaaccgtaccaccccttcatggcgccgcaagtacatcaaacactttgttgcactcgctgcgccatggggtgggacgatctctcagatgaagacatttgcttctggcaacacactcggtgtccctttagttaaccctttgctggtcagacggcatcagaggacctccgagagtaaccaatggctacttccatctaccaaagtgtttcacgacagaactaaaccgcttgtcgtaactccccaggttaactacacagcttacgagatggatcggttttttgcagacattggattctcacaaggagttgtgccttacaagacaagagtgttgcctttaacagaggagctgatgactccgggagtgccagtcacttgcatatatgggagaggagttgatacaccggaggttttgatgtatggaaaaggaggattcgataagcaaccagagattaagtatggagatggagatgggacggttaatttggcgagcttagcagctttgaaagtcgatagcttgaacaccgtagagattgatggagtttcgcatacatctatacttaaagacgagatcgcacttaaagagattatgaagcagatttcaattattaattatgaattagccaatgttaatgccgtcaatgaatga

SEQ ID NO: 377 - DNA, 1428 bp, Arabidopsis thaliana
atggtgacgaaagaatccattgaagtgatagctcagagcattggactctccactctttctccggacgtctcagccgctcttgctcccgatgtcgagtatcgcgtccgagaggtcatgcaggaagctatcaaatgcatgcgtcatgctcgacgcaccactttaatggctcatgatgtcgattctgctcttcatttcaggaatttggagcctacctctggctccaaaagtatgcggttcaagagagctcctgagaacagagatctatacttcttcgatgacaaagatgtcgagctcaagaatgttatcgaagctcctctaccaaatgcacctcctgatgcatctgttttctcattggacgatggcttggctgctagacaggtgctttctaaggaccttcagatttactttgacaaagtcacggagtgggctttgactcaatctggctccaccctctttagacaagcactcgccagcttggaaattgatcctggactccacccattagttccctttttcacttctttcatcgctgaagagattgtcaaaaacatggataattatccaatcttgttggctttgatgcgtcttgctagaagcctccttcataaccctcatgtacatattgagccatatctgcatcagttgatgccgtctattatcacttgccttattgccaagcgcttaggaagaaggtcatctgataatcactgggacttgagaaacttcactgccagcacagttgcttcaacgtgcaaaaggtttggacacgtttatcacaatttgttgccacgtgtcacaagatcactgcttcatacctttttggacccaaccaaggcactcccacaacactatggggcaattcaagggatggtagcccttgggcttaatatggttcgctttcttgttctcccaaacctagggccgtatttgctgcttcttttacctgaaatgggacttgagaagcagaaggaagaagctaagaggcatggggcttggcttgtttatggagcgttgatggtggcagctggtcgatgcctatatgaacggcttaaaacatctgagacactgctgtctcctccaactagctctgtctggaagacaaatggaaagctcaccagccccaggcaaagtaaacgcaaagcaagcagtgacaacttaactcatcaaccaccactgaagaagatagcagtagggggaattatacaaatgagctccacacaaatgcagatgcgcggaaccacaacagtccctcaacagtcccacacagatgcagatgcacggcaccacaatagtccctcaacaattgctccgaagacttcagctgctgcaggcactgacgtcgacaactatctctttcctctttttgagtattttggtgagagcatgcttatgttcacccccacacatgagctcagtttcttcttgtaa

SEQ ID NO: 378 - DNA, 1791 bp, Arabidopsis thaliana
tggagtcaatccactgcaatagtttactaaaccctaatttctccttaaaccagcgtcgtcggaggattaatcacgctgttcttaatcggagagatgctcttttgcgatccctcaacgccgtggagttgcggcggagcaggacgttctcggctgtacggacttctaatttctcagttactgcggcggcgacggatgttggtggtcggaattcgacggatgcatcggtaatgacaacggcgatgagcggggtggagagaggtgtgcgagtagggaaatcgagctccgcgcttgagcagctagatattgagcgaggcgtttgcgttccattccgaaagtattctccggagactgtgaggagtaaagtgctggaatcaagaggagcagtcgtgtctctagtttcaaggggtgtggagattgtttggactcttggggatgaggaagttgtcccctttcgtgctaggcagcttaggaacctgttgtgcaatttgggaccttcatttatcaaagctggacaagttctcgcaaataggcctgatatcatccgtgaagactacatgaacgagctctgcatactccaagatgatgttcctccattcccaaacgaggttgctttcaatatcatcgaggaagagttaggccaacctcttgagaacatatttagcaagatttcttcacaaacaatagcagctgcaagcttaggacaagtttatcgagctactctacgtgccactggagaggatgttgctatcaaggttcttctaaatgaaaattttattgtggctacagagttcatacaggtgcagagaccacaaatagagcctataatttaccgggatctctttcttttccgaaccctcgcctccttcttaaatggcttcagtctacagaaactgggttgcaacgcagagctaatagttgatgaatttggagaaaagcttttggaggagcttgactacaccttggaagccagaaacattgaagactttctggagaacttcaaagatgaccccacagtcaaaattcctggagtatacaagaatctttgtggtccgcgggttctggtaatggagtggattgatggtattcggtgcactgacccacaggccatcaaggatgcagggattgatttaaatggattcttgactgttggcgtaagtgctgctctaaggcagctgttggaatttggattgttccatggagatccacatcctggaaatatctttgcaatgcaagatgggcgtatcgcttatgtggacttcggtaatgttgctgtactgagtcaggaaaacaagcaaattttgattgatgctgttgttcatgcggttaatgaggactatggggagatggcaaatgatttcactaggcttgggttcttggccaaggataccgatgtttctcctatcgttccagctttagaagccatctggcagaactctgcagggaaaggacttgcagatttcaatttccgaagtgttacaggaccccatgcacatttgaagaaacggtgtcacgtttttggtgcaggacaattcaacaagcttgtgtacgactttcccatccgtatcccagagcggttctctcttgttattcgttctctgcttacgcaggagggtatatgtttcacactgaagcctgattttaaatttctagaggtttaccgaatgttttccgagattttgtgttgtcatggagcaactcagtattatccgacagatgatgaatcagcttctcacttactttttttggctctttttgaagaggaaagaggtaatatatattacagggagtaga

SEQ ID NO: 379 - DNA, 1539 bp, Arabidopsis thaliana
atgatggttacattagtactaaagtacgtcctcgtgatagtcatgaccttgatattaagagtcctatacgactccatttgttgctacttcctcacaccaagacgaatcaagaagtttatggaacgtcaaggcatcacggggcctaaaccccgtctcctcaccggaaacatcattgatatctccaaaatgctctctcactccgcttctaacgactgctcttccatccaccacaacatcgtcccacgccttcttcctcattacgtctcttggtccaaacaatatgggaagagatttataatgtggaacgggacagaaccgagactatgcctaacggagaccgagatgattaaagaattgctaacgaagcacaatccggtcaccgggaaatcatggctgcaacaacaaggaactaaagggtttatagggcgtgggcttctcatggccaacggcgaggcttggcaccaccaacgtcacatggcagctccggctttcacacgtgataggctcaaaggatacgctaagcatatggtggaatgcacgaagatgatggctgagaggctgagaaaggaggttggagaagaggtggaaattggtgaggagatgcggcggctcacggcggatataatatcgaggacggaatttggaagtagttgtgataaaggaaaggagctttttagtctactcactgtacttcaacgtctttgtgctcaagccactcgccacctctgttttcccggtagccggtttctacctagcaaatacaatagagaaataaagtctctgaaaacggaagtggaacgtcttttgatggagattatagacagccgaaaagacagtgtagagatcggtcggagtagctcatacggggatgacctcttagggcttcttttgaaccagatggatagcaacaagaacaaccttaatgttcaaatgataatggatgagtgcaagactttcttctttaccggtcatgagacaacctctcttctcctcacgtggactctcatgctccttgctcataatcccacttggcaggacaatgtccgcgatgaggtccggcaagtttgtggccaagatggtgtcccttccgttgaacagctctcaagtcttacttcgttaaacaaagtgataaacgagtcattaagactttaccctcctgccacacttttaccaagaatggcatttgaagacataaaactaggtgacctaatcatccctaaaggtttatctatttggatccctgtccttgcgatccatcatagtaatgaattatggggcgaagatgcgaacgagttcaaccctgaacgatttactactagaagttttgcatctagtcgccattttatgccttttgcggctggacctaggaactgcattggccagacttttgccatgatggaggcgaagataatattagcaatgcttgtttccaaattcagttttgcaatatcggagaactatagacatgctcctatagttgtgcttactataaaacctaagtatggagttcaattagttttgaagccacttgatctatga

SEQ ID NO: 380 - DNA, 1017 bp, Arabidopsis thaliana
atggcttccatttccagaatcttaccaacagatggcagattaagtcaatgcagaatcaacacctcgagggttgtttgcaaagctgctgctggtgtgtcaggtgacttacctgagagtactcctaaggaacttagtcagtatgagaagattattgagcttttgacaaccctttttccactttgggttacatggttggaaacagatctctttactctaggtcttggatttcttatgctttccatgggtttgactcttacgtttgaagatttcagaagatgtttacgtaatccatggacggtgggtgttggttttcttgctcaatatatgatcaagccaattctaggttttctcattgcaatgactcttaagctttcggcacctcttgcgactggccttatcctagtctcatgctgccctggaggacaggcgtcaaacgttgctacttacatttccaaggggaatgtagcgctctctgtactcatgacaacgtgttcaaccattggggctattataatgactcctcttcttactaagcttcttgctggtcagcttgttcccgttgacgctgctggacttgctcttagtacgttccaagtagtgttggttcctaccataattggagttctggcaaatgagttctttcctaaatttacgtctaagatcataacagtgacgcctctaatcggagtcattctgactactctgctctgtgccagccctattggacaagttgcagatgttttgaaaacccaaggagctcaacttatactcccggtggcactccttcatgctgcagcctttgctattggctattggatttcaaagttttctttcggcgagtccacttcgcgtaccatttctatagaatgtggaatgcaaagttcagcgctcgggttcttgcttgcacaaaagcatttcacaaaccctctagttgctgttccttctgcagtcagtgttgtctgtatggcggtaagttttcatagccatttcactaaagttcacatgcaaattccttaa

SEQ ID NO: 381 - DNA, 1443 bp, Arabidopsis thaliana
atggaagccaaaatcgtcaaggtatcggatagtagttataaagatggtcttgggaagaagagaaagcatccagggaactatactccttatgattctggaaggtcatatgcaaagctgcaatgggtgctttcacccaacagttccacccagaagcttgagaaaaggagaaatttggatggtgaaaacaaagttattgtttctgagaatcatgttgagaagtctttggtcagatacttctcttattataagaagacaggagtgccaaaacgtgtaatgttccatgagaatggtgaatggattgatttgcctgatcatattctatgcgacatcaggaatgatcttgaagcaaagagagctacaattgagttcaattggtgcggtcgccattttctcctggatttcttgcacatgtatcgactagacttggaaacaggtgtaaaaacccagcttgcttggattgatattgctggcaaatgctttttccctgaaacttttgacaccctcgaaagggacggctgccatcatatccgtggggaagatccggaacaacatgatcaacgtgagatcaagctgcacattgaaattgatgtaaatagtggggagttaccgaggctgaatttgaatgtggtcactgacgagtctggtgacaatatggatgattttcaagctgttcagagatcctcaaatgggccaaatgacgaggcatcagaggatagctgcagccgtgagcttgatgatgctgttgagaaatgggacaaaacagaaactgatcggttctctggtgtcaagcctgctgaggaggagcttgataaagatgctgtcaaacaaatgtttgctttgggtgctgccactctagggcatgtagagtcgcttgatgtgtatcagttttcaagcgagattgcaaaggctcgtctatctcttttccagaagcaagctgacatcactaagaaacaccgaggagatgcaaacattagatatgcatgggttcctgcgaagaaggaagtgttatctgccgtgatgatgcatggacttggagtgggtggagcattcattaaaaagtctatgtatggtgttggggttcacgctgcaaactgcccttatttcagtgctagatactgtgatattgacgataatggtgtgcggcacatggttttgtgccgcgtaataatggggaatatggagcctcttcgtggtgataacacgcagtactttactggtggagaagagtatgataatggggttgatgatgttgagagtccaaagcattaccttatctggaacatgaatatgaacactcacatttacccagaatttgtagttagcttcaagctgtctatccccaatgctgaaggtgattaccatttgagccaggaagggtatcaaatggaggttcagggagcgaaaagaatagctccagcagtagaaggcccagatctcctataa

SEQ ID NO: 382 - DNA, 1131 bp, Arabidopsis thaliana
atgtctaatttcacttatacatctgctttcaacttatccgacaactccccttttaatcccgccattggttcttcgtcttcttcttcctccgcgctcgtcgtagcttccgatgatgataataataccgatgatgcttgtagcatctgtctcgagcctttcaccctccaggatccttccactgtcaccagctgcaaacatgaatatcaccttcagtgcatcattgaatggtcacagagaagcaaagagtgtcctatttgctggcaattgtttgttttgagagaccctgctagccaagagcttttagctgctgtggaaaaggaaagacttttgaaaaccaggaatatatcttcatcctctccaatctctattcatcactctcatgacgattttcactctgaggaggaggaatcacagtttagcagctttgatgaacaattcttgaggcatcttactgaagctgcacatagacgttgtttgcttcgcagaagggatggtcaaatatcctctagtcttgtttcgtccagcgatcccactacgattcatcctactgatttggtcaatctttatcgtctctctgctatttcccatgttgaacatcaaaactcaaacccttgtccaagtcctggctcaatgactccatctcccgtctctggtcattcttccattcctgcagatagcaataacggatccagaatctctcctggcccttctccatctcgttcatctcaaagtccaaaatcacctgaagcatcctcgcttccggaagccattaaatcgaaactagctgctgcttctgcaaagtacaaggaatcgatctctaaaagtaaacaaggtcttaaagagaagctacttgctcgcaataactcagtgaaagaattgagcaaaggagtgcaacgtgagatgaatgcaggaatagctggtgttgcacgaatgatcgaacgcatggatttttcttcaaaacgttttggagggtctgctcatgtatcaacctccactgctactgcttctggattcaatttctcattcaaagggaaacgtgtagaagccaattctaagtctaacaacaatggagacaaaaccgaaccccaaaagctgcaggtttcagacttctcccggtttcttgtcttctaa

SEQ ID NO: 383 - DNA, 426 bp, Arabidopsis thaliana
atggaaacgaaggcggctcctgaagctggtatgatcaaaaagtccaacgaggagtggcgtacggttctatctcctgaacagtttaagattcttagagagaaatctattgaaaagagagggtcaggagaatatgtgaagttgttcgaggaaggaatctactgttgtgttggttgtggaaatccggtttataaatcaaccactaaattcgattccggttgcggttggccggctttttttgatgctattcctggcgccattaaccgaaccgaggagagagctggattaagatatgagataacttgcacaaaatgtgatggacatctaggtcatgtcttaaaaaatgaaggttttccaacaccaactgacgaacgccattgcgtcaacagcgttgctctcaagttctcttccgctatcacatctcagtga

SEQ ID NO: 384 - DNA, 498 bp, Arabidopsis thaliana
atgagatgtctagtgatattctcggtggtttcagcattattagtgtgtggacctgctctttactggaaattgaataagggtttcgttggatctgctcgtagcaccaactccatttgtcctccttgtgtctgcgattttcctcctcctttgtctctcctccagattgctcccgggcttgcaaacctctctattacaggttgtggcagcgatgatccagagctcaaagaggagatggagaagccgtttgtggatcttctcacagaagagctgaagcttcaagaagcagtggcagacgagcatagtcgtcatatgaatgttacacttgccgaagctaaaagagttgcttcacagtaccaaaaggaggctgagaagtgtaacgctgccactgaaatttgcgaatcagctagagagagagctcaagcattgttgctcaaagagcggaagatcacttttttgtgggagcgcagagctcggcaattaggttgggaaggtgagtaa

SEQ ID NO: 385 - DNA, 831 bp, Arabidopsis thaliana
atgacggcatcaggaggaggatcaacggcggcgacggggaggatgccgacgtggaaggaaagagagaacaacaagaagagagaaagaagaagaagagcaatagcagctaaaatcttcaccggacttagatctcaaggcaattataaacttcctaaacactgtgacaacaatgaagtcctcaaagctctttgtcttgaagctggttggatcgttcatgaagatggcaccacttatcgaaagggttctcgaccaacagaaacaacagtgccgtgttcgtcaatccaacttagtccacaatcatcggcctttcaaagcccaattccttcgtatcaagctagcccttcatcgtcatcttacccaagtccgacccggtttgacccgaatcaatcctcgacttatctcattccctatctccaaaacctagcttcgtctggaaacctcgctcctctacgaatttccaatagtgcccctgttacaccgccgatttcttcacctagaagatcaaatccgagacttccgagatggcaaagcagtaatttcccagtctcagctccgtcaagcccaacacggcgtctccatcactacacatcgattccagaatgcgatgaatcggatgtttcgacggttgattcttgtcgatggggaaatttccaatcggttaacgtttctcagacatgtcctccgtcgccgacatttaacctggtcggaaaaagcgttagctccgtcggagtagatgtgtcggtgaagccgtgggaaggtgagaagattcacgatgttggtatcgatgacttggagctgacgctaggtcacaacaccaaaggacgcggctag

SEQ ID NO: 386 - DNA, 489 bp, Arabidopsis thaliana
atgaggaagatcatagggtttagaatcgggagacgagtctcaagatggatctttcgcaaaacccggatccaacgttcaggatacaaccggatacactcgacccagcaagcttgcatgctgatgagaccattagccaaactcaaaagttggggccaacgtctcaagcaaagtttcagacgcaggtctacgagaagatccgcatacatacccgttgatcataagaaagccgacccggttccaaggggacacttagctatctacgtgggtcaaaaagacggcgactgtcatagagttttggtacccatcgtttactttaaccatcctttgttcggtgagctgcttcgagaagccgaaaaagagtacggattttgccacgaaggaggtatcactattccttgtctgtattcagatttcgaacgggtcaagacccggatcgcatcggggtcaagttctcgggtatttccatggggccgtcattgccgcaattga

SEQ ID NO: 387 - DNA, 708 bp, Arabidopsis thaliana
atggctgctgacgtcagctctctcgtacggttactaagcggttacaaagatgatcgagcggtggttaaagattctgccggagccaaatcctcggcggcgctgatgactcgtgaccttcttggaaacggcagaggaggaggaggcgatcggtctttagagcttgacctcgaccttcaagtccccaccggttatgaaaaacgcctcgacttgaagtcagggaaagtgtatttgcaacgatgcaattcaacgagctcgtcgtcaataacaaacgcagaccaaaccaatcaaacagtaccaacgtttcaggatttgaattttcctcctccgactttgaacaattctcctttgttgaacctcttcgacgatacaacgccggaactgaagctacttccgtcgtctcgttcttctcgtccgaacactagtaatttacagagtgtatgcacactggacaaggtgaaatcagctctagagagggcagagagagatcctgctatgttcaagaaacgtcaatcaccggatgatacggtttacgatcattataggacggaggctgtagcgtcaccggtggttgccggatgtcctggttgtttatcgtacgtgttggtgatgatgaataacccgaaatgtccgaggtgtgataccattgttcctttgcctacaaatcctatgaagaagaagcctaagattgatctcaacatatcaatctga

SEQ ID NO: 388 - DNA, 513 bp, Arabidopsis thaliana
atgacaaatgctgttggtaaagccttgttctctaaagcaggggagctttgtgtgcctgttggcttcatgtgcatgaagggtctagatcttcacattgcagaaattgaggaactttgcacagaatttccaaagacaactgttttactagatcacgctggattctgcaaagtaccagaaagtggtgaggcaaagcttgcttattctcaactcatgaagctgtctagatttccacaggtatatgtgaaattcagtgctctattcaggatctcaagaaccggcttcccgtatcaggacctatcgcctctcctatctcaacttgtgtcccattttggggcaaatcgtgtcatgtggggcagtgacttcccatttgttgttcttgaatgtggatataaagaagctaaagaagctgtgactatcattgcaaaagaagcatccttgtcaagttctgagatggactggattctgggaaagactctgatgcagctcttccctggacaatgggttcttccttga

SEQ ID NO: 389 - DNA, 1359 bp, Arabidopsis thaliana
atgtgtagctacggcggtcatatccttcctcgccctcacgataagtctctctgctacatgggcggtgacactcgcatcgttgtcgtcgaccgtaactcctctctcccttctctcatcgctcgtctctccaacacgcttctcgacggtcgttccttcaccctcaagtaccagttacctagcgaagaccttgactctctcatctccgtcactaccgacgaagatctcgacaacatgatcgaagagtatgaccgtaccatttccgcttccaattccaccaaaccttcgcgtctccggttgtttctattcacctccaagcctgaggctactcaatctatgggtcagatccttgagagctctgccaagagcgacgattggttcctcaacgcactcaatagcgccggtcttctcaatcgaggattctcagattctgatactaacgtcaatcgtttacttgcaacagcaacctccaccgccgcagcagcaagaacaacagcaaggaggccaagatgtgaactgcttaccggattctccgatgttagatacatcctcttctttcggctccacttcttcgtctccctcgctcgccaatttgcctccgatccgtgtccatatccaagcacacttttgtcacagcatcagaatcaggacccagcctatatccttcacccccagtttgagcaacaatctgcacaatctcagccacagcagcagttcatacacactgctgctcctcctcaatacattcatcaccatccgtctagcggccttcctgtcccgacttacatccaggtttacccttcgcaacagcctcaacagtccttccatcaacacgcaggtcgactggatcagcagccttatcctgtttattatgtcactgctcctgtcccacctaggccctacagtatgcctgtgccacaatctccaagtgtgagcgatgctgcagggtctatcccctctaaccatcccaactctaccatgatgcctccacctcctaacaaccacatgagaagtgttagcagtggcaaacctgagatgggacaggctggggtttacacaacagccccaggtgtgggcggtgctcagatggttcaccagattcccacaaaccagcagcaattcatggggtattcgcagatccgtcaccctcctcagtctggttcagctgggaatccaaactatggatatgaatatgtcgacaatgctcatacacagatatactacactcaacctatgggacatgcacagtaccagacaatgactgggcctccacctgccatggtgatgcctgatggttctgctgctgctaagcttccagctgagaacatgactcaacagatccggagttcacagccattgtga

SEQ ID NO: 390 - DNA, 525 bp, Arabidopsis thaliana
atggagaagattattgacgtagcttatggcgcatcagtgaaggtgggtttgacgttgttggagatgaatctgttgccggatattgtcattaggcggctcacacgtctgcttctggccggtcgtctccgttccggttacaaacccacggcggagatgcaactctccgatctcctccgttttgttgactctataaagaagatgcctatagctatccataccgagaagccaaagactcaacactatgaattaccgacagctttcttcgaacttgtccttggaagaaacatgaagtacagctcttgttacttctcaaacgattcaagtagcttagaagatgcagaggaagcaattttggctctttattgtgaaagagctaaagtggaagatggtcaaagtgttcttgatatcggatgtggctggggatccttgtctttgtacattgcacgcaagtacagcaaatgcaagttaaccggtatctgcaactccaaaacgcagaaagcatttatcgatgagaaatgccggtaa

SEQ ID NO: 391 - DNA, 1005 bp, Arabidopsis thaliana
atgccacttctcctccgtcgatttccctctccctccgtcgtctcctccttcttcctccgtcgctcaatggcttcctcaacaatctcctcggatataatcactccatcaaacaccaaaatcggatggatcggaaccggagtcatgggccgatcaatgtgtggacacttaatcaaagccggttacacagtcaccgtcttcaatcgaaccatctccaaagctcaaactctcatcgacatgggtgctaacgtcgccgactcaccaaactcagtcgctgaacaatccgacgtcgttttcaccatcgttggttatccttccgatgtccgtcacgtccttctcgatccaaagtccggagctttatctggtctccgtcaaggaggtgttctcgttgatatgactacttctgagccttctttagcagaggagatagctaaagctgcttcctttaagaattgtttctcaatagacgctcctgtctcaggtggagatttaggagctaagaatgggaagctatctatattcgccggaggtgatgaaaccaccgtgaaacgtttagatccgttgttttcgttaatgggtaaagtcaacttcatgggaacaagtgggaaaggtcaatttgcgaaattggctaatcagataactattgcttcgactatgttaggacttgtggaaggtttgatttatgctcataaagctggacttgatgttaagaagtttcttgaagcgatttctactggtgctgctggttctaagtctatagatttgtatggagataggattctgaagagggattttgatcctggtttttatgtgaatcattttgtgaaagatttagggatttgtttgaatgaatgtcagaggatgggtttggctttgcctggtttagctcttgctcaacagctttacttgtctcttaaggctcatggtgaaggtgatcttggtactcaagctcttctcttggctcttgaacgtctcaacaatgtctctgttcaatcatctgactcttga

SEQ ID NO: 392 - DNA, 534 bp, Arabidopsis thaliana
atgaagaaaattgtgttaaagctggatttgcatgacgatagggcaaaacaaaaggcccttaaaacggtttctactctcccaggaatcgattccattgcaatggacatgaaggagaagaaattgacggttattggaaccgtggatccggtaaatgtagtaagtaagctaagaaagtattggccgatgacggatatcgtactagtgggacctgcgaaagagccggaaaaggagaagaaggaggagccgaagaaggaaggtggtggcgagccgccaaagaaagaaggagaagctccaaaagaagaagggaaaaaggaaggagaagcaccgaagaaggaagaagagaagaaagaaggtggcgataagaaggaaggagagaagaaagatcaaccacaagcgcagccgcaaccagttgtgccgccacctgatcatgtgttggaacttgtaaaggcgtataaagcatataatcctcacctaacaacgtattactacgcccaaagcatcgaagaaaaccctaatgcttgcgttatatgttga

SEQ ID NO: 393 - DNA, 822 bp, Arabidopsis thaliana
atgtctatagaggaagaaaacgttccaacgactgttgactcaggagctgccgatacaacggtgaaatctccggagaagaaaccggcggcgaaaggtggtaaatctaagaagacgacgacggctaaagcaacgaagaagcctgtgaaagctgctgctccaacgaagaagaaaacaacttcctctcaccctacctatgaagagatgattaaagatgcgattgtaacgttgaaggagagaactggatctagtcaatacgcgattcagaaattcatagaggagaaacataaatcactgcctcctacttttaggaagcttttgcttgtgaatctcaagagacttgttgcttctgagaaattggttaaagtcaaagcttcttttaagattccttctgctagatccgcagcaacacctaaaccggctgctccggttaagaagaaggcaactgtagtagctaaacctaagggtaaggttgctgctgctgttgctcctgctaaagctaaagcggcggctaaaggaactaagaagcctgcggctaaagttgttgctaaggctaaggttactgctaaacctaaggctaaggttactgctgctaaacctaagtctaagtctgttgctgctgtttccaagactaaagctgttgctgctaagcctaaggctaaggagagaccagctaaagcttctaggacttcgactagaacatctccagggaaaaaagttgctgctcctgctaagaaagtggctgtgactaagaaggctccggctaagagtgtgaaggtgaagtctccggcgaagagagcttcgactaggaaggctaagaagtga

SEQ ID NO: 394 - DNA, 2793 bp, Arabidopsis thaliana
atggattcaacaaatggtaacggagctgatcttgaatcagcaaatggggcaaacgggagtggggttactgaggcattaccacctcctccaccagttatacctccaaatgtggaaccagttcgtgttaaaactgaacttgctgagaagaaggggccagttcgagttcctatggctcgaaaaggatttggaacaaggggccaaaagatccccttgttaacaaatcatttcaaagtcgatgtggctaatcttcagggtcatttcttccactacagtgtggctctattctatgatgatggtcgtcctgttgaacaaaagggtgttggaagaaaaatccttgacaaggtgcatcagacttaccattctgatctggatggtaaagagtttgcttatgacggtgagaagacgttgtttacatatggagctttgcctagtaacaagatggatttttctgtggtgcttgaggaagtatctgctacaagtaaggattttgtgagcagggctaatggaaacggaagccccaatgggaatgaaagtccaagtgatggtgataggaaaagactgcgtaggcctaaccggtccaaaaactttagagtggagatcagctatgcggccaaaattcctcttcaagctcttgctaatgcaatgcggggacaagaatcagagaattcccaggaggcaatacgggttcttgatatcatattgaggcaacatgctgctagacaaggttgcttgcttgttcgacagtcttttttccacaatgatccaaccaactgtgaaccagttggtggtaacatcttaggatgtaggggatttcactccagtttcagaacaacgcagggtggcatgtcacttaatatggatgttacaaccaccatgatcatcaagcctggtccagtggttgatttcctaattgctaaccaaaatgctagggacccttattcgattgactggtctaaggctaaacgaacccttaagaacctaagggtaaaggtcagcccctcaggccaagaattcaagataaccggattgagtgacaagccttgcagggaacaaacgtttgaattgaagaaaaggaacccaaatgaaaatggagagttcgaaactactgaagttacagttgctgactacttccgcgatacaaggcatattgatttgcaatattctgcggatttgccttgcatcaatgttgggaagccaaagcgacccacttacattcctctcgagctctgcgcgttggttccacttcagaggtacacaaaagcacttaccacgttccaaagatctgcccttgttgagaaatccagacagaaaccccaagagaggatgactgttctgtccaaagctctgaaagttagcaactatgatgcggaaccactcctgcgatcctgtggcatttcgatcagctccaactttactcaggtggagggtcgtgttctaccagctcccaagctgaaaatgggatgtggatctgaaacctttcccagaaatggtcgctggaacttcaacaacaaggaatttgttgagcccaccaaaattcaacgatgggttgttgtcaatttctctgctcgctgtaatgtacgtcaagttgttgatgatctgataaaaattggaggatcaaaaggaattgaaattgcttctccctttcaagtgtttgaggagggtaatcaattccgccgtgctcctcctatgattcgtgttgagaacatgtttaaggacatccaatcgaaactccctggtgtcccacaattcatactatgtgtgctccctgacaaaaagaacagtgatctctatggtccatggaagaaaaaaaacttaactgaatttggcattgttactcaatgcatggctccaacgcggcaacctaatgatcagtatcttactaacttacttctgaagattaatgcaaagcttggaggcctgaactcaatgttaagtgtagagcgtacacctgcgttcactgtgatttctaaggttccaaccattatccttgggatggatgtttcacatggatctcctggacagtctgatgtcccgtccatcgctgctgtggtgagttctagggagtggccactgatatccaaatatagagcatctgttcggacacagccttctaaggctgagatgattgagtcccttgtcaagaaaaatggaactgaagacgatggcattatcaaggagttgctggtagatttctacaccagctcgaataagagaaaaccagagcatatcataattttcagggatggtgtgagtgaatctcaattcaatcaggttctgaatattgaacttgatcagatcatcgaggcttgcaagctcttagacgcaaattggaacccaaagttccttttgttggtggctcaaaagaatcatcataccaagttcttccagccaacgtctcctgaaaatgttcctccagggacaatcattgacaacaaaatatgtcacccaaagaacaatgatttctacctctgtgctcacgctggaatgattggaactacccgcccaactcactaccacgtcctgtatgatgagattggtttttcagctgacgaacttcaggaacttgtccactcgctctcctatgtgtaccaaagaagcaccagtgccatttctgttgttgcgccgatctgctatgctcacttggcagctgctcagcttgggacgttcatgaagtttgaagatcagtctgagacatcatcaagccatggtggtatcacagctccaggaccaatctctgttgcacagctcccaagactcaaagacaacgtcgccaactccatgttcttctgttaa

SEQ ID NO: 395 - DNA, 1695 bp, Arabidopsis thaliana
atgtcttgtcctatccatcctaggcgtctcttcctctgcttgcttatttctctcactttcttcgtcgtcgacccttcatcgcagcatatcgaggtcaagaagaaacaaatgcgagagaaagtacgcgagatgttctatcatgcgtatgacaattacatgacttatgcatttccgcatgatgagctaaagcctctaactaaaagtttcacagactccctcagtgagcttggaaatcttaagtacccgtttgacatgattctcctttgtcccagccttgctatattggggaacagtacagaatttgaaaagggggttctctggctctcagaaaatcttactttcgatattgatgcccgggtcaacctttttgagtgcaatataagagttcttggaggacttatctctgctcatcttcttgcaattgatccaaataataggttgattcagggttcctacaacaatcagcttcttcgattagctgaagaccttggaaaacgttttttacccgcgtttgaaacacctacaggattaccatatgcatggattaatttgaagaatggagtaatggagaatgagacaactgaaacaagcacttcaggatgtggttctctcgttcttgaaatgggagcattgtcacggctcactggtgacccgaggtttgaatcagctgcactacgtgcgcttcgtcagctatggaggatgcgaagttcgttagatctgcttgggacaacattggatgtggtaactggggaatggatagagtactcctctagcattggagctggggttgactctttctatgaatacctcttgaaggcttatattctttttggaaaagaagactactggcgaatgtttcattctgcttatctggcatctcagaagtacttcagacatgggccttggtaccatgaagctaatatgtggagtggaaaaccaacttactggcagctcacaagtcttcaggcgttttggcctggtctgcaggttcttgttggagatattgcagctgcaaattcatcgcatcgtgagtttttccatgtatgggaaaagtttggtgtattacctgagaggtatctactcgatcatcaaataatacatccgacaatgaagtactatccactacgtcctgaattagcagaatccacgttctacctttaccaagctacaaaagatccatggtatctagatgttggtgaatcaatggtaaaatctcttaatctctacacaaaggtgccagggggatttgcaagtgttagagatgtgacgaccatgcaattggaagatcatcagcacagtttctttctcgctgaaacgtgcaagtacctatatctcctcttcgatgactcatttgtggccaaaaggaattatatatttacaaccgagggccatcctatacaggttgtgagctcctggcatgagaaactaccagaaacttatttctcaggcaactggaccctttcaaagagtggagcatgggaaagtcgagctagcgcattgtcactacaagtctgtccactgatatctcttaactctagacatcctgagcaacaaagagagagtgcttgccatgttcttgacgagcaaatcaatcataagtgttggagcaacaaagagtgcggagttgatgccactacttgtagactaagaacctgcagcggggttggatactgcggcttatggaatcccttataa

SEQ ID NO: 396 - DNA, 1497 bp, Arabidopsis thaliana
atgatgaacatgatcaaggctggaatcatacacacccagaacatccatattcgagtcaagaacagatcacatgtttatccagcagaaaacatgttgaatgaaggaatgccagtgtcttctcattggaactcttctccaggaccaaatgcttatactgactcaggtcatagtgtggagagaccacactacaatccgggggtttcggggccgtcccatgatccttccgtgaattcaacagttccaactttctctgctccacatgagaattatgtgacatttgcatcttcttcaagctacaacagccagacatggtcaaatgctagttatgttgatcatcaatctatggaaagtgtgagaggagcacaaaagagaaaacgaccatgtccttcttccatctatgaaatgggtagttcaagccaatatcacggtgacagaactcctgcagacactcatttcccctcggaattgcacttgggaaaatcaataacgcatgatcatgaccctcattacatgccatggcttatgaacccaacttacagaagtaataatctctcgatcaggggagagagctcttcaaggaatgtccggagtcgtcctacacttgattcagagaccagcttaggtagaaataatttgccaagaagcttgagccttgattctcattctacacaccaccacagtgttgatcattatggctcaggtcaatttcctggtcagacatctcacggaaataaagactggaactgtgctagattgtccccagttcttagagatataaatggctttagtccagagacaaataatttccttcctgcaagaagtgttgtcaacagcttatctgttaatacttccggctatcatcaccatgagcttaccggaaacagaaaccctacagtttcccacggggttcctggaacttcaacactatctacaagcagcagccgcttctctcataggtcaacatccacctatagatcttcttcacacggttcgcgatcgggacatgtagcatcttcttctggagacaggtctcatttggtcactgagacttatccgtctaggcatttaaggccaccaccacacatttcatggcgtagcggtgatcggccagggagacgcagaagttcctatgagaggtttcagcctcctttcgatgaagttgctctccacgaacggttttcatctgaggaattcatggttgaagatcgccaaccacaatactacggatccagaaacatgcttgatcaccacagagacatgaggcttgacatcgataacatgagctatgagcgcaatctccagttgcttgttagcaacaatgtattatccatcatatcaaacagaggagcaaagaaaatgtgcaatctgcctggggaagttaaggggtgtggtcatgactaccatgggaggtgcatcaagaaatggttgtctatgaagaactcttgccctatttgcaaatcccctgctttacctgatgcttctaagaactcatcataa

SEQ ID NO: 397 - DNA, 1113 bp, Arabidopsis thaliana
atgtctctctatcactctcttagcattttcctcctcctatctctctgccatggctcttacagtcttcaaccacgtcgagttcctcatctagacgggattctcccaaatggaaacttcgagataacccctctcaaatcaaacatgaagggtcgacaaataatcggggctaactctcttcctcattgggaaatcgccgggcacgtggagctagtctccggtggacctcagcctggaggattctatttccccgttccacgtggagtccacgcggttagactcggaaacttgggcaccatctctcagaacgtgagggtgaagagtggtttggtctactctctaacgttcggagctacgaggacttgtgctcaggatgagaacatcaaagtctctgtgcctggtcaggccaatgagcttccgctccagaccgtctttagctccgacggtggagacacttacgcttgggctttcaaggcaacttctgatgtggttaaggtcactttccataaccctggtgttcaagaagaccgcacgtgtggacctctcttagatgttgtcgcaatcaaggagattcttcctctccggtataccagaggaaacttggtgaaaaatggaggattcgagatcggtccacatgttttcgctaatttctcaaccggaatcttgattccagcaagaatccaagacttcatctctcctcttccgggatggatcgtcgaatcccttaaaccagtgaagtatatcgatagacgtcatttcaaagttccttatggacaaggggccgtcgagctagttgccggaagagaaagcgcaatagctcagatcatccgaaccatcgctggtaaagcctatatgctctcattcgcggttggtgatgcacaaaacggttgccacgggtcgatgatggtggaagcgttcgcaggaagagaaccgtttaagctttcttttatgtcagaaggtaaaggagcgttcaaaacagggcattttaggtttgttgctgattcggatcgaacgaggctaacgttttatagtgcgttttatcatacaaagcttcatgacttcggccatctttgtgggcctgttcttgatagcgttgttgttaccctggcccgttaa

SEQ ID NO: 398 - DNA, 2982 bp, Arabidopsis thaliana
atggctcatctcttcagggagctgtctctgggccactccaagagagagtctacgccgccgccgccgtcacattcggcgacttcacgttcttcttcaatgtcttccgatctacctccatcaccactcggacaactcgctgtccaactttccgattccgatctccgtctcactgcttacgagatcttcgtcgccgcatgtcgtagcgccaccggtaaacctctctcatcggctgtttcagtcgctgttttgaatcaggattctcccaatggctctcctgcttcgccggcgattcagcgttctctgacctcaaccgccgctagtaaaatgaagaaagctttggggttaaggtcgtcttcttcgctttcacctggatctaataagagttctggttctgcttcgggttctaatggtaagtcgaaacgtcctactactgtcggtgagcttatgcggatccaaatgcgagtatcggaggctgtcgattctcgtgttcgtagagcttttcttagaatcgctgcttcacaggttggaaggaagattgagtcagtagttcttcctttagagttgttacagcagctaaagtcttctgattttacggatcagcaagaatatgatgcttggctgaagagatcattgaaggttcttgaggcaggtcttttgttgcatcctcgtgtacctcttgataagacgaatagttctcaacgactgcgacagattattcatggtgctttagatcggcctttggagactggaaggaataatgagcaaatgcaaagtcttagatcagcggtcatgtctcttgcaactagatctgatgggtctttctctgattcttgtcactgggctgatggatctccgtttaatctcaggctttatgaattgcttttagaagcgtgttttgattctaatgatgcgacgtccatggttgaggaagttgacgacctaatggaacatataaagaagacgtgggtaattcttggaatcaatcaaatgctgcataacctctgttttacgtggcttttgtttagtcgttatgttgttactggacaagttgagatggacctgcttcatgcttgtgattctcaactggcagaagttgctaaagatgcaaagacaacaaaggatcctgaatactcccaggttttaagttctacactgagtgctatattaggatgggcagagaaaaggctccttgcataccatgacacttttgaccgaggaaatattcataccatggagggaattgtttctttgggtgtatcagctgccaggatattagttgaagatatatctaacgagtaccgtagaagaaggaaaggagaagttgatgtagctcgtaccaggattgagacgtacatcaggtcctcactacgaacttcttttgcgcaggcaagtatttgcattgtcagaatggagaaagcagattcaagccggagagcatctaggaaccagaaaaatcctcttcctgttctagccatccttgctaaggacattggtgagctagctattcaggaaaagcggatgttcagtccaatattgaagagatggcatccgtttgctgcaggggttgctgtggcgacccttcatgtttgttacggaaatgagattaaacagtttatagccggaatatctgaattgacacctgatgctgtccagatactaagagctgcagataagctagaaaaggatctggtgcaaatcgcagtagaggattctgttgacagtgatgatggtggcaaagcaattatccgtgaaatgcctcccttcgaagctgagaccgtaattgctaatttggtcaaagactggataaaggcaagaatagacagacttaaggaatgggttgacaggaatttgcagcaagaggtttggaaacccctggagaacctagaaggaggatatgcacagtctgctgccgaagtgttgcggattactgatgaaactttggaagctttttttcagcttcccatacctatgcatcctgctgtattacctgatttaattattggtttagacaaatatcttcagtattatgtctcaaaggcgaaatctggctgcggctctcggactacgtacatgcctacaatgcctgcactcaccagatgtacaacgggatcaaaattccaatggaagaagaaagaaaagacacctaccactcagaagagagaatctcaggtttcggttatgaacggtgagaattcttttggggtcacgcaaatatgtgtcagaataaacagcttgcacaaaatccgcagtgagcttgatgttgtggaaaaaagagtgatcacacatttgaggaactgtgagtcagctcacaccgatgacttttccaacggcttagaaaaaaagtttgagctcacaccagcggcttgcatagaaggcgttcaacagctttctgagtctctggcttataaggtcgtcttccacgacctaagccacacgttatgggacgggttatacatcggagacctctcttcctctagaatcgatcctttcctcaaggaactcgaacagaatttgacagtcatagcagagacagtacatgaaagagttcgaacacgcatcatcaccgatattatgagagcctctttagatggcttcttacttgtcctgcttgccggaggaccctctagggcgttcacaagacaagactctcagataatggaagaagatttcaaatcaatgaaagatatgttctgggctaacggagacggtctagccatggacctgatcgataaattctcaaccactgtcagaggcgtgcttcctctgttcagtacagatacagacagtttaatagagaggttcaagggaacgaccctcgaagcatatggttcttcagctaagtcgaggcttccgttgcctccaacatcaggccagtggaatggcatggagccaaacacactcttacgtgttttgtgttaccgtaacgacgaatctgccacgaggtttctcaagaagacatataatctacctaagaagctttag

SEQ ID NO: 399 - DNA, 2478 bp, Arabidopsis thaliana
atgccaaaggaagagaatggtcaattgaaaagagataggcttgatgatgatactgatgaaggtaataaaggagatcactttcccagtaagaaacaagctaaagaagcttctaatgatgacattacatcggagatttcaaatccagtcgcttctccggttgaaagcacgtctctttttcgtgatgtctctagccagccggttaaatccggtttagttgagtgctccgggagtgattttgggtccgaagagactgtaagtgacgatgcatccgttgtaggtagctcacaaacagagcagtcgagtgatgttttaccatctcgttttgtgttggagattcctaagcatcttagctcgactgggatcacgaagatcacgtttaagttgagtaaaccaaagaaggaatttgatgatttgcctttgataaaggatcatacttgggacgctggtgttgtgaagatgccgaagaaaaagattgtttctttgagctacccatctaatgtcaagaagctattggaaacgggtatacttgaaggagctcgagtgaagtatatttcaaccccacctgtgagacagcttctggggataatccattcgggtggctatttgtgtggctgtacaacttgcaatttctcgaaagttctaagtgcgtatgagtttgagcagcatgctggtgcaaaaactagacatcctaataatcacatatttttggagaatagaagggcggtttataacatagttcaagaactgaagactgctcctcgtgttgttctcgaggaagtgataaggaatgtagctggttctgctctgaatgaggagggcttacgagcttggaaaggtgatggccagcaagtttccaacagagtaatagcatgtctgaccggaattatattacggatcattccactgtcagttaatgcactattaagttaccattttgtgttactatctgaaactgattcctgtgaaagctgcagttatcttggtcctggtcttgatgagagtcagagccttactccatgctctgtggagaaccattatttttcagagaaaacatatgcaaaggacacattagatgagccgaagcggatagcaaagaagcttacttctcatgtatctggtacgggttgccataagaaagtttctgaaggaagcaatagaaaaagggataatgatttacatcggttgctgtttatgcctaatggacttccagacgggactgaattggcttactatgtgaaaacgcagattagtccttcgcaatttgaagcgcatgctggaatggcggctagacgacaaccttatcgacatatcttcatctcttctggattgtcattgcatgatatagccatgtcactggccaatggacatgtcattacaactggtgatagtgatgacatgtgttctatttgtggggatggtggagatttgttactttgtgctggatgtcctcaagcatttcatacagcttgtttgaaatttcagtctatgcctgaaggtacttggtactgttcgagctgcaatgatggacctatctctagtaaaaaggctactactactgatccttctggcaacgctaggcctatagttataagactctcaagagtcgtgaaagcgccagaaagcgatattggtggctgtgtgttctgcaggtcccatgattttagcattggaaaatttgatgataggactgttattctctgtgaccagtgtgagaaagagtaccatgttggttgcctgagagagaacgggttctgtgatttgaaagaaatcccgcaggagaaatggttctgctgtagcaattgcagcaggattcacacggcagttcagaattctgtttcttgtgggccacaaactcttcctacacctttgttagacatgatatgcagaaaagacagagaaaaaggaatatttaccgatattggggatacagtcgaatggagaatacttagtggaaaaagtcgatacccagagcatctgcctttgctttcacgagcggctgttatcttcagggagtgttttgatcccattgttgcaaagtctggccgtgatctgattcctgtcatggtgtatgggagaaatatatctggccaggagtttggaggaatgtactgtttggtcctgatagtaaattctcttgttgtttctgctgcgctgctgaggatatttggtcaggaagttgctgaacttcctatagtggccacaagccgagagtaccaaggaaggggatacttccaagggctgtatgcctgtgtagagaatcttctttcttctttaaatgttgagaacctggttcttccggcagctgaagaagcagagtctatatggacaaagaagtttggctttacaaagatgtctgaccagcaattgcaggagtaccaaaaggaagtgcagcttacaatattcaaaggaacctcaatgctggagaagaaagtacctaaggcgacaacgggtttatcagaatctacaactctcatctga

SEQ ID NO: 400 - DNA, 1551 bp, Arabidopsis thaliana
atgttctctcaggctcagagcaagaagcagtttaagaggtctatgactaagaaatcacattcatggtggtgggatagtcacaattgtcccaagaactcaaaatggcttgcagagaatctagaaaagatggatgatcgagtgaaccacatgttaaaactgattgaagaagacgcagactcttttgcaaagaaagctcagatgtattttcagaaacgtcccgagttaatccagcttgtcgaggaattctaccgcatgtatcgcgcattggctgagcgttatgatcaagctagtggtgaacttcagaagaaccatacatctgagatccagtcacagagctctcttgagatatcatctcctaccaaagagaagttgagtcgccgtcaatctagccataaagaagaggaagattcatcgtctttgacagattctggttctgattctgatcattcctctgccaatgatgaagacggtgacgaggcattgatccgtagaatggctgaacttgagcttgagcttcaagagacgaaacagaagctccttctccagcaggaaagtgttgatggtgacaacaatgttgatctccttcacaaaattactacatatgagggagagcttaaagaagctaatgagaagatgcgaatgcacgaagacgagattgctaatctgaagaatcagcttcagagcttcatgtcttttgacacagaggatcatcttggtgctgaacaaaagagtgttgatttggataaagaggacactaaagaagatgcagtagctacaaaagtgctagccttggaggaagagctgagtatcgcgaaagagaagcttcagcactttgagaaagagacttattctctgaaaaatgagctcgagatcggcaaagccgctgaggagaagctgaagagcttacaacatgagctcgagttggctcagagagacgctgatacctacataaacaagctcaacgcagagaagaaagaagtcttgaagttgcaggagagattggcaatggtgaaaactagtttacaggatagagataacgagataagggcattgaaaactgcggtttcagacgctgaacagaagatattccccgaaaaagcacagatcaagggagaaatgtcgaagatgcttgaagaacgaagccaacttggagagcaactgagagagctggaatcacatataaggctgatcaaggaagagaaagctgaaacagaggagaagcttagaggaggaactgagaaaatcagcggaatgagagacgagagcaatgtgctaagagaagagattgggaagagagaagagaagataaaggaaacggaaaagcatatggaggagcttcacatggagcaagtgaggctgagaagacggtcaagtgagcttacggaagaagtggaaaggacgagagtgtctgcatcggaaatggctgagcagaaaagagaagctataagacagctttgtatgtctcttgaccattacagagatgggtacgacagactttggagagttgttgcaggacataagagtaagagagtagtggtcttatcaacttga

SEQ ID NO: 401 - DNA, 1221 bp, Arabidopsis thaliana
atgttagctctgtctccggcgacaagagatggttgcgacggagcgtcagagtttcttgatacgtcgtgtggattcacgattataaacccggaggaggaggaggagtttccggatttcgctgaccacggtgatcttcttgacatcattgacttcgacgatatattcggtgtggccggagatgtgcttcctgacttggagatcgaccctgagatcttatccggggatttctccaatcacatgaacgcttcttcaacgattactacgacgtcggataagactgatagtcaaggggagactactaagggtagttcggggaaaggtgaagaagtcgtaagcaaaagagacgatgttgcggcggagacggtgacttatgacggtgacagtgaccggaaaaggaagtattcctcttcagcttcttccaagaacaatcggatcagtaacaacgaagggaagagaaaggtgaaggtggattggacaccagagctacacaggagattcgtggaggcagtggaacagttaggagtggacaaagctgttccttctcgaattctggagcttatgggagtccattgtctcactcgtcacaacgttgctagtcacctccaaaaatataggtctcatcggaaacatttgctagctcgtgaggccgaagcggctaattggacacgcaaaaggcatatctatggagtagacaccggtgctaatcttaatggtcggactaaaaatggatggcttgcaccggcacccactctcgggtttccaccaccaccacccgtggctgttgcaccgccacctgtccaccaccatcattttaggcccctgcatgtgtggggacatcccacggttgatcagtccattatgccgcatgtgtggcccaaacacttacctccgccttctaccgccatgcctaatccgccgttttgggtctccgattctccctattggcatccaagatttagagcaccgccagttgccggaatcccgcatgctctgccgccgcatcacacgatgtacaaaccaaatcttggatttggtggtgctcgtcctccggtagacttacatccgtcaaaagagagcgtggatgcagccataggagatgtattgacgaggccatggctgccacttccgttgggattaaatccgccggctgttgacggtgttatgacagagcttcaccgtcacggtgtctctgaggttcctccgaccgcgtcttgtgcctga

SEQ ID NO: 402 - DNA, 2280 bp, Arabidopsis thaliana
atggcctcagcttcgaaaaagacgtcggcatgtcctcaccacggtggctctcttccgcctcccaaactcgtctccgctgctcccgataccgttgctgtatggtccgacgctgacgatcagcgagcctctaaagtttctttggaatccgttatccgccctgtcgattcgtttcctgataatactgccaagaaacctgccaacaaagggatttctgtgatgccaaggactgaaaccaagcacccattggatcctctttctgctgcagaaatatcagttgctgtggcgactgttcgcgcagctggtgccaatcctgaggttagggatggcatgcgtttcattgaggtggcatcagtggaaccagataaacaagttgtggcgctcgctgatgcttactttttcccaccgttccagccatcactacttccaagaactaaatctggacctgtgattccgatgaagctccctccaaggcgagctagacttgttgtttacaaccaaaagtctaatgagacaagtgtatggattgtggcattgtctgaagttcatgctgtcactcggggtggacatcacaggggaagagttgtttcctcacaagttatacctgatgttcagccacccatggatgcggctgaatatgctgaatgtgaagcgattgtcaaagacttcccaccattcatagaggcaatgaagaggagaggtattgaagacatggatctagtgatggttgatccctggtgtgtgggttatcacagtgaggctgacgctcctagtcgtaggcttgcaaagccccttatatactgtcggactgatagtgattcccctatggaaaatggatatgctcgtccagttgagggcatttatgtacttgtagacatgcaaaacatggtggtgattgaatttgaagaccgtgaaagtagagggggtgttgatagaagtgatgttaagcctctccagattattcagcctgaaggtccaagttttcgtgtaaggggttactttgtcgagtggcagaagtggaactttcgtattggattcactccaagggaaggtttagtcatacattcggtagcatatgttgatggcagtcgaggtcgaaggcctgttgcacacaggctaagttttgtggaaatggttgtgccttatggcgatcctaatgagccacattacaggaaaaatgcttttgatgcaggggaggatggtctcgggaaaaacgcacattcgcttaagaaggggtgtgactgtctgggatctatcaagtacttcgatgcccatttcacaaatttcactggaggagttgaaacaattgagaactgtgtttgcttgcatgaagaagatcatgggattttgtggaaacatcaggactggagaacaggattagccgaagtgcgaagatctaggagactaactgtctcttttctatgtactgttgccaactacgagtatgggttttactggcacttctaccaggatgggaaaatcgaagctgaagtaaaacttactggtatcctcagtttaggagctctgcagccaggtgaaactcgaaagtacggtactactattgctcctgggttgtatgcaccagtccatcaacatttctttatcgctcgcatggatatgtctgttgactgtaaacctgctgaagcttttaatcaggtagttgaggtaaatgttagagttgacgagcgaggtgagaacaatgtccacaacaatgcgttttatgcggaagagaagttacttaaatctgaggcagtggcgatgcgtgactgtgaccctctttctgctcgccattggattgtaaggaacacaaggactgtaaacaggacgggccaattaacgggatacaaacttgttccgggttcaaattgtttgccattagctcgacccgaggcgaagtttctaagaagagccgctttcctgaagcataatctctgggttacccgttacgccccagacgagaagtttcctggaggagaattcccaaaccaaaacccacgggctggtgaaggtcttgccacatgggtgaaacagaatcgctccttggaagaatctgacgtcgttctttggtacgtgtttgggatcacacatgttcctagacttgaagattggccggttatgcccgtcgaacatattggtttcacactaatgccacatggatttttcaactgctcaccggcagtagatgtgccaccgaatccatgcgaattggagactaaggagagtgaagtcaaagaggttgtagcaccgaaagctcttcagactggtttactttcaaagctttga

SEQ ID NO: 403 - DNA, 819 bp, Arabidopsis thaliana
atgcaagttatttctccttcgtctccggcgccgagattcgccggaaaagagagattttcagaagtttacggcgaactaaacgacgattttggctctaaactgaagattagttctaaagaggaagaaaacagagatgatgattcatggtggaatcagaacggaactgataaagatgatgaaggaagagaagaagatttctcattcgcaagtgtaaacgcagataattcaccgataaccgcagatgaagcattcgaagacggtcagatccgaccggtttatcctctgtttaaccggaatattttcttcgatgatccagaggaaaaaactttacgttcacctctcaagaaactcttcgttgaatccacaaccacagaagaagaagaagaagagtcagatacggtgggtccatattgttcatggacaaatcgtacggtggagcaagcatcaccagagacttgtcggaaaagtaactcaacagggttctcaaagctatggagatttagagatcttgttttgagaagtaacagtgatggaaaagatgcgtttgtgtttttaagcaacggctcttcatctacatcgtcgacgtcgtctacggcggcgagattgagtggtgtggtgaagtcgtcggagaaagggaaagagaaaacgaagacggataagaagaaggataagatgagaacgaaatcggcacatgagaaattgtatatgagaaacagagcaatgagagaagaagggaaacgaagatcgtatcttccgtataaacatgttgggttcttcactaatgttaatggtttaaccagaaatgttcatccctattga

SEQ ID NO: 404 - DNA, 732 bp, Arabidopsis thaliana
atgaagaatgtgaatcgagtcttcttctgcaaatcactatctctcgtcttcctcgttccttctttcactcgttctcatatccgatttacttactccgccgccggtgcttcttctcctaatcgagctattcactgcatggcttccgattcccctcaatccggagatggttccgtctcttctcctcctaatgtcgcggctgttccctcttcttcttcttcttcgtccgcttcttccgccattgatttcctctctctctgtactcgtctcaagacaactccaagagctggatggattaagagagatgtgaaagatccagaatctatagcggatcacatgtatcggatgggtcttatggctctaatttcttcagatatccccggtgttaacagagacaaatgcatgaaaatggcgattgttcatgatattgcagaagccattgtaggagacattacaccttcttgtgggatatctaaagaagagaaaaaccgaagagaaagcgaagcacttgagcacatgtgcaaactcttgggtggaggcgaaagagcaaaagaaatcgctgagctttggagagaatacgaagagaactcttcacctgaagccaaagttgttaaagatttcgataaagttgagctgatactacaagctttggaatatgaacaagggaagttccagactaatataggcaaggcttgggcgtcggagattgtttcaagaagacgaaagcaacattag

SEQ ID NO: 405 - DNA, 1242 bp, Arabidopsis thaliana
atgatgatgctcagaatccgaagcagagatggactggagagagtcacagcggagggagctcatatcactgtttcccagctcaaaaccttgatcgcggatcagcttcagatccctctccataagcagaccttatccaccaatcgtgatctcctcctcgccaaaactcccgctgatctactcgccttcaccgacctcacggacccaaacctccccctctcctctctcaacctcggccatggctctatgctctacctcgcctacgatggcgagcgctccattcctggagctcctcccgttactcctgccggatccttcgggaggaagatgaccgtcgatgacttgatcgcccgccagatgcgcgtcactcgtcaggagacgtctcactgcgactccgtctccttcgatcgcgatgccgccaacgctttccagcactacgtcaatgagtctctagcttttgccgtcaagcgcggcggctttatgtacggcaccgtcaccgaggaaggacaggtggaagttgatttcatttacgagccgccccagcaaggcacggaggctaatcttattctgatgagagatgctgatgaagagaagcgcgtggacgcaatcgccatgggcttggggatgaggagggtcggtttcatttttaaccagaccgtggtgcaggacaagactgaatacactctgtccaacgccgaggtgctacaggcggcggagcttcacgccgagagcgagctgaaggagtgggtcacggcggtggtgaagcttgaggtgaatgaggatggtggcgccgatgtccatttcgaggcgtttcaaatgagtgatatgtgcatcaggctgttcaaggaagagtggttcgagacggagattatgccggacgatgatccaaagctctctaagatgaagaaggaggtggttgttggtgtgaaggatcttaaggaggtagataacgatttcttcctcgttctcgtcaggatcttggatcaccaggggcctctgtcatcaacattcccaatagagaaccggagcagtcgagcaacgatgcgggctctaaaaacacatctggaccgggcaaagagcttgccgttggtgaagaagatgtcagattttcatctgcttctctttgtggctcagtttctggacgtgtcatcggacgtccctgctttagccgagtgtgtgcgtctgcagtcgcctgtcccagagggctatgcgttgctcatcgaatcaatggccaacacttgttaa

SEQ ID NO: 406 - DNA, 864 bp, Arabidopsis thaliana
atgaatccttctatgccacctccaccaccagctccgccgattttctcgggccggagtacaaaccctagaaacggtttcgttatcggcaaggaatctttcttcccttccagcttttggggtgaaaaatatataaacgatttttctcaatctaatttttttttttgggttaaatataagatctcgtatttttctttgcctttctttgacccaatcttcaaatctgggctacttgttttgaaatcaatcgattatagatttcttcttattttctgttttggtccctctcttttagttttattgtgtgtgtgtgtctgcgttttgattctgattcttaaatatgtaaatgggaatctagaagatcgatcagcaaacggatcaccatcaaggaacaacataaacggccgtatgatatccagatcgggtggctcaaagcgatctccaccgtcaccagaccaaatcgagaagagatcaagcgttagagatcagagacaaaacgggtttgatcatcaacaacaacaacatcaaagagtgaacagatcagaatcaacggctcagggtcatcaagaagtggagataaatggagaaagagagaaagcaacgcaagagtggccgaggatctacattgctttgtctaggaaagagaaggaagaagatttcttggttatgaaaggaactaagcttcctcatagacccaggaaacgagctaagaacattgataaagcccttcagttttgttttccagggatgtggttatctgatttgaccaagaaccgttatgaagttagggagaagaaaaatgtgaagaagcagcagaaacggagaggattgaaaggcatggagaatatggacaccgactccgagtaa

SEQ ID NO: 407 - DNA, 846 bp, Arabidopsis thaliana
atggcatcatcatcaatcctcatccctccgattctcacccgtcgtaatctcctcctctccaccacaatcgccaccgtaactccaccaccaccagctaaaccaccttcccccgacatcacaataaccgatcgagtcttcctcgacttctccctctgccccacctacttccgctcagatccctccgcgacactctcctccaccacaccttgctccgattcaactcctctcggccgcgtcgttctcggattatacggccgtcacgttcccataaccgtctcaactttcaaacgtatgtgtacttcatcttccacatcttacaaaaacacacctgtccacaaaatcttccctggtcagtattttctcgccggaagacaaggaggaggacggcgagatacggcggaggttggttattcactcagagacttacctcgtaacaccgacgttgttaattccaaagcttttttacttcctcatgctcgtgctggtgttgtttctctttgtttatctgagaatgatgatgatgatgatattagactcgatcctgattatagaaatgttgaattcttaatcactactggtcctggaccgtctccgcagctcgatggcggtaacattgtattcggaactgttcttgaaggattagatgtagtgacgagtatttcttcgattccgacgtataagccgtcggagaatattaaacagtttaacgattttgcggagtttcttggagacgagagagctcaaaacgcgagatctttgtggaatagacctttgaagacggttttcattagtggctgtggagagcttaaggtcactaatccttcactctctccaactttgccttaa

SEQ ID NO: 408 - DNA, 903 bp, Arabidopsis thaliana
atggctgcaactgcaatctcttctctttccttcccagctttgggtcaatcggacaagatctccaatttcgcatcttctcgtcctctcgcctccgcaattcgcatctgcacaaagttttctcgcctttctttgaattcgcgttccacttcgaaatctcttattcactgcatgtccaatgttaccgccgatgtgcctcctgtatcagagacaaagtcgaaattcctaaaagcttacaagcgacccatcccgagtatctacaacacggttttgcaggagctcattgtccagcagcatttgatgaggtataagaagacttatcgttatgatcctgtttttgcccttggatttgtcactgtatatgatcagctcatggaaggatatccgagtgatcaagaccgagatgccatttttaaggcttacattgaagccttgaatgaggatcctaagcaataccgaattgatgctcagaagatggaggaatgggcacgaagtcagacttctgcttcactagttgacttttcctctaaagaaggagatattgaagcagttcttaaggacattgcaggaagagctggtagtaaggaggggtttagttacagcaggttcttcgctgttgggctctttcgtttgcttgagcttgcaagtgctactgatccaactgtcttggacaagctttgtgcatccctaaatatcaacaagaaaagcgtggatcgggacctggatgtgtatcgtaacctgctttcaaagcttgtccaagccaaggaattgcttaaggagtatgtcgagagggagaagaagaagcaaggagaaagagcccaatctcagaaggctaacgaaacaatctccaagtgtctgggagatactctatataacccatctttcttggttgaacggaaatcttag

SEQ ID NO: 409 - DNA, 774 bp, Arabidopsis thaliana
atggatgcttcaaatcccaattcttctagaaaatctaatgtctcttccttcgctcagtccagtcgaagcggtggtagaggaggaggatatgagagagataacgatcgacggagacctcagggtcgtggcgacggtggaggcggaaaggatagaatcgatgcacttggacgactcttgacgagaatattgcgacatatggctactgagctgagattgaacatgagaggtgatggttttgttaaagttgaagatttacttaacctgaatttgaaaacttctgcaaatattcagttaaagtcacacacgattgatgaaattagagaggctgtgagaagggacaataagcaacggtttagtctcatcgatgagaatggagagctcttgattcgcgctaaccaaggccattcgatcacgacggttgagtcagagaagttacttaaaccaatactgtcaccagaagaagctccagtgtgtgtacatggaacttataggaagaatttggaatccatcttagcatcgggcttaaagcgtatgaatagaatgcatgttcacttctcttgtggattaccaacagatggtgaagtgattagtggcatgagaagaaatgtaaatgttatcatcttcctcgacatcaagaaagctcttgaagatgggattgcgttctacatatcagacaacaaagtgattttgactgaaggcattgatggtgtattgcctgtcgattacttccagaagatcgagtcttggcctgatcggcaatccatacctttctga

SEQ ID NO: 410 - DNA, 1266 bp, Arabidopsis thaliana
atgtcgaacccaaacgaaccagccagggctcttctgccttacctgcaacgtgccgatgagctgcagaagcatgaaccacttgttgcttattactgtcggctatatgcaatggaacgaggattgaagattccgcagagcgagagaactaagaccaccaattcgattctcatgtctctcattaatcaactcgaaaaggataaaaaatcattgactctgtccccagatgacaatatgcatgtggaggggtttgcacttagtgtctttgctaaggcagacaagcaggatcgtgcaggaagagcagacttgggcactgccaaaactttttatgctgcgagcatcttctttgaaattctgagccagtttggtcccgtacctcctgatatagagcagaaacacaagtatgctgcttggaaggctgctgacataaggaaagccattaaagaaggaaggaagcccactccaggtgatcctgtggatgatgatactgatttatccatcccatcaagcggtcctagtggctcctatgatcacagtgcaagtgataccaacacaacaagtcatcatagaacagagcttgatccaccccatgactcgaatgatgactccagccaccatcaattccctgaagtgccacaacaccctctacctcccaggttttatgacaatccgaccaacgattatcccgcagatgtcccacctccaccaccgtcttcttacccttccaacgatcatcttccccctcccacaggaccatcagactccccttacccgcatccttacagtcatcaaccataccaccaagacccgccaaaacacatgccgccaccgcaaaactactcatctcatgagccttctccaaattctctccctaatttccaatcttatcctagctttagtgagagcagcctcccatccacttctccccactacccttctcactaccaaaacccagaaccttactattcttctccgcactctgcacctgctccttcttccacaagcttctcctctgctcctcctcctccaccttactcatcaaacgggcgtatcaatattgctcccgtgctagatcctgcaccgagttcagctcagaagtaccattacgatagcagctaccagccagggcctgagaaggttgcagaggcactcaaggctgctagattcgctgtgggagctttggcttttgatgaagtctcgactgctgtagaacatctcaagaagtcacttgagttgctaacaaatccatcggccggtgccggtcactga

SEQ ID NO: 411 - DNA, 828 bp, Arabidopsis thaliana
atgacgacgccgtgccggaccattaacgctaatgctatcgccgcaccgtcgccttcgggattgatctttaacgggtttcgtgatttcgtcccgattgaaaagaggcttgttatatcaagctttcgtggcttgaaactaccgtcgaggacgacgaagactattacgagctctgactggagttggagttataggtctccgggaagattggcgtctgcgtctacgtctacgtctgcgtctacgtctacgtctgcggctgtaacatcgaattctacgaatagatttgaagctttagaagaggggattgagaaggtcatttatagttgtcgatttatgacgtttcttggaacattaggatctttgctcggatcggttctctgtttcatcaaggtaaagccactacagattatctcattgctctttcttggatgtatgtatgttgtagactcgtttttgcagtattcggtgaatcgtgggaaagtgatattccttttggttgaggccatagtctttggattgggactttacgagttgttcatcagcaatctcgatacttcagagtcgcgcacacacgatattgtttccaataggtcgagcctctttggcatgttcaccttaaaggagcgacctcaatggttagaggtgaaatcggtaagcgagctgaaaacaaagttgggacatgtaatagtgatgctactattgattggtttgtttgacaagagcaagagagtagtcataacttctgtcacggatttgctatgtatctctgtttctatctttttttcttctgcttgtctcttcttgctctctaggctcaatggttcacactga

SEQ ID NO: 412 - DNA, 444 bp, Arabidopsis thaliana
atgatcctagctgtgttgttcgccaattccgttgggaatgttttaatcgaaaggttcaatggagtaccagctgaggaacggctccactggcgatctttcttggttaagttgggagcagataatctcaaaggcgttaaaaatgaggagcttctcgttgcttgccacaagtcggtttatatcgtgtacacaatgctaggggatgttagcatcttccttgttggcaaagacgagtatgatgaacttgctttggcagaaaccatctatatcataacagcggctgtgaaagacgtatgtggaaagccgcctacagagcgagtgtttttggataaatatggaaggatttgcttgtgccttgatgaaatcgtttggaacggacttctggagaacaccgacaaagacaggatcaagcgactcatcagattgaaacctccttctgaagtttga

SEQ ID NO: 413 - DNA, 1932 bp, Arabidopsis thaliana
atgaagcagaggagtttcttatcaatcctctgttttattcttctagcctttggtgttgcttctgtttcagcacaaacatgcatagagaaccgtaaatatttcacacccaacggtacatacgattcaaatcgtcgtcttatcctctcttctcttcctaacaataccgcctctcaagatggtttctactacggttcgattggagaagagcaagatcgagtctacgcattagggatgtgcatcccaagatcaactccaagtgactgttttaattgtataaagggtgcggcaggctggttgatacaggactgtgttaaccagacagacgcgtattattgggcacttgatccaacgctgtgccttgtccgctactccaacatttctttctcaggatctgcagctttttgggagattgagcctcagtatttggtcttgaacactgcaactatcgcctcagatctaacggatttcaagaacatatgggaagacttaacatctcgtacgattactgcagcctccgcagcaagaagcacaccatcgtccagtgataaccattacagagttgattttgcgaacttgacaaaattccagaatatctacgcattgatgcaatgcacgccagatatttcttctgacgaatgtaacaactgtctccaacgaggcgtacttgagtaccagtcatgctgtggaaataatactggaggctatgcttttcataacattaccttggctactcctccgaaacctccaatgaatgtaccgcgaccaccttctgtaggtcacggggcgaacactacagataatgatagcaggggagtctcagctggaattgtagtggtgattaccgttccagcagttgtcatcgtcttgatactagttgttctaggattttttatttgctggaggagaaagtctttgcaaagaactgaatttgaatctgatagtgatgtttctactacaaattcattgcaatacgagtttaagacaattgaagctgcaacgaataagttttcgaagagcaataagctcggcgaaggtcgatttggggaagtttacaagggtaagttttcaaatggaactgaagttgccgtgaagaggctctcgaaagtatcaggacaagacacaaaaaagttcaggaacgaggctgttcttgtatcaaaaattcagcataggaatctggctaggcttcttgggttctgtttgcaaggagatggaaagtttttgatctatgagtttgttctcaacaaaagccttgactattttctattcgatcctgaaaagcaaggtgagctagactggactcggcgatacaagatcattggagggattgctcaagggatactacatcttcatcaagatccacagctcacaatcatatatcgtgacttcaaagccagcaacattctcttagatgccgatatgaacccaaaaatttcagattttggaatggccacagtttttggaatggaggaaagtcgaggcaatacgaactggatagctgaaaccttcgtttacatgtctcccgagtatgcggtgcatggcaaattctccatgaaatctgacgtctacagctttggaatcttgattcttgaaattattagcggcaagaagaatagcagcctctaccagaacgatgaaactactactgctggcaacttggttacctatgcttggaggctttggagaaacggctcgcaactaaagctgctggattcgtccataggaaggaactatcagagtaatgaagtcactagatgcatccatattgctcttttatgtgttcaagagaatccagaagaccgtccaaagttgtcaaccattgtctcaatgcttaccagtaacacaatcagtgtgccagcgcctggcataccgggatttttcccccaaagcaggcgtgaactggacccattatctgagggattagagtcgggttaa

SEQ ID NO: 414 - DNA, 1143 bp, Arabidopsis thaliana
atggaaacacaaggcaaagtaatcacttgcaaagctgctgtggcatggggagctggagagcctctagtaatggaagatgtaaaagtggatcctcctcaaagattggaagtgagaattcgaatcctcttcacttccatctgtcacactgatctcagcgcatggaaaggcgagaacgaggctcagcgagcataccctcgaatccttggccatgaggcagcagggatagtggagagcgtaggggaaggtgtggaagagatgatggcaggagatcatgtgctccctattttcacaggagagtgtggagactgcagagtgtgcaagcgagacggagccaatctgtgcgagagattccgagtggatccgatgaagaaggtgatggtaaccgatggaaagaccagattcttcaccagcaaagacaacaaaccaatctaccattttctcaacacatccaccttctccgagtacacggtcatagactcggcctgcgtgctcaaggtggaccctctgtttcctctggagaagataagcctcctcagctgcggtgtctccactggagtcggtgcggcgtggaatgtggctgatattcaacctgcctccaccgtcgctatttttggacttggcgctgttggacttgccgtggctgaaggtgcaagagccagaggagcctctaaaatcattgggatcgacatcaaccctgacaagttccaactaggcagagaagcagggattagtgaattcataaatccaaaggagagtgacaaggcagttcatgagagagtaatggagataacagagggaggagtggagtacagcttcgagtgtgcaggaagtatagaagcacttagagaagcctttctgtctacaaactcaggagtgggagtgactgtcatgctgggcgttcacgcaagcccacagcttctccctatccatcccatggagctcttccaaggcagatccatcaccgcctctgttttcggaggcttcaaacccaaaacccaattaccctttttcatcacccagtgcctccaaggtcttctcaatctcgatctcttcatctctcaccagcttcccttccacgatatcaacgaagccatgcagctgcttcaccaaggcaaagctcttcgttgccttctccacctctaa

SEQ ID NO: 415 - DNA, 1335 bp, Arabidopsis thaliana
atggttattgcggtggcgacgacgagctccattgtttccggaatcaagctttcagggatcttaacttcgttcaacgccgtagatgatgcgtccagtagttgcggaagaagcaacttgaccggagttagaatttttccgacattgagtcggcgacgattctcatcgatcggagctgtttccccaattcgtggggatgctcaatcttcctttagtcgcagctctttcgcttgctctcagaatctcggtttgagcggtggatttagtgcagctgaagctctgccacctgcttgtgcaaatgctagcccttcttccattaaatctttcaaccagttgattgaaaccttgattgatcgggttgatctatctgaaactgaggctgaatcatctcttgagtttttgctgaatgaggcaaacgaggcgctgatcagtgcctttctagttcttctgagagctaaaggagagacatacgaagagattgtggggttagctagggcaatgatgaagcatgccaggaaagtggaaggattagttgatgctgtggacatagttggaacaggtggtgatggagcaaacacagtcaatatatcaactggatcttcaatacttgctgcagcttgtggtgcaaaagtagcaaagcaagggaatcgttcaagttcttctgcttgtggaagtgctgatgtactagaggcactaggagtggttctggacttgggaccagagggcattaaaagatgtgttgaagaaggggggatcggttttatgatgtcaccaatgtatcatccagctatgaagatcgttggtcctgttcggaaaaagcttaaaattaaaactgtttttaacatattgggacctatgcttaatcctgctagagtttcttatgctgtcgttggtgtataccacaaagatctggttgttaagatggcaaaggcactgcaacgatttggaatgaaaagagcactggtggttcattcatgtggtctagacgaaatgagtccgttaggaggaggactagtttatgatgtaactccggaaaagatcgaagaattctcattcgacccattggactttggtattcctcgttgtactcttgaggatttgcgaggtggaggtccagactacaatgcggatgtgctaagacgtgtgctttcaggggaaagtggagcaattgcggattcattgatcctaaacgcagctgcagctcttctggttagcaaccgagttcaaacgctagctgaaggagtaaccgtggcacgtgaagtacaatcgtctgggaaagctatcaagacgcttgattcttggataaacatctcaaacttagctcagaaatctcagtga

SEQ ID NO: 416 - DNA, 3336 bp, Arabidopsis thaliana
atgtcatcgaacacttcacgaagctgttctactagatctagacaaaactctcgagtttcttcacaagttctcgtcgacgcaaagctacacggaaacttcgaagaatctgagcgtttatttgactattcagcttcaataaacttgaacatgccaagttcttcctgtgagattccttcttcagctgtctcaacgtacttacagaagattcagagagggatgttgattcaaccctttggttgtttaatcgttgttgatgagaaaaaccttaaagtcattgcctttagtgaaaacactcaagagatgttgggtttgattccacatacagtaccaagtatggagcagcgtgaagctttgactataggaactgatgtgaaatcattgtttctgtctccaggttgttctgctttggagaaagctgttgactttggtgagattagtattttgaatcctatcacgcttcattgtaggtcttcaagtaagcctttttatgcgattctgcatcggattgaggaaggtcttgttatagatttggagcctgtgagtcctgatgaggtgcctgtgactgctgccggggctttaagatcgtataagcttgcggcgaaatcgatttcgaggttgcaggcattgcctagtgggaatatgttgttgttgtgtgatgctttggttaaggaagttagtgaattaactggttatgatagggtgatggtgtataagttccatgaggatgggcatggggaagtgattgctgaatgctgccgggaagatatggaaccttatcttgggttgcattactccgctactgatataccgcaagcttcgagatttctgtttatgagaaacaaggttaggatgatttgtgattgttcagcggttccggttaaagtcgttcaagataagagtctctcacagccaataagtctttctggatctactttgagagctcctcatggttgtcacgcacagtatatgagtaatatgggatcagtggcgtctcttgtcatgtctgtaactatcaatggtagtgatagtgatgagatgaacagagatttacagactggcagacacttatggggcttggtggtttgtcatcacgcaagtcctagatttgttccgtttccattacgatatgcttgtgaattcttgactcaagtatttggcgtgcagatcaacaaagaagcggaatcagctgttctgttgaaagagaagcgtattttgcaaactcagagtgtgctatgtgacatgcttttccgcaatgcaccaataggtatagtcactcaatcaccaaatataatggatcttgttaaatgtgatggagcagcattatattacagagacaacctctggtctctaggagttactcccacagagacacaaattagagatctaattgactgggttctcaaaagtcatggaggaaacactggctttaccactgaaagtctaatggagtctggctatccggatgcttctgttcttggggagtcaatatgtggaatggctgccgtatatatttccgaaaaagatttccttttctggttccggtctagcactgcaaaacagatcaagtggggtggtgcaagacacgatcctaatgacagagatggtaagagaatgcatcctagatcctcattcaaggcttttatggaaatagtcaggtggaaaagtgtgccctgggatgacatggaaatggatgcaattaattctctgcagctaataataaaaggctcattgcaagaggagcattcaaagactgttgtggatgtcccacttgtggataatagggttcagaaggtagatgaattgtgtgttatcgtgaatgaaatggtgcggttgattgatacagcagctgttcccatctttgcggttgatgcctctggtgttataaatggttggaattctaaagcggctgaggtaacaggattggcagttgaacaagcaataggcaaacctgtatcagatctcgttgaggacgattctgtagaaaccgtgaagaacatgttagccttggctctcgaaggtagtgaagaacgtggtgctgagatcaggatcagagcatttggtcctaaaaggaaaagcagtccggttgagttagttgtcaacacttgttgtagcagagatatgacgaataatgttcttggtgtatgcttcattggacaagatgttacaggccagaaaacgcttactgaaaactatagccgcgtgaaaggagattatgcccgaatcatgtggagcccttccacactcattccaccaatttttataaccaatgaaaatggggtatgctcagagtggaacaacgcaatgcagaagctctctgggataaagagagaagaagttgtcaataaaattcttctcggggaggtttttaccacagatgattatggttgctgccttaaagaccatgacactttaacgaagctgagaataggtttcaatgctgtgatttctggccaaaagaacatagagaagcttttatttggcttttaccatcgtgatggtagcttcatcgaggcattgctttctgcaaacaaaaggactgatattgagggaaaggttaccggggttttatgctttttgcaagtacctagtccagaactccaatatgctctacaggttcagcaaatatcagagcatgcaattgcctgtgccctcaacaaattggcatatctccgccatgaagtgaaggaccccgaaaaggcaatatccttccttcaagatttgctccattcatctggattaagtgaagaccaaaagcggctcctgaggacaagcgttttatgcagggagcagttagccaaagtcataagcgactcagacatagagggaatcgaagaaggctatgtggaactggattgcagcgaattcggcctgcaggaatccctggaagcagttgtaaaacaagtgatggagctgagcatagaacgtaaagtacaaatcagctgcgattatcctcaagaagtttcatcaatgagattgtatggagacaacttaaggcttcagcaaatcctttcagagacactattaagcagcatacgcttcacgcctgcattgagaggattgtgtgtctcattcaaggtaattgcacggatagaagctataggaaaaagaatgaaaagagtcgaacttgagttcaggataatacacccggcaccaggactgcctgaggatctggtaagagagatgtttcagcctttgagaaagggaacatcaagggaaggtttgggattacacattacccagaagctggtgaaactcatggagagaggaacattgagatacctcagagagtctgaaatgtcagcctttgtgatcctcacagaatttcccttgatttga

SEQ ID NO: 417 - DNA, 1575 bp, Arabidopsis thaliana
atgcctctgtttgagcttttcaggctcaccaaagctaagcttgaatctgctcaagacaggaacccttctccacctgtagatgaagttgtggagctggtgtgggaaaatggtcagatatcaactcaaagtcagtcaagtagatcgaggaacattcctccaccacaagcaaactcttctagagctagagagattggaaatggctcaaagacgactatggtggacgagatccctatgtcagtgccatcactaatgacgggtttgagtcaagacgatgactttgttccatggttgaatcatcatccctcccttgatggatattgctctgatttcttgcgtgatgtgtcgtctcctgttactgtcaacgagcaagagagtgatatggcggtaaaccaaactgctttcccgttgtttcagagaagaaaggatggcaatgaatcagctcctgctgcttcttcgtcgcagtataacggtttccaatcgcattctctgtatggaagtgatagagctagagatcttcctagccaacaaaccaatccggatcggtttactcagacgcaggaaccactaattactagtaacaagcctagtttggtcaacttttcacatttcttacgccctgcaacttttgcgaagactactaataataaccttcatgacactaaagaaaagagtcctcaaagcccgccaaatgtgtttcagaccagagttcttggagctaaagactctgaagataaggttcttaacgagtctgttgcttctgctacgcctaaagataaccaaaaggcttgcctaatatcagaggactcatgtagaaaagaccaagagagtgaaaaagcagttgtatgttcttctgttggctcgggtaatagtctcgatggcccatccgaaagtccttcactttctttaaagagaaagcattcgaatattcaagacattgactgtcatagtgaagatgtggaagaagaatcaggagatggaagaaaggaagcaggtccatctcgaacgggtttgggttcaaagagaagccgctctgcagaagtgcataatctgtctgaaaggagacggcgtgataggatcaacgagaagatgcgtgccctgcaagaactcattccaaactgtaacaaggtggacaaagcttcgatgctagatgaagccatcgagtatctcaagtcactccaacttcaagtgcagatcatgtcaatggcgtctggttactatctgccaccggcggttatgttcccaccgggtatggggcattacccggcagcagctgctgcaatggcaatgggtatgggaatgccttatgcaatgggcttgcctgatttgagccgtggtggttcatcggttaaccacggaccacagttccaagtctcggggatgcaacaacaaccagtggcgatgggtattccacgtgtctctggtggtggtatctttgccggttcttcgacgattggcaatggctcgactagagatttatctggttctaaagatcaaacaacgacgaataacaacagtaacttgaaaccaataaagagaaaacaggggtcttctgatcagttttgtggatcgtcgtga

SEQ ID NO: 418 - DNA, 1998 bp, Arabidopsis thaliana
atggttgaagggttctcattgtcattgatgttcctccttgtttcacatttctttgtctcaggagtaatgtcgagaaactttactatagagaacaaatgcgattacactgtctggccgggattcctaaccatgactactgcggtttcgctccccaccaacggcttctccctcaagaaaggggagtcacgtgtcatcaatgtgccaccgtcatggtcaggtcgtttgtggggtagatcgttctgctccaccagctcaacagggaatttctcatgtgccacgggagactgcggctccggaaaaatcgagtgctccgattccggagcaaggcctcctacgacgctaattgattttacccttgacgctaccgacggtcaagacttctacgatgtaagcgtcgtggatggttacaaccttccgttggttgtggtcccacaacgtctagggagtggccggacatgtagcaacgttggttgtgtggttaacttgaacaagacttgtccgtcggagcttaaagtgatgggaagctctaacaaggaacatcccattgcttgcatgaacgcttgtcagaaattcgggttgccggagttctgctgctacggtgagtacggtaaacctgcaaaatgtcaaccgacgctttactctacgaatttcaagaacgagtgtccactcgcttatagctatgcttatgacaatgaaaacaacaccttcagatgctcaaactcacctaactatgtcatcaccttttgccccaacgacataagttcaatgtctcaaccatccaaggaaactaatggaggaacgaaacaaaagtcatcatggaagttaaaactcatagttggagtctcagcagctttgaccctgatgatcttaattgtggtcgtaataatagtgagaacaaagaatatgagaaatagtgagtggaatgatcagaacgttgaagcagttgcaatgttgaaacgatacagttatacaagagtcaagaagatgacaaactcatttgcgcatgttctcggtaaaggaggatttggaactgtctacaaaggaaagttagccgatagcggtcgggatgtcgcagttaagatcttgaaggtgtcagagggtaatggagaagagttcattaatgaagtagcaagcatgagtagaacatctcatgtcaatattgtttctctgcttggattctgttatgaaaagaacaagagagctataatctacgagttcatgccgaatgggtccctcgacaagtatatttctgcgaatatgtcaacaaagatggaatgggaaagattatacgacgttgcggtaggtatctctcgcggcctagagtatttacacaatcggtgtgtcacgaggattgtccatttcgacataaagccgcagaacatactgatggacgaaaatctttgtcctaagatttcagattttggtcttgctaaactctgcaaaaataaggagagcatcatatcaatgctacacatgagagggacctttggatacattgcccctgaaatgttttccaagaattttggagcagtttcgcataagtcagatgtttatagttatgggatggtagttcttgagatgattggagcaaagaatatagaaaaggttgaatattctggatctaacaatggttcaatgtactttccagaatgggtctataaagattttgagaagggagaaatcacaaggatttttggagatagtataactgatgaagaagagaaaattgcaaagaaattggtattggttgctctatggtgtatacagatgaatccatcagaccgtccaccaatgatcaaagtcattgagatgttagaggggaatctagaggctcttcaagtaccacctaatcctctcttgttttcacccgaggaaacggttccagacactcttgaagatagtgatgacacttcaaccttctttaatccaagtcattttgaaagaggtactctcttagatagtgaagatgttttacaacatgggtcaaggtcctcctaa

SEQ ID NO: 419 - DNA, 687 bp, Arabidopsis thaliana
atggcgaccaacgaacccgagcacgagcacagagacgaggaagaggccggagctaacgaggatgaggacaccggagctcaggtcgctccgatcgttaggcttgaggaggttgccgtcactaccggcgaggaagacgaagatgccgtccttgatctgaaatcgaagctttatcgattcgataaggatgcgaatcagtggaaggagagaggagctggtactgtgaagttcttaaagcataagaacactgggaagattcgtctcgttatgaggcaatctaaaactttgaagatctgtgctaatcacttcgttaaatcgggcatgagtgttcaggaacacgttgggaatgaaaagtcatgtgtgtggcacgctcgtgactttgctgatggtgaactcaaggatgagcttttctgtatccgatttgcttctattgagaattgcaaaacatttatgcaaaagttcaaggaagttgctgagtctgaagaagagaaagaagagagcaaagatgccgctgacactgctggccttcttgagaaattgactgtggaagagacaaaaacggaggagaaaaccgaagcgaaagctgtggagacggcaaagactgaagtgaaagcagaagaaaagaaagagagcgaggcagagaaatctggtgaagcaaagaaaacagaagaaagtggtccctcaacataa

SEQ ID NO: 420 - DNA, 666 bp, Arabidopsis thaliana
atggctctacctaaccagcaaaccgtggattaccctagcttcaagctcgttatcgttggcgatggaggcacagggaagaccacatttgtaaagagacatcttactggagagtttgagaagaagtatgaacccactattggtgttgaggttcatcctcttgatttcttcactaactgtggcaagatccgtttctactgttgggatactgctggccaagagaaatttggtggtcttagggatggttactacatccatggacaatgtgctatcatcatgtttgatgtcacagcacgactgacatacaagaatgttccaacatggcaccgtgatctttgcagggtttgtgaaaacatcccaattgttctttgtgggaataaagttgatgtgaagaacaggcaagtcaaggccaagcaggtaacattccacaggaagaagaacctccagtattacgagatatctgccaagagcaactacaacttcgagaagccattcttgtaccttgctagaaagctcgccggggacgctaatcttcactttgtggaatcacctgcccttgctcccccggaagttcaaatcgacttggctgctcagcagcagcatgaggcggagcttgcagcagcagcaagtcagccacttcctgatgacgatgatgacaccttcgagtag

SEQ ID NO: 421 - DNA, 846 bp, Arabidopsis thaliana
atggcggcggataatgcttatctgatgcagtttgttgacgaaacctctttttacaaccgaatcgttctgagtcatcttttgccggcgaatctatgggaacccttacctcattttctccagacatggctccgaaattacctcgccggaaccctactatacttcatctccggtttcctctggtgcttctacatctattaccttaaaatcaacgtttaccttcccaaagatgcaattcctacaataaaggctatgcgtttgcaaatgtttgtggcaatgaaggctatgccatggtacactcttcttccaactgtctccgagagtatgattgaacgtggttggaccaaatgttttgctagcataggcgaattcggctggattctgtattttgtttacatcgccatctatcttgttttcgttgagtttggtatttattggatgcacagagagcttcatgacattaagcctctctataagtatctccatgccacccatcatatctacaacaagcagaatacactctctccatttgccgggcttgcatttcacccagtagacgggatacttcaggctgtaccgcatgtgatagcgctgtttatagtgccaattcatttcacaactcatataggtcttttgttcatggaagcgatatggacggcgaacatccatgactgcatccatggcaacatctggccagtaatgggtgcaggataccatacgatacaccacacgacatacaagcataactatggtcattataccatatggatggattggatgtttggctctcttagggatcctctcttagaagaagatgacaacaaagacagcttcaagaaagcagagtga

SEQ ID NO: 422 - DNA, 1413 bp, Arabidopsis thaliana
atggcagcctcaggcacctctgctactttcagagcctccgtttcttcagctccttcctcttcttcccaattgacccatttgaaatcacccttcaaagctgtcaaatatacgcctctgccatcgtctcgctccaagtcatcatccttctccgtctcctgcaccatcgccaaggacccgcctgttctcatggccgccggatctgacccggccctgtggcaacgacccgattcgttcggtcggtttgggaagtttggtgggaagtatgtacctgaaacccttatgcacgctctatctgagcttgaatccgctttctatgctcttgccaccgacgatgatttccagagagagttggctggaatcttgaaggactatgtgggtagagaaagtcctctgtattttgcagagaggcttacggagcattacaggcgcgagaatggcgaagggcctcttatatacttgaagagagaagacttgaatcacacaggagctcacaagattaacaacgctgtggctcaggctcttcttgctaagcggttggggaagaagaggattattgctgagacaggagcgggtcaacatggtgtggctacagctactgtgtgtgcccgttttggtttggagtgtattatctatatgggtgctcaagatatggagagacaagcactcaatgtgttcagaatgcgacttcttggtgccgaggtgagaggagtccactctggaacagcgacattgaaggatgcgacatctgaagcgataagagattgggtgacaaatgtggagactacccattacatattgggatctgtggcgggtcctcatccttaccccatgatggtcagagactttcacgctgtgattggtaaagaaacaaggaaacaagcgttggagaaatggggcgggaagccggatgtcttggtggcttgtgtcggtggtggttcaaacgctatgggactcttccatgaatttgtgaatgacacagaggtccggatgatcggtgtggaagcagcgggattcggattggacagtggcaaacacgctgctacattgacaaagggagatgttggtgtcctccatggagctatgagttacttgctgcaagatgatgatggacaaatcattgaaccacactccatcagtgcaggattggactaccctggagtcggacccgagcacagtttctttaaagacatgggacgggctgaatactatagcataaccgacgaagaagcgttggaagcgttcaagagagtgtcgcggttagagggaatcattccagcactggagacctcacacgcactagcttacctcgagaagctatgtcccacattatcagacgggacgagagtggtcttgaacttcagcggaagaggagataaagatgttcagacagtggctaaatatcttgatgtttga

SEQ ID NO: 423 - DNA, 558 bp, Arabidopsis thaliana
atgcctctctctctccgacttgctccatctccgacgtctttccgttattctccgattacatctaccggcgccggaggattttcccccgtgaagcagcactgccggatcccgaattcgggcgtcgcgacgaaaattggattctgttctggtggtggtggtgttttagattccggtagaaggattggttcctgtgtggtgaggtgtagcttagaaacagtgaatgtcactgttggccaggtgacggaggttgataaggacacgttctggccaattgttaaagccgccggtgataagattgttgtcctcgacatgtacactcagtggtgtggtccttgcaaagtgattgctcccaaatacaaagagctatcggagaagtaccaggacatggtgtttcttaagcttgattgtaaccaagacaacaagccattggcgaaagagctaggaattagagtggttccaacttttaaaatcttgaaagacaacaaggtagtaaaggaagtgaccggggcaaaatatgaagacttacttgcagccattgaagcagcaaggtcaggctga

SEQ ID NO: 424 - DNA, 939 bp, Arabidopsis thaliana
atggcgattgctttcaaatccggcgtcttcttcctccaatccccaaaatctcaaattggattccgccattcttctcctcctgattcatcgctttctttcaagagattcactcccatggcttctctctccacctcttctcctactctcggtctcgctgatactttcacacagctcaaaaaacaaggcaaagtagcattcataccatatatcacagctggtgatccggatctctctactactgctgaagcattgaaagttcttgatgcttgtggttctgacataatcgaattgggtgttccttactctgaccctttagctgatggacctgttattcaggctgcggcaacaaggtcgttggagaggggaacaaacctcgatagcatccttgagatgttggataaggttgttccacaaatatcttgtccgatttcgttgttcacgtattacaacccgattcttaaacgtgggttggggaagttcatgtccagcatcagagctgttggtgtacagggacttgtggttcccgatgttcctcttgaggaaactgagatgctgagaaaagaagccctcaacaacgacattgagctggtcctactcactacaccaaccacaccaacagagcgaatgaagctaattgttgatgcgtcagaaggatttatttaccttgtgagctcaattggagtgactggtgcacgatcatctgtaagcggaaaggttcagtcgctcttgaaggatatcaaagaggcgacagacaagccggtggcagtcggttttggaatatcaaagccggagcatgtgaaacagatagctggatggggagctgatggagtgatcgtaggcagtgcaatggtaaagctattgggtgatgcaaagtcgccaactgaaggacttaaggagcttgagaaactaaccaagtctcttaaatctgctcttctttga

SEQ ID NO: 425 - DNA, 1542 bp, Arabidopsis thaliana
atggcggagaaggaagaaaaagaaccatcgaagttaaaatcatccaccggagtttcacggccaacgatttcactacctcctcgaccgtttggtgaaatgttttttagcggtggcgttggatttagtcctggaccaatgactctcgtctcaaatttattctctgatcctgatgagttcaagtctttctctcagcttttagctggagctatggcttctccggcggcagctgctgttgccgccgctgctgtggttgctactgctcatcatcagacacctgtgagctctgtcggtgatggcggtggaagcggtggtgatgttgacccgaggtttaagcagagtagaccaacgggattgatgataactcaaccaccggggatgtttactgtaccgccggggttaagtccggctactcttttggattctccgagcttctttggtcttttttcacctcttcagggaacatttggtatgacacatcaacaagctttagcacaagtcactgcacaagcagttcaaggcaataatgttcatatgcagcaatcacaacaatctgaatatccttcttctacacaacaacaacaacaacaacaacaacaagcttcattgactgagattccatcattttcttctgcacctaggtctcagattcgagcctcggttcaagaaacatcgcagggtcagagagagacttcggaaatatctgtctttgagcatcggtcacagcctcaaaatgctgacaaaccagctgatgatggatacaactggcggaaatatgggcagaagcaagtgaaggggagcgattttcctcggagttattacaaatgtacgcatccagcttgtcctgtcaagaagaaagtggagaggtcactcgatggacaagtaacggaaatcatctacaagggtcaacacaatcatgagcttcctcaaaagcgcggtaacaataacgggagttgtaaaagttctgatattgcaaatcagtttcaaacaagtaatagcagtctcaacaagagtaagagggaccaggaaacaagccaagttacaacaacagagcagatgtctgaagcaagtgatagcgaggaggttgggaatgcagagactagtgtgggagaaagacatgaggatgagcctgatcccaagcgaagaaatacagaagttcgggtttcagaaccagttgcttcatcgcatagaactgtgacagagcctaggattattgtccaaacgacgagtgaagttgacctcttagatgatggatataggtggcgcaagtatggtcagaaagtagtcaaaggaaatccttatccgaggagctactataagtgtacaacaccagattgcggagtaaggaaacatgtagagagagcagcaactgacccaaaagctgttgtaacaacatatgaaggtaaacataaccatgatgttccagctgctagaaccagcagccatcagttaagaccaaacaatcaacacaacacctcaacggttaacttcaatcatcaacagcctgttgcacgtttaaggcttaaagaagagcaaatcacttga

SEQ ID NO: 426 - DNA, 282 bp, Arabidopsis thaliana
atgaatcaagaagctgcgagtaaccttggacttgatctgaaactaaatatttcaccgtcgttggattcatctttgctcactgagagttcatcgtcatcgttatgctcggaggaagctgagggtggaggaggagaggctaaatcaatggtggtcgttggctgccctaattgcatcatgtacatcatcacttctttagagaatgaccctagatgccctagatgcaacagccatgttttgcttgattttctcacaggaaaccatagcaagaagagcactagttaa

SEQ ID NO: 427 - DNA, 681 bp, Arabidopsis thaliana
atggcgacgaacaacatcgtacgtttgatcgctccaagccgatccgtctcctctagattcctcgagccagtgtcacggtttctaagctccggtacacctcctccgccgcaagctccatctccgaatcaggatctgaaccgggacgtgaagccagatcagaatcttcaacagaatctgcagatgcagaaggaagaagaagaggaaggagaaggtggtggaggtggagagtttgtgaacgaagatactggtgagattggagggcctagaggtcctgaaccgactcggtacggcgattgggaacaacgtgcttgttcttatatatttctgggaaaaatggaaataaattcgttttatgtgtttatgtatttgcaaaataatggagaaaatggaagaaaatgtagtagaacttcaaattcgttgcctttatttggatcatcattctctggtgatcttgttattccagtaatagttaataagttcttcctcaggtttagtgatgatttagaattaaggaaacaacaagagatgagtttaactaacctgagagttcagagttcaggtttgacattacccggtggttacatgagttctggtccaagtttaggcatggctgcatgggtcagtgagatgatgtcaaggtatttctgttgttcaacaacattgcaatgtgcacttctgtga

SEQ ID NO: 428 - DNA, 555 bp, Arabidopsis thaliana
atggaggctttgccggaggatgaagagtacagtttcagggaagtagtgttgccgtctttgattccggtagtgccggagccggaacttgagagagagagcggagagaggagaagaggaagagatgttatcgtagccgttgatcatggtcccaatagcaaacacgcttttgattgggctcttgttcatttctgtcgtctcgccgatactctccatcttgtccacgccgtctcaagttcgttctctcttcaatgtgttaagaacgatgttgtgtatgagacgagccaagccctcatggagaaacttgctgttgaggcgtatcaagttgccatggtaaagagtgtggctcgtgttgttgaaggcgatgctggtaaagtaatctgcaaggaagcagagaaagtgaagcctgctgctgtgattgtaggcacacgaggcaggagcttagtaagaaggttgcgtgctacaggggagcgtaagcgagtattgtttccacaattgcaaatctgctcctgtcataatcgttcctggaaaaggtacattactaatcaatcatggtaa

SEQ ID NO: 429 - DNA, 768 bp, Arabidopsis thaliana
atgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggaaagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgacgaagcaggagatgagattaaggaggcatcaaagcccgatggtgccgagtaa

SEQ ID NO: 430 - DNA, 774 bp, Arabidopsis thaliana
atgggaaccctaggacgagcgattcacactgtgggtaatcggattcgtggaactgcccaagcccaagctcgcgttggttctcttcttcaaggaagccaccacatcgagaaacatctgtcgaggcatcggacgttgattactgtggctccgaacgcttctgtgattggtgatgttcagatcaataaaggctcgttcatttcgtatgcaagtgtttctcgtgatttgcagtatcctcgtgcaatgggaatgggacaggtccggagatttagcgaagatgtttctcacatgcctgaaatggaagactctgatgttctgaatgcattcaaagacttgatggctgcagattgggctgagcttccttctgctgttgttaaagatgctaaaaccgcgatatcgaaaaacacagatgacaaggcagggcaagaggctttgaaaaatgtgttccgagcagctgaagctgtagaggaatttggtgggattctcacttcgattaagatggaaatcgatgatagcattggaatgagtggggagggtgtgaagcctttaccaaatgatataaccgatgcgctgcgtactgcttatcagaggtatgctgagtatctagactcctttgaacctgaagaagtctacttgaagaagaaggttgagatggagttggggactaagatgatccacttgaagatgagatgcagcgggcttggttctgaatggggaaaggttactgttcttggaacctcaggactctcgggatcttacgtggagcaaagggcctaa

SEQ ID NO: 431 - DNA, 1794 bp, Arabidopsis thaliana
atgtgcggtgcaaagagcaacctttgctcatctaaaaccctaacagaagtcgaattcatgaggcagaaatcagaagacggagcttccgccacgtgtctcctcgaattcgccgcctgtgatgatctttcatcgtttaagagagagatcgaagagaatccatcggtggagattgatgagtcagggttttggtattgcagacgggtcgggtctaagaagatgggttttgaagaaagaacaccacttatggttgctgctatgtatggaagcatggaagtgttgaattacataattgccacaggaagatccgatgtgaacagagtttgcagtgacgagaaagtcactgctcttcactgtgcagtttctggctgttctgtttctatcgttgagatcatcaagatcttgcttgatgcttctgcttcacctaattgtgttgacgctaatgggaacaaaccggttgatttgttggctaaagattctcggtttgttcctaaccagagtagaaaggcggttgaggttttactgaccgggattcatggttcggttatggaagaagaggaggaggaactgaagagtgttgtgactaagtatccagctgatgcatcacttcctgatattaacgaaggtgtttatggaactgatgattttaggatgtttagctttaaggttaagccatgttctagggcttattcacatgattggactgaatgtccttttgttcatcctggtgagaatgcaaggaggagagatcctaggaagtatccttacacttgtgtgccttgtcccgagtttcgtaaagggtcttgtcctaaaggagattcgtgtgagtacgcgcacggtgttttcgagtcttggcttcacccggcgcagtataggacacggctttgcaaagatgagactggttgtgctaggagagtttgtttctttgctcatagacgggatgagttaagaccggttaatgcttctactggttctgcaatggtttcaccaaggtcgtctaatcagtctcctgagatgtctgttatgtctcctttgacgctgggatcatcgccaatgaactctcctatggctaatggtgttcctttgtctccaagaaatggtggtttatggcagaacagagttaatagccttacaccaccaccgttgcagcttaatggtagcagattgaagtcgactttgagtgctagagatatggatatggagatggaacttaggtttcgcggtttggataaccggagacttggtgatctcaagccatccaacctcgaagagactttcggatcatatgactcagcttctgtgatgcaacttcaatcaccaagcaggcattctcagatgaaccactatccgtcttcacctgtgaggcagcctcctcctcatggattcgaatcttcagcagccatggcagctgcagtgatgaatgcaagatcctcagcgtttgcgaaacgcagcttgagtttcaaaccagctccagtagcttctaatgtctccgattggggatcaccaaatgggaagcttgagtggggaatgcaaagagatgagctgaacaagttgaggagaagtgcctccttcggcattcatggaaacaacaacaacagtgtgtcacgccctgctagagactacagtgacgagccagatgtgtcgtgggtgaactcactggtgaaagagaatgcaccagagagagtgaatgagagggttgggaatacggtgaatggtgcagcgagtagagacaagtttaagctgccgtcgtgggcagagcaaatgtatatagaccatgagcagcagattgtggcataa

SEQ ID NO: 432 - DNA, 2967 bp, Arabidopsis thaliana
atgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaaaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcgatatggcttcagctgcattcatcgagcctcttccagtgatagagtttgtagcacagcttcttggaaaggatgtcttgtcgaagccattgtcggattctgatcgcgtcaagattaagaagggtcttagaggagtgaaagtagaggttactcacagagcgaatgtaagaaggaaataccgtgttgcgggtttaacaactcaaccaacaagagagctaatgtttccagtagatgagaactgtactatgaagtcagttattgagtatttccaagagatgtatggattcacgatccagcacacgcatttgccatgtctccaagttggaaaccaaaagaaggcaagctatttgccgatggaggcatgcaaaattgtcgagggacaacggtacacgaaaaggttgaatgagaagcagattactgctctcttgaaagttacatgccaaaggccgagggacagagaaaacgatattttgcggactgtccaacacaacgcatatgatcaagatccatatgcaaaggagtttggcatgaacataagcgaaaagttagcttctgttgaagctcgtattcttccagctccatggcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtgatcttaagagaatctgtgaaaccgagcttggtttgatatctcaatgttgtctcacaaaacatgtgttcaagattagcaaacagtatctggcaaatgtatcccttaaaatcaacgtaaagatgggaggaaggaacacagttctagtagacgccataagctgtagaataccactggttagcgatataccgacaatcatttttggcgcagacgtgactcacccagagaacggggaagagtcaagcccttcaatcgctgctgttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcagggaccttcttatctcatttagaaaagcaacagggcaaaaaccgcttcgaattatcttttatcgtgatggagtaagcgaagggcaattctatcaagttttactctatgagttggatgcaattcgaaaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggtactgtagttgacactaaaatatgtcatccaactgaattcgacttctacctttgtagccatgcgggtattcagggaacaagcaggcctgcacattaccatgttctttgggacgagaacaatttcacagcagatggtattcaatctctgactaacaatctctgttatacctatgcgcggtgcactcggtcggtctctatagttcctccagcgtattatgctcatcttgcagcatttcgagcacgtttctacctggaaccggagataatgcaagacaacggatcaccgggtaaaaagaacacgaaaacaacaactgtcggagacgtaggtgtgaagcctttaccagccttgaaggagaatgtgaagagagtaatgttctactgctaa

SEQ ID NO: 433 - DNA, 2850 bp, Arabidopsis thaliana
atgtcaggtctcgaagatatcaagaacgagaccgttgatctggaaaaaattccgattgaggaagttttccagcagctaaaatgtacaagggaaggattgacaacgcaggaaggggaagacaggattgtgatatttggccccaacaagctcgaagagaagaaggaaagcaaaattctgaagtttctggggttcatgtggaatccgctttcatgggttatggaagctgcagctctcatggccattgctttggctaatggtgataatcgacctccggattggcaagattttgtgggtattatctgtctgcttgttatcaactccacaatcagtttcattgaagaaaacaacgccggaaatgctgcagctgctctcatggctggtcttgctcctaaaaccaaggttcttagggatggaaaatggagtgaacaagaggctgctatccttgtcccaggtgatattgttagcattaaacttggagacattatcccagccgatgcccgtcttcttgaaggagatcctttaaaggttgatcagtctgctctaactggagagtcccttcctgtgaccaagcaccctggtcaagaagttttctctggttcaacttgtaaacaaggagaaatcgaagcggttgttatagccactggagttcacaccttctttggtaaagctgctcaccttgtggacagcactaaccaagttgggcacttccagaaagttcttacatccattggaaacttctgtatctgttctattgctattggtatagcgattgaaatagtcgtcatgtaccctatccaacaccgaaagtacagagatggaattgacaatctcttggtcctcttgatcggtggtatccccattgctatgcccacggtcttgtctgtgactatggctatcgggtctcacaggttgtctcagcaaggtgctatcaccaaacgtatgacagccattgaagaaatggcgggaatggatgtcctttgcagtgacaaaaccgggacactaacccttaataaattgagtgtggataaaaacttggttgaggttttctgcaagggtgtggagaaagatcaagttctactatttgcagctatggcttctagggtggagaaccaggacgctattgatgcagccatggttggaatgcttgctgatccgaaagaggcccgagctggaatcagagaggttcacttccttccattcaaccctgtggataagagaactgctttgacttacatcgactctgatggtaactggcacagagtcagcaaaggtgctcccgagcagatccttgaccttgccaatgccaggcctgaccttaggaagaaggtactctcttgtattgacaagtacgctgagcgcggtcttaggtcgttggcagtagctcgtcaggtggtacccgagaaaacaaaagaaagcccaggtggaccatgggaatttgttggcttgttgcctctttttgaccctccaagacacgacagtgccgaaaccattcgtagggcgttgaatctaggtgttaatgtgaagatgatcactggtgatcaacttgctattggtaaggaaaccggtcgcaggcttggaatgggaaccaatatgtatccatctgcggctcttctcggtaccgacaaggactcgaacattgcatccatccctgttgaggagttgatcgagaaggctgatgggtttgccggcgtctttccagagcacaaatatgaaattgtgaaaaagctgcaggagaggaagcacattgttggtatgaccggtgatggtgttaatgatgcacccgctttgaagaaagcagatatcggtattgctgtggccgatgctacagatgctgctcgtggtgcttcagatatcgtcctcacggaacctgggctgagtgtcatcatcagtgccgttctcactagcagagctatcttccagagaatgaagaactacaccatttatgcagtctcaatcacaatccgtattgtgtttggtttcatgcttattgctttgatatgggaatttgacttctcagcgttcatggttctgattattgccatccttaatgatggtactatcatgacaatctcaaaggacagagtcaagccatctcccacacctgatagctggaagctcaaagaaattttcgccactggaattgtgctgggaggctaccaagccattatgagtgttattttcttctgggctgctcacaagaccgactttttctcggacaagttcggtgtgaggtcaatcagggacaataacgatgaactaatgggtgctgtgtatctacaagttagtatcatcagtcaagctctaatctttgtcaccaggtcaaggagttggtcatttgtcgaacgtcctggggcgcttctgatgattgcattcgtcattgcacaactggttgcaactttgatcgcagtgtatgccgactggacatttgcaaaggtgaagggtatcggttggggatgggcaggtgtgatttggatttacagtatcgtaacatacttcccacaggacattttgaagtttgccattcggtatatcttgagtggaaaggcttgggccagcttgtttgacaacaggaccgctttcacaaccaagaaagattacggtattggagaaagagaagctcaatgggcacaagctcaaaggacattgcacggtctgcagccaaaagaagatgttaatatcttcccagagaaaggaagttacagagagctgtctgagatcgcagagcaagccaagagaagggccgagatagctaggcttagggagcttcacacattgaagggacatgtggaatcagtcgcaaagctaaagggattggacattgatacagcaggacatcactacactgtgtag

SEQ ID NO: 434 - DNA, 756 bp, Arabidopsis thaliana
atggctactgtcactactcatgcctcggcctcgattttccgaccttgtacttcaaagccaagattcctcaccggttcttccggtaggttgaaccgcgacttgtcgtttacatcgatcggttcatcggccaaaacgtcgtcgttcaaggttgaagctaagaaaggagaatggttgcccggtttggcatcgcctgattatctcaccggcagtcttgccggtgacaatgggtttgacccgttgggtctagcagaggatccagagaacttgaaatggttcgtccaggcagagctggtcaacggacgatgggctatgctcggtgtcgctgggatgcttttgccggaagttttcaccaagatcggaatcataaatgttcctgagtggtacgatgctgggaaagagcagtattttgcatcgtcgtcgacattgttcgtgatcgagttcatattgtttcattacgttgagatcagacggtggcaagacatcaagaacccaggaagtgtgaaccaagaccctatctttaagcaatacagcttacctaagggtgaagttggttaccctggtggaatctttaacccgcttaactttgctcctacgcaagaggccaaggagaaagagctagcaaacgggaggttggcgatgttggcattcttagggtttgtggttcaacacaatgtgactggaaaaggaccatttgagaatctgttgcagcacttgtctgacccatggcacaacactattgtccaaaccttcaactaa

SEQ ID NO: 435 - DNA, 1158 bp, Arabidopsis thaliana
atgatgggattgagttccttggtctttaccgagtttcacagcctcggcttctctgaccttatagtttttgttgcgccactctggattgctgtggctgccggtgttttggttggttgggtttggaggcccaagtgggcttatctcgattctaaactcttgtccaattcacctaaattcctcaatcttcagcttcccacttccatcctcaaaacttcttctcaccacgttaaccccagcctttcttccaaagagaaaactgggtttgtaacggacgatgattttaggcatctatggaagttggttgaggtcaaagatggcggtccttgttggattcaaatgatggaccgatcaaccccaaccttctcatatcaagcttggaggcgagatcctgagaatgggcctccccagtaccgtagcagaactgtgtttgaggatgccactcccgagatggtcagggacttcttttgggatgatgagttccgttccaagtgggatgatatgcttttgtattcttctactctcgagcgttgcaaggacacgggcactatggttgtgcaatgggtgcgaaagttccccttcttttgtagcgacagggagtatattataggccgtcgtatatgggatgctggccgagtcttttactgcattactaagggagtacaatacccgtctgtacctagacaaaacaagccaaggcgagtcgacttgtactattcaagctggtgtatccgtgcagttgaatcaaaaagaggcgatggtgagatgacatcatgtgaggtactactatttcaccatgaagatatgggaataccgtgggagattgcaaagcttggggtgagacagggtatgtggggtgcagtcaagaagattgagccaggcctacgtgcatatcagagggctaaagcagcgggagcaggtttatccccgagtgccataatggctcacatcaacaccaaagtgagtgcagaggagttcatgaatgagaggggttcgatagcagaggttacaggagacaagccgacggggaaaaacataccaaagatactagtggtaggaggggcgattgcacttgcatgtacattggacaaagggctgttgacaaaggcggtgatattcggagtagccagaagatttgcaagaatgggaaaaaggatgtag

SEQ ID NO: 436 - DNA, 4872 bp, Arabidopsis thaliana
atggggtttgagtttattgaatggtattgtaagccggtgcctaatggtgtttggacaaaacaagtggctaatgcatttggtgcatacacgccttgtgctactgactcttttgtgcttggtatctctcaactggttctgttggttctgtgcctgtatcgtatatggctcgccttaaaggatcacaaggtggagaggttctgtttgaggtcaagattgtataactatttcctggctttgttggctgcgtatgctactgctgagcctttgtttagattgatcatggggatttcagttttagattttgatggacctggacttcctccttttgaggcattcggattgggtgtcaaagcttttgcttggggcgctgtaatggtcatgattttaatggaaactaaaatttacatccgtgaactccgttggtatgtcaggtttgctgtcatatatgctcttgtgggggatatggtcttgttaaatcttgttctctcagtcaaggagtactatagcagttatgttctgtatctctacacaagcgaagtgggagctcaggttctgtttggaattctcttgtttatgcatcttcccaatttggatacttaccctggctacatgccagtgcggagtgaaactgtggatgattatgagtatgaagagatttctgatggacaacaaatatgccctgagaagcatgcaaatatatttgacaaaatcttcttctcatggatgaatcccttgatgactttgggatctaaaaggcctctaacagagaaggatgtgtggtatctagacacttgggatcagactgaaactctgttcacgagtttccagcattcctgggataaggaactacaaaagccgcaaccgtggctgttgagagcattgaacaatagcctgggaggaaggttttggtggggaggattttggaagatcgggaatgattgctcacagtttgtgggacctcttttactgaatcaactcttaaagtcaatgcaagaggatgcgccagcttggatgggttacatctatgcgttctcaatctttgttggagtggtgttcggggtgctatgtgaagctcaatatttccagaatgtcatgcgtgttggttaccgactgagatctgctctgattgctgctgtgttccgcaaatcgttgaggttaactaatgaaggtcgtagaaagtttcaaacaggaaagataaccaacttaatgacgactgatgccgaatctcttcagcaaatatgccaatcacttcataccatgtggtcggctccatttcgtataattatagcactgattctcctctatcagcaattgggtgttgcctcgctcattggtgcattgttgttggtccttatgttccctttacagactgttattataagcaaaatgcagaagctgacaaaggaaggtctgcagcgtactgacaagagaattggccttatgaatgaagttttagctgcaatggatacagtaaagtgttatgcttgggaaaacagtttccagtccaaggtccaaactgttcgtgatgatgaattatcttggttccggaaatcacagctcctgggagcgttgaatatgttcatactgaatagcattcctgttcttgtgactattgtttcatttggtgtgttcacattacttggaggagacctgacccctgcaagagcatttacgtcactctctctctttgctgtgcttcgtttccctctcttcatgcttccaaacattataactcaggtggtaaatgctaatgtatccttaaaacgtcttgaggaggtattggcgacagaagaaagaattctcttaccaaatcctcccattgaacctggagagccagccatctcaataagaaatggatatttctcttgggattctaagggggataggccgacgttgtcaaatatcaacttggatgtacctcttggcagcctagttgctgtggttggtagtacaggcgaaggaaaaacctctctaatatctgctatccttggtgaacttcctgcaacatctgatgcaatagttactctcagaggatcagttgcttatgttccacaagtttcatggatctttaatgcaacagtacgcgacaatatactgtttggttctcctttcgaccgtgaaaagtatgaaagggccattgatgtgacttcactgaagcatgacctagagttactgcctggtggtgatctcacggagattggagaaagaggtgttaatatcagtggaggacagaagcagagggtttccatggctagggccgtttactcaaattcagatgtgtacatctttgatgacccgttaagtgcccttgatgctcatgttggtcaacaggtttttgaaaaatgcataaaaagagaactggggcagaaaacgagagttcttgttacaaaccagctccacttcctatcacaagtggacagaattgtacttgtgcatgaaggcacagtgaaagaggaaggaacatatgaagagctatccagtaatggccctttgttccagaggctaatggaaaatgcagggaaggtggaagaatattcagaagaaaatggagaagctgaggcagatcaaacagcggaacaaccagttgcgaatgggaacacaaatggtcttcaaatggatggaagtgacgataaaaaatccaaagaaggaaataaaaaaggagggaaatctgtcctcatcaagcaagaagaacgtgaaaccggagttgtaagttggagagtcctgaagaggtaccaggatgcacttggaggggcatgggtagtgatgatgctccttttatgttacgtcttaacagaagtatttcgggttactagcagcacgtggttgagtgagtggactgatgcaggaactccaaagagtcatggaccccttttctacaatctcatatatgcacttctctcgtttggacaggttttggtgacattgaccaattcatattggttgattatgtccagtctttatgcagctaagaagttacacgacaatatgcttcattccatactgagggccccgatgtccttcttccataccaatccgctaggacggataatcaatcgattcgcaaaagatctgggtgatattgatcgaactgtggccgtctttgtaaacatgtttatgggtcaagtctcacagcttctttcaactgtagtgttgattggcattgtaagcactttgtccttgtgggccatcatgcccctcctggtcttgttttatggagcttatctttattatcagaacacagcccgtgaggttaagcgtatggattcaatttcaagatcgcctgtttatgcacagtttggagaggcattgaatggcttatcaactatccgtgcttacaaagcatatgatcgtatggctgatatcaacggaagatcaatggataataacatcagattcactcttgtcaacatgggtgccaatcggtggcttggaatccgtttagaaactctgggtggtcttatgatatggctgacagcatcgtttgctgtcatgcagaatggaagagcggagaaccaacaggcatttgcatctacaatgggtttgcttctcagttatgccttaaatattactagcttgttaacaggtgttctgagacttgcgagtttggctgagaatagtctaaacgcggtcgagcgtgttggcaattatatagagattccgccagaggctccgcctgtcattgagaacaaccgtccacctcctggatggccatcatctggatccataaagtttgaggatgttgttctccgttaccgccctcagttaccgcctgtgcttcatggggtttctttcttcattcatccaacagataaggtggggattgttggaaggactggtgctggaaagtcaagcctgttgaatgcattgtttagaattgtggaggtggaaaaaggaaggatcttaatcgatgattgtgacgttggaaagtttggactgatggacctacgtaaagtgctcggaatcattccacagtcaccggttcttttctcaggaactgtgaggttcaatcttgatccatttggtgaacacaatgatgctgatctttgggaatctctagagagggcacacttgaaggataccatccgcagaaatcctcttggtcttgatgctgaggtctctgaggcaggagagaatttcagcgtgggacagaggcaattgttgagtctttcacgtgcgctgttacggagatctaagatactcgtccttgatgaagcaactgctgctgtagatgttagaaccgatgccctcattcagaagactatccgagaagaattcaagtcatgcacgatgctcattatcgctcaccgtctcaataccatcattgactgtgacaaaattctcgtgcttgattctggaagagttcaagaattcagttcaccggagaaccttctttcaaatgaaggaagctctttctccaagatggttcaaagcactggagctgcaaatgctgagtacttgcgtagtttagtactcgacaacaagcgtgccaaagatgactcacaccacttacaaggccaaaggaaatggctggcttcttctcgctgggctgcagccgctcagtttgctctggctgcgagtcttacttcgtcgcacaacgatcttcaaagccttgaaattgaagatgacagcagcattttgaagagaacaaacgatgcagttgtgactctgcgcagtgttctcgaggggaaacacgacaaagagattgcagagtcgcttgaggaacataatatctctagagagggatggttgtcatcactctatagaatggtagaagggcttgcagtgatgagcagattggcaaggaaccgaatgcaacaaccggattacaatttcgaaggaaatacatttgactgggacaacgtcgagatgtag

SEQ ID NO: 437 - DNA, 684 bp, Arabidopsis thaliana
atgatgtctactgtaccggcctttacctttactgaaccgggtttggttaaccaattatcggatttccagaccggattcactccttgggaattgaactgctccgatctcttctctacaatccatctcgaaccggtcgtaccgagtccttgttctggtgaatccgatgccggttctgtcaaaattaacaccgattttaacggttttgacgaatcgtgtatcggttccatcaaaactaactccggttctgatgattccaaccttttccacggcgtaccgagtcctcaatccgacgaattggactcaaaaaacacgaaaatccgaagtaacgccacgaatcataaccggaacaaattgaaccggtcggttttgcaggtgactgacgaccgtaaacgcaaacggatggaatcaaaccgagaatcagcgaagcggtcgaggatgcgtaaacaaagacacattgataatttaaaagacgaagcaaatcgtctcggtttagaaaaccgggaactcgcaaaccggcttcgaattgttttgtacaacatcgcattaatgtgtacggacaacaatcagcttttgtcggaacaagagattctcagacggagattcttggagatgaggcagattttgattttcagacagcttcagctgaatccatcattgatcatcaatcatcatcatatgatttga

SEQ ID NO: 438 - DNA, 1413 bp, Arabidopsis thaliana
atgacaaacttcaaagacaacgatggagatggaaccaaactccacgtggtaatgtttccatggttagcctttggtcacatggttccatacttggagctctctaaactcatagctcaaaagggtcacaaagtctctttcatttccactccacgtaacatcgaccgtctcctcccatggttaccggaaaatctctcctccgtcattaacttcgtcaagctatcacttcccgtcggcgacaacaaactcccggaagacggtgaagctaccacagacgtccctttcgaactcataccttacttaaaaatcgcttacgacgggttaaaagttccggtgacggagtttcttgaatcttcgaaacccgattgggttcttcaagatttcgcggggttttggcttcctccaatctctcgtcgtctcggaatcaaaaccggattctttagcgctttcaacggcgcgacgctcggtattcttaaaccgccggggttcgaagagtaccgtacttcgccggcggattttatgaagccgcctaagtgggttccgtttgaaacttcggtagctttcaagttatttgaatgcaggttcattttcaaaggatttatggcggaaaccaccgaagggaatgttcccgacatccaccgtgtcggcggcgtaattgacggctgtgacgtcatcttcgtacggagctgttacgagtatgaagcggagtggttaggacttacacaagaacttcaccggaaaccggttataccggtcggagttttgcctccaaaaccggacgaaaagtttgaagataccgacacgtggctgtctgttaaaaaatggttggactcacggaaaagtaagtccattgtctacgtagcttttggttcagaagctaaaccgagtcaaacggagctaaatgagatcgctctcggtttagagctttctggtttacctttcttttgggtgttaaagactcgtcgtggtccgtgggataccgaaccggtcgagcttccggaaggattcgaagagcgtacagcggatagagggatggtgtggagaggttgggttgagcaattgcgtacattgagccatgactcgatcggtttggttctgactcatcccggttggggaacgataattgaagctatccggtttgctaaaccgatggcaatgctggtttttgtgtatgaccaaggattgaatgcgagagtcattgaagagaagaaaattgggtatatgatccctcgagacgagacagaaggtttctttactaaagaaagtgttgcgaattcgctaagattggtaatggtggaagaagaaggaaaggtttatagagagaatgtgaaggagatgaaaggagtgtttggagatatggatagacaagatcgttatgtggattcattcttggaatatcttgttactaatcgttaa

SEQ ID NO: 439 - DNA, 351 bp, Arabidopsis thaliana
atgaatgtattgaaatgtctagcgatcatttccgttctcggaatattcttcatacctcgttattctgaatccgctatatcttgcagtgttgtgttacaggatttgcagccatgtgtgagctacttgaccagcggaagtggaaaccctccggagacttgttgcgacggagttaagagtttagcggcggcaaccaccacatctgccgataagaaggcagcttgtcaatgcatcaagtcagtggctaatagtgttaccgtgaagcctgaattggctcaagcccttgctagcaattgtggtgcgagcttgcccgttgatgcttctcctactgtcgactgcactactgttggttga

SEQ ID NO: 440 - DNA, 1455 bp, Arabidopsis thaliana
atgggaaaggataagactttgccgttgcttgaccctcgtgagccaccggaactcaccggaaccaagtcggcgtcaaaagtatgggccaaagagttcggcgaagagtcgaagcggctttgggagttagcaggaccagcgattttcactgccataagtcaatactctcttggtgctctcactcagactttctccggccgtctcggtgaacttgagctcgccgccgtctcagttgaaaactctgttatctccggtcttgccttcggtgtcatgttagggatggggagtgcattggagacgttgtgtggacaagcatatggcgcgggacagattaggatgatgggaatatatatgcaacgttcatgggtcattctctttactactgctttgtttttgcttcccgtctacatttgggctcctcctattctttccttcttcggcgaggctcctcacatctctaaagccgcggggaagttcgcattgtggatgatcccgcaactatttgcctatgcagccaacttcccgatacagaaattcttgcagtcacagaggaaagttcttgtgatggcttggatctctggagtggttttagttatacatgcagtttttagctggctcttcattctttactttaagtggggacttgtaggtgcagctatcactctcaatacctcgtggtggttgattgttattggtcagcttttgtatatcttaatcaccaaatcagacggtgcgtggactggattttctatgctagcgtttcgggacctctatggatttgtcaaactttccttagcctctgctcttatgctttgtttggagttttggtacttgatggttctggttgttgttaccggtctccttcctaacccgttgataccagtcgatgccatctccatttgcatgaatatagaagggtggactgccatgatttcgatcgggtttaacgctgcgattagtgtgagagtatcgaatgagctgggtgcaggaaacgcagcgttagccaaattctcagtgatagtcgtctccataacttcaactcttatcgggatagtgtgcatgattgttgtcttagccacaaaagacagcttcccttatcttttcacttcaagcgaagctgtggcagcagaaaccacgagaatagccgtcttgttgggcttcactgtcctcttgaacagcctccagcccgtcttgtcaggggttgcggttggagcggggtggcaggctctggttgcatacgtgaacattgcgtgttattacattatcggactacctgctggtcttgttcttggattcacactagacctcggcgttcagggaatatggggaggtatggtagctggaatatgcttgcagacacttatattgattggaatcatctacttcactaactggaacaaagaggctgagcaagcggagagtcgagttcagagatggggaggaacggcgcaggagtga

SEQ ID NO: 441 - DNA, 1083 bp, Arabidopsis thaliana
atgattactgtcgtcacctccaggctctctctccttcctccagtcttctccgtcgttaactcttcttcttcgcgttccaaagcctgcatgaacccttctcttatggctttaattgcagatatgaatctagagccaaaaaagaaggttaaattaagagaagactggagagaaaagtccagacctatcccacccggaggaacctatccagctaaagaccattgcagtcagtgcgggctatgcgacacctactacattgcccatgtgaaggaggcatgtgcatttcttggagatggaatgtcaaggattgagagcttggaacctgttgtgcatggtagaggaaggaaagcagattccttacaagatacatattttggggtgcatcaagagcagctctatgctcgtaagttgaagcctgtcgaaggagctcagtggactggaattgtcacaaccatagccattgagatgctgaaatctaatatggttgaagctgtcgtttgtgtgcagagtgatcctgaagacagattatctccaagaccagtattagccaggacacctgaagaagttttggctgcaagaggtgtcaagccaactctgtctcctaatctgaatactcttgaattaatcgaggcttccggagtgaagcgtcttctgttttgcggtgtgggttgccaagtgcaagcattgagatcagtggagcagcatctgaatctggaaaagttgtatgtactaggcaccaattgtgtggacaacggaacacgagatggactagacaagtttctgaaagcagctagtaaagagccagagactgttctccattatgaatttatgcaagattacaaggtccaactcaaacacttggatggacacattgaagaggttccctatttctctctacctgcaaacgatttagtagatgtcatagctccatcgtgttacagctgctttgattacacaaatgcattagcggatttggttatcggttacatgggtgttccgaagtattcaggtctgaacatgactgaccatccacagtatattacagtgaggtcaatatttctacgtattttgacatggaccatatag

SEQ ID NO: 442 - DNA, 1005 bp, Arabidopsis thaliana
atggcccctgagatttccgtaaacccgatgtatttatccgaaaaggcgcatcaagcacctccaaggagagcttatgtgacgtttttggcaggaaatggagactacgtgaagggagtggtgggactagcaaagggtttgcgtaaggtcaaaagtgcgtatcctcttgttgttgctatgttacctgatgtgcctgaggaacatagagagatcttgaggtctcaaggctgtgtcgtgcgtgagatcgaacctgtttatcctccagacaaccaagttgagtttgccatggcttattacgttctcaactactcaaaacttcgtatttggaactttgaagagtacagcaagatgatataccttgacgcagatattcaagtctttgacaatatcgatcacctctttgatttgtctgatgcatatttctatgccgtgatggactgtttctgtgagaaaacatggagccactcgctgcagtattcaattgggtattgtcaacagtgcccggagaaggtcacgtggccagaagatatggaatctccacctcctcctctgtatttcaacgccggtatgtttgtgtttgagcctagtcctttgacttatgagagtctccttcagaccctggagatcacaccaccttcaccgtttgcagaacaagattttctcaatatgttctttgagaaagtgtacaaaccgatccctttggtatacaatctggttttggctatgctttggcgtcacccggagaacgtggagctggagaaagtcaaagttgttcactactgtgcagctggatccaagccatggagatacacaggagaagaagctaacatggacagagaagacatcaagatgttagttgataaatggtgggatgtctataatgatgaatctctcgatttcaaatcgaaaatccctgcagatgcggaagaaaccgttacaaaatcaagcatcctagcttccgttcttgaaccagaaatgacctactttcctgctccttctgctgcttga

SEQ ID NO: 443 - DNA, 678 bp, Arabidopsis thaliana
atggaggagaacgagcgcttgtcgatgaagaggaaagatattgacagagtaaacgatgacttctctgatttttccctctcttctcccgccaggaagattcgtcgtctggatgtggatttgccaccgattatggaggaagaagagattgatttaccgatgcaagatacggtcgcggaagaaatcgagcttgagccggttaacgatgagagagcaattgttctatttaagcctcttcattatcatcagccttcttctggaaacgtatttgttgatcgacacttgatttctgggtttaagaatagatttcttcgcgatgtatcgatagctgatgataatcagtatgaagatgagagattaaacaagtgtcaagctgttgtttgctggaatccgtctcagtctacttactcacagtccataggaaccttccaacaaccgcggacactagagattactgagttggatgagacaggtgaggatgtggtaatggatgatgcatccaatgagatagaagaggatactggaagcaccagtctatctttccctcagcaaggacagcagcaagagcaagagcacacctatggttttggcttgcatccgtggcagcaagcgcaaaactgtatgattccgcagcttcctcaagtcagtactactcccactcccatcacttggttccgatga

SEQ ID NO: 444 - DNA, 1977 bp, Arabidopsis thaliana
gagctttcttatattcttgcaaagaatatcatattaaagcttgccgacttgatgaaaaatgcaatcggagatacttctagctcacaagatcttcagcaatgtattgggtctgcagtggtggcaatgggaccagtaaggctactgacacttcttcctatcactcttcatgctgagagtcactcatgcacaaatgcttggctaattcctatcttaagaaaatatatcattggagcatctcttgcgtattatgttgacaacattgttccgcttgcaaaatcactgatgcttgcttctaaaggagctaaaaagtcaactcacggcaaagagttgcgggcttgtggtcatgagcttctgagactgttacctgccttttgtaactatccagttgatgtggccaacaaatttggatcgttagccaaactgatggttaaatttatcaaaaagaaatctttcatgcatgaagctgtggctctttctctgcagatgcttgtaaatcagaataaaggaatgcctaagcccagtacagatatgggagaagcaaaagccataagcgaagaagatgcaacaacagagcttgaaagaggatttcactattcgaagaaagcttcaacgaaaaacatgaaagctttggcatcaagctcgacagagttgcttcaaactcttgttgatgttttcacagtttcaggcacagagatcagtgcagactttaaggctgcaattggatgcttagcttctactctggattcgtcagttaggaaaaagattctgatatccttgctaaataagtttgatcctgccggtgaaagcgagactgaggggcaggtcaatcaatcgaatgattctgtcgatgaagaaaaagaaaactgcagttccacaaagacacagttaaagaggagtgctgtgctggatcttgcatcttcatttgttgaaggagccaaggaagatcttattgagttgatttataatcttgttcgccaaagttttcaggccaccgacgaggctgatctttatggggcatatgatactctgagcagagttctacaggaacatggttggttttgtgcatctcattttgcagaggtgatagagatgttactcagccataaaactccagaggatgcggcttcttctagaagccgatttgcatgtctccacgtcctaatggctcatggaattcagtcaagcaccgaggaggagaatgagaaggctttccttattctgaacgagatgatcctgacacttaaagaggggaaagaagaacataggaaagcagcttgtgatacactggttatggtgtataccaccctgaaaaattcatcatctatcaccagtgatgaactttgtcccaaattgattaacatgataacgggttatatttctggaacgtcgccgcacataaggagtggagcagtgtctgcattatctgccttggtatacaaagaccctgagatatgcctatcgtcacctgagcttctttcatctgttttatcattgcttcacactaaatccattgagattataaaagctgttttaggttttgtgaaagttttagtctcaacatcgcaagctcaggacttgcacagtctactgcagaacctcttatacgaaattctcccctggtcgtctgtttcaagacattattttaagtcgaagaaccgttcggggaaatcaaaagacaaagaagagaccaatgagtcacagactacatccatcgatccatccagagggccgcggaaaagaaattacagagaagcttcatcagaaactacagccaaacaagatggcaacaaattcaaacggcaaaagagaacatatcaacaacacacacctgcttccgacattaatcaaagtagaacaggaccacagcgccccggtaacagaagcttcggaaaacaaagggaagcttctggaaacaatcacaagtcaggaaaagagacacgaaagccacagaagaacagattcaggaaagcaacatga

SEQ ID NO: 445 - DNA, 1461 bp, Arabidopsis thaliana
atgaaaatccctgcatcatctcctcaagacacgaccaacaacaacaacaacactaatagtactgatagtaatcacttatcaatggacgaacatgtcatgcgttcaatggattgggattccatcatgaaagaattggagcttgatgacgattctgctcctaactcacttaaaaccggtttcaccacaaccacaacagattctactattttgcctctttacgccgtcgattcaaatctccctggctttcccgatcagattcaaccgtcggatttcgaatcgtcttccgatgtttatcctggtcagaaccaaacaactgggtacggttttaattctcttgatagtgtcgacaatggaggatttgatttcattgaagatctcatccgagtcgtggattgtgttgaatcggacgagttacaactcgctcaggtggttttatcacggcttaatcaacgcttgagatctccggcgggtagaccgttacagagagctgcgttttactttaaggaagctctcggttcgtttttaaccggatcaaaccggaatccaatccggttatcttcttggtccgagattgttcagaggatccgagcgattaaggaatattccgggatttctccgatccctctcttctctcatttcacggcgaatcaagcgatactcgattcgttgagctcgcagtcgtcttctccgtttgttcacgtggtggattttgagattggattcggtggccaatacgcatcgcttatgagagaaatcactgagaaatctgtaagcggtggatttttaagagttacggcagtggtggcggaggagtgcgccgtagagacgcgactagtgaaagaaaacctaactcaattcgcggcggagatgaaaattcgtttccagattgagtttgtgctgatgaagacttttgagatgttatctttcaaagcgattaggtttgttgagggggagaggaccgtcgttttgatttccccggcgatatttcgtcgtctaagtggaatcactgattttgttaacaatttacggagagtatcacctaaggtcgttgtattcgtggatagtgaaggatggacggagatcgccggatctggatcattccggcgagagtttgttagcgctcttgagttctacacgatggtgctggagtcgctcgacgctgcagctcctcccggagatttggtgaagaagatagtggaagcgttcgttctacgaccgaagatctccgctgcggtagaaacggcggctgacaggagacacaccggcgaaatgacttggcgggaagcgttttgcgccgccgggatgaggccgatacagcaaagccagttcgccgactttcaagctgagtgtttattggagaaagcgcaagttagaggattccacgtggcgaaacgacaaggagaattggtgctgtgctggcatggaagagcacttgttgccacatcagcttggcggttttag

SEQ ID NO: 446 - DNA, 1662 bp, Arabidopsis thaliana
atggagctattcacaaaaggtaacaacgttaagttacgtagccacctagataagtttttagtcgccgacgatgaccaagaaaccatccgtcaaagccgtaaaggagatgcacggcgtgccgtttggacggtggagcccgtcgtcgataaacctaatctgataaggttaaagagcagccacggcacgtacttaacggcgagcaacaaaccgttattgttaggtatgaccggtgagaaagtgactcaaacggcgtcgtttaacaagctgatggattggcaaacgcagtgggaaccggagcgagatgggtttcaggtgaagctaaaatcttggtgcggtaagtggatgagggctaacggtggaacgccgccgtggagaaactctgttactcacgatgagcctcatacgtcaaagacaaagaactggttgatttgggatgttataactattgatggttctgatcttgaaaacatgtctgatggtgatgaaagctctgtttcttctccggtcgggtctgaattcggatcagaacccgggtcacctgtttctgccaggtctacgaagagtagtattagccggtttgcttctcttggtttatctacgtctccgagatggtcctcaaaaccgaagtcgacggcgagtagcttcaaccaaaaagaaacaccagtatctgtctcagcaatggaatttttccagaaagcaaaagctattcgaatgcgtaacagtcacaacaagtatctaacagcagacgacgatgaagaaaccgtaactcaaaaccgtaacggatctaccaaaaacgctcgatggaccgtcgaaccggttcgtgattctttccatgttattcgtcttaaaagctgttacggtaagtacttaaccgcttctaacgagcggttcttgctcggggctacggggaagaaagtgattcagttgaaactgagtcgggttgattcgtctgttgagtgggaaccgcttagagaagggtctaagattaagcttaggactagatctggtaactatttacgaggtaatggtggtcttcctccttggagaaactcggtcacacacgacgttcctcatttgtctgctactcaggattcgatttcttgggatgttgatgttgttgagatcttgactgattccgaattcaagacggagtctgcgaaagcgccgccaccgaagacgacgtctccaccgccgcatcggagaccgacgagttcgccgttgtcggctgagtctccaaggacttcgtcttctctttcagacagatccgattcagatgtgagtacttttcctaaattcctaaaacacctttggttttgtttaaaattacagttgtaccgttttccggttattgaaaattttgattttgattttgaccagtcggttgagtctccgcctaaatctgatggacgaaccatatattaccatgtcgctgacgaggaaggacacgtggaagatgaaacaaccgttggatatgctttcacgtttaaaggaaatagcgtggcggagctgactcagacattgcgagaagaaacgtgcatggaagacgctgtggtgtgtactcgtagtcctttaaacggcaagctgtttcctcttcgtttgcaacttcctcctaacaacggaacattgcatgtcattttactaccctccagcgcgagcctctag

SEQ ID NO: 447 - DNA, 168 bp, Arabidopsis thaliana
atggcgacgagattcgatgtgaagacgatcgtcaaggacaagagattctggattgcttccttcatcatcgtctgggctgctggtcttcagggtcacatgatgtggctgcagaagcaagaatctttcaagcagaaatttggaacaatcgatgaagacgaccacaagtga

SEQ ID NO: 448 - DNA, 2520 bp, Arabidopsis thaliana
atggagtgtcgtttggagttgaagaaaggttcttgtgatagaccaccatttgtagctgctgagaagaaggtattaactaaggaaagctcaaaggcatttacaccggataagtttagagacgataaacgcgggttatcttactccgatttccaccgcgagatcacgaaaaaagttgaagatgtatgtcctaaacgcttggagaatcgtttgaagtcaaggataggtagaactgcttcaggagaaagagatcttgtgaagtacaagtcttatgtgccgagttatataaagaaatgtgataaagttgaagacaagagtgttaaagctggtggtgttattggttcacaggagctaaggaatatgcaagggattgataaactgatggataagcatacgaggtcttccttgtctaatacaagtacatcgtcttctctctggactgatgagtcatcgactgattccagtagaggtctttgtgcttctccttttcgtaaaaagatcaatcaccctcctttgcagtattatctcatgtcttctaagcctggagataattttcaagatttggagccacctcaagataacggtgatacttctcacagtcatagaagagatgggcagtttcatcagacccctcgtgcaactgcggtccaacagaatgagaagaaagatactgatgttaagattgttccaaagacaagaactctctttagtccatcgaagccagatagtccttcttgcacaaggataatatcaaagaatctagccgaggattttaagaagaaaggagagaagttggaagagagaatccgaaatcctcgtgttcatgatctctttggaaaagaaaagcctgctgctgtatttgtaccagggattgtttctcagaaacagtttattggtttgtccaagttctatgattcgaaagtgttactagctgagcgattggcggaaagtaaccgaaaggggttcacagagaggttagcgcatgggaaaactgcagttcttgactctgatgtaggtcctttccgacgtgaagctgatggaggaagtaagccattcttaaaacgtatcagcttcttatcagaaagatcatgttcagctccacgatcaagaaaggctgaatctagtccctctagaagcaggactctagatagaaggtcaacagaaacattacctaaacagtcagatcagaaaccagctaaagtcttatcagaaagagctaggagcatttcaccatttcgccgactcagcttcagcattggaaagtccagtaaaaactccaacaccgaagatgctaagactcctccacacttaagcacagcacttatttcatcacgagctggtttagacaatccatctgcctcttctttcagtgacagctcttcttttgataaaaccagtgcagcaaacagaggcaggtctagtccattgagaaggttactcgatcctttaataaaaccaaaatcaagccactcatgtagatctcctgagccatcactaaaggaagcaccttcaagtcaaccatcttcgtcatcctttctgtcgagaaatggaaaatcttcaactgttcaggctctatttcgtgtgacatctaagaatgatcaaccactcttcacttttgcggttgaaaaggaacaaagtattacagcagctacaataagaaaacagactctcccagagaaggaagactatggacacaagtatacttttttcactgttcaagaagtacagaagaaaaatgcaaaatggatgaacaacagcaggaaagtccaaagccaagagtacacatccaacattgtcgctcagatgagagtctcagatcctaagcctctatttctcgctggagaaagatctgcggaaaacctcttaactagagagtttgtacttgttgcatctgaatcgcagcggactaacgagctagctgccatggtgatcaagataccaaaacttacagacacaacaagctcaaccactcttggagattactttgcagaggttaacgcaacagtggtacttccaagtggagttcacagtctcccgcacaaaggagggccgtcatcactgatccaacgatggaaatcagatggatcatgtgactgtggaggctgggacacgggatgtaaccttagaatcctcacaaatcagcataataaacccataaacccttctccaaccacttcagatgccttcaagcttttctttcagggaggagtacaggagaataacaaccaaccatacttgagtttcactacatacagagaaggtgtttacgcggttgagtacaatacatcgctctcactcttgcaagcattctccatttgtatagcggttaacgagggacgaaatccgttaataaagaccaccgtggaacccaacacttcacgtgtagagaagaaagcttatggaggagagatgtcatcgattcaaaacgagaatttgaagtcattttcaggtcctattgaagctgaggctccggctaggtatctctcacaccacccacctttgtctcctgttgggagggtttag

SEQ ID NO: 449 - DNA, 390 bp, Arabidopsis thaliana
atggctgtgactctgagattaacgaattctttagcattttccagtcatcctctaacgtcgtccgtactgttccgaggaagcaaatcgatcggtactattactaagatagcatcaacaatcaggacggtaaaaatggcggcttttgctgggtctgactcagaaacaacgtcgtctacctcgagagttatcgattctcatctccacatttgggcttctcctcaagaggccgagacatatccttattttcctggccaagaacctactttgactggtgatgtcaatttcttgcttaagaacatggaagaggcaagagtagatggagctctcattgtgcaacccataaatcacaagtttgaccattctttagtaacaaggtctcgtcctttttaa

SEQ ID NO: 450 - DNA, 1704 bp, Arabidopsis thaliana
atggcggccacgtttctgccggcgacatctctccgtctaactcaaaactctactctccgcttcttatcattcttcaccatttctaacccttcttattctctcttccgtcctctacgccgccgtgttctccctcccttcgatgcttttccggccaattctcgccggagatgcttttgcacagctgtttcggaatctctcggctccggtgatggaaataaagttgagagttacgagaaacgatttgggagtaaagttggagaattcaggaaaaagttgaggatagctgaagtgaaaggaggagcggacgaaggactgagtcgggtcgggcagagccttaacattatgggttgggttcgtacacttcgatctcagagcagtgtcacattcattgagataaatgatggttcatgcttatcgaatttgcaatgtgtgatgacttcggatgcagaagggtatgatcaggtagaatctggttcgatcttgactggagcatcagtatctgtacaaggtactattgtagctagccagggaacgaagcaaaaagtggaacttaaggtggagaaaatcattgtggttggagagtgtgactcttcctatccgatccagaagaaaagggtcagccgggaattcttgagaaccaaggctcatttacgtcctagaaccaacacttttggggcggtggcaagagttaggaatactctggcatatgctacacacaagttctttcaagaaagtggatttgtctgggtggcaagcccaattatcacagcttcggattgtgaaggagcaggagaacagttctgtgtcactacacttattcctagctcccatgagaacaccgatacttccattgatgcgattccgaaaacaaagggagggttgatcgattggtctcaggacttttttgggaaaccagcattcttaaccgtctctgggcaacttaatggagaaacttatgcaaccgctctctcagatgtatacacatttggtcctacatttcgagctgagaattccaacacgtcaaggcacttagccgaattctggatgattgaaccagaacttgcttttgccgacctggatgatgacatggcctgtgccactgcctacctccagtacgtagtaaagtacgttcttgataattgcaaggaagacatggagtttttcgatacatggattgagaaaggaatcattcgccgcttgagtgacgtagctgagaaagagtttctacagctggggtacacagacgccattgaaattcttctgaaagcaaacaaaaaattcgattttccggtgaagtgggggctggatctgcagagtgagcatgaaaggtacataacagaagaggcttttgggggtcgacctgtgataataagagactatccgaaggagatcaaagcattctatatgcgggagaacgatgatgggaagacagtggcagcaatggatatgcttgtgcctcggataggagagctgataggtggaagccaaagagaggaaaggcttgaggtgttggaagcgaggcttgatgagttgaaactcaacaaagagagctactggtggtacctcgacctccgccgctatggttcagttcctcatgcaggatttggactagggtttgagagactggtccaatttgtcaccggaattgataatatcagagacgttattcctttcccgcgcacacctgcctctgctgaattctga

SEQ ID NO: 451 - DNA, 1275 bp, Arabidopsis thaliana
tatgtcctttgaatttcaaaagaaaaaaaggggaagctggtggagcttgtactggtgttttggatccaagaagaacaataaaaggataggccacgcggtgcttgtacccgaaccagctgcatcaggagctgcggtggctccagtccaaaactcttcgagcaattctacttcaatattcatgccctttatagctcctccttcatctcctgcttcctttctgccatcaggtcctccctctgcgtcacatactcctgatcctggtctactttgttccctaaccgtcaatgaaccgccttcagcctttactattggaccatacgctcatgagactcaacctgttactcctccagtgttctctgctttcacaacggaaccctccaccgcgccattcacgccacctcctgaatcaccttcttcccctgaagtgccttttgctcagttacttacatcttcattggaaagggctaggaggaacagtggtggtggaatgaatcagaagttttcagctgcacactacgagtttaagtcttgtcaagtgtatcctggaagtccaggtggtaatctaatctctcctggttcaggtacatcttctccttacccagggaaatgctccatcatcgagtttcgtatcggcgaacctccaaagtttcttggttttgagcacttcacagcgcgtaaatggggatcaagattcggttctggatccatcacacctgctggacaaggttcaaggttgggttcaggtgctttgactcctgatggctcaaagctaacttctggtgtagtgacaccaaatggtgcagagactgttataagaatgagttatgggaatctcacaccacttgaaggcagtcttttggatagtcagatctctgaggttgcgtctttagccaattcggaccacgggtcgtcaaggcataatgatgaagctctcgtggttcctcacagagtttctttcgagttgactggtgaagacgttgcacggtgtcttgcaagcaagctaaaccgttccggttcacatgaaaaagcaagcggcgaacatttaagaccaaactgttgtaaaacgtcgggagaaacagagagcgaacagagtcagaagctaagatcgttttctacaggctctaacaaagaattcaagtttgatagcaccaatgaagagatgatagagaaaattcgatcggagtggtgggcgaatgagaaggtcgccggaaaaggtgatcacagtccaagaaacagttggactttctttccagtcttacgctctggacatactta

SEQ ID NO: 452 - DNA, 1425 bp, Arabidopsis thaliana
atgtcggcgacgcttacaggatcgggaactgctttggggttttcgtgttcctcgaagatctcgaaaagagtttcttcttcaccagcttctaaccgatgctgcatcaagatgtctgtttccgtcgacgagaagaagaaaagtttcagtcttcagaaatctgaggaagctttcaatgctgctaagaatctaatgcctggaggtgtgaattcccctgttcgagcattcaaatccgttggtggacaacctgttttgattgattctgttaaaggctcaaaaatgtgggacattgatggaaatgagtatattgactacgttggctcttggggacctgctattattggccatgctgatgacgaggttcttgcggctctagctgagacgatgaagaaaggaacaagctttggtgctccttgtctcttggagaatgttttagctgagatggttatatcagctgttcccagcattgaaatggttcggtttgttaattctggtactgaagcgtgtatgggtgtgcttcgtcttgccagagctttcactaacaaagagaagttcattaagtttgaagggtgttatcacggtcatgctaacgccttccttgttaaagctggtagtggtgttgccactttggggctaccggactctccaggtgtccctaaagcagctacttcagatactttaacagctccgtacaatgatcttgaagctgttgagaagctctttgctgcgcataaaggggagatttctgcggtaattctcgaacctgttgttggtaactccggattcatccctcctactccggaattcatcaacggtttacgccagcttactaaagacaatggtgttcttctcatcttcgatgaagtcatgactggatttcgtctagcctatggtggagcccaagaatactttggaatcacgcctgatctaactactcttggtaaaattattggtgggggtcttcccgtgggagcatacggtggtagacgtgatattatggagatggttgctcccgctggaccaatgtaccaagccgggactctaagtggtaatccgctggcaatgactgcagggattcacacgctgaagcggctaaagcaggcaggaacatatgagtatttagacaagatcacgaaggaactaaccaacggaatcttagaagccggaaagaaaaccgggcatccaatgtgcgggggttacataagcggtatgtttggattctttttcgcagaaggaccggtttacaactttgcagactcaaagaagagcgacacagagaagtttggtaggtttttcaggggaatgttggaagaaggtgtttactttgcaccgtctcagtttgaggccgggtttacgagcttggctcacactcccgaggatatacagttaacaattgctgcggctgagagggtactgagtaggatctag

SEQ ID NO: 453 - DNA, 888 bp, Arabidopsis thaliana
atggcgcttgagcaagtaatgtctgatcgggatagcgaggatgaagtcgatgacgatgttgcagattttgaagatcgccaggtattccatgatttctttctgcgttcattaagtaggcaacagaaaatggtatacgatatgcttgatgactttgtggatgtgaataaagatgaaaagcaattcatgcatctttggaactcgtttgtaagaaaacaaagaaacaaacacatcttattaccaatctttgctttcatagcgatccctctcgcagccttacacctctccttaactcttacctcctttcgccttaaaaaccatgtctttcgtttagaagccttagctaacgttgtgcatacacggtttgaagctagacagatttggcaagagtctagagaagatgctgtctcgcttttacatctcaaattccggtatttcgtcccatcctttatcctctcctgtatggcctccataactgtcatcacatcaacttccttctcacaccaaggcataaacccatctctgaagtcgtcatttgcttcagtcaagtcttcgtggatgcgagtaacagcaacttccatcatcgtctacgctctcgttggttatacacctacattgcgttatctaatcacgatcctctttctcggagttgaggtatacataatggctataacagggcttgggtttgtcgtctctgtattggaagaaagatacggttttgatgcgattaaggaaggaaccgctctgatgaaagggaggaggataacagggttggccttggcggttggcgaaggagctagatatggacttgagctcagggtcgtggtggaggtcggtggttgtggccggtgggtgggacgggtggaagctggtttgtatgtatggggctga

SEQ ID NO: 454 - DNA, 1224 bp, Arabidopsis thaliana
atggtggtgatgatgaaggcaactcgagggacgagagatccagatctacttgggctaatgttcgtacatcatcaattcctcttctgcgttatcagttttttttatttattgttgagagattttgaatttctgttgaacgattcttcttctggaatctggacatggtcgcaggtggtttccgaaacccaggctcttccttacctgcaaaaagcctttaatattcagcattttgatttccccacgcaggaggaccaggaagagaatacatatgcggctaaagtgagcgagaaacaagacttctcgaaggagcaatggcaagattacaaacgcccagcaagtgaacaacactactcagacgaagttgaaacttatggaaacctagaaccctcacaactagagctctcaggtctctcagaagcttgcaacaaactgtgggagctcgatttaaaccgccttgttcctggaaggattatcaaatcgactgcggagatgggaaaagggtccatgagagagctgatatggctgaaggactactgttctcttggattctgttcattgcttgacaactacaaccccaacgaaggttacaaagaagtggtcacagaagaagagaggcaagagcaagcggctttcattgaagaaattagcagaacctctgtgatcaagtaccttcacaggtaccttgtgctcaaggacgtcgctcctggaagctacttagagttcaagagaatgttgacaagtctctggttcgatctgtatggccgcggaggtacatctggctcatcttctgcgtttgagcatgtctttgtaggtgagatcaaacaatctggtgggaacaagtctctggattccataactggcttcagtacttcaaaaccggtgactgaccgagaaaccacacttttgcttcgtatgcagcctgattcagagactcagctgctaacaatccaattcgagtggaacggtgttctaaaatcagtctcaagtactctagttggagtaagtccagagttcgagttggctctatacaccatgtgtttcttcatgggcacagaagataaccacattcagttgggtccatacaatgtcaatgtcaaatgttaccgacttggcaacaaccgtatcgcgctcagctttccccattgcagaatcttgaaacctctcttgatggctctggtcacaaaatatctgccccttgcgcagtactgtattgaattattgtga

SEQ ID NO: 455 - DNA, 420 bp, Arabidopsis thaliana
atgagctcctcaattatgaaaacccttcaaattcgtaaaccaacttctctccctatctcttccaccaccacagatgagccagggcttctccgtcgtcgtctctcttctctttctctaaatctctcacgtaaccaaccttccaccgtctcaagatccaagtctgtctctgacatgggagagcaaggagggagctccgtgaaagaatggtgggaatggagttggtcatggattcttttaaagaagttaccaatctttttcacagatcttgaggttaacaagaacgaaaccaaatcatcattggggaatcaacaaagaggtagcttcattcacgtcttttttaagctccgatctgaaatccgccgtctcctccgtccttcctcagactctcttcctctctcttgcaaacatggacagcgatga

SEQ ID NO: 456 - DNA, 525 bp, Arabidopsis thaliana
atggaaggatgggatccgaacacgaagtcgacgttaacgcgaataccgcttctgacgacaaaggcgggtccaagagacggcgcggcatggacgcagaggctgaaagaggagtacaagtctctgattgcgtatacccaaatgaacaagtccaacgacaatgactggttccgtatctccgcttccaatcctgagggcacgcgttggactggcaagtgttggtatgttcacaaccttctcaaatacgaattcgatctccagttcgatatcccgattacctatccagccactgctcctgagcttgagctgcctgagattgacggcaagactcaaaagatgtatcgaggtgggaagatatgtttgactgtgcatttcaagcctctatgggccaaaaactgtcctcggtttggtatagcacatgcactttgtttggggctcgctccgtggttagctgcagagattccaattcttgtggactccggcgcgattaagcacaaagatgacgcagccacatctgcggaatcttaa

SEQ ID NO: 457 - DNA, 2331 bp, Arabidopsis thaliana
atgaagttcgggaaagagttctcgtcgcaaatggtgccggaatggcatgaagcttacatggattatgattatctcaaatctcaacttaaagaaatcatcaaattcaaacgcaaaaccaatcctcacggtcctcatcatcatcatcatcacttacttcacaggaaaatgactcttcaccgagcattcagcggtttaatctccacatcaccgaaaaaaaagaaacaccacggacacggcggcggacacggtggtggtcatcagatcggacatttctcagattccgatgatgacatcgaggagggaattaagcatgtcactgcgccgattctaataaactcggcgagtcatggttacgagacgacgtttttgatggcgtcggaggaaggaggagagtacgagacggtgtttttccggcgactagacgatgagttcaataaagttgagaagttttataaagagaaagttgaagaagttatgaaagaagctgtgatgcttgagaagcaaatggatgctttaattgcgtttagggttaaagttgaacatcctgatggttggccttgggaggaacgtacggtggagatgactcaattagcttctgatgttgctaattctgcggcggccgtcgctgcttctactcccgccggtgctagatctatgaaagttggagctcaagctcacatggaagcgatacaagaaggaggatcaagcaaagctggtaaatcctctgacgaagaagatgatgatgatgcagagaaagaagaagataacggtgtttccggcgaagtgtccggtgacgtgaggaagatgaaagctgggagaccacctccgattgaggttttggatcgtgtcaagtttaaccatacgaaggaaacgccacgatccaccattaaaagtgttctccaggcctcgaatttgacggagcttaaatttagcagagagaatctgaggaaagtggaggcgaaactcagacgcgccttcgttgagttttaccagaagcttcggttactcaaaagctacagctctgatgaggttactagactcgttgagcgtgttgaagctacgtttattaagcatttctccaatgctaacagatcaaaaggaatgaacatcttgagacccaaagctaaacgagagagacatcgaattacattctccacagtagtggctctattcgcaatcatacgaacacgaaacattttgcaggaggaaggccagaaacagtacatgaacactatgttccctctttacagtttgttcgggttcgtcgttctgcacatacttatgtatgctggtaacatatactactggaggcggtatcgagtgaattactctttcatatttgggttcaagcacggtactgaacttggttatagacaagttctatttgtgggattaagcattggagtctttgcacttctttgtattcttgccaatcttgacatggaggttgaccccgaaactaaagattatcaagcattaaccgaacttcttcctcttttcctgctcactggtatgtttgtagttctagtcttaccattcaacatcttctaccggtcgagtcgcttcttcttcctcacttgcctctttcactgccttgctgctcctctatacaaggtaacattacctgatttcttggtgggcgatcagttaacaagtcaggtgcaagctcttcgaagtatccagttttatatatgtcattacggttggggagattacaaacatcgaataaacacttgcacagagtcagatgcctacaatgctttcttattcattgttgctgtcatcccatacgtctctcgtctccttcagtgcttgaggcgactgtttgaagagaaaaacccagaacaaggatacaatggcctcaagtacttcttgactatagtggctgtctgcttgaggacgacttacagtgtcgacgaggataatcaatttatatggagaatattagctgggatcttctcagctattgctgccattttctgtacttactgggacttagtctatgactggggtcttctaaacagaacatctaagaacccttggctccgtgataaactccttgtcccgcagaagaaagtatacttcatcgcgatgatcttgaacatcttgctcaggttcgcgtggctgcagaccgtgcttgatttcaatttctccttcatgcacagacagacgatggttgctgttgttgtcagtctagagattatccgccgtgggatatggaatttcttcaggttagagaatgagcatttgaacaatgttgggaagtatcgagcatttaagacggttccattaccgtttaactacgacgaggatgacgataaaggcaactag

SEQ ID NO: 458 - DNA, 2604 bp, Arabidopsis thaliana
atgaatccattctcttccggcacgcgtctcagcgacatgattcgagctatacgtgcgagtaaaaccgctgctgaggaacgtgctgttgtgaggaaagaatgtgctgcgatccgtgcttcgattaatgaaaatgaccaggactatagacatcgggatctagcgaagcttatgttcattcatatgcttggttaccctactcattttgggcaaatggaatgcttgaagttaattgcttctcctggatttcctgagaagaggattggttatcttggattaatgttgcttcttgatgaaaggcaagaagtattaatgcttgtcaccaactcgctgaagcaagatctgaatcacacgaaccagtacattgtggggcttgctctctgtgctttaggaaatatttgttcagcagaaatggctcgtgatctcgcccctgaagttgaacgattacttcagtttcgtgatccaaatatacgcaagaaagcagctctttgcgcgataaggatcatcagaaaagttccggatctttctgagaactttattaatcctggtgctgctttactcaaagaaaagcatcatggtgttctcattacgggagttcacctttgcacagaaatctgtaaagtcagttccgaagcccttgaatatttccggaagaaatgcacagagggcttggttaaaaccctgagagatattgcaaacagtccatattcacctgagtatgacgtcgctggaattacggatccattccttcacatcagattgctcaaactgttgcgtgttttgggccaaggggatgcagatgccagtgactgtatgaatgatatacttgctcaggtggcatcaaaaaccgagtcaaacaaaaatgcagggaatgctatcctatacgaatgcgttcaaacgataatgagcatcgaagaaaatggtggcctacgagtccttgcaatcaatatcttaggaaaattcttgtccaaccgagataataacatcagatacgtagcattaaacatgctgatgagatccttaactgttgattcccaagcggttcaaagacacagagctacaatcctggagtgtgttaaggattcagatgcttcaattcagaaaagggcacttgagcttatttaccttctagtgaatgagaataacgtgaagccactagcaaaggagcttatagaatatttggaagtaagcgaacaagattttaaaggagatcttactgcaaagatatgctccatagttgaaaagtttgctccagagaaaatctggtacattgatcaaatgctaaaggttctatctgaggctggaacttatgtgaaagaggatgtatggcacgcgctgattgttgtaataacaaatgcccctgatctccatgggtacactgtcagggctttgtatagagcattacatacatcttttgaacaggtagacatttctttggaaactcttgtgcgcgttgcaatatggtgcataggagaatatgctgatctgttggttaacaatgctggaatgcttgacttagaagatccaataacggtaacagaatcagatgcagtggatgttgtcgagaatgctattaagcatcatttatcagatgtcacaactaaggcaatggcactcattgctctgttaaagatctcatctcgtttcccatcctgttcagagagagttaaaagtattataggacagaacaaaggtagctttgtcttagaacttcaacaaagatccctggagttcagttcagttattcaaaagcatcagaatataagatcttctctggttgaaagaatgccggtccttgatgaggcaacatttagtggaaggagagctggttctttaccagcatctgtgtcaacttctggaaaatctccgcttggtattccaaacggtgttgctaaagcagcagctcctcttgttgatttactcgatctgggctctgatgatactcctgcgcctacctcctccagtaacaactttcttcaagatcttcttggtgttgatttatcgcagccttcagcacaacctggtgccatgcagccatcgcaagctggtgcggatattcttatggatctgttgtcaatcggaactcctgcccctgtgcaaaatggctcggcgaatggagacttattatctattcaagataacaatgctccaatagcgccttctttgacttctcccactgcgccttcttcgatgatggatttattggatggatttggtcccaccccaccaaagagcgaggacaagagtgcagcatatccgtccattgttgcatttgaaagcagctccttgaagattgagttcaacttcacaaagcaatcagaaaatcctcaaacgacagacattgtggccaatttcataaatcttactcctaacgtgtacacagaatttcttttccaggctgcagttccaaagtttctacaacttcacctggatcccgctagcagcaattctcttccagctaacggaaacatcaaacaaactatgagagttacaaatagccaaaaggggaagaaacccattgtgatgcggatgagggtaggttacaagattaatggcaaagatgtgttggaggaaggacaaatcaacaatttcccacgtgggttatga

SEQ ID NO: 459 - DNA, 1362 bp, Arabidopsis thaliana
atgggtggtttgaagtttcatgtacttatgtatccatggttcgcaacaggccatatgaccccgttcctttttcttgccaacaaattggctgagaaaggtcatacggtcactttcttgcttcccaagaaatctctgaaacagttggaacatttcaatctgtttccacacaacattgtctttcgctctgtcaccgtccctcatgtggatggtctccccgttggcacagagacagcctctgagatccctgtgacatcaactgatctcttgatgtctgctatggatctcacacgtgatcaagttgaagctgtggtccgagccgttgaaccggacctgatcttctttgactttgctcattggattccagaagtagctagggacttcggccttaagactgtaaagtacgtcgtggtgtctgcatcgactatagctagtatgcttgtcccaggtggtgagttaggtgttcctccaccgggatatccatcatcaaaggtgctgcttcgtaaacaagatgcttacactatgaagaaactggagcctacaaatacaatcgatgtcggaccaaacctcttggaacgagtcactacaagtcttatgaactctgatgtcattgcgataaggacagccagagaaatcgaaggaaacttttgcgactatatagaaaaacattgcaggaaaaaggttctcttgacaggtccggtgttccctgagccagacaagactagagagctagaggaacgatgggttaagtggctaagtgggtatgaaccagactcagtggtgttttgtgcactgggctcacaagtcattttagagaaagatcaattccaagaactctgcttaggaatggagctaacaggttcaccgtttcttgtagcggttaagccccctagaggctcatcaacgattcaagaagcacttcctgaaggattcgaagagcgggttaaaggaagaggccttgtttggggaggatgggttcaacaaccattgatattgtctcatccatcagtcgggtgctttgtgagccattgtgggtttggatcaatgtgggagtctttgctgagtgattgtcagatagtcttagtaccacagttgggtgatcaagtcctgaacacaagattgctgagtgacgaactcaaggtttcggttgaagtggcaagagaggaaacaggatggttctcgaaagagagcttgtgcgatgctgtcaatagtgtgatgaaaagggacagcgagctcgggaacctggtgaggaagaatcacaccaagtggagggagacagtagctagtcctggactaatgactggttatgtcgatgctttcgtagagtcattgcaggatcttgtctctgggaccacccatgactga

SEQ ID NO: 460 - DNA, 522 bp, Arabidopsis thaliana
atgcagactaccattttggttttatggcctggttcacattttgatatatttgcatttgcctgttgcgtgaagtctggacctactgaaaccaaagctgctctagagttctctgtgaatactcttaatgtggaaaacatcttagtcattggtcatagccggtgtggaggaattcaagctttaatgaaaatggaagacgaaggagattccagaagtttcatacacaactgggtagttgtgggaaagaaggcaaaggaaagcacaaaagctgttgcttcaaacctccattttgatcatcagtgccaacattgtgaaaaggcatcgataaatcattcattagaaaggctgcttgggtacccgtggatagaagagaaagtgcggcaaggttcactgtctctccatggtggatactataattttgttgattgtacgttcgagaaatggacagtggattatgcagcaagcagaggtaagaagaaggaaggcagtggaatcgctgttaaagaccggtcagtttggtcttga

SEQ ID NO: 461 - DNA, 363 bp, Arabidopsis thaliana
atggcgattagctccttcaagcatgaacatcctcttgaaaagagacaagctgaagcagcacgtatcagggagaagtatccagacagaataccagtcattgtcgaaagagccgagaagagtgatgtcccggatattgataggaaaaagtacttggtcccagctgatttgactgttggccagtttgtttatgttgtacggaagcggatcaagctcagtcccgagaaagccatcttcatttttgtcaagaacattctaccaccaactgcggcaataatgtctgcaatttatgaagagcacaaagacgaagacgggtttctatacatgagttacagtggtgagaacacgttcgggatcttcttctaa

SEQ ID NO: 462 - DNA, 1395 bp, Arabidopsis thaliana
atggctgctcgtatcgggatcttctccgtcttcgtagctgtattgttatctatttctgcattttcctcagctcaggatctccagatcgtaaatgccgagcgaaggattgatttaagctcacatatcgtgaaggccttcttgactctcaaggttgaaaatattgggaaagatcctgctgcagaaatgcttcttgctttcccacctacccagatcaagaatttggctatggtacaagccctggcaactactggcaagaagaagaagaaaacttatttgccattagatgtaaaaccaactgaacaacctgatgcaccaaatgacactggatactaccgtgttacgtttattagccccttaggtccgggtgaaactgtttcacttgaggtgctttacatattgactcattccttggaacctttcccagtggagataacccagtcagaatctcaattggtttactatcatgatagtgcagtgatattgtcaccgtatcatgttaagcaacagacaacttttattaagactcctagtactagagtagagtcgttcactagcattgaacctgctaaccgggctggcaaagagatcaaatatggaccatatgaaaatcgtgcttcatactcttacacacctgtcatcattcacttcgagaataacagtccatttgctgttgttgaggagcttgtgcgtgaaattgagatttcacactggggtagccttcagattacagaaaattataggttgactcatgggggagcgaggcataagggtgttttctcaagggttgattatcaatctaaacgatcggtcagtggtgcatcctctttcaatgcgctccttgcagtcctacctcccagagtgaactctgtctactacagggatgagataggaaacatctctacttcacatttgcgtacaggctttagaaagtcagaacttgaatttgaaccccgctacccattatttggagggtggagtgcaacttttatcatcggctatagagttccattggaagactatctctttgaagcatctgatggcagacgttacttgaactttacctttgggtgcccgctcgtcgaaactattgttaacaagttgactatcaaagtcgtgcttcctgaaggatcaaaggacccttctgctgttttgccctttacagtcaatcaagagttgcaggtcaaatactcataccttgacattgtgggaagaaccgtggttgtgttgcaaaaagataacgtagttcccactcacaacgtacccttccaggtgtactatacattcaaaccaatatacatgctagcggaaccattcatgcttgtatcggctttcttcttagtatttgtggcttcgcttgcgtatgtacacatcgatctcaatatcgtcaggaagtag

SEQ ID NO: 463 - DNA, 984 bp, Arabidopsis thaliana
atggagacagatagtatggagtgcgtctcatctacgggtaatgagatccatcagaatggtaatggccaccaatcttaccaattctcttcgacgaagactcacggcggagccgctgctgccgccgtcgttaccaatattgttggcccaacagcaactgctccggccactagcgtgtatgagcttctggagtgccctgtctgtacctattctatgtatcctcctatccatcagtgtcataatggacatacattgtgctcgacctgtaaagtgagggttcataacaggtgtcccacatgtagacaagaacttggagatattagatgtttagctcttgagaaagtagccgagtcgcttgagctgccttgcaagttttacaatctgggatgtcctgagatctttccttactacagcaaactgaagcacgagtctctctgtaacttcagaccttacagttgtccttatgctggttcggagtgtggtatcgtaggggacatcccttttcttgtagcccatctcagggatgatcataaagttgacatgcacgctggttccacttttaaccaccgctatgtcaaatccaatccgcgtgaagtagagaacgctacttggatgctaaccgtattccattgctttgggcagtacttctgcctccatttcgaagcgttccagcttgggatgggtccagtatacatggcattcctgagattcatgggggacgaggaagatgcacggagctacagctacagcttagaagtgggaggcagtgggaggaagctaacatgggaaggaaccccaagaagcatcagagatagccacaggaaagtaagagacagcaacgacggtctcatcatccaaagaaacatggctctctttttctccggtggagacaggaaagagcttaaacttagagtcactggtaaaatctggaaagagcaacacagtccagattctggactttccataccaaacctatcttcttcctga

SEQ ID NO: 464 - DNA, 3003 bp, Arabidopsis thaliana
atggagattgcaatttcgtataaaccgaatccgcttatctcttcatcgactcagttgttgaaaagatcaaaaagttttggtcttgttcggtttcccgccaagtatggactgggagctacccggaaaaaacagctctttcgagtctatgcgtctgaaagtagtagtgggtcttcatctaatagcgatggaggcttttcgtgggtgagattggctcagtctattcgccttggtgccgagcggattggggagaagattggagaatctgtgaagacagaaattgggtttgactcggaagaagcaagtgggagagtgaatgagtatgtggctcgagttaaggatagtgtgcacaagggccatcacgagctgactcgctttaagaatgagacagtgccttcgtttattgattggaacaagtgggagcattggaaggacatcaggaattgggacggtaaacgagttgctgccttgttcatatatgcttttgcgctgttactttcttgtcaaagagtttatgttgccatccaagctcctcgggtagaacgagagagaagagagttaacagagtcttttatggaggctttgatccccgagccatctcctggaaatatagaaaagttcaagagaaatatgtggaggaaagcaacacctaaaggcttgaaattaaaaaggttcattgaagcgcctgatggaacacttgtccacgatagttcttatgttggagaaaatgcgtgggatgacgatctagagaccacagagggatctctcaagaaaataattggtagaaatgctaggattcagacagaggcaaagaagaaactaagccaagatctgggtgtctctggtgaaattggagacagtgtaggtaattggcgggaaaggcttgcaacctggaaggaaatgttagaacgagaaaaattatcagaacagttaaactcctcagcggcgaagtatgtggttgaatttgatatgaaagaggtagagaaaagtcttcgcgaagatgttattggaaggacatctgaaactgagggaactagagctctctggatatcaaagagatggtggcgatatcgccctaagcttccctatacctacttccttcagaagcttgattcttctgaggttgcagctgttgttttcacggaagacctaaagagattgtatgtgaccatgaaagaaggtttccctctagaatatattgttgacattcccttagatccttacttgtttgagactatttgcaacgccggagttgaggtggatcttcttcagaagaggcagatccactacttcatgaaagttttcattgcacttctgccggggatactaattttatggtttataagagaatctgccatgcttctccttatcacatccaagcgctttctctacaagaagtataatcagctgtttgatatggcttatgcagaaaattttatattgccggttggagatgtcagtgagacaaaatcaatgtataaggaagtggtactaggcggtgatgtctgggatcttcttgatgagctaatgatctacatggggaacccaatgcaatactatgaaaaagatgtggcttttgtcaggggtgtgcttctttctggacctcctggaactggaaaaacactttttgcgcgaacacttgcaaaggaaagtgggctaccatttgtgtttgcatctggtgcggagttcacagacagtgaaaaaagtggtgctgcaaagatcaatgagatgttttcaatcgcgagacgaaatgcccctgcttttgtgtttgtggatgaaatagatgctattgctggtagacatgctagaaaagatccacggagaagagcaacttttgaagctttaattgcgcaactcgatggggagttttctttgagacaagctgtgatatttatctgtgctaccaatagacctgatgaactcgaccttgagtttgtccgttctggccgtattgaccgtcggctgtatattgggttgcctgatgcaaagcaaagggtgcaaatatttggagttcacagtgctgggaagaaccttgcagaagatatagactttgggaagcttgtttttcgaacggttggcttttccggggcagatatccggaatcttgttaacgaagcggctataatgtcggtaaggaagggacgttcttacatatatcaacaagacattgttgatgtgttagataaacaattgctcgagggtatgggtgtacttcttacagaggaagagcaacagaaatgtgaacaaagtgtatcttacgaaaagaagagacttctggctgttcatgaggctggtcatatagtgttggctcatttgtttcctcgatttgactggcatgcattttcgcagctccttcctggtggcaaggaaactgctgtatcggttttctatccacgtgaagacatggtagaccaagggtataccacgtttggttatatgaaaatgcaaatggtggtagctcatggtggacgctgtgctgaacgtgtggtttttggcgataatgtcactgatggaggaaaagatgacctggagaagataacaaaaattgccagggagatggtgattagccctcaaagtgcgagattaggtctcactcaacttgtaaaaaagattggaatggtggatttaccagataacccagacggcgagctgataaaataccggtgggaccatcctcatgtaatgccagcagagatgtcggtagaagtatccgagctattcacccgtgagttgacaaggtatatcgaggagactgaagaacttgcgatgaatgctctgagagcaaacaggcacattctggacttaatcaccagagagttattagaaaaatcaaggattactggattggaagtggaagagaaaatgaaggatctttctccgttaatgtttgaggattttgtgaagccattccagataaaccctgatgatgaggagcttttacctcacaaggatcgagtgagctatcagccagttgatttacgtgctgcgccactccacagaagctag

SEQ ID NO: 465 - DNA, 1947 bp, Arabidopsis thaliana
atggcaattccattggttccttatacatttgtgaagctaagccgcgctttttctaagaaacaacggagtatacattgtcaatgtcttgagtgtgatcgttcagggaagtacaagagatccatttctcaaagtatctctagcttcacttcttgtagcaacttgacagttgtcctactttggattgtaatgatcttcttgatttatcatactaagaacatgagccgtgagagtcaactctttgagccattcggtatactcggtttggaacctggtgcttcagattcagaaatcaagaaagcatatagaagactctctattcaataccatcctgataaaaatcctgatccaggtcgaaatgcttcctggtcctcttccttgataatctattgcttatttgtgtattgtaatggtacagaggccaataaatattttgtggagtccatagctaaagcttaccaagctttgactgatccgttatcccgcgaaaactttgagaagtacggtcatccggatggtagacagggttatacaatgggaattgctcttcctcaatttattttaaacatgaatggagaatctgtgatcgcttcaatctatctctggagatcatcaaagtatactgggaatcacgttaagcttcaaactcgtcaagcatatttcgagttattgcaaccctctttaactccaagcaaagttatggatattttcatcagagcagctgaatacgcagagatttcagttcgtaaatccgatgatgaatctctgcagaaactctttatgtctgtcaaaagcgagctaaatttggatcctaagaagttgaagcaagaggaagctaagttttggaaaaagcatcctgcaactatcaagactgagcttttgatacagaaacagttaactcgtgaatcatcagtcctgtctccgactctgcaacgtgatttcaggcatgtgctagagtttgcacctcgcctgcttgaagatttgattaagatggccgttataccccgcaatgaacaagggcgtggatggttacgtcctgcacttggagtaatggagctatctcaatgcattgttcaggctgttcctcttagtgcaaggaagtcatcttcagaagacattgctcctttcttgcaactccctcatttcaatgaatctatcgctaaatcgatagcgttgcaggttaaatcattccaaaagtttcaagaactgagcttggcagaacgttctaaactgctcagagaggttgtgagtttgtcagaaaccgatgttcaagacatcgagaaagtgttagaaatgataccttctcttaaaatcaacgtcacttgcaaaacagaaggcgaagaaggcattcaagaaggcgatattatgacagttcaagcttggatcactctgaaacgtcccaatggactcataggcgctattcctcactcaccttactttcctttccacaaagaggaaaacttttgggttcttcttgcggattcaaaccatgtctggttctttcagaaggttaaattcatggatgaagctggagctatagccgctgcatcaaacactattactgaaacaatggaacctttaggagcaagcgtcaaggaaacaaatgatgcagttaaagaagctgttgagaaggttaaaagtgggtcaagattggtaatggggagactcttagcacctggagaaggtacttataacttgacttgcttctgcctaagcgatacttggatcggttgtgaccaaaagacatcactgaaagtcgaggttttgaaaagaacccgtgatgtggagggtgagaatgcagaagaaggattagaggaagaggatgatgagattgaagaggaggattacgaaagcgaatacagtgaggacgaggaagataagaagagagggtcaaagaagaaagtaaacaaggaatcgagttctgaagagtcaggatcagatgaagagtaa

SEQ ID NO: 466 - DNA, 282 bp, Arabidopsis thaliana
atgggattctctggcttagctccgattcttcacaagctgataatcttttgggaccaacctgaagcccttcacacgacatgttatgagattttgatgggtttgctttatgggttaggagctctggtttatgcaactaggatcccagagagatggatgccgggtaaattcgatatagcaggacatagccatcagttgtttcatgttctggtagttgctggtgcgttcacgcactatagagctgggctagtgtatcttaagtggagagatattgaaggatgttga

SEQ ID NO: 467 - DNA, 1227 bp, Arabidopsis thaliana
atggcgagagtcgcctttgccacatcatcgccgccgttaatctcatcagttcgtactctccgccgtcatttctcagttttcgccgccgcgaatccagaaatgtctcgtccctctcaccacagctctctcgaagttatcggcggaggaagtgatcgtttcttaccgtcgttaaaggactcactcgctaaaccgtacaatgcgtttcctctaatcggatttaaccgccacgtggagacaatctacgcatctttctttcgttctgttcctttcgttagactccgccgtgaatgtctccgaactaaagacaacggctctgttgctttggattgggtcgccggcgaagataggcactttcctcctgattcaccaatcctcattttgttgccaggtttaacaggaggaagtcaagattcgtatgttagacatatgttgttaagagctcaaagtaaaaaatggcgttgtgttgtgtttaatagccgtggttgtggagatagtcctgtgaccactcctcagttctactcggcttcgtttttaggagacattggtgaagtgattgatcatgttgttgataaattcccaaaagccaatttgtatgctgctggatggtctcttggaggcaacattcttgttaactatttgggtcaggaatctcataactgtcctctcactgctgctgtttctttgtgcaatccttttgatttggttatagcagatgaagatttccataagggttttaacaatgtttatgacaaggccttgtcgaaatctcttcgtagaatatttagcaaacattctcttctttttgaagacataggaggtgaatttaacattcctttggctgcaaatgctgagacggttagggatttcgatgatggcttaacccgagtctcgttcggtttcaaatcagtagatgagtactattccaagtcgagcagctccaaagctataaaacatgtccgcatacccttgctttgcattcaggcagcaaatgatcccattgctcctgagagaggtatccctcgcgatgacatcaaggcaaacccaaactgcgtgttgattgtgacaccaagaggagggcacttgggatgggtggcaggtgaagaagctcccaacggagctccttggaccgaccaagtggttatggagtttctgcaacatgtagagaatcgtgaaaccattaacggggagagatctttcgaggatgtccatgatcagattcaagtctaa

SEQ ID NO: 468 - DNA, 513 bp, Arabidopsis thaliana
atggcgacgttgccgaaactgattcaaagcatgagaaacgaagttacgaagcagcccagtcttgtcttaccatctctcagaagagctttctctctctacgatcagatcaatctcatcgataacgttcctgaggatcagctccgatttcaggagtattcatctctctcagtcatgtttgatgagacgagtttcactgtgaatggggttaaatacgaaggaagcttgctctgtgttgggaatttgctaatgtcatggagccctcgttacttctccgacatcacaacggatagcttgtcaatcttccagacggttcgaccaattccagagctcttgattgtcgggtgtggaagatacaaccacccactgaatccccaagtccgtcagttcgtaaagtcaatcggcatgaagctagaaactgttgattctagaaatgctgcatcaacttacaacatactcaatgaggaaggcaggatcgtggctgctgcattgcttccttatggagttacatcgtaa

SEQ ID NO: 469 - DNA, 627 bp, Arabidopsis thaliana
atggcggcgaacgattcttcaaatgctattgacatcgacgggaatctcgactccgattcgaatcttaacactgacggtgacgaagcgaccgataatgattcctcgaaggcattggttactatccctgctccagccgtttgtcttttccggttcgccggagatgctgctggtggcgccgttatgggctctatcttcggatatggattgttcaagaagaaaggcttcaaaggatcatttgcagatgcagggcagtctgctaagacttttgctgttttatctggagtccacagtttggttgtttgccttctgaagcaaatccgaggcaaagatgacgccattaatgttggagtagcagggtgttgcactggtcttgctcttagtttccctggtgctccacaggctcttctacagagttgtctcacgtttggggcattctcttttattcttgagggactcaacaaaagacaaacagctttggcacactcggtctcgttgagacaccaaaccggactgttccaagatcatcatcgtgctttaccactctctcttgctctcccgatccctgaagaaatcaaaggagccttttcttctttctgcaagtccttagctaaaccaaggaagttctaa

SEQ ID NO: 470 - DNA, 1515 bp, Arabidopsis thaliana
atgattcttcagaaaacgatgcaatcaccatttcttcatctctgtaaaagcttcacttcttcttctccactttcatgtcacaaccacaatatatgctttggatttcataatgctctgttatctccttcaatctgcaatttccagcgacgaaacaatgtcaacgggagaaaaatcgttgcgcagggatcaagactaaacgacggaaatagccgtccggcgggaaacaaagggaaagtaagtctgaaaggtaacaaagagaatatatggagcgttgacaacgaaatggcggagaaggataagcgtaaggtgaagccaaaaggaagaaaaagcgggaagagattaggtggaggaagaaagggtaaattcggtagagttttggtttcagggacgatgttgatcgaatccgagactgttcttcaaactcaggagcctgtgataaaaccagtttggagaacatttgcgagtagtgtaagtgggatttggaaaggtgtaggagctgtgttctcgccgattactggagagatggaaccgattgaaattgggaagaagaatgagagtctttatgattgttatactctttctaagattgaagcgttaccatctccttctagtggagctaatacagagtctgagatacagaggaagatcaattgggttactttaaatcctcatggagagtgttctgagagtaaagatgaggtttttgttgatcagagtggtgtagatagtcgtttgcctaagtttgagtcttttaacttgaaagcaagtgatgtcatggaagaggattccatgataaatgatgttgttatggtctttgatgtggctgatatgcaggatggatcgtattccagaggtccagttacaatccctgttggggagatgagtgaatccaactattacctcacaccgactttcaagtttgaacagtgtctggtgaagggttgccataagagactgagagtagttcacactatagaattcgccaatggtggtgcagatatacagataatgagagttggtgtttatgaagaactgtgggttagtccttcaaattatgaagagcaaagtgacaacgacgcaccattggagttaaaaccattctcacagaggaaacgcacgcaaccatcagaactaacaggatcatggaaagtatttgaagtaaatgcaactccactctacggagaagaagccgaattcgaacagccaggtgaaagcactccagttgtgtacctctgcacagaagctctaaagagaaggaacttaccggaaactttggtttcgtttggggaggaagagatgatagatatgcaagatgtgtctgtgatgtggctaccaggtggtgtgagtgcatacgtggatgtgaagaaagatggagtgttgtgcattggagttggatggtattcagatgaaggaatcaatcttgtgatggagagagattatggtttggatgggaatcttaaagaagttcgatccaaatccgaaatgaagagacgatggacagaagaacccaagtaa

SEQ ID NO: 471 - DNA, 1056 bp, Arabidopsis thaliana
atggatagcttgagagatgttaagcctatcaaactcatattttctattttctgtctagttattatactatccgcctgtaattcaacggcagagctaccgcggttcgtccaaccaccagaacccgatggttcactcagttttctcgttgtcggcgactggggaagaagaggttcttataatcagtcccaagtagctcttcagatgggaaaaatagggaaggacttaaatattgatttcctcatttcgactggagataacttttatgatgatggaataatcagtccatatgattctcaatttcaagattcgtttaccaatatttacacagcaactagcttacaaaaaccatggtacaatgtattaggaaatcatgattatagaggtaacgtctatgcgcaactcagccccatactcagggatttggactgccgttggatttgtttaagatcttatgttgttaacgccgagattgtcgatattttcttcgtggatacaacaccgttcgaccatgtatatgattggagaggcgtattaccgagaaataaataccttaacagtctcttaacggtaactttttttttcttactctaccataagctagtcatatcatcaaattcattgaaaattagaataattaaattggatgtggatgtggcattgcaagaatcaatggctaaatggaaaatagtggtaggccatcacacgatcaaaagtgcaggtcaccacggaaataccatagagcttgagaaacaacttttacctatcctcgaggctaatgaagtggatctctatataaacgggcatgatcattgcttggagcacataagcagcatcaacagtggaatacaatttatgacaagtggaggtggctccaaggcgtggaaaggagatgtgaatgattggaacccacaagagatgaggttttactatgatggacaaggattcatgtcggtttacacatccgaagctgaactacgcgtcgttttctatgatggtcttggtcacgttttgcatcgatggagcactcttaagaatggggtttattccgatatctaa

SEQ ID NO: 472 - DNA, 663 bp, Arabidopsis thaliana
atgaatctggagcagtacgacattgcgcaacaactaagagaaaagctaactgaggtggaagaggagtcgataaggctgcaggaagggaaaagagggtcatcagctaaaagtgaagctcaagacaagggtattagcattataaggctacgtgcagatctccagaatgccattgacagtgaggattacggtttggcagctaagttacgagatgaaatctcaaagcttgaggcagaatcattagctgtatctgcgaaagccttggcttttgagaaagcagagtatgcatttcgtttgggacagaaacttagacacaaaacttttggttaccgggctgtagtgtgtggtatggatccaatttgcagtgaatcaagctcttggatggaagctgcagaggttgaaaagttacctcgtggatccaatcagccattttatcaggttctagtcgatgttcggacgcacccagatctactagtggcatatgttgctgaagacaatctgttagctcctgaaaaacccgataaggaaaggtttgatcatccatacatttcttttctctactatggagctgacacagctggagatttcatccctgtcaaacaattgcgtgagaagtacaacagacctcggcatgaagttccttttgattcacaagacgaagattaa

SEQ ID NO: 473 - DNA, 2295 bp, Arabidopsis thaliana
atgcagtattgtttgacaagagtagtaaaccataagcagaagagtcttgtcgcattcccgagcattacaaggagaaagagacatcttttactgagtgttcaatcagtcttgcacaatacaagacccaacatcaacgacaatggctcagctgagtctgcaaatgttcttttcgataaattatttgctcggacacacagattggagagacaaaccaatcaacactcggtttatcctgacgatgatgatctcccctattcaaaccttggcgtgcttgagtctgaccttgaggctgcgctagtggccttgttgaaaagggaagaggacctgcacgatgctgagaggaagcttctctctgacaaaaataaacttaaccgggcaaaggaggagttagaaaaacgtgagaaaacaatctctgaagcttcgttgaagcatgagagtctacaagaggagctgaagcgggcaaatgtggagttagcttctcaagccagggagatagaagagttaaagcataagctaagggaaagagacgaggaacgtgctgctttgcaatcgtccttgactttgaaagaggaagagctagagaagatgcgtcaagagattgcaaacagaagcaaggaggtttctatggctatttctgaatttgaaagcaagtcacaactcttaagcaaagccaacgaagttgtcaagagacaagaaggtgaaatatatgcacttcagagagctcttgaggagaaggaagaagaattagagatttctaaggctacgaagaaacttgaacaagaaaagcttagagaaacagaagccaacttgaagaaacagacagaagagtggctgatagcccaggatgaagtgaataagcttaaagaggaaaccgtgaaacgtttaggagaagccaatgaaaccatggaggacttcatgaaagtgaaaaagcttctgactgatgtaagattcgagcttatttcttctcgggaagctttggtattttccagggagcaaatggaagaaaaagagctactattggaaaaacaattggaggaactcgaggaacagaggaaaagtgtgttgtcatatatgcaaagcttgagggatgcgcacactgaagttgaaagtgagagagtaaagctcagagttgttgaggctaaaaattttgcgcttgagcgggaaatatcggtccaaaaagaattgctggaggatttacgagaggagttgcagaaagagaaaccattgttggagctagctatgcatgatatatccgttattcaagatgagctttacaaaaaagctaatgcgtttcaggtatcacaaaatctacttcaggagaaagagtcaagtttggtggaggccaaactagagattcagcatctgaagtccgaacaggcttctctagaactattactgcaagaaaaggatgaagaactcgctgaagctcgaaataaattgggagaagtgaaccaggaggtaacagagctaaaggcacttatgatcagtagagaagatcagcttatggaggcaactgagatgctgaaggagaaagatgtccaccttcacagaatagaaggtgagttgggcagttccaagctgaaagtcactgaagctgaaatggtggtggaaagaattgcagaattgacgaacagactgcttatgtcaaccaccaacggtcaaaatcagaatgcaatgaggattaacaatgagataagcattgactcaatgcagcaaccactagagaaacctcatgatgattacggaatggagaacaaacggctggtgatggagttaagcttcaccagagaaaatctacggatgaaagaaatggaagttctagcggtgcagagggctttgacatttaaagacgaagagatcaacgtggtcatgggaagattagaagccaaggagcaggaactcaagaaattgaaagaagaaacgatcaatgacagtgaagatttgaaagtgctatatgccttggcacaagagagagtcggggaaaaaacaatgggtgatctggccatagagatgcttcagcttgaggcagctaaccttgaagttgaagctgcgaccagtgcattacagaagcttgcaaaaatgagcacggaactgttaactcaagctgacatgagcattgaggccgacacaactcacactgtaatgccagagagagggtattcagaaggaagtaatgagtgtcttggtgaggtaaaaacagaagttgtcaggctctggtccttgacagagaaactcctggagaacgcaggaatcgttgctggtacatctacatgcatggaaggtgtaattttataa

SEQ ID NO: 474 - DNA, 663 bp, Arabidopsis thaliana
atggcttcctcagcaccaccagtcctcccaatctccaatccccaaaccgttccatccgccgctccttcctccgtcgaatctcaaccaccgatcgctactccagctttccgcaatttcatcaatcagatcaccgaaaccgttaaaaacggtctctctaagcgtcgtccttgggctgagctcgcggatcgttccgcattatccaaacctgagtcgatctccgacgctgctgttcgtatccgcaagaattactcgtatttcaaggttaattacctcaccgtcgctacagcgatcgtcggattctctctcgtcactcatcctttctctctcgtcttcctcctctgtctcctcgcgtcgtggctcttcctctacttgttccgtcccacggatcagccgatcgttctattcggtcgtacattctccgatcgtgagacgttagggtgtttgattttgttcagtatctttgtgatcttcctcaccgatgttggatctgttctggtttcggctatgatgattggtgttgcgttgatctgtgctcatggtgcttttagagctccggaagatcttttccttgatgagcaagagcctgctgctaccggattcctctctttcctcggtggtgccgcctcttcagccgcgcctgctgttatcgccgctcgcgtgtaa

SEQ ID NO: 475 - DNA, 777 bp, Arabidopsis thaliana
atggcgatggcggtctccggagctgtcctcagtgggcttggttcttcgttcctcaccggaggcaagagaggtgccaccgcattggcaagcggcgtaggcactggagctcagagagttggcaggaaaactcttattgtcgctgctgcggctgctcagcctaagaaatcttggatccctgccgttaaaggtggtggcaacttccttgaccctgaatggctcgatggctcgctaccaggagatttcgggttcgacccattgggtttggggaaagacccggcttttctgaaatggtacagagaggctgagctgatccatggccgatgggcgatggcagcggttcttgggatcttcgtcggccaggcctggagcggtgtggcatggtttgaagctggagcccagccagacgcgatcgctcccttctcgttcgggtcgcttcttggaacccaattgcttctcatgggttgggtggagagcaaacgatgggtcgatttcttcaacccggattctcaatcggttgagtgggcaacgccatggtcgaagaccgccgagaatttcgcgaactataccggcgatcagggataccccggtgggagattcttcgatccgttgggtctcgccgggaaaaaccgcgacggtgtttatgagccggactttgagaagctggagaggctgaaattggcagagattaagcactcgaggctcgcaatggttgccatgttgatcttttactttgaggccgggcaggggaaaacgcctctcggtgctcttggtttgtga

SEQ ID NO: 476 - DNA, 2907 bp, Arabidopsis thaliana
atggcgggtcggaacatagagaagatggcatctattgatgctcagcttcggcaactcgttcctgctaaagtcagtgaagacgataagcttgttgagtacgatgctcttctccttgatcgctttctcgacattctccaggatttacacggcgaggatctccgtgaaacggttcaagagttatacgagctttctgctgagtatgaagggaagcgtgagcctagcaagcttgaggagctagggagtgtcctaacgagtttggatcctggtgactcaattgttatctccaaggctttctctcacatgcttaacttagccaatttggctgaggaggtgcagattgctcaccgtcgcaggatcaagaagctgaagaaaggtgatttcgttgatgagagttctgcaactactgaatccgatattgaagagacttttaagaggctcgtttcggatcttggtaagtctcctgaagagatctttgatgccttgaagaatcagactgtggatctggttttgactgctcatcctactcagtctgtgcgtagatcattgcttcagaagcatgggaggataagggactgtcttgctcaactctatgcaaaggacattactcctgatgacaagcaggagctagatgagtctctgcaaagagagattcaagctgcattccgaacagatgagattagaagaacacctccaaccccacaagatgaaatgagagctggaatgagttatttccacgagacaatctggaaaggtgtccccaagttcttgcgccgtgtggacacagctctgaaaaacattgggattgatgaacgtgttccttacaatgccccattgattcaattctcttcgtggatgggcggtgatcgtgatggtaatccgagggtcacacctgaggtcactagagatgtgtgcttgttggctagaatgatggctgccaatctctactataaccaaatcgagaatctgatgtttgagttatctatgtggcgttgcactgatgaattccgtgtgcgggcggatgaactgcacaggaactcaaggaaagatgctgcaaaacattacatagaattctggaagacaattcctccaactgagccataccgtgtgattcttggtgatgtgagggataagctgtatcacacacgtgagcgttcccgccaattgctgagtaatggaatctcggatattcctgaagaagctaccttcactaatgtggaacagttcttggagcctcttgagctctgttaccgatcactatgttcatgtggtgacagcccgatagctgatggaagccttcttgatttcttgaggcaagtctctacctttggactctcccttgtgagacttgacatcaggcaagagtctgaacgccacacagatgtcttggatgctatcaccaagcacttggacatcggttcctcctatagagactggtctgaagaaggccgacaggaatggcttcttgctgaactaagcggcaaacgtccacttttcggacctgatcttcccaaaaccgaagaaatttctgatgtcctggacacattcaaagtcatatctgagctgccttcagattgttttggagcttatattatctctatggcaacttcacctagtgatgtgcttgcggttgagcttttacagcgcgaatgccatgtgaaaaatccacttagagttgttccactctttgagaagctagctgatcttgaagcagctcctgccgctgttgcaagactcttttctatagactggtacaaaaaccgtattaacggtaaacaagaggttatgattggttactcagattcagggaaagatgcagggcgtctctcagctgcttgggagctatacaaagctcaagaagagcttgtgaaggttgctaagaaatatggagtgaagctaactatgttccatggccgtggtggcacagtcggaagaggaggtggtcctactcatcttgctatattgtctcagccaccagatacagttaatggctctcttcgagtcacggttcagggtgaagtcattgagcaatcatttggggaggcacacttatgctttagaacacttcaacgtttcacagcagctactctagagcacggaatgaaccctccgatttcaccaaaacccgagtggcgtgctttgcttgatgaaatggcggttgttgcaactgaggaataccgatctgtcgttttccaagaacctcgattcgtcgagtatttccgcctcgctactccggagctggagtatggacgtatgaatattggaagtagaccttcaaagcgaaaaccaagcggtgggatcgaatctctccgtgcaatcccatggatctttgcttggacgcaaacaagattccatcttcctgtatggttaggtttcggagcagcatttaggtatgcgatcaagaaggatgtgagaaaccttcacatgctgcaagatatgtataaacaatggccctttttccgagtcaccatcgatctaattgaaatggtgttcgccaagggagaccccgggatcgctgctttgtacgacaaacttcttgtctcagaagatttatgggcttttggagagaaactcagagccaactttgatgaaaccaagaacctcgtcctccagactgctggacataaagaccttcttgaaggagatccttacttgaaacagagactaaggctacgtgactcttacattacgaccctcaacgtttgccaagcctacacattgaagaggatccgtgatgcaaactacaatgtgactctgcgaccacacatttctaaagagatcatgcaatcaagcaaatcagcacaagagctcgtcaagcttaaccccacgagtgaatacgcgcctggacttgaggacacacttatcttaaccatgaagggtattgctgcaggattgcaaaacaccggttaa

SEQ ID NO: 477 - DNA, 843 bp, Arabidopsis thaliana
atggcgtctttgggtgtgtcggaaatgcttggtactccccttaacttcagggcagtttcaagatcgtctgctccgttggcatcaagcccatccacgttcaagactgttgctctcttctctaagaaaaagccagctcctgctaagtccaaggctgtctctgagactagcgatgagctcgccaagtggtatggtcctgacaggagaattttcttgcctgatggtcttttggatagatcagagatcccagagtacttaaacggtgaagttgctggagattatggttatgacccatttggtcttggaaagaagcctgagaactttgctaaataccaagcttttgaattgatccatgcgagatgggctatgttaggagcagctggtttcatcattcctgaagctttaaacaaatatggcgctaactgtggccctgaagctgtctggtttaagactggtgctttgcttcttgatggaaacacattgaactactttggcaagaacatccctatcaaccttgttctcgccgtagttgctgaggttgttctcctcggtggagccgagtactacagaatcaccaacggattggatttcgaggacaagctacacccaggaggtccatttgatcctctaggccttgctaaggaccctgagcaaggagctcttctcaaagtcaaagagatcaagaacgggagattagccatgtttgcgatgctcggtttctttatccaagcgtatgttaccggagaaggtcctgttgagaaccttgcaaagcatctcagtgatccttttggaaacaacttgcttaccgtcatcgctggaactgccgagagagctcccactctctaa

SEQ ID NO: 478 - DNA, 408 bp, Arabidopsis thaliana
atgggttccaagattgtccaagttttcttgatgttggctctattcgccacttcagcactcgctcaagcccctgctcctactcccaccgccactcctcctcccgcaactccccctccagtcgcaactcctcctccagtggctaccccaccacctgctgcaacccctgccccagccacgccaccacctgctgcaaccccagctcctgccactactccaccgtcagttgctccttctcctgctgatgttcccaccgcctctccaccagcaccggaaggtcccaccgtgagcccaagcagtgctcccggaccttcagatgcatcccctgccccaagcgccgcattctccaacaaggctttcttcgccggaaccgccttcgccgctattatgtacgccgccgttttggcttga

SEQ ID NO: 479 - DNA, 1839 bp, Arabidopsis thaliana
atgaagatggacaaaaagactatagtttggtttagaagagacctaaggattgaggataatcctgcattagcagcagctgctcacgaaggatctgtttttcctgtcttcatttggtgtcctgaagaagaaggacagttttatcctggaagagcttcaagatggtggatgaaacaatcacttgctcacttatctcaatccttgaaggctcttggatctgacctcactttaatcaaaacccacaacacgatttcagcgatcttggattgtatccgcgttaccggtgctacaaaagtcgtctttaaccacctctatgatcctgtttcgttagttcgggaccataccgtaaaggagaagctggtggaacgtgggatctctgtgcaaagctacaatggagatctattgtatgaaccgtgggagatatactgcgaaaagggcaaaccttttacgagtttcaattcttactggaagaaatgcttagatatgtcgattgaatccgttatgcttcctcctccttggcggttgatgccaataactgcagcggctgaagcgatttgggcgtgttcgattgaagaactagggctggagaatgaggccgagaaaccgagcaatgcgttgttaactagagcttggtctccaggatggagcaatgctgataagttactaaatgagttcatcgagaagcagttgatagattatgcaaagaacagcaagaaagttgttgggaattctacttcactactttctccgtatctccatttcggggaaataagcgtcagacacgttttccagtgtgcccggatgaaacaaattatatgggcaagagataagaacagtgaaggagaagaaagtgcagatctttttcttaggggaatcggtttaagagagtattctcggtatatatgtttcaacttcccgtttactcacgagcaatcgttgttgagtcatcttcggtttttcccttgggatgctgatgttgataagttcaaggcctggagacaaggcaggaccggttatccgttggtggatgccggaatgagagagctttgggctaccggatggatgcataacagaataagagtgattgtttcaagctttgctgtgaagtttcttctccttccatggaaatggggaatgaagtatttctgggatacacttttggatgctgatttggaatgtgacatccttggctggcagtatatctctgggagtatccccgatggccacgagcttgatcgcttggacaatcccgcgttacaaggcgccaaatatgacccagaaggtgagtacataaggcaatggcttcccgagcttgcgagattgccaactgaatggatccatcatccatgggacgctcctttaaccgtactcaaagcttctggtgtggaactcggaacaaactatgcgaaacccattgtagacatcgacacagctcgtgagctactagctaaagctatttcaagaacccgtgaagcacagatcatgatcggagcagcacctgatgagattgtagcagatagcttcgaggccttaggggctaataccattaaagaacctggtctttgcccatctgtgtcttctaatgaccaacaagtaccttcggctgttcgttacaacgggtcaaagagagtgaaacctgaggaagaagaagagagagacatgaagaaatctaggggattcgatgaaagggagttgttttcgactgctgaatcttcttcttcttcgagtgtgtttttcgtttcgcagtcttgctcgttggcatcagaagggaagaatctggaaggtattcaagattcatctgatcagattactacaagtttgggaaaaaatggttgcaaatga

SEQ ID NO: 480 - DNA, 489 bp, Arabidopsis thaliana
atggctccaattactgtcggcgatgttgtaccagacggaactatctctttcttcgatgaaaatgatcagcttcagaccgtctccgttcactctatcgccgccggtaaaaaagtcattctctttggtgttcctggtgctttcactcccacatgcagtatgagccatgtgcctggattcattgggaaagcagaggagctgaagtcaaagggtattgatgagatcatttgctttagtgtgaatgatccatttgtgatgaaggcatggggaaaaacatatccagagaacaagcatgtgaagtttgtagcagatgggtctggagaatacacgcatcttcttggacttgagcttgaccttaaggacaagggtcttggtattaggtcaaggagattcgctttgttgcttgataaccttaaggtgactgtagccaatgttgaatctggtggcgagttcacggtttccagcgcagaggatattctcaaggctctttaa

SEQ ID NO: 481 - DNA, 639 bp, Arabidopsis thaliana
atggcaggtatcaaagttttcggacacccagcttccattgccaccaggagagtcctcatcgccctccacgagaaaaacctcgactttgagctcgttcatgtcgaactcaaagacggtgagcacaagaaggagcctttcctctcccgcaacccttttggtcaggttccagcctttgaagatggagacctcaagctcttcgaatcaagagcgattactcagtacatagctcaccgatatgaaaaccaaggaaccaaccttctccaaaccgactccaagaacatatctcagtacgcaatcatggccattggaatgcaagtagaagatcaccagttcgacccagtggcttcaaagcttgcttttgaacaaatattcaagtccatctacggcttgaccacagacgaagccgttgttgcagaagaggaggctaagttagccaaggtccttgatgtctacgaggctaggctcaaggagttcaagtatttggctggtgaaactttcactttgactgatcttcaccacattcccgcgattcaatacctgctcggaactcccaccaagaagctcttcaccgagcgtccacgtgtcaatgagtgggtggctgaaatcaccaagaggccagcttccgagaaggttcagtga

SEQ ID NO: 482 - DNA, 753 bp, Arabidopsis thaliana
atggctggagttgcctttggttcctttgatgattcattcagcttggcttctctaagagcttacctcgctgagttcatctccactttactctttgttttcgctggtgttggctctgccattgcctacgcaaagctgacgtcggacgctgctcttgatacaccgggactagtggccatcgcggtttgtcatggttttgctctcttcgtggccgttgcaatcggagccaacatctccggtggccatgtgaacccagccgtcacttttggtcttgctgtcggtggtcaaatcacagtcatcaccggagttttctactggatcgctcagcttctcggctccaccgccgcttgtttcctccttaaatacgtcaccggtggattggcggttccaacccacagcgttgcggctggactaggatcgatagaaggagtagtgatggagatcatcatcaccttcgctttggtctacactgtctacgccaccgccgctgatcccaagaagggttctctcggaaccatcgctcctctcgccattggtcttatcgttggtgccaacatcctcgccgccggtccattctccggtggatccatgaacccagcacgttcctttggaccagctgttgctgccggagacttctctggtcactgggtctactgggttggaccactcatcggtggtggacttgccggacttatctacggaaatgtcttcatgggttcttccgaacatgttcctcttgcttctgctgatttctaa

SEQ ID NO: 483 - DNA, 741 bp, Arabidopsis thaliana
atgagcagaggaagcggcgctggttacgatcgtcacatcactattttctcaccggaaggtcgtctcttccaagtcgagtatgctttcaaagccgtgaaagcagctggaatcacatcgatcggtgtccgagggaaagattcagtatgcgtcgttacgcagaagaaagttccggacaagcttttggatcagtctagtgtatctcaccttttccctgttaccaagtaccttggattgttagccactggcatgacagctgattcaaggtcattggtacaacaagctaggaatgaggctgctgagtttaggttccaatatggttatgagatgcctgcagatattcttgctaaatggattgcagataagtctcaggtttacacacaacatgcttacatgagaccccttggagtagttgccatggttctaggtattgatgaagagagaggacctctactttacaagtgtgacccagctggacatttttacggtcacaaggcaactagtgctggtatgaaagaacaagaagcagtcaatttcttggagaagaaaatgaaagaaaaccctgccttcacatatgatgaaacagtacagactgctatatccgctctccaatctgttcttcaagaagacttcaaagcaactgaaattgaggtgggagttgtgagagctgatgaccctctcttccgttccctgagaacagaggagatcgacgagcacttgacggccattagtgaacgtgactga

SEQ ID NO: 484 - DNA, 369 bp, Arabidopsis thaliana
atggttctgctagagaagctttgggatgatgttgtggctggacctcagcctgaccgtggccttggccgcctccgtaagatcaccacccaacccattaatatccgagatataggagaagggagcagcagtaaggtggtgatgcataggtcgttgaccatgccggcggcagtgagccctggaactccaacgactccaaccactccgacgacgccacgtaaggataacgtgtggaggagcgtctttaatccgggaagcaacctcgccactagagccatcggctccaacatctttgataaacccacccatccaaattctccctccgtctacgactggttgtacagcggtgactcaaggagtcagcaccgttag

SEQ ID NO: 485 - DNA, 906 bp, Arabidopsis thaliana
atggataagccaagcttcgtaatccaatccaaagaagcagaatccgccgcgaaacaactcggcgtttccgtcattcagctcctcccgtcgctagtcaaaccagcacaatcctacgctcgaactccgatttcgaaattcaacgtcgcagtcgtcggactcggatcatcaggtcggatcttcttaggcgtcaatgtcgaattcccaaatctccctctccaccactcaatccacgccgaacagttcctcgtcaccaatctcacactcaacggtgaacgtcatctcaatttcttcgccgtctccgccgcaccatgtggccattgccgtcaattcctccaagaaattcgcgacgcacctgaaatcaaaatccttatcaccgatccaaacaactccgccgattccgattccgccgccgattcagacggattcttacgtctcggaagcttcttgccacacagattcggtcccgacgatcttctcgggaaagatcatcctcttcttctcgaatctcacgataaccatctcaaaatctcagatctggattcgatttgtaacggaaacaccgattcatccgccgatttgaaacaaacggctttagcggcggcgaatagatcgtacgcgccgtatagtttatgtccatcgggagtttcgctggtggattgtgacgggaaagtgtacagaggttggtatatggaatcggcggcgtataatcctagtatgggaccagtacaggcggcgttggttgattatgtggctaatggtggtggaggaggatacgagaggatcgtcggagcggttctggtggagaaagaagatgcggtggtgaggcaagagcacacggcgaggttgttattagagactatatcgccgaaatgcgaattcaaagtgtttcattgctatgaagcttag

SEQ ID NO: 486 - DNA, 1104 bp, Arabidopsis thaliana
atgtctcgccaatcgttttctctactgaagaatcttcgtagcatcgcttccggttccaaaatccagacccgatccgtgacttacatgcccagacccggtgacggaaaaccaagaccagtgacgttaatccccggagacggagttggtccgttggtaacaaacgcggttcaacaagtgatggaagcgatgcacgctccggtttacttcgaaccgttcgaagttcatggagatatgaagagtttacctgaaggattgttggaatcgattaagaagaacaaagtttgtttgaaaggtggtcttaagactcccgtcggtggtggtgtgagctctctcaatgttaatctgagaaaggagcttgatctctttgcttctttggtcaactgtttcaatttgcctggtttagcttctcgtcatgagaatgttgatattgttgtgattagagagaacactgaaggtgaatatgcaggtcttgaacatgaagttgttcctggtgttgttgagagccttaaggtgattacaaagttctgttcagagcgtattgcaaagtatgcgtttgagtatgcctacttgaacaacaggaagaaagttacagcagtgcacaaggctaatatcatgaaattggctgatggtttgttcttggagtcttgtcaagaggttgctaagaagtatccaagcattgcttacaatgaaatcattgttgataattgttgtatgcaacttgtggctagaccagagcaattcgatgtcatggtgacgcctaatctctatggtaatctagtggcaaacactgctgctggtattgctggaggtactggagtcatgcctggaggaaatgttggggcggagtatgcggtctttgagcaaggtgcatcagcgggaaacgtggggaaggatacaacggaagagcaaaagaatgcaaaccctgtggctttgttgctgtcatcagccatgatgcttagacaccttcagttcccttcttttgctgacaggcttgaaaccgctgtgaagcgtgttatcgctgaagggaattgtcggactgaagatcttggtggaaacagtaccactcaagaggtcgttgacgctgtcattgcaaatttggattga

SEQ ID NO: 487 - DNA, 2571 bp, Arabidopsis thaliana
atgtcaatgggaggagggtcaaaccacgagtttggccagtggcttgaccagcaactcgttccgttagctacgagtagtggctctttgatggttgaattgttacatggtaacttagacatttgggttaaggaagctaaacatcttcctaacatgatatgttaccgtaacaagcttgttggtgggatttcgttttctgagttaggtcggaggattcgtaaagtggatggtgagaagtcttctaagttcacaagtgatccttatgttactgtctctatctctggtgctgtcattggtagaacttttgttattagcaatagtgagaatcctgtgtggatgcagcatttcgatgtacccgttgctcatagtgctgctgaagtacattttgttgtgaaagacaatgatcctattggatcaaagatcataggagttgttggaataccaaccaagcagttgtgttccgggaatagaatcgaagggctgtttccgatacttaacagtagtgggaagccttgtagaaaaggtgctatgttgagtctgtctattcagtatactccaatggaaagaatgagactttaccaaaagggtgttggttctggtgttgagtgtgtaggagttcccggtacatacttccctttgaggaaaggcggtagggttactctttatcaggatgctcatgtcgatgacggtactcttccgagtgtacatcttgatggtgggattcagtatagacatggaaaatgctgggaggatatggctgatgcgatacgacgggcaaggaggctgatttatatcacaggttggtcagttttccatccggttaggctggttcgtcgtaacaatgatccgaccgaaggtacattaggggagttacttaaagtcaaatctcaagaaggtgttagagtgttggttttggtgtgggatgatccaacttcaatgagttttccgggattcagtacaaaaggacttatgaacacaagcgatgaggagactcgccgttttttcaagcactcatcggtgcaagttctcctttgtcctagatatggggggaaaggtcacagcttcataaaaaaatctgaagttgaaacaatctacacgcatcatcagaaaactatgattgtagatgctgaagcagctcagaaccgaagaaagattgtagcatttgttggagggctagacttgtgcaacggacgatttgatactcccaagcattctcttttcgggacattaaagacactccataaagatgacttccataacccaaattttgtgactactgaggatgttggaccaagagaaccatggcatgatctgcacagcaaaattgatggtccagctgcatatgatgtgcttgctaatttcgaggaacgctggatggcttcaaaacctcgtggaatagggaaaggaagaacttcttttgacgattctttgcttaggataaacagaattcctgacatcatgggactttctgaagcttcttctgctaatgataatgatccagagtcttggcatgttcaggttttccgttctattgattcgacttcagtcaaagggtttccaaaggacccagaggaagctactggaagaaatcttctatgtgggaagaacattctcatagatatgagcatacatgcagcttatgttaaggcgatacgatctgctcagcacttcatttacattgagaaccaatattttcttggatcttcattcaactgggattcaaacaaggacttgggtgctaataatctaatcccgatggaaatcgcgcttaagattgctaataagattagagcgagggagaatttcgctgcttatattgtcattccaatgtggccagaaggtgctccaacaagtaagcctattcaaagaattctctactggcagcacaaaaccatgcaaatgatgtatcaaaccatctacaaggcacttctggaagttggtcttgatggccagcttgagccacaagactttttgaacttcttctgtcttggaaacagagaggttggaaccagagaggttcctgatggaacagttaatgtatataattgtcctcggaagccacctcagccaaatgctgcacaggtgcaagctttgaagagtcgaagattcatgatatatgttcattccaaaggtatggtagtggatgatgagtttgtcttaattggttccgcgaatatcaaccagagatccttggaaggaactagagacactgaaatcgctatgggagggtatcagccacatcattcatgggctaagaaaggttctcgtcctcgtggtcagatctttggatatagaatgtcgttatgggcagaacatctagggtttctagagcaagaattcgaggaaccagagaacatggaatgcgtgagacgagttaggcaattgagtgagctgaattggggacagtatgcagcagaggaagtcacagagatgtcaggtcatcttcttaagtatccagttcaagtcgataaaacaggcaaagtgagttctcttcctggatgcgagacattcccagatctcggtggcaagatcataggatcattccttactctacaagaaaacctcaccatctga

SEQ ID NO: 488 - DNA, 1686 bp, Arabidopsis thaliana
atgtcggatcttcagacaccgcttgtgaggcccaagaggaagaagacttgggttgattactttgtcaagttcagatggatcattgtcatcttcatcgtccttccattctcagccacattctacttcctcatctacctcggggacatgtggtcagagtccaagtcctttgagaaacgtcagaaggaacacgacgagaatgtcaagaaagtcatcaaaaggcttaagggtagggatgcttccaaggacgggcttgtctgcactgctcgtaagccctggatcgctgttggaatgaggaacgttgactacaagagagcccggcatttcgaggttgacttgggggagttccgtaacatccttgagatcaacaaggagaagatgactgctagagtggagcctcttgttaacatgggacagatttcccgtgctaccgtcccaatgaacctgtctctcgctgttgttgctgagcttgatgaccttaccgttggtggacttatcaatggatatggtattgaaggaagctctcacatctacggtttgtttgctgataccgttgaggcttacgagattgttcttgcgggtggagagcttgtccgcgccacaagggataatgagtattctgatctttactacgcaatcccgtggtcgcaaggaactcttggactccttgtagctgctgagatcaggcttattaaagtcaaggagtacatgagactcacttacataccagtcaagggtgatcttcaagccttagctcaaggttacattgattcttttgctcccaaagacggtgacaagtcgaaaatcccggatttcgtcgaaggcatggtttacaatccaacggaaggagtgatgatggttggaacatatgcatctaaagaagaggcaaagaagaaagggaacaaaatcaacaatgtgggatggtggttcaagccgtggttctaccagcacgcgcagaccgccctgaaaaagggacagtttgttgagtacatcccaactcgtgaatactaccacaggcacacaaggtgcttgtactgggaagggaagcttattcttccatttggtgatcagttctggtttaggtacctcttaggttggttgatgcctccaaaggtctctcttcttaaggccactcaaggtgaagctatcaggaactattaccatgatatgcatgttattcaggatatgcttgttcctctttacaaggttggcgatgcactcgaatgggtccaccgcgaaatggaggtgtatccaatttggctttgcccacacaaactcttcaagcagccaatcaaaggccaaatctacccagagccaggcttcgagtacgaaaacagacaaggagacacagaagatgcacagatgtacactgatgttggagtctactacgcacctggctgtgtcctaagaggtgaagagtttgatggatcagaagcagtgcgtaggatggagaaatggctgatagagaaccatggattccagcctcagtacgcggtgtctgagctcgacgagaagagcttctggagaatgtttaatggtgaattgtatgaggagtgccgcaagaagtatagagctattggaacgttcatgagtgtttactacaagtccaagaaaggaaggaagactgagaaagaagttagagaagccgaacaagctcatctcgaaactgcttatgccgaggcagattaa

SEQ ID NO: 489 - DNA, 636 bp, Arabidopsis thaliana
atgaagatgataatccaaattttcttcatcatctccctcatttcaaccatctcttttgcctctgttcaagacttttgtgtagctgacccaaagggtcctcaaagcccatcaggttactcttgcaagaaccctgaccaagtcaccgaaaatgactttgcatttaccggcctcggcacagctggaaacacttccaacatcattaaagccgcagtgactccagcctttgctcctgcttacgcaggcatcaatggccttggcgtatctctggctcgtcttgacttagccggtggtggtgtcatccctctccacactcatcctggtgcttctgaggtccttgtagtcattcaaggcaccatttgcgccggatttatctcctccgccaacaaagtttacttgaagactctcaacagaggagattctatggtgtttcctcaaggacttcttcattttcagctaaactctgggaaaggccctgccttggcctttgtcgcattcggaagctcctccccagggctccaaattctaccatttgctctgtttgcaaacgatttgccttcagaacttgttgaagccacaacgttccttagcgatgcagaagttaagaagcttaagggtgtgcttgggggaactaattaa

SEQ ID NO: 490 - DNA, 639 bp, Arabidopsis thaliana
atgaagatcagacttagcataaccatcatacttttatcatacacagtggctacggtggccggacaacaatgcggtcgtcaaggcggtggtcgaacttgtcccggtaacatctgctgcagtcagtacggttactgtggtaccaccgcggactactgttctccgaccaacaactgtcagagcaattgttggggaagtgggcctagcggaccaggggagagcgcgtcgaacgtacgcgccacctaccatttctataatccggcgcagaataattgggatttgagagccgtgagtgcttattgctccacgtgggatgctgataagccgtacgcatggcggagcaagtatggctggaccgccttctgcgggccggcaggacctcgtggtcaagcttcttgcggcaagtgtttaagggtgaagaacacaagaacaaatgctgcagtaactgtgagaatagtggaccaatgcagcaacggaggcttggatttggatgtagcaatgttcaatcaaatagacaccgatggttttggctatcaacaaggccatctcattgttgactaccaatttgtcgactgtggcaatgagctcattgggcagcctgattccagaaacatgcttgtttcggccattgatcgcgtttga

SEQ ID NO: 491 - DNA, 591 bp, Arabidopsis thaliana
atgagtgcttcgaggtttataaagtgtgtcaccgtcggcgatggtgccgtcggaaaaacttgtatgctgatttcttacacaagcaacactttccctacggactatgttccaactgttttcgacaacttcagtgctaatgtggttgtagatgggaacacggtgaatcttggattgtgggatacagctggtcaagaagactataacaggttaagaccgttgagttaccgtggtgccgatgtcttcattcttgcattctcgcttattagcaaagctagctacgagaatgtagccaagaagtggattcctgagcttaggcattatgcccctggtgttcctataatcctcgttggaacgaaactcgatcttcgagatgacaagcaattcttcatagaccatcctggtgcagtgcctattactacaaaccagggagaggaactaaagaaactgataggatcaccaatctacattgaatgtagttcaaagactcagcagaatgtgaaagcagtctttgacgcagccataaaagtggtgcttcagccaccgaaacagaagaagaagaaaaagaacaagaaccgctgcgtgttcttgtga

SEQ ID NO: 492 - DNA, 957 bp, Arabidopsis thaliana
atggcggagaagccggcgcaagagcaagagcagaagcgagcgatggaacctgcagttctcgacgatattattcgtcgtttggttgagtttcggaacacgagacctggatcggggaagcaagttcatctcagtgaaggtgaaattcgtcagctttgtgctgtctccaaagaaatatttcttcaacagcccaatctgcttgaattggaagctcccatcaagatctgcggtgatattcatgggcagtattcagatctattgaggctttttgagtatggagggttccctcccgaagctaattatttgttcttgggtgattatgttgaccgtggcaagcaaagcttggaaacaatatgtcttcttctagcttacaaaatcaagtaccctgagaacttcttcttgttgagagggaatcatgaatctgcttccattaatcgtatttacggtttctatgatgagtgcaaacgcaggttcaatgtcagactctggaaaatattcaccgattgctttaactgtcttcctgtggccgccttaattgatgacagaatactatgtatgcatggtgggatttccccagagctgaaaagtttggaccagattagaaatattgcacggccgatggatattccggagtctggtttggtatgtgatttactatggtcggatcctagtggagacgtaggctggggcatgaatgatcgtggtgtttcatacacttttggagctgacaaagtcgcagagttcttggagaaacatgacatggaccttatctgtcgtgcccaccaggttgttgaagatgggtatgagttctttgcagaaagacaacttgttacagtattttcagctcccaactattgcggggaatttgacaacgctggcgcaatgatgagcattgatgagagcttaatgtgctcattccagattctaaagccgtcagaaaagaagtcgccttttctgtga

SEQ ID NO: 493 - DNA, 447 bp, Arabidopsis thaliana
atggcatcgaaacggattttgaaggaattgaaggatctgcagaaggatcctcctacttcatgtagcgcaggacccgttgcggaagacatgtttcattggcaggccactataatgggtccatcggatagcccttattctggaggagtttttcttgtaaccatccatttccctccagattacccatttaagcctcctaaggtggcttttaggacgaaggtgttccatccaaacattaacagcaatggaagcatctgcctcgacatcttgaaggagcagtggagtcctgctctcacaatttccaaggtgctgctatcgatctgttctttgttaacggatccaaacccagatgatcctttggtccctgagatagctcacatgtacaagacagacaagaacaagtacgagtccactgctcggacctggacccaaaagtatgccatgggctga

SEQ ID NO: 494 - DNA, 870 bp, Arabidopsis thaliana
atgggtccaagttcgagcctcaccaccatcgtggcgactgttcttcttgtgacattgttcggttcggcctacgcaagcaacttcttcgacgagtttgacctcacttggggtgaccacagaggcaaaatcttcaacggaggaaatatgctgtctttgtcgctggaccaggtttccgggtcaggtttcaaatccaaaaaagagtatttggtcggtcggatcgatatgcagctcaaacttgtcgccggaaactcggccggcaccgtcactgcttactacttgtcttcacaaggagcaacacatgacgagatagactttgagtttctaggtaacgagacagggaagccttatgttcttcacaccaatgtctttgctcaagggaaaggagacagagagcaacagttttatctctggttcgacccaaccaagaacttccacacttactccattgtctggagaccccaacacatcatattcttggtggacaatttacccattagagtgttcaacaatgcagagaagctcggcgttcctttcccaaagagtcaacccatgaggatctactctagcctgtggaatgcagacgattgggccacgagaggtggtctagtcaagactgactggtccaaggctcctttcacagcttactacagaggattcaacgctgcggcttgcacagcctcttcaggatgtgaccctaaattcaagagttcttttggtgatggtaaattgcaagtggcaaccgagctcaatgcttatggcaggaggagactcagatgggttcagaaatacttcatgatctataattattgctctgatctcaaaaggttccctcgtggattccctccagaatgcaagaagtccagagtctga

SEQ ID NO: 495 - DNA, 972 bp, Arabidopsis thaliana
atggaagatcggtgcttgatcaagaacgatatcactgaattgattggtaacacaccaatggtgtatctgaacaatgttgttgatggttgcgtggctcgtatcgctgcgaagcttgagatgatggagccttgttctagcgtcaaagacagaatcgcgtatagtatgatcaaagatgcagaagacaaaggattgattactcccggaaagagtacattgatagagccaactgctggtaacaccgggattggtttagcttgcatgggagctgcaagaggctataaagtgatccttgtgatgccttcaactatgagcttagagagaagaatcattctgagggcactaggtgcagagcttcatctctcggaccagcgcataggccttaaaggaatgttggagaaaactgaagcgattttaagcaaaactcctggtggttacattccacaacaatttgaaaatcctgcaaaccccgagattcattaccgaaccacgggaccggaaatatggagagattcagccgggaaagtagatatattggtcgctggcgtagggactggtggaactgctactggagtagggaagttcctcaaggagcagaacaaagacatcaaggtttgtgtggtggaaccagtagaaagtccggtacttagcggaggtcaaccaggtccacatttgattcagggaattggctctggtatcgtcccattcaatttggacttaaccattgttgatgaaattattcaagtggcaggtgaagaggctattgaaacagccaagcttcttgccctcaaagaaggattactggtgggaatatcctctggagccgcagcagcggctgcgttaaaggttgcaaagcggccagaaaacgcggggaaactcattgtggtggtttttcctagtggaggagaacgttatttatcgactaaactgttcgattcgattagatatgaagcagagaatttgcctattgaatga

SEQ ID NO: 496 - DNA, 2868 bp, Arabidopsis thaliana
atgtcaacaaaagtgttggatcctgcatttcaaggagctggccagaaaccagggactgaaatctggagaattgagaattttgaggcagttcctgtaccaaagtctgagcatggaaagttctatatgggagatacttacattgtcttgcagacaacacagaataaagggggtgcttatttgtttgatatacatttctggattggtaaagatacaagccaggatgaagctggaacagcagctgttaaaacagttgaactcgatgcagttcttggaggccgtgctgtccaacaccgggaaattcagggtcatgaatctgacaaattcttgtcttacttcaagccatgtattatacccttagagggtggtgttgcgtctggtttcaaaacagttgaagaagaggtgtttgagacccggttatatacttgcaaaggaaaacgtgcaatccgtttgaagcaggttccttttgcccgctcatcactgaatcatgatgatgtatttatcttggacaccgaggaaaagatctatcagttcaatggtgcaaattcaaacattcaggagagagccaaagctttggaagtcgttcagtatttaaaagacaagtatcacgaaggaacttgtgatgttgcgattgttgatgacggaaaattagatacagaatcagattctggtgcattttgggtcctctttggtggttttgctccaatcggaaggaaagttgccaatgatgatgacattgtcccggagtcaactccacctaagctttattgcatcactgatggtaagatggaaccaatagacggtgacctatccaaatctatgctggaaaacactaaatgctacctcttggactgtggcgctgagatatatatctgggttggccgtgtcactcaagtagatgagaggaaagctgctagtcaatctgctgaggaattccttgctagtgaaaataggccaaaggcaacacatgtaactcgtgtaatccaaggttatgagtcccattctttcaagtctaactttgactcttggccatcaggctcggccactcctggtaacgaagaaggacgaggaaaagtcgctgctttactgaagcaacaaggcgttgggctcaagggcattgcaaaaagtgcaccagtgaatgaggatattccacctctgcttgaaagtggtggaaaattggaggtttggtacgttaatggtaaagtcaagactcccttacctaaagaagatattggaaagctctattctggggactgctatttggtcctttatacctatcattctggggaaaggaaagacgaatatttcttgagttgttggtttggaaagaaaagcattccggaggaccaagatacagcaattcgactggcgaatacaatgtcaaactcgttaaaaggaagacctgtgcagggccgtatatacgagggtaaagagcctccacaatttgttgccctttttcaacctatggtggtcttaaagtcagagtcaacagacgaaacctacacgccagaatcaattgcactagttcaagtatctggaaccggagttcacaataataaggctgtgcaagttgaaacggtggcaacatctttgaactcttatgagtgcttccttctgcaatctggtacttccatgttcctttggcatggaaatcaaagtacgcatgaacagctagaactggccactaaagttgctgaattcttgaagcccgggattactctcaagcatgccaaagaaggaacagagagctcaaccttttggtttgcacttgggggaaaacagaatttcaccagcaagaaggcttcctctgagacgatcagggatcctcacttattctcatttgttgaggagatttacaactttgctcaagatgacctcttgactgaggatatatatttcctagacacccatgctgaagtttttgtctgggttggtcaatgtgtggagcctaaggaaaagcaaactgtatttgagattggccaaaaatacatagatcttgctggatccttggaaggcttgcatcctaaagtcccaatctacaaaatcaatgaagggaacgaaccatgcttcttcaccacttacttttcttgggatgccactaaagctatcgtacaaggaaattcattccagaaaaaggcatcgttgttatttggcactcaccacgttgtggaggataagtctaacggtgggaaccaaggactaaggcaaagggctgaagcactagctgccttaaattcggcatttaactcttctagtaacaggcctgcctattcgagccaggacagattaaacgaaagtcacgacggcccaagacagagagctgaagctttagccgccttgtcatccgcattcaactcttcttcgtcatcaactaaatcgcctccaccaccaaggccagtggggacgagtcaggcttcacagagagcagcagcagtggctgctctttctcaagttcttgttgcggaaaataagaaatcacctgatacctctcctacaagaagatccactagctccaacccagcagatgacatccctctgacggaagcaaaagatgaagaagaggcttcagaggtagctggtcttgaagccaaggaagaagaggaagtttcacctgcagcagatgaaacagaagcaaagcaggaaacagaagagcaaggtgattctgaaatacaaccaagtggagcaactttcacctatgaacagctgagagctaaatctgagaacccagtgactggaatcgatttcaaacgcagagaggcttatctatctgaggaagagttccaaagtgtgtttgggatcgagaaagaagcattcaacaacttaccacgttggaagcaagatctgcttaagaagaagttcgacttgttctag

SEQ ID NO: 497 - DNA, 648 bp, Arabidopsis thaliana
atggtgttgacaatctatgctcctttattcgcttcttcaaagagagctgttgtgacattggtggagaagggagtatcattcgaaactgtcaatgtcgatctcatgaaaggagaacagagacagcctgagtatctcgcgattcagcctttcggtaaaatcccagtcctcgtcgacggagactacaaaatcttcgagtcgcgtgcgatcatgaggtatatagcagagaagtatagatcacaaggacctgatcttttggggaagactattgaagagagaggacaagtagagcaatggttagacgttgaggctacaagttaccatccaccactattggctttaacgctcaacattgtctttgcaccacttatgggtttccctgctgatgagaaagttattaaggagagtgaagagaagcttgcagaagtgcttgatgtctatgaagctcagctttctaagaacgaatacttggctggtgattttgtgagtctagctgatttggctcaccttcctttcaccgagtatcttgttggtcctattgggaaggctcatttgatcaaagataggaagcatgttagcgcttggtgggataagattagtagccgtgctgcgtggaaggaggtttccgctaagtactcactacctgtttaa

SEQ ID NO: 498 - DNA, 1398 bp, Arabidopsis thaliana
atggcaatgtctgtaaatgtttcttcttcttcgtcttctgggatcataaactctcgtttcggtgtttcattggagccaaaagtttcgcaaattggttcgttgaggttattggatcgtgttcatgttgctcctgtgtctctgaatctatctgggaagcgatcatcatctgttaaacctttaaacgctgaaccaaagacaaaggattcaatgattcctcttgcggcaacaatggtagcagaaattgcagaggaagttgaagtggttgagattgaggattttgaagagcttgctaagaagttagagaatgcttcacctcttgagattatggacaaagctcttgagaaatacgggaacgatatcgccattgcatttagtggtgcagaagatgttgctcttattgagtacgctcatttgactgggaggccatttagagtatttagtttggatacagggaggttgaatcctgagacgtatcggtttttcgatgcggtggagaagcactatgggattaggattgagtatatgtttcctgattctgttgaggttcaaggtttggttaggagcaagggattgttctctttttatgaggatggtcatcaggagtgttgccgtgttcgaaaggtgagacctttgaggcgtgctctcaagggtttaaaggcttggattactggtcagaggaaagatcaatctccggggacaaggtctgagattccggttgttcaggttgatccggtgtttgaaggtttggatggtggagttggtagtttggtgaagtggaatccggttgcgaatgttgaagggaatgatgtttggaacttcttgaggactatggatgttccggttaacacattgcatgcggcagggtatatatcgattggatgtgagccttgcacgaaagcggttttaccgggtcagcacgagagagaagggagatggtggtgggaagatgctaaagccaaggaatgtggacttcacaaagggaatgtcaaagaaaactccgatgatgctaaagtgaacggggaatcgaaatccgctgttgcagatatctttaagagtgagaatcttgtgactttgagcaggcaggggattgagaatttgatgaagttggagaaccgtaaagagccttggatcgtcgtgctttatgctccgtggtgccccttttgtcaagccatggaagcatcgtatgatgaactggcggataaattggctggaagtgggattaaggttgccaaattcagagcagatggtgaccagaaggagtttgctaagcaggaattgcagctcggtagcttccctaccattctggttttccctaagaactcatcgagaccgatcaagtatccgtctgagaagagagatgttgagtctttgacttcgttcttgaatcttgtccgataa

SEQ ID NO: 499 - DNA, 2109 bp, Arabidopsis thaliana
atgcctgctctagcttttgttgatactcccatcgataccttttccagtatctttacaccgtcgtctgtttccaccgccgttgttgacggttcctgccattggtctccgtccctctcctcctctctttaccgtatcgacggatggggagctccgtatttcgcagcgaattcctccgggaacatctctgttcgtcctcatggctcaaacactttacctcaccaagacatcgatctgatgaaagttgtgaagaaagttacagatccgagtggtttaggattacagcttccgcttattgttcgtttccctgatgttctgaagaatcgtcttgagtgtcttcaatccgcgtttgattacgcgattcagagtcaaggatatgattctcattaccaaggtgtgtatcctgtgaaatgtaatcaagatcggtttatcatcgaagatattgtcgaattcggatccggttttcgattcggtttagaagctggttccaagcctgagattcttcttgctatgagttgtttgtgtaaaggtaatcctgaagcttttcttgtgtgtaatggttttaaagactctgagtatatctcattggctttgtttgggaggaaacttgaattgaatactgttattgttcttgagcaagaagaagagcttgatttggttattgatttgagccagaagatgaatgttaggcctgttattgggttaagagctaagcttagaactaaacattctggtcattttggttctacttctggtgagaaggggaagtttggtttgactacggttcagattcttcgtgtggtgaggaagctgagtcaagttggtatgcttgattgtctccagcttctgcattttcacattggttcacagattccgtccacggctttgctttccgacggtgtggctgaggctgcgcagctttactgtgagcttgtccgtcttggtgctcatatgaaggtgattgatattggtggtgggttggggattgattacgacgggtctaaatcgggggagtcggatctctctgttgcttatagtctcgaggagtatgctgcagctgttgtggcttcggttaggtttgtttgtgatcagaagtctgtgaagcatccggtgatttgcagcgagagcggtcgagccattgtgtctcatcactcggtgttgatctttgaagctgtctcagctggtcaacaacatgagacccctactgatcatcagtttatgcttgaagggtactctgaggaagttcgaggtgattacgagaatctttatggtgctgctatgcgtggtgatcgtgaaagctgcttgctttatgttgatcagctgaagcagagatgtgttgaagggttcaaagaaggttccttgggcattgaacagttagctggtgttgatggattatgcgagtgggtgattaaggcgattggtgcatcggatccggttcttacttaccatgtcaatctatcggttttcacttcgattcctgatttctgggggattgatcagctgtttcctattgttccaatccataaacttgaccaaaggcctgccgcgagagggatcttatcggatttgacgtgtgacagcgacggaaagatcaacaagttcataggcggagaatcgagcttgccattgcacgagatggacaacaatggctgcagcggtgggcggtactatttgggaatgttcctaggtggagcttatgaggaagctctcggtggagtccacaatctgttcggtggaccaagcgtggttcgcgtattgcagagcgatggacctcacggattcgcagtgacccgtgctgtgatgggccaatcctctgcagatgtcctcagagcaatgcagcatgagcctgagctcatgtttcagactcttaaacaccgagccgaggagccgaggaacaacaacaacaaagcttgtggtgataaggggaacgacaaactagtagtcgcatcgtgtcttgctaagtcattcaacaacatgccttatctttccatggaaacgtcaacaaacgctctcaccgcagcggtcaataaccttggcgtttactactgcgatgaagctgcagctggtggcggcggcaagggcaaagatgagaattggtcttatttcggttga

SEQ ID NO: 500 - DNA, 471 bp, Arabidopsis thaliana
atggacgctctcattgctcagcttcagagacaatttcgtgattacaccatttctctctaccaacaggggtttttggatgatcaatttactgagttgaaaaagctacaagatgatggaagtcctgattttgtgtctgaagtgctttcacttttctttgaagattgtgtgaagcttatcagtaacatggctagagctttggacacgacaggaactgtagattttagtcaggtaggtgctagtgtgcatcaattgaagggtagtagctcaagtgttggtgccaagagggtcaaaactttgtgtgttagcttcaaggaatgttgtgaagctaagaactacgaagggtgtgtgagatgtttgcagcaagtggatattgagtacaaggcgttaaagacaaagcttcaagatatgttcaatcttgagaaacagatcattcaagctggtggtatagttcctcaagtggatattaactaa

SEQ ID NO: 501 - DNA, 1128 bp, Arabidopsis thaliana
atggcggctgcaatggcttctcatgtttcgacggctcgatcaccggctctttccttctcttcttcgtcttcctccttcttccccggtactactcttcggagattctccgccgtttcactcccttctcctgctctccctcgccttcgtgtttcatgtcaagcctcctccgtcacttcgccttcttctccttccgatgtcaaaggaaaatctgacctgaaagactttctggcaatagatgattttgacacagccaccattaaaacgattttagacaaggcttcagaggttaaggccttgctgaaatcaggggagagaaattatctaccttttaaagggaagtctatgtctatgatctttgcaaaaccttccatgaggactcgggtttcgtttgagactggttttttcttgctcggtggccatgcgttatatctaggtcccaatgacattcagatgggtaagcgggaggaaactcgtgatgttgctcgtgttctttcacgctataatgacatcattatggctcgtgtatttgctcatcaggacattcttgatttggctaactactcgagtgtaccagttgtcaatggtctgactgatcataaccatccttgccaaatcatggccgatgccctcacaatgatagagcacattggtcaagttgaagggacaaaggttgtgtatgttggagatgggaacaacatggttcactcttggttagaattggcatccgttattccattccactttgtctgcgcttgcccaaaagggtatgaaccagacaaagaaagagtttcaaaggcaaagcaagctggattaagtaagatagagatcaccaatgatcctaaagaagctgttattggagcagatgttgtgtactcagacgtatgggccagtatgggtcaaaaggatgaagccgaagctcgccggaaagcattccaaggattccaggtggatgaagctctgatgaagttggcgggtcaaaaagcctatttcatgcattgtttgcctgcagagagaggagttgaggtgaccaatggagtcgtagaggctccttattccattgtctttccacaggcggagaatcgcatgcatgctcaaaatgctataatgcttcacttgctcggcttttaa

SEQ ID NO: 502 - DNA, 804 bp, Arabidopsis thaliana
atgtttgaagagattcttcacctttctgaaggaaaacaaatcgttatgttcttggattatgatggcactttatctcccattgttgatgatccagatcgagctttcatgtctagaaagatgagaagaactgtgaggaaactagcaaactgtttcccgacggccatagttagtgggagatgcatagaaaagctaattatgatagttttgacaacttttcaggtttataactttgtaaaactaactgagttgtactatgctggaagtcatggaatggacatcaaaggaccagagcaagggtccaaatatgagcaagatagtaaatctcttctttgccaaccagctacagagttcctccccatgatcgacgaggtttatcataaattagtggagaaaacaaaatctactcccggagcccaagtagagaacaacaaattttgtgtctctgttcacttccgacgcgtagatgaaaataactggagtgatttggctaaccaagttcgatcagtaatgaaagactaccctaagctccgtcttactcaaggaagaaaagttttggaggttcgtccgattattaaatgggacaaaggcaaagcactcgagtttttattagagtcacttggatacgctaattgtaccgacgttttccctctttatatcggagatgatcgcaccgacgaagatgcattcaaggtatatacagaatttagttatggagttcttgcaacgtttagtggaatggaaacaattgagatctggagcatgatgagagctataactacagaagaatcgtttcttcttaattag

SEQ ID NO: 503 - DNA, 531 bp, Arabidopsis thaliana
atggcagtcacagcatttaacacattgaaacttgtatcgtcgtctctagatccgattccttcagtctcttgttcttcttattccttctctctgatatatgtcggatctccttacaagagatgtctaaagcagtcatgttctgttcgagctatgacttcttcttcttcggctgcatcgtcttcttcttcgtcctttggatcgagaatggaagagagtattaggaaaacagtgactgagaacactgtcgttatttactccaaaacttggatttgttttatttctttctttttgcttaattggagaatgggtttatcaaatatccttccactggttgttgaattggatcaacttggtccacaagggccacaactgcagaaggtactggaaagacttactgggcaacacactgttcctaatgttttcgtatgtggcaagcacattggtggctgcacagatacagtgaagcttaacaggaaaggagatctggaactgatgttagctgaagccaacggtaaaaacggtcagagttga

SEQ ID NO: 504 - DNA, 2262 bp, Arabidopsis thaliana
atggagtgggatagtgattccgatctcagcggtggagatgaagtggcggaggatggatggttcggtggagataacggagcgattccgtttccggtaggtagtcttcctggcacggcgccgtgtgggtttgtggtcagcgatgctcttgaacctgacaaccctatcatttatgttaacactgtttttgagattgttactggttatcgagctgaagaagttattggtcgaaattgccgtttcttgcaatgtagagggccatttactaaaagaaggcatccaatggtagattctacaattgtagcgaagatgcgacaatgtctagaaaatggcatcgagtttcaaggcgagttgctcaactttcggaaagatggatctcccttgatgaacaagctgcgtctagtccctatccgtgaagaagacgaaatcactcatttcataggcgttctcttatttacagatgcaaaaattgatcttggcccatctcctgatttatctgcaaaagaaattcctagaatatctcgctcatttacttctgctttaccaatcggagagcgtaatgtttctcgtggactctgtgggatattcgaactgagtgatgaagtaatagctatcaagatattgtcacagttgactcctggtgatattgcatcggttggttgtgtatgtaggcggctcaatgagttgacaaagaatgatgatgtgtggagaatggtctgtcaaaacacatggggtaccgaggcaacacgtgttcttgagagtgttcccggtgcaaaaaggattggttgggtgcgactggcccgagagttcaccactcacgaagcaacagcatggaggaagttttcagttggaggtactgttgagccttctcggtgtaatttcagcgcatgtgcagttgggaacaggattgttatctttggcggggaaggtgtgaatatgcagccgatgaatgatacatttgtgttggaccttggctcgagtagtcccgagtggaaatctgttctggtcagctctcctcctccgggtcgctggggtcacacactttcttgtgtcaacggttcccgtttagtagtgtttggaggttacgggagccacggattactcaatgatgtgttcttattagaccttgatgcagacccaccaagctggagggaagtatccggattggcccctccaataccaagatcatggcacagttcgtgcacacttgatggcactaagctgattgtatctggtggttgtgctgattcaggagctctactcagcgatacattcctgcttgacctatcgatggatatacctgcttggagggagataccggttccatggactcccccatctcgcctcgggcatactctaactgtctatggtgaccgcaagattcttatgtttggcggtctagctaaaaacggtactttgagattccgctctaacgatgtatacacgatggatcttagcgaggatgaaccgagttggagacctgtgattgggtatggatctagcctccccggaggcatggcagctccaccaccaaggctggaccatgtggcaatcagccttcccggtggtagaatcttgatctttggtggttcggttgcagggcttgactcggcttctcagctttatcttcttgatccaaatgaggagaaaccggcatggagaatactgaatgttcagggaggtccgccgaggtttgcatggggacacacaacatgtgtggtcggaggaactcgattggtcgtattaggtggtcagaccggtgaagagtggatgttaaatgaagcacatgaactgttactagcaacttctaccactgcaaattcttgtctgaaaactttctctttcattttctctcaatttaacactttcaagatgccgatcaacaaagacccatcaacacctcctcctgttatcggaaaaatcggtccttacactgtctttatgactcctcctgcgactcctaaaccacctgaatctccctccgctgtgtctcagaagcctgtgatggcaccaccggttcttcctccgccgcagcagtttaaatcggtggcttcttctgaccaggacggctcagttttggggttctttaaaaacgccgtcacaaaggttcaaaatgcacattcaagtgtggatgatcatttggtgaggtggtttgggttaaaccaatctaagtatcagtgggctttggatgagtactacgaaagcaaagaatcagctaatgaacataacaatatacaaccaatgaaattgatacaacatatttga

SEQ ID NO: 505 - DNA, 1488 bp, Arabidopsis thaliana
atgacctctctctccaccgccggttaccttcttctccttctccttctccctataagctacgacggtggcttcatcggagccgccgatgcagaacatgacctcagagccactgatctccataatcatcgccatcgtcgccaccgtaaccaccatcgcggagaagagtttgagtactcagccatatcatgtagagcttactcagcctcattggacgagtttggcgccgtaggagacggtgtaacttcaaatacagcggcgtttcgcgacgcggtgtcacaacttagccgtttcgcagactacggtggctcattgttatttgttcccgccggacggtggctcaccggaaactttaacctgaccagccattttacgcttttcctccaccgtgatgctgttatcctcgcctctcaagaagagagtgactatgaagtgatagagccactgccttcgtacggaagagggcgagacacagatggtggaaggttcatcagtctactttttggttcaaacttaaccgatgttgttatcaccggtgagaatgggacaattgatggacaaggagaaccatggtgggggaaattcaagagaggagaactaaaatacacaagaccttatttgattgagattatgcattctgatggtatccaaatctccaatctcactttcttgaattctccttcttggcatattcacccggtctacagcagcaatatatatatccaaggtttgacgatattagcaccggtcacggtaccaaacactgacggtatcaacccagattcttgtaccaacacgaggattgaggactgctacattgtctccggcgacgattgtatcgccgttaaaagtggatgggatcaatacggaatcaactacggcatgcctacgaaacagctcttgatccgacggctcacatgcatttctcctgatagtgccgtgatcgctctcggcagtgaaatgtccggtggaattgaagatgttcgagctgaagatattgttgccattaactctgaatctggaatcaggattaaaacagctatcggacgaggaggttacgtgaaggatgtatacgtaagaggaatgacaatgatgacaatgaaatatgtgttttggatgaccggaagttacggttcgcatccggacgatcattatgatccgaaagcgttaccggtgattcagaacattaattatcaagacatggtcgccgagaacgtgacgatgcctgctcagttagctggaatatcgggagatcagtttactggaatttgtatctctaacgtgactatcactctatcgaagaaacctaagaaagtgctttggaattgtactgatgtttcgggttatactagtggtgtgactccgcagccgtgtcagttgttaccggagaagcagccggggacggttgtgccgtgtaatttcccggaagatccgattcctattgatgaagtgaagcttcaacgttgctactccagaagaaggaatatgtga

SEQ ID NO: 506 - DNA, 1137 bp, Arabidopsis thaliana
atgagagatgtgagcggatttggtatagcttctcgacctcagttggacaagggtttgtcggaaaacaatatagggttcacggaaagagttttctctgccgccggagctgcggttttgtccgccgttactctaaatcctcttgacgttgtcaagactcgattgcaagctcaagccgccggaatgtcgtactctcacccactcagtaactccattggacgcatggcattttttggcccaaacatgatgtttgcagacttgagatgttctccttcatgtgcacgcgctggtgttgaaggtactgtttctatttgcccaccggattgtttccagtacaaaggaacatttgatgtcttcaccaagatcatacgacaggttgggatatatctcccattctatgatatgttccgcaaccggttggaagaattatctcgggagaaagctcctgctatgacattttgtgtgcctactgtggcagggtctttagcgcggtccttagcttgtacagtctgctatcctattgatcttgcaagaacgcgtatgcaggcattcaaagaagcaaaagccggtgtgaagcctccgggagtttttaaaactctagttggtgttttctctgaagtcaggacagcaaataaccttgaaagtagcttgcacaactatcgtggtctctggagaggcttgggtgcacagcttgcccgtgatgttccattctcagcaatctgctggtcgaccctcgagccaataaaaaagaggctccttggagttgcgggcaatgatacaaatcttgttggtgttttcggtgcaaccttttctgctggatttatagctggaagtatcgctgctgctgctacttgtcctcttgacgttgcaagaacaagaagacagatagagggatggagggatgagaggactgttcatgggaatgggtccacgagtggcacgtgcaggaccatcggttgtcttctcaacttagattcttatcatcaaaaagtatccatgagagccttctcaaatatgaaaagcaaaacgcactattacgatttccttaattgtaacctgaggaggcgacgatgtgtaaaacgccattcatattgtcccgctttagtgatgaattataagtcttcgtttgtcgaaaattaa

SEQ ID NO: 507 - DNA, 1326 bp, Arabidopsis thaliana
atgggtatctcaaaagacaggatcaaattcaacgttggtggacgactcttcgaaacgacggcgacgacgttagcaaacgcaggtcgtgattctttcttcggagcattgttcgacgacgaatggaatctttcaccacttgaagattccattcttttcgtagacagaaactcagattgcttcgcagttcttcttgatcttctccgtacgggagaccttaacgttccggccaacatccctgagcgtctccttcatagagaagcttctttctacggtttacttgaccatgtacggaccgctaaatggggtccgtttgatggtaaccgtcttcgtctatcggattctgttaaaggaattgctcccggagacggaaccgccatcagggcaggtcctgatggcggttgttgcgtcgcgcacgggagtgttgttcatgtttttgattggatgttggaagaacattctccgatcaaccttgattaccagagagtaaacgatgttggctggattgattcagacaacatcgtactctctgcttgtgagaaattgggaagaggagatggaggaatgggactgttcagttcatcttccggtgatcttcggtataagtttcaggtctgtcatgagaatcaggtgaagagttatacagctggagctttgagtttttcgccggattatgagatttttgcgagctgcaaaggtcggagtaatgagtatggaatcggagtttgggatcagataactggaaagcaaaccgatttcttctacgagagtcctggttggtcacttggtgatgctgacaagcttcaatggctgaatggtaagaactgtcttcttgtggctacattgtttccaagaaaggacaactgttacattagtttgttggattttcgggacaagaacatggtttggtcatggtcggatattgggtctcctatggcgatagacgagaagagagtgagagatgcaatagctatggaagatagcaattcgatttgtgtggtgaatgagtttgaggatttggggtttattgatctgaggatgtatggaggaagcgtgaggtggagttcgagaagtaaactgatgaagagtaagatgcctgatgagccttgttacccgaaactagctttgcatgaaggccagcttttctcatcaatgaatgattctatctctgtgttctgtggaccagactgggtcttaacttctaggctaagaagaagctatggtggctcaatctgtgatttctccattggtggcgaccgcctttttgcattgcatagcgaggagaatgtgtttgatgtctgggagactccgccttgtccgatcatataa

SEQ ID NO: 508 - DNA, 207 bp, Arabidopsis thaliana
atgagccaatacagtcaaaaccaatatgcagtgtctaccggtccatacgtggcaccgccaccgctcggttacccaacgaacgacacgactcatgctacggtggctcctgtcgagacaaagtctaaaggtgaagctgctgatggattcttgaaaggctgtcttgcgaccatgttggcctgttgcgtcctcgacgcatgcattttctga

SEQ ID NO: 509 - DNA, 666 bp, Arabidopsis thaliana
atgactcagagtcaaaccaacgacggagctggagctggagctgttacgacggtagaatctgttcctcctcagcctcaatctcagcctcagcctcagccgcagcagcagagcaacgagatggttctgcatacgggaagcttgagttttagtagtcatatgtcgagagaagacgaagagatgactcgttctgctctttcggcgtttagagctaaagaagatgagattgagaagaggaggatggaagttcgtgaacggatccaagctcaattgggtcgggtcgaacaagaaaccaaacgtctctctactattcgtgaggagcttgagtctatggcagatcctaggatttggccaagtgagcttgagtctatggcagatcctatgaggaaggaagtttctgtggttcgtaagaagattgatagtgttaacaaagaactcaaacctctaggttccactgttcaaaagaaggctgaacaaaattcgatttttggtaatgaaatgaaacaggaaagggaatacaaagaagcacttgatacattcaacgagaagaacagggagaaagtacagctgatcacaaaactcatggagatggaacagttggttggagaaagcgagaagttgaggatgattaagctggaggagctgagcaagagcatagaaaccgtgtga

SEQ ID NO: 510 - DNA, 1002 bp, Arabidopsis thaliana
atgggagctccgttagtgtgccacgggcattctcgtcccgtcgtcgatgtggcttatagtccggtgactccagatgggttctttctcattagcgccagcaaagattcgaatccgatgttgaggaatggagagactggtgactggattgggacttttgaaggacataagggagcagtttggagttgcagccttgataaaaatgctattcgtgctgcctcagcttctgctgatttcactgcgaaaatatggaatgcattgacaggagatgaattgcactcctttgaacacaagcacattgttcgtgcatgtgccttttctgaggacactcaccgtttactcactggtggaatggagaaaatacttcggatattcgatttgaatcggccagacgcacctccaaaagaagtcgggaattcccctggttcaattagaactgtcgaatggcttcatagtgataatacaatcttaagctcttgcacagataccggtgacattaggttatgggacataagaagtgacaagattgttcatacattagaaacaaagtccccagttactagtgctgaagtaagtcaggatgggcgatacatcactactgctgatggatctagtgttaagttttgggacgctaaaaattttggattgctgaagagctatgacatgccttgcaatgttgaatcggcatcgttggaaccgaaacacggtaacactttcattgctggaggagaagatatgtgggtgcacaggtttgatttccagactggagaagagattgggtgtaacaagggtcatcacgggccagtgcactgcgtgaggtatgcgccaggaggggagtcatacacctcaggctcagaagacggaacggtcagaatatgggtggtgggttcggtaaaccatcctgaggagagcaatctaagcggccacgtgaagcttgtggcagaggaggttgtgcgtaaagctgaaagtctccgtatcagtgagaaagccgcagaagctaaatga

SEQ ID NO: 511 - DNA, 3354 bp, Arabidopsis thaliana
atgattcgccggccgatctacgacttcgccgccgtttttcgccacttaacttctccgttatcgacatcctcgcgttttctgttctattcttcatctgaacatgaagctcgaaaaccgattgtctcgaaccctaaatccccaatcgggtctccgactcgggttcaaaagctcatagcttcgcaatcggatcctctcctcgccaaggagattttcgattatgcttctcaacagcccaatttccgccattctcgatcttctcatctaatcctcattctcaaactcggccgtggtagatatttcaatcttatcgacgacgttctcgccaaacacagatcaagtggttatccattaaccggagaaattttcacttatctgatcaaagtctacgcagaagcaaagttaccggagaaagtcttaagtacgttttacaaaatgctggagttcaatttcacgccgcagccaaaacatctgaatcggattctagatgttctcgtaagccatagaggttatctccagaaagcttttgagcttttcaagagttcacggcttcatggagtaatgcctaacacgagaagttacaatttattgatgcaagctttttgtttgaatgatgatttgagtattgcataccaactgtttggtaaaatgcttgagagagatgttgtccctgatgtggattcttataagattctgatacaagggttttgtaggaaaggtcaagtgaatggtgctatggaattacttgatgatatgttgaataaaggattcgtgcctgataggactttgattggaggattgtgtgatcaaggaatgtttgatgaagggaagaagtatctagaagagatgatatccaaagggttttctcctcatttctcggtttcaaattgtttggtaaaagggttttgtagcttcgggaaagtcgaagaagcttgtgatgttgtagaggttgtgatgaagaacggagaaacattgcattcagacacttgggagatggtaattccattaatctgtaatgaagatgagtcggagaagatcaaactgtttcttgaagatgctgtaaaggaagaaataaccggtgataccagaatcgttgatgtcggtatcggtttaggatcttacctttctaaaaataaaaaaatgccggagattgaacaagacgatgcagcggcggagacggtggattcctccaccgttaaattcggtacaccggaagcactggagtatgtacggtcgctcacggacgttggcgcaatgacacgtcttcttcacgaatgtatcgcttaccagcgaagcttagactcagatctcgacacgcttctatcgcagcggacggagcttgatcggaatctcgttcagcttcagagatcggcggagattctcgatatcgtgaaagcagatgcagatcacatgctcggaaatgttcgatcgacttgtgatctcgcggatcaagtcagtggcaaggtacgagagctcgatcttgctcaatctcgtgttaatgttactctctcccgcattgacgcgattgttgagcgagggaattgcatcgaaggcgtgaagactgctttggaatccgaggattacgaatctgctgcgaaatttgtacagagatttctccagattgatttgcagtacaaggattctggttccgatcagagcgaacagcttcacgcgtcgaaggagcagcttgaaggtattgcgaagaagaagctcttggcagcaatagaccagagagatcatcctacaattttgagattcgtgagactgtattccccactgggaatggagacagaaggtctacagctttacgttggttacttgaaaaaggtcattgcgttgagaggaaggatggaatatgaaaatgttgttgagctcatggagcaaggactcggacaggttaatttcgttgggtgcttaaccaatttgtttaaggatattgtcatggctattgaagaaaacgatgagatcttgaggggtctttgtggagaagatggtgttgcgtatgcgatttgtgaattgcaagaggaatgtgatttaagaggttcgttgatcttgaagaagtacatggactttagaaagttagctatattggcgtctgatattaacaattctcccaatctgaatattcttcccggtggtgcgtctgaaggaccagacccgagagaagttgagctgtatgtggaagagatactgtcactgatgcagttgggtgaggactataccgagttcatggtgtcaaaaatcaagtctttgacgtcggtagatcctgaattgttgccaacggctacaaaggcatttagaaataagagttttagcaaagcgattcaggatgtgacgagatattatgttatactagaagggttctttatggttgagaatgtgaggaaagctattaggatcgatgagcatgtacctgacagccttaccacttcaatggtggacgatgtgttctacgtgttgcagagttgtctgaggagagcgatttcaacttcaaacataagttctgtgattgctgtgttgagctatgctggtagcttgttgggcaatgattaccatgaagctctacaacagaagattagagagcctaaccttggtgctaggttgttcttgggtggtataggtgtggaaaacaccggaactgagattgcaactgctttgaacaatatggacgtgagctgcgagtacattctcaaactaaaacatgaaatcgaggagcaatgtactgaggtatttcctgcaccagcagatcgagagaggataaaatcatgtctatccgagctaggcgagttaagcagcacgttcaagcagttactcaactcaggcatggaacagctagtagcaaccgtaacaccaagaatccgtccggttctagacaccgtggctaccataagctacgagttaacagaaaccgagtacgcagagaatgaggtgaacgacccttgggtccaaagacttctccactcagtcgaaacaaatgccgcgtggctccaaccactaatgacatccaacaactacgactcgtttctgcatctcataattgatttcatagttaagagactcgaagtcataatgatgcagaaacggtttagccagcttggtgggcttcagcttgatcgagacacaagggctttggttagccatttctcgggtatgactcaaagaacagtgagagataagtttgctcggttaacgcagatggcgacgatactgaacttggaaaaggtctcagagattttggacttttggggagaaaactcaggacccatgacttggagactcacaccagctgaggttagacgggttttgggtctccgggtcgagttcaaacccgaatcaattgctgctctcaagttgtga

SEQ ID NO: 512 - DNA, 630 bp, Arabidopsis thaliana
atggaggtcaagttatggaatgataagcgtgagagagaaatgtatgagaatttcgcagagctttatgctatcatcaaagctactgagaagctcgagaaggcttatattcgtgatctaatctctccatctgaatacgaaaccgagtgccagaaactcattgttcacttcaagacattatctgcatctctcaaagatatggtcccaaacattgagagatttgcagagacgtacaagatggattgctcagctgcagtttatcgccttgtgacttctggtgttccagctactgtggagcatagagctgctgcttcggcttctacatcaagctctgcttctgttgttgctgagtgtgttcagaacttcatcacttccatggattctttgaaactcaacatggttgctgttgatcaggtgtatccgttgttgtctgatctctcggcttctcttaacaaactaagtatattgccaccagatttcgaggggaagattaagatgaaggaatggcttttgaggctgtcaaagatgggagcttcagatgaactcactgagcagcaggctcggcaacttcactttgatcttgagtcatcctataactcgttcatggctgctttgcctaatgctggtaattaa

SEQ ID NO: 513 - DNA, 1197 bp, Arabidopsis thaliana
atggttaaggaaacagagtactacgatgtgctcggagttagcccaactgctacagaatctgagattaagaaagcttactacataaaggcacgccaagttcatcctgataagaaccctaatgatcctcaagctgcacacaatttccaggtcttgggagaggcctatcaagtgctaagtgattcaggacaacgccaagcttatgatgcatgtggcaagtcaggaatctcaactgatgcaatcatcgatcctgctgcaatatttgcaatgctatttggcagcgaactttttgaagggtacataggacagcttgctatggcatctatggcttcacttgatatcttcacggaaggggatcagtttgataccaaaaagatacaagaaaaattgaggattgttcagaaagaaagagaagacaagcttgctcagattctgaaagaccgactcaacgaatatgtaataaacaaagacgaatttatcagtaatgctgaagctgaagtagcaagactctcaaatgcagcttatggtgtggatatgttgaatacaattgggtatatatatgtaagacaagcagcaaaagagctagggaagaaagctatttatctcggagtaccattcattgctgaatggtttaggaacaaaggtcacttcatcaaatctcaattaacagctgcaacaggcgcatatgcgttgttccagttgcaggaggaaatgaaaaggcagctaaatactgaaggaaattatactgaggaggaacttgaggaataccttcaggcccataaaagagtgatgattgattcactgtggaagctcaatgtcgctgatatcgaagccactctttgtcgtgtttgtcagctggttcttcaagatccagaagccaaaagagaggagcttcgtacaagagcaagaggtttaaaagctctggggaggatctttcagagagccaaaacagctagtgagagtgatcctttagaaaatagtgaacctcaaaagttaaacggaaatggaaagaaccacgatgaggatacttctacatcaccaaaatccagtgaagcatctcactccacctctggtcctcaggaaccacaaagcccctacgtggaagaattcaaacttggagatgaacaattcaactattacttcccacgaccagcgccacctcctggcgcagggaaatactcttcctctggctatgattga

SEQ ID NO: 514 - DNA, 516 bp, Arabidopsis thaliana
atggccgcaattacatcagctaccgtcaccatcccttctttcaccggcctaaagctcgccgtcagctcaaaacctaagacattatccaccatcagtagatccacttccgccaccagggcgccacctaagctcgctttgaagtcctctttgaaggatttcggtgtcatcgcagtggcaacagcagcttcgatcgttttagctggaaatgcgatggccatggaggttcttttaggatccgacgacggttcccttgctttcgtaccatctgaattcacggtggctaaaggagagaagatcgtgttcaagaacaacgcagggttcccacataacgtggtgttcgacgaagacgagatccctagtggtgtggacgcaagcaagatctcgatggatgagacagcgcttctaaatggtgcaggggagacttacgaggttactttgacagagccaggctcttacggtttctattgtgcgccgcaccagggtgctggtatggttgggaaactcaccgtcaagtaa

SEQ ID NO: 515 - DNA, 510 bp, Arabidopsis thaliana
atggggatatcgggttcaaagcgagttacgacgattctatctaactcgcccgagtttgactcggcttgtgactcagcatacgacgaatctctctctcttgcacagcatgctttcgccggagttcgtccttaccagctcgtctccgccgccgcccacatccaccggaatctttccgctcttcgtttccctctaatcaccagatggctctcttctcctccgagtcaatcccaagtcgactcagctctccgagtcaccgtctctcgagtcacggcggcggatgaggaggagatcctcgggcaagaggagttcaagaaatgggccgtcgaggttttcgcggaagccgttgtgggaaacgcgaggaagacaatagcgagtcggattccgttaggaatcgtcggaatcggtgggatcggcgccgtgactcggtcgggtcaaaacttgatcggagctgcgattggtgtgtacgcgataggagttgctacttccgtttttctaagcctcactgattag

SEQ ID NO: 516 - DNA, 312 bp, Arabidopsis thaliana
atggcatacgtcgaccatgcgttctcgatatcggacgaagacctaatgattgggacttcgtacaccgtcagtaatcgaccaccggtgaaggagatctcactcgcggtgggtctactcgtattcggaaccctaggaattgttttaggtttcttcatggcgtataaccgtgttggtggtgatcgaggtcacgggattttcttcattgtactgggatgtctactgtttatcccggggttttactatacacggattgcatattacgcttacaaaggatacaaaggtttctctttctcaaatataccatccgtttaa

SEQ ID NO: 517 - DNA, 618 bp, Arabidopsis thaliana
atgggagggaaaggaaaaaagaggagagagaaaaattacctagctgctcacggcggaccggcgagacttccgccgccgcctgatcgttcgaagcaagatgatgttccttctacgctccgtatcctcatgaactacacttctccttctccccatgattctactaaacaagtcgtagagaagaaggaaaagcttaagaaagctgaagtagttgttcctgcaacggagagtgatggagatgatagtgtggtggagaagaagaagaaaaagaggaagagaaatcaaatgacggatcttcgttttgaaaacgaacttgcagagattgatggtcggtctaaaaggaaagaacgcaagaagaagtattgggaggccaagaagcaaaagaagaataaaggaaagactgaagataccctccgtgaaaacttccccaagcatgaacagataagatttggtgatgttgtgcaagctccacttaagttggctgttgttccgaaggcaagaaagtctactctaagtgcttcccaggagaggctgcgattacaagccatcgatgcttacagatcacgcaagggatggaccgctagaccaggtgttccgattcctgccgtgatgatgcaataa

SEQ ID NO: 518 - DNA, 342 bp, Arabidopsis thaliana
atggctccaccacctccggcaccaccgtccgttacgttgaggacagtgctccttctccttagggttttgaccgcggctttcctcctcataacggtggtcctcatcagcaccaacaccgtcactctcgaaatttcaagcacgtctatcaaattgcctttcaacgatgtctatgcttatagatacatgctgtccgctgccgtcatcggactagtttacgccgttgtacaactgttcttaacaatctcccaatttgccaccggaaaaacacatcctcttacttatcagttcgatttctacggtgataaggtatttatatcatttttgaggaaatactatctttaa

SEQ ID NO: 519 - DNA, 426 bp, Arabidopsis thaliana
atggatcagtcatcatcaacgttgctcataaaccagagaaagtcatcatcgtctccgactaggatcccacctaagcagaagaggaagtcaacgactacgcacaaacccatcaaagtccgttacatatcaaatccgatgagagtcgagacttgtccttctaagttcagagagcttgttcaagaactcaccggtcaagacgccgctgatctaccaccgtcgcccaccacttttaccgccgtagatctccaccgtccgtgtgagtcggagatgaacttagagccgttggatggagaggtccgtggagagtattattcaccgttggatgaggaagtgtttaatgctcctcagatgtcggcaggtctttctggttttttctcgtctggattttacaatgttaacgctttaggaagcattggttctctctga

SEQ ID NO: 520 - DNA, 327 bp, Arabidopsis thaliana
atggactcatctttgtcgcagaagttcactcttgcttatgcttctctcctcggagttggtgggttgatgggttacctgaaacgcggaagcaaaatatcacttgtcgcaggaggaggttcagctgcgttgttctattatgtatacacggagctcccaggaaatccagtcttagcatcctccattggcattgtggggtcggcggcactgacagggatgatgggatcacgttacctaaggacgaggaaagtggtaccggctggacttgtgtcggtggtgtcactcgtcatgactggagcttacttgcacggcctcattcgctcaagttga

SEQ ID NO: 521 - DNA, 1902 bp, Arabidopsis thaliana
atgagtgcatcatgggctgatgtagctgactcagagaacacgggttctgggtcttctaatcagaattctcatccttcacgacctgcttatgttcctccacatctaaggaacaggccagcagcttctgagcctgttgctccattgccagctaatgatcgtgtaggttatggtggtccaccttctggctctcgatgggctcctggtggtagtggtgttggtgttggaggtggtggtggttatagggctgatgcaggtcgtcctggctctggctctggctatggtggacgaggaggtggtggttggaacaacagaagcggagggtgggaccgtagggaacgtgaagtaaacccctttgaaaatgatgattccgaaccagaaccagcttttactgagcaggataatacggttattaattttgatgcctatgaagatattccgattgagaccagtggggataatgtgcctcctcctgttaacacattcgcagagatagatctcggggaggcattgaatctaaatatccgtagatgcaaatatgttaagccaacacctgttcagcgtcatgcgattccgatattgcttgaagggagggatttgatggcctgtgctcagacagggtcggggaagacagctgctttttgctttccaatcattagtggaataatgaaagatcagcatgtacagagaccccgtggttcacgaacagtctaccctcttgcagttattctctcaccaacaagagagttggcaagtcagatacatgatgaggctaaaaagttctcttaccaaactggtgtgaaggtggttgttgcatatggaggaacacctattaaccagcagctccgggaacttgagaggggagtcgatattcttgtggcaacgcctggtcgattaaatgatttgctcgagagagctagagtctcaatgcagatgattagatttttagctcttgatgaggccgatagaatgcttgacatgggttttgaaccacaaattagaaagattgtcgaacaaatggacatgcctccacgtggagttagacagacactgttgtttagtgctacatttccaagagaaattcagagactcgcagctgacttcctagcaaattatatatttttggctgtgggtagagtgggttcaagtaccgatttaattgtccaaagggttgagtttgtccttgactctgacaaaagaagtcatctcatggacctgcttcacgctcagagagagaatggcatccaaggcaagcaagccctgaccttagtttttgtggagacaaagagaggagctgactctttggaaaattggttgtgcatcaatgggtttccagcaacctccattcacggtgacagaacacagcaggaaagagaagtggcattgaaagccttcaagagtgggagaacaccgattttggttgcaactgatgtagcagcacgtggccttgacattccccacgtggctcatgtggtcaacttcgatctgccaaatgacattgatgactatgtccaccgtattggacgaacaggacgtgctggcaaatcaggactagcaactgccttcttcaacgatggcaacacctcactggccagaccgctcgctgagctgatgcaagaagctaaccaagaagtccctgagtggctcactcggtatgcgtcacggtcctcttttggtggtggtaagaaccggcggtctggtggtcgatttggtggccgtgactttagaagggaagggtctttcggtagcggtagaggaggctatggcggtggaggaggagggtatggcggcggaggaggctatggtggtggaggaggctatggcggcggaggaggctatggtggtggatatggtggtgcttcaagtggtggatatggtggagaacctccaagtgcttgggactaa

SEQ ID NO: 522 - DNA, 660 bp, Arabidopsis thaliana
atgaataatcaaaatgaagacacagaaggtggtcgaaactgttgtacttgctgcttaagcttcatcttcacagctggtctcacctctcttttcttatggcttagtctccgtgcggacaaacccaaatgctcaatccaaaactttttcattcctgccctcggaaaagacccaaattcacgagacaataccactctaaatttcatggttcgttgtgacaatccgaataaagacaaaggaatctactacgacgatgtccaccttaatttttccaccatcaacacgaccaagatcaattcatctgctcttgtcttagttggtaactacacagtgcctaagttctatcaaggacacaagaagaaggccaagaagtggggtcaagtaaagccgctaaacaaccagacggttttacgagcggttttgcctaatggatcggctgttttcaggttggatctcaagactcaagttagattcaagattgttttttggaaaactaagaggtatggggttgaagttggagctgatgttgaagtcaacggtgatggagttaaagctcagaagaaaggaattaagatgaagaaatctgattcttcttttccattaagaagctcttttccgattagtgttttgatgaatttactcgtattctttgctattcgttaa

SEQ ID NO: 523 - DNA, 171 bp, Arabidopsis thaliana
atgcaacaagcccttcgaattttagaggtacggtctgcttattgtaaaaacgatttcgaatgggataatatgaagcgcctcgccttcaagaacgtagatgattccaacacaagactcatgcgcgagtacgtcttggagactagccatgtcgaaaccgattctgataagtga

SEQ ID NO: 524 - DNA, 1416 bp, Arabidopsis thaliana
atgaagaagaacaacaaatacaataagaaatcaacatctttgcattgcaatgatgcaggaggttgcagatattcattgcttactattgtttggaccgtcgtcgggtttttcctggtggctcatcttatctctctgtatagcagaaaagataacaacatccatcaacaagtttcttcagatcagttacaagtagtacatcatcttgctcatcctattgttcgtgaacttataagagttgaagaagaggtcctgagaatgccgccacctaggaagcgttctcctcgtactagtaaacggagatcaagaaaaccgatccctctcgttgaggagtttcttgacgacaagtcaccaattcgacatcttttctttcccggtatcaaaaccgccgcttttggtcccaccaaggatatgggaaacgagacatcgtattacttccccgggaaaatttggatggacacacaagggaatccaattcaagcacatggcggagggattctgcttgacgtgaaatctaacacttactattggtatggagagtataaagatggaccaacttaccatgctcacaagaaaggaccagctagagttgatattattggtgttggttgttactcttcaaaggacttatggacatggaaaaatgaaggcattgtactcggagctgaggaaacaaacaagacccatgatttgcataaatccaatgttcttgaacgacccaaagtgatctacaatgaaaagacagaaaagtatgtgatgtggatgcatatcgacgatgcaaactacactaaagcttcagttggtgtggccattagcaatagcccgacaggtcctttcgagtatctatacagtaaacgtccacacgggttcgatagtcgggacatgactgtcttcaaagacgacgatggtgttgcttacctgatatattcgtctgaagtcaatagtgtgcttcatattggacccttgacggaagattacctcgatgtgacaccggttatgaagagagtaatggtgggacaacacagggaagctccagctatcttcaagcatcagaatatttattacatggtcacttcctggtgcactggttgggcaccaaatgaagccttggctcatgcggctgaatctataatgggtccatgggagaaattggggaacccgtgtatcggtggtaacaaagttttccggttaacaacattctttgcgcagagcacttatgtgattcctttacctggtgttcccggtgcgtttatattcatggcagataggtggaacccggctgatttgcgggattccagatacgtgtggttaccgttagttataggtggacctgctgaccagcctttggagttcaacttcgggttcccatcgtggtccagagtgtccatctactggcacagtaaatggcggctgccttaa

SEQ ID NO: 525 - DNA, 393 bp, Arabidopsis thaliana
atggcgtcaccaaagtcacccacaagaccaacccaacaaaacccacaacccaatttccacgattttcttcctaccatggccggaaacctaggcggtgaaggtctgatcggagagctatgcaacggcttcgagcttttgatggacagagagaaaggtgtcatcacgttcgagagtctccgacgtaacgctgcggcggttctgggtttaggagatttgactgatgaagatgtccggtgtatgattaaagaaggtgattttgactgcgacggtgcgttgaatcagatggagttttgtgtgttgatgtttaggcttagccctgatttgatggaagcgtcgcggtgtctcgtcacggaggtcattgaggaggagtttggcttcacgcgccggcattga

SEQ ID NO: 526 - DNA, 1002 bp, Arabidopsis thaliana
atggagacgaatccgtgtgacatgaatcagctcgattccgattcgcatctccctcctcgaaaacgattacttgctggattcaagaaatttaactccaacggcattaatggatcttctccttcagatttcgcttcttcttcctctacttcaaactcaaacggatcttcctctgcttccaccaatgttcagacccatctcggcaacttgttatcttctcctttcaacaatgaccagtcacctgaagagctcgtggaggcaacgagatctgcagctgctttagcggttaaagctgcaaaggctgcgagagctattgctaacgagaaggctttgatttccgctaaggcgattgctgcggctaagagggcattggaattggttgattcttttcctaaagaagcaatggctgattgcaaggagaggtctcctaggaagaacaagcagaagaaacatgtccccgtcgagctcttgtattcaaaggggcagctaagagacgaggaagatgatttagcgcgtaggttgcatcgagctatagacaatacgtcgtatcctagagtcttgagaactagcgaggagaatggtcagagatacaagaagcagaagaagaacaagagcgtagttgaaggtgggagtagtagtattatagtgaccggttctatgaaagacattgctggagttgtggattcagacagctcctatgaaggattagagatagctagatcaaacagggatgaagcggattcgatgctgatgatggagaaatcaggggaagaaagcaactcattggttaaaagaagaggaagagtgaagctaaagaagcttcctttgagcatttgtaattctagaaatcaagaaaacggaacttcctccgcgtctccattaccggtggctcagccgcaggaagacggtggtgcgatcacggtcatagcaggatcgtcgtcttggaaatgccaggacataaaggcaccagaatgtgtgaagcagaacaaagccgtacggtcatag

SEQ ID NO: 527 - DNA, 513 bp, Arabidopsis thaliana
atggatcatgatcacatgcatggaatgcctcgaccatcatcatcatcatcatcatcaccatcatccatgatgaacaatggatccatgaacgaaggaggaggacatcaccacatgaagatgatgatgcacatgaccttcttttggggcaagaacacggaggttctcttctccggttggcccggaacaagctccggcatgtatgctctttgtcttatctttgtcttctttctcgccgtcctcaccgaatggcttgctcattcctctctcctccgtggctccaccggagattcggctaatcgtgccgccgggttaatccaaaccgccgtgtataccctccgtatcggcctcgcctatctagtcatgctcgccgtcatgtcgtttaacgccggtgtgtttctcgtcgctctggccggtcatgccgttggtttcatgttgttcggaagccaaactttccggaatacctccgatgaccggaaaactaactatgttcctccctcaggttgtgcttgttga

SEQ ID NO: 528 - DNA, 795 bp, Arabidopsis thaliana
atggaggaagagagagtggccgtgaccggagtaggaacgactcgatacgcgcttaaaccggggcgtataaaaagcgaggacatactcatctgtatcgatgtagatgcagaatcgatggtggagatgaagaccactggaactaatggtaggcctttgatcaggatggagtgcgtcaagcaagccattattctcttcattcacaataagctgtccattaatcctgatcatcgctttgctttcgctacgctcgccaaatcagccgcttggcttaaaaaggagttcacaagtgatgctgaatctgctgttgcttcccttagaggattgtcaggtaataaatcctctagtcgagcggatctcacacttctcttccgagcagcagctcaggaagccaaagtttccagagcacagaaccgaattttcagggtgattctcatatactgtaggtcatctatgagaccaacccatgagtggcccttaaaccagaagctcttcacgttggatgttatgtacctgcacgacaagccaagtcctgataattgtccacaagatgtgtatgactctcttgtcgatgcagtagaacatgtttcagagtatgaaggttacatatttgagagcggtcaagggcttgcacggtctgttttcaagccaatgtcaatgctgttaactcatcctcaacaaagatgtgctcaagatgatcttgacatccccatgtctcttgcaaagaaagtgcctgtgactgaggcggcaagtgctgtagatcctcacaatgggaacaatattcagatcataaactaa

SEQ ID NO: 529 - DNA, 447 bp, Arabidopsis thaliana
atggctggtgtccagactctcgaattagagatccaagtgaatatgaccgccgagagattcttcaagactttcaagaagaaagaaggaaatttcacggacaagacagaggcagtttatgttcatcgtgacgatcccacatccaactcctctattcagatctggaatttcatcgttgatggaaaaatggagcagatcaaagagaagatagacgtagatgaagagaacaagtcggtgtctttcttagctcttgaaggagatgtgttaaagcaatataagagctataagataacacttgacgttgttcctaaggatcataaagtttgtattgcaaagtggacatgggaatacgagaagttaaatgacgacgttcctccccctaccagatacactgcgttcgttgaagattacacacgcgacctcgagactagattgttgtctgaatcatga

SEQ ID NO: 530 - DNA, 513 bp, Arabidopsis thaliana
atgttaaaagaccaagcgaatcaattggagtttcctcgtgattttctagggatttcacttgcggatcagccgaataagtactatttcattatcaggacgcagaggattgtcttggaagctgattcttcgattcagttgattatggagaagcttcagtcttataaatctaaagtggctctttactttgatgggtttcagtatcagcttggtgattttaggttgagagttggtaaagttgttcctactcattctgagaatgttagaggcattgtcatggaggtggagtatcttcctatatcatcaatggaaaaggcacaaaaggtgatggaggagttcttggagatatggaatgaagctctggctaaaaggtcgttgccgggtaagtttgtgaacatagatctcaactttggggagtttggacttggagacatctacactccacaacacacagctgttcgttacgctctcgtgatggctcacatgattgctaccgttcaagctgtgagaggctaa

SEQ ID NO: 531 - DNA, 186 bp, Arabidopsis thaliana
atgtgcatgcacacggtggtgctgaatcggagaacgctgctgtgtacgaggaaggacagtcgtcggagtctattactaacgccggaaactctaccggagcgcctgttgactccgagagctccgacacttcccttaggctcggcttaccgtatggtggttagagatggaacaattcaaagaagttga

SEQ ID NO: 532 - DNA, 717 bp, Arabidopsis thaliana
atgttatcgaagatcaaccacaagaattttgcaaaccttcttggttattgtgaagaaaaggaacctttcaccaggatcttgatctttgagtatgctccaaatggatcactctttgagcatttacattataaagaatcagaacacttggattggggaatgcggttaagaattgcaatgggattagcatattgccttgaccatatgcaccaactcaatccacctatagctcacaccaatctcgtctcatcatctcttcagctcacagaggattatgctgtcaaagtatcagatttcagtttcggttcatctgagacagagactaacatcaacaacaacacagtcatagacacacacatctcagccttgaatccagaagacaacatttacagctttggtttactgttattcgaaatgataaccgggaaactcatagaatccgttaacaaacctgactcagtagatagctcgctggttgatttcttaagaggagagactctagccaaaatggtagatccaacactggaatcttatgatgccaagattgagaatataggtgaagtgatcaaatcatgccttaggactgacccgaaagagagacctacaatgcaagaagtcacaggatggttacgggagatcacgggattgtcaccgaacgatgctacaccgaaattgtcacctctttggtgggcagagttggaggttttgtccacggcgtaa

SEQ ID NO: 533 - DNA, 1014 bp, Arabidopsis thaliana
atggcaaccgtcgatgtcatcaacggtgattcaatctcaactcttcattctgacataatccaaacccaaatcttgacccgactcgatggtccgacgctagcctccaccgcaacaacctcttcttacctccaaactctatgcacggaagagaaactctggcaagaactctccatcgacacgtggccttcgatcaatgatccacgtgttgtccaagctatctcctctttcccttccggttaccgttctttctttgctgactcgtacccgttcactgaacacacgtggcagtctgaaaaacatgatccaccgacgggattaatctcagccgttgatttatactacagaggagagattatatactcgaaggtacaagagatggaaacagagaaaggtaaatcaggatggttcttgtcatcaccgtttcgggtcgatatactcgacccgaaagagtcggtccaaacccggattcgatatccgggtggggactacgaagcgtgggtgaaagatatggaagagagcatgaaacttaattggatactaatcgatccgatcaagaaacgagcggcgaatatatctagtcgaaaggcggtgtcggcgcggcggaactggctaacgggggatttagaaatacggttttcaacggtagtgacggcggaggcggcggaagtggcggcggttgtgtcatgcgggtcagcggaagcgtggaaagaggtggatgaggaagtgggaggagaaatacacgtgagggacgtgaggctacaagtagaggacatagaaggaaaatgtatgaaaggtagggatagtttggtaattttacaagggttgttagatggaaagagatcgtgtaaagatgatgaagagagaagagctaaagaaaggtatgaagaatacgtgcgaatgaagatacaatggagagagaataaagagaggagagaaaaagctcaagacacaatttgtatgatctttgggttctctatgtttgtgcttttgtggagttttattttgttaaggtaa

SEQ ID NO: 534 - DNA, 1821 bp, Arabidopsis thaliana
atggctcttcggctaccagcttctaaagcagctgaagttgcgattggatctattggctgtggttatgatctagctattgatttacggttgaagtattgcaaaggaggttccaaagattctagattacttgacattaaagaaggtgatgataattgtgagattgttttacctggtggaatctccattcctaatgtttccaagtctatcaaatgcgataaaggggagcgtatgcggtttaggtccgatattcttcctttccaacagatggcagagcagttcaaccaggaactatctttggctgggaaaatcccgtcaggtctcttcaatgccatgtttgaattctcgagctgttggcagaaagacgcagcctacaccaaaaaccttgcttttgatggggttttcatctcattatactcggtggctttggacaaatctcaagtgttactccgtgagcatgttaagcaggctgttccatcaacatgggaccctgctgcattggcaaggtttatagatatttatgggacgcatataattgttagtgttaagatgggaggaaaagatgtgatttatgcaaaacaacaacactcctcaaaacttcagcctgaggatctgcagaaaaggttaaaagaggtggcagataagaggttcgtggaagctagcgtagtgcataatacgggttcagaaagagtacaagcaagtagtaaggtggaaacaaaggagcaacgcctgagatttgcagataccagttctttgggctcttatgcaaataaggaggactatgtcttcatgtgcaagaggcgaggtggaaacgataacagaaatctaatgcataatgaatggctgcaaacagttcagatggagcctgatgttatctccatgtcttttattccaattacgtctttgcttaatggagttccaggaagtggattcttaagccatgccataaatctgtatctaagatataagccaccaattgaagagctgcatcagtttctcgagtttcagctaccaaggcagtgggcacccgtttttagtgaacttcctcttggtccgcaacgaaagcaacaaagttgtgcgtctctgcaattcagtttctttggacctaagctatacgtgaataccactccggttgatgttggtaagaggccaatcactggcatgcggctctacctagagggtagaagaagcaaccgtttggcaattcatttgcaacacctttcctctcttcccaagatatatcagctcgaagacgatctaaatagaagtatccggcaagagtctcatgaccgtcgatactatgagaaagtaaactggaagaactactctcacgtctgcacagagcctgtcgaatcagatgatgatctttctgtagtaacaggtgcgcagcttcatgtagagagccacggattcaagaacgtgctcttcttgcgcctttgtttctctagagttgtgggagcaacactggtaaagaattctgaatgggatgaagcggtaggctttgctccaaaatcaggactcatctcaacgctaataagccatcacttcactgcagcacaaaaaccaccaccacgacctgcagacgtgaatataaattcggctatatatcctggtggaccaccagtacccacgcaagctccaaaacttttgaaatttgtggatacaagtgagatgacaagagggccgcaagaatcacccgggtattgggttgtatcgggtgcaagattattggtggagaaaggcaaaatctcattgaaggtgaagtattctctatttactccaatattgggagatgaagtgatcgaggaagcctatgaaggttaa

SEQ ID NO: 535 - DNA, 954 bp, Arabidopsis thaliana
atgtcaaaaacggctaattttctcagcctgagatccaatcctctacctccgattttctcctccaccggaaactctcctttcctccgagcttcctcggctctgaatcttccgacaactgcttcgaaacctttccacagttggattcgtgcttcttcacgtcgccggttggttctcggtggttttggcggcgcttctttgtggatgaacaacaatatgtccggtaaatttggcggtaaatctttcattgcttccgctaggcagaccaatccttctcccgtcgaacaggcgttgaataaggtggattggccagagactttccctttcaaagaagaagatttccagagatacgatgagtcgtctgattcaacattctacgaagctccaaggtttgtgacacacattgatgatccagctatagctgcattgacaaagtattactccaaggttttgcctcagagcgatactccaggagtgagcatactcgatatgtgtagcagttgggtcagtcattatccaccggggtataggcaagaacgaatagttggaatgggtatgaatgaagaagagcttaagcgaaatccggttctcaccgagtacatagtccaagacttaaatctcaattcaaatctgccttttgaagacaattctttccaagttataaccaatgtggtaagtgtggattatcttacaaagccgcttgaagtgttcaaggaaatgaacagaatccttaagcccggaggactcgctctaatgagcttctcgaaccgttgcttctttactaaagcaatctcgatatggacatcaactggcgacgcagatcatgctctcattgttggatcatactttcactacgccggaggatttgaagctcctcaggccgttgatatatctccaaatccagggcgttcagatcctatgtacgttgtttactctagaaaactccccatggtttaa

SEQ ID NO: 536 - DNA, 933 bp, Arabidopsis thaliana
atggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgagccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtag

SEQ ID NO: 537 - DNA, 966 bp, Arabidopsis thaliana
atgaaactcgcaggtctgaaatcgatcgagaacgctcacgaagattccgtttgggcagcgacgtgggttccggcgacggaagatcgaccggcgttgcttctgactggatctcttgacgagacggtgaagttatggcgaccggacgagctggatcttgtgcggactaatactggacactctttgggagtagcagctttggctgcgcatccttctgggattattgcagcatcttcttcgattgatagctttgtccgtgtgtttgatgttgatactaatgctacgattgctgttttggaagctcctccttctgaggtttggggaatgcaatttgaacctaagggtacgatccttgctgttgcaggtggaagtagtgcctcagtcaagctttgggacactgcaagctggagattaatctcaactctatcaatcccacgcccagatgcaccaaaaccttccgataaaaccagcagcaagaaattcgttctctcggtggcttggtctcctaatgggaaacgacttgcttgtggttcaatggatggtacgatctgtgtttttgatgttgaccgctcaaagctacttcaccagctagaaggtcacaatatgcctgtaaggtcccttgtgttctcccctgtagacccgagagtcctcttctctggatcagatgatgggcatgtgaacatgcacgatgcagaagggaaaacgctgttggggtccatgtcagggcacacgagttgggtgctgagcgttgatgctagcccagacggtggagccatagcaaccggctcaagcgatagaactgtgaggctatgggatcttaaaatgagagctgcgattcagacaatgagcaaccacaatgaccaggtttggtctgtggcctttagaccaccaggtggaaccggtgtccgggctggtcgacttgctagtgtctctgatgacaagagtgtatcgctctatgattactcatga

SEQ ID NO: 538 - DNA, 1395 bp, Arabidopsis thaliana
atgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaagtatatttatcttgggctgttcgacagcgaagtagaagctgcaagggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaa

SEQ ID NO: 539 - DNA, 663 bp, Arabidopsis thaliana
atgcagaagctggcaaaggaattgggtgtagtgatacctgttagtttctttgaggaggcaaatactgcacattacaattcgattgctataattgatgctgatggaactgacttgggaatttataggaagtctcatattcctgatggacctggttatcaagagaagttttatttcaatcctggagatactggctttaaggttttccagacgaagtttgctaaaattggagtggctatatgttgggatcagtggtttcctgaggcagctcgagctatggttctacagggtgctgaaatactgttttatcccactgctattggttctgaacctcaagaccagggattggattcgcgtgatcattggaggagagttatgcaagggcatgctggagctaacgtggtacctctagtagcctcaaatcgcatagggaaggaaataattgaaactgagcatggacctagtcagatcactttctacggaacttccttcattgccggaccaacaggtgaaattgtggccgaggcagatgataaatcggaagctgttcttgtagcacagtttgatcttgatatgatcaagtcgaaaaggcaaagctggggagtgttccgtgaccgtcgtccagatttgtacaaggtgcttcttactatggatggtaatctctaa

SEQ ID NO: 540 - DNA, 1443 bp, Arabidopsis thaliana
atggtgtccacgagcaagatcaaatccgttgatttctataggaaaatcccgagggatttgacagaggcgtctctgtctggtgctggattgtccattatagcagccctctctatgatatttctatttggaatggagttgaataattatttggctgtcagcacttccacatcggtcattgttgacaggagcgctgacggagacttcttgcgcttagattttaatataagcttcccgtcactttcatgtgaattcgcatctgtggatgtcagtgatgtattaggaactaacaggctaaatgtaacaaagacaattcggaagttttctattgattcgaatatgagacccactggttctgagtttcatgccggggaagttttatcactcattaatcatggagatgaaactggtgaagaaatagttgaagattcggtaccacttactggacgcaactttgacacatttacacatcaatttccaatcttggttgttaatttctatgctccgtggtgctattggtgtaatctcctgaaaccatcatgggagaaagcagctaaacagataaaagagagatatgatccagaaatggacggacgtgttattttggcaaaagttgactgcacccaagaaggtgatctctgtcggaggaatcatatacaagggtatccatccattcgcattttccgcaaaggcagtgatcttaaggatgacaatgcacaccacgaccatgaatcctactatggagatcgtgatacggaaagcttagtgaagatggtggtgagtctggttgaaccaattcatctagagccccataatctagcattggaggacaaatcagacaattcatcgagaactctaaaaaaggcaccttctacaggaggatgtcgagttgaaggatacatgcgtgtgaagaaggttccaggcaatttaatggtttcagctcgctcgggatctcattcctttgattcttctcagatgaatatgtcacatgttgttaaccatctatcctttgggcggaggattatgcctcagaaattttcggagtttaagcgcttgtcaccttatctcggcctaagccacgaccgtttagacggccggtccttcataaaccaacgagatctcggcccaaacgttaccattgagcattatcttcaaatagtaaagactgaggtagtgaaaagcaatggacaggcattggttgaggcgtatgagtacacagcacatagcagcgttgctcatagttactatttaccagtggccaagtttcactttgagctctcaccgatgcaggttctcataacggaaaactccaagtccttctcacatttcatcaccaacgtatgcgccattattggtggtgtcttcacggtggccggaatcttggattctattctccatcactccatgacactcatgaaaaagatagaacttggtaaaaacttctga

SEQ ID NO: 541 - DNA, 1083 bp, Arabidopsis thaliana
atggcgtcgatgatgtttaccgattgctcctccaccacgacgtcgcgtctcatccatttgaaccgaagcagcggtactttcctcctccgtcaatgcgtcggccaactccgtttacagaccactgcttctggccgtggctgctgcattcgctcctcttcttctcccatttcttccatttccgctgatacaaaatcagagggtggcgcaattgtaatagatggaaaggctgtggcaaaaaagattagagatgaaatcacaattgaagtttcaagaatgaaggaatcaattggtgtgattcctggtttagcagtaatccttgttggtgacagaaaagattctgcaacttatgtgaggaacaagaagaaagcttgtgactccgttggaatcaaatcgttcgaagttcgtctagctgaagattcatcagaagaagaggtgttgaaatctgtatcaggattcaatgatgatccttctgtccatggaatccttgttcagttgcctctgccatcgcatatggatgaacagaacatactgaatgcggttagtatagagaaagatgttgacggatttcatccgctaaatattggacggcttgccatgcgtggaagagaacccttattcgttccttgtactccaaaaggatgcattgagttgttgcatagatacaacattgaaatcaaaggaaagagagcggttgttatcggaaggagtaacattgtcggtatgccagctgctcttttactgcagagggaggatgcaaccgttagcattatccattcaagaaccaagaaccctgaagaaatcacaagagaagctgatattataatctcagctgttggacagccaaacatggtcagaggaagctggataaaaccgggcgcagtcctcatcgatgttgggattaatcctgttgaggatccaagtgctgcgcgtggatatcgattggttggagacatttgctacgaggaggctagcaaagttgcatcagccatcacacctgttcctggcggtgtaggaccaatgaccatagccatgcttctatccaacactttaacatcagctaagaggattcacaacttccagtga

SEQ ID NO: 542 - DNA, 1047 bp, Arabidopsis thaliana
atgggagttgattattacaaggttttacaggttgatagaagcgctaacgacgatgaccttaagaaagcttatagaaaactcgctatgaaatggcatcctgataagaaccctaacaacaaaaaagacgctgaggctaagttcaagcagatctctgaggcctacgatgttcttagcgatcctcaaaagagagctgtatatgatcaatacggtgaggaagggttaaaagggaatgtgccacctcccaatgctgctactagtggagcatcctacttctcaacaggagatggatcttcgtctttcagattcaacccgagaagtgcagatgatatattcgctgagtttttcgggttctcgaccccgtttggtggcggtggtggtggcactggagggcagagattcgctagccgcatgtttggtgatgatatgtatgcctcgtttggtgaaggagcaggtggaggaggagctatgcatcatcatcaccatcatcatcatcacgctgcagctaggaaagtggctcctatcgagaacaagttgccttgtagccttgaagatctctacaaaggaaccaccaagaagatgaagatctccagggagattgtagatgtcagcggtaaggcaatgcaagtggaagagattctaacgattggagtgaaacccgggtggaagaaaggcacaaagatcacattcccagagaaaggcaatgagcatccaggtgtgattccagcggatctagtcttcatcattgacgagaaaccccatccagtgtttacccgtgagggcaacgacctgattgtcacacagaaagtctcactagctgatgccttaacaggctacaccgcaaacatagcgacccttgatggccgtacacttacaatcccgatcacaaatgtgatccatccagagtatgaagaggtggttcctaaagagggaatgccactccagaaagatcagacaaagaaagggaacttaaggatcaagttcaatatcaagtttccagcgagattaactgcggaacagaaagctgggtttaagaagcttattgggtga

SEQ ID NO: 543 - DNA, 648 bp, Arabidopsis thaliana
atgaagcttgtggagaagacgactactacagagcaggacaatggagaagatttctgccgcaccatcatcgaggtttccgaggttaacagaaacgtgtttcaggctccgggcggtgaagctgatccctttcgagttgtctccggcgaagaacttcacctaattccgccgctcaacttctccatggtcgataacggtatattccggtctggattccctgattcagctaacttctcctttctccagactctcggtctccgctcaatcatatacttgtgcccggagccctacccagagagcaatctccagttccttaaatccaatggaatcaggcttttccagtttggtattgaaggcaacaaggagccatttgtgaatattccagaccataaaatccgcatggcactgaaagtgcttctagatgagaaaaaccatcctgttctgattcattgtaagcgaggcaagcatcggaccggttgtcttgttggttgcttgaggaagctccagaaatggtgtttgacatcgatattcgacgagtaccaacgatttgcagcagcgaaagctagagtttcagatcaaagattcatggagatattcgatgtttccagcttcagtcatattccaatgtcattctcttgttccatcaggtaa

SEQ ID NO: 544 - DNA, 129 bp, Arabidopsis thaliana
atgatcatgagagatcataaagaggaaggtaacgaagaagacgggttctatggaggaatccgaaagctaaattgtaaagaagagattgcaatgtggaaacgtcactggccttgctccatcttggaatag

SEQ ID NO: 545 - DNA, 312 bp, Arabidopsis thaliana
atgtcaggaagaggaaaaggaggaaaagggttaggcaaaggaggagcaaagagacacagaaaggttctaagagacaacattcaaggaatcacaaagccagcgattcgtcgtcttgctcgtagaggaggtgtgaagagaatcagtggattgatctatgaagaaacgagaggtgtgttgaagatttttctggagaatgtgattagagatgctgttacttacactgagcatgcgaggaggaagacggtgactgctatggatgttgtttatgccttgaagagacaaggaagaactctatatggatttggtggttga

SEQ ID NO: 546 - DNA, 1218 bp, Arabidopsis thaliana
atggcgaaaaaagaaggttcaaagatgaacatcgccattatacatccagatcttggaataggcggagcagagagattgattgttgatgcggccgttgagcttgcctcgcacggtcataaagttcatatcttcacctctcaccacgacaaatccagatgcttcgaggaaactctttccggtatctttcaagttacggtgtatggatctttcctgccacggcatattttctaccgactacacgcagtgtgtgcatatttgcggtgcttgtttgttgctctctgtgttcttttgggttggtcttcattcgatgttgtactagcagaccaagtttcagtcgtagtcccattgctgaaactcaaaaggtcatctaaggttgttttctactgccatttcccggatctcttgctagctaagcatacaacaacacttagacggatgtatcggaaacccattgatttcattgaagaacaaacaacagggatggctgatatgatccttgttaacagtaacttcacggcatcaacatttgccaatacatttaaaaggctaaatgcacaagggagtcgcccagctgtactttaccccgcagtcaatattgatcagttcattgaaccccacacttataagttgaatttcctctccataaaccgctttgagaggaaaaagaacatcgatctagctgtttcagcttttgctatcctatgcaaacataagcaaaatctgagtgatgttacccttaccgttgcaggcaagtgtggatatgacgagcgattgaaggagaatgttgagtacttggaggagctcagaagtttagccgagaaagaaggagtttctgatcgagttaactttatcacatcttgttcaaccgctgaaagaaatgaacttctctcaagctgcttgtgcgttctctacacccccacggatgaacattttggtattgttccattagaagcaatggctgcatacaaacccgtgatagcctgcaacagtggtggccccgtggagacggtaaagaatggagtaacaggctatctttgtgaaccaactccagaagatttcagttcggcgatggctagattcatcgagaatcctgagttggcgaatagaatgggagctgaagccaggaaccatgtcgttgaatcattctctgtgaagacgtttggacagaagttgaatcagtatctcgttgatgtcgtatcaagtcctaaagaagattga

SEQ ID NO: 547 - DNA, 735 bp, Arabidopsis thaliana
atggcggatggaaacgccagttcgcgttacgtgaaattgaggaaagagcaggctcctgtcgaagaagatatcacacccggtgaactcaatcagcccattgatgttcctcagttgaatgtccgcaagtgccatgaatgtatgcaagttctacctgaaacctatgaacctccttctgatgaaaactggaccaccggcatttttggttgtgctgaagatccagagagctgcaggactggtctcttttgtccgtgtgttctgtttgggcgtaacattgaagctgtgagggaagagattccttggacccaaccatgtgtatgccatgctgtatgtgtcgaaggaggtatggcacttgcagcagtaaccgcactcttcagtggctacattgatccacaaacaacagttgtgatctgcgaaggcctcttctttgcttggtggatgtgtggaatctattcaggcttgttccgccaagaactccagaagaaatatcatctcaagaatgcgccttgtgatcattgcatggttcactgttgcttgcactggtgtgctttgtgccaggaacacagggagatgaagaatcatctttctgatacagaagcctcatcatcaactactatggatcctcccccagttcaagagatgaacactgaggagagaagagacgcttcatcttcttcgtcctcatccccatcatctgccaaaagccaacacaatgatctcgagatggtccctctatag

SEQ ID NO: 548 - DNA, 1611 bp, Arabidopsis thaliana
atggcttatcgtcaaattttggccatagttttgtttctttgtgtgtttcaattcttggactgcactgttagctccgccgtagaagagaatgggactgtgtttgtgtacggaagagccgccgttggaacaatagatgaagacttcatttgcgccaccttagactggtggccaccggagaaatgtgactacggcagttgtagttgggaccatgcttcaattctcaatctggatttgaccattgttgttccaatttccaaaaacacagcatttgctccgttgaaaataagaataggaggaacattacaagacatagtgatatatgagacaccagattcgaagcaaccatgtcttccttttaccaaaaactcttcaattctttttggttacacacaaggatgtctacctatgcgtcgatgggacgagctcaatgccttctttcgcaaaaccggaactaaagtcatcttcgggctgaatgcactttctggacgttccataaaatctaacggtgaagccataggagcctggaattacaccaatgctgaatcgttcatccggtttacagcagagaacaattacaccatcgacgggtgggagctcggcaatgagctgtgtggaagtggtgttggtgcacgagttggtgcaaatcaatatgctatagacaccataaatctgcgaaacattgtgaaccgggtttacaagaatgtgagtcccatgccgttggtgataggtccgggtggcttctttgaagttgattggttcacagaatacctgaacaaagcagaaaactctctcaatgctactactcgacatatctacgatctcggtccaggagtcgatgaacatctgatagaaaagattctaaacccttcatatctggaccaagaggcaaaaagttttcgcagtctcaagaacataatcaaaaactcctcaacaaaggctgtggcatgggttggtgagtccggtggtgcctacaacagtgggcggaatcttgtctctaatgctttcgtgtatagtttctggtacctggaccagcttggtatggcatcgctttatgatacaaaaacatactgtagacagtctctgatcggaggaaactatgggctgctaaatactactaacttcacaccaaatccagactattacagtgctctgatctggcgacaacttatgggaagaaaggcattgttcacaaccttttccggaaccaaaaagatacgttcgtacacccattgtgcaagacaatcgaaagggatcacagttttactgatgaaccttgacaatactacaacggttgtagcgaaagtagagttaaataacagtttcagtctgagacatacaaagcacatgaagtcttataaaagagcaagttcccaactttttgggggtcctaatggagtaatccaaagagaagagtaccatttgacagcaaaggatggaaacctacacagtcagactatgctactcaacggaaatgctcttcaggttaattcgatgggtgatttacctcctatagagccgatacatataaattcaacagagccaataacaatagctccatattccattgtgtttgtgcatatgcggaatgttgttgtacctgcatgtgcttaa

SEQ ID NO: 549 - DNA, 753 bp, Arabidopsis thaliana
atggtgatgtgggtctttggctatggctctcttgtgtggaacccaggatttcactacgatgagaaagtgttaggtttcatcaagggatataaacgtgtctttgatcttgcttgcattgatcatagaggtacaccagaacaccctgcaagaacttgcaccctcgagaaagctgaagaagccatatgctggggtactgcattctgtgtccgtggaggaccagaaaaagaacgtctggctatggaggaagatgatcctctaaagccagctgtaactggagtgatagtattcacttctactcctgacaaggtctccaacaagtattatctcggacctgcgccattagaagacatggcaagattcttgtcctcacacttagctgttattttgtatattcaaagacaaatcgcgacagccaatggaccatgtggtaacaacagagattatctcttcctgctcgagaaggcaatgcacgacattggctttgtagtcaaaggttctgaccttgatggttttaagagagacattgtttttgatgtgttaagccattttttatttcacacagggcatgaggaggactatgttatagagctggcaaacgaggtgaggaaggttctggccgagtcctcgactaagaaggtgacaccggtgaaggaatcaagagcaagccgtgtagctaacaagtcgaagaacaatgtccccacggctcatcagatactacctcatcatccagaagctgttgccactacaatataa

SEQ ID NO: 550 - DNA, 1536 bp, Arabidopsis thaliana
atgatgatgcgtgctgttataaggagagctgccagtaatggctcttctccttcgttattcgcaaaatcactgcagtcttctcgtgttgctgcatcttcccctagcttgctatcaggttcagaaacagggatttctatgtatctgcttattttcgatgaacaatctaataaagttttatttgagaatctgaacaggcatatctgcatcgtggaaatcatgctcatagctttcataaccttgctttgccagtttcttaagatttttgtgctcttattttgtttgtatcccactagcagggaactcgggcatctcgaggtcggcgagtttagtttcttcaaccctgcaaagatgggagataccgtggaagcagttgtgcctcatatgggggaatcaattactgatggcaccttggccacctttctgaagaaacctggtgagagagtccaggctgatgaggctattgcacaaattgaaactgataaggtgacaatagatattgctagcccagcaagtggtgtaatccaagaggtaaatatgtttgctctttgtgttgtttattcagtcgttattgttgttctctttctgtttctagtcaacgaaggagatactgtagaaccaggaaccaaggtcgctattatatcaaagtctgaggatactgcatctcaggttaccccctctcagaagataccagagacaactgataccaaaccttctcctcctgctgaagataagcagaagcccagagtggaaagtgctcctgtagcagagaaacccaaagcaccatcctcaccacctccacccaaacagtctgctaaagaaccgcagcttcctcctaaggaaagagaaagacgggttccgatgacaagacttcggaaacgagttgcaacaagattgaaagactctcaaaatactttcgcgttgctgacaactttcaatgaagttgatatgacaaatttgatgaagctccgatcccaatacaaggatgcattttatgaaaagcatggagtgaagttggggcttatgtctggatttattaaagctgctgttagcgcccttcagcatcaaccagttgtaaatgcagttattgacggggatgatatcatatacagagactatgtggatatcagtatcgctgttggtacctctaagggacttgtagtaccagtcataagaggtgctgataaaatgaactttgccgagatagagaagacgataaactcacttgccaagaaggcaaatgaaggaaccatatccatagatgagatggctggcggatcattcaccgtttcaaatggcggtgtctatggaagtctcataagcactccgatcattaatcctcctcagtctgccatactcggcatgcactcgattgtgtcacgtccaatggtagtaggaggaagcgtagtgcctagaccaatgatgtatgtcgcacttacgtatgatcacaggctgattgatggtagagaggctgtgtacttcctgcgccgtgtcaaggatgttgtggaggatccacaaaggcttcttcttgacatataa

SEQ ID NO: 551 - DNA, 1134 bp, Arabidopsis thaliana
atggctgatggtgaagacattcaacctcttgtttgcgacaatggaactggaatggttaaggctggttttgctggggatgatgcacctagagctgtgtttcctagtattgtgggtcgtcctcgtcacaccggtgtgatggttgggatggggcaaaaggatgcttatgttggcgatgaagctcaatccaaacgaggtattttaactctcaagtaccctattgagcatggaattgtcaacaattgggatgacatggagaagatttggcatcacactttctacaatgagctccgtgttgctcctgaggaacatcctattctacttaccgaggcaccgcttaacccgaaagctaatcgtgagaagatgactcaaatcatgtttgagactttcaatgcccctgctatgtatgtggctattcaggctgttctttctctttatgccagtggtcgtactaccggtattgtgctcgactctggagatggtgtgagccacactgttcctatctatgaggggtatgcacttccacatgctatcctacgtcttgatcttgctggtcgtgacctcacggatgcgctgatgaagatcctaaccgagcgtggttactctttcaccaccacagcagagcgtgaaattgtcagagacataaaggagaagctttgctacattgctcttgactacgagcaggaactcgagacagccaaaaccagctcatctgttgagaagaactacgagctacctgatgggcaagtgatcaccattggatcagagcgattccgttgtcctgaggttctttaccagccatctatgattggtatggagaatgctggtatccatgaaaccacctataactccataatgaagtgtgatgtcgacatcaggaaggacttgtacggtaacattgtgctcagtggtggaaccacaatgttccctggaatcgccgacagaatgagcaaagagatcactgctttggctccaagcagcatgaagatcaaagtcgttgcccctccagagaggaaatactctgtctggattggagggtccatcttggcctccctcagtaccttccagcagatgtggatcgcaaaggcagagtatgacgagtcaggtccatcgattgttcacaggaagtgcttctga

SEQ ID NO: 552 - DNA, 948 bp, Arabidopsis thaliana
atgatgatcggcgaaaataaaaaccggccacatccaacgatccatatccctcaatgggatcaaatcaacgatccaacggccacaatctcttcaccattctcttccgtcaaccttaacagcgttaacgactacccacactctccgtcaccgtatctcgactccttcgcttctctcttccgttacctcccgtcaaacgagttaacaaacgattcagactcatcaagtggcgacgagtcatcaccactcaccgactcattctcctccgacgagtttcgcatctacgagttcaaaatccggcgatgcgctcgaggtcgatctcatgattggacggagtgtccgttcgcacatcccggagaaaaagctcgacgacgtgatccgagaaagtttcattactccggcaccgcttgtcctgagtttcgtaaaggaagttgtagaagaggtgattcgtgtgagttctctcatggagttttcgagtgttggctccatccttctcgttaccgtactcagccgtgtaaagacggaactagctgccggagaagaatctgtttcttcgctcatacgacggagcagttacgtgtattaccttgttcgttagatccagatcttggattcttctcaggattagctacttctccgacttcgattcttgtttctccttcgttttcaccaccgtcggaatctccgccgctttctccgagtaccggtgaacttattgcgtcgatgaggaaaatgcaattgaacggaggtggttgttcgtggagttctccgatgagatctgcagttaggttacctttttcgtcgtctctgcgtccgattcaggcggcaacgtggccgaggataagagagtttgagatcgaagaagctccggcgatggaatttgtggaatctgggaaagagctgagagcggagatgtatgcaagactcagtagagagaactcactcggttga

SEQ ID NO: 553 - DNA, 1092 bp, Arabidopsis thaliana
atgaagaaaggtggattcagcaataatctcaagctcgcaattcctgttgctggcgagcaatccatcaccaaattcctgactcaaagcggtacgtttaaggatggagatctacgtgttaacaaggatggagttcgaatcatttctcaattggagcctgaagtcctgtctccaattaagccagctgatgatcagctgagcttgtcggatttggatatggttaaagtcattggcaaaggaagtagtggtgttgttcagctggttcaacacaaatggactggccaatttttcgccttgaaggtcattcaactaaatattgatgaagcaattcgcaaggcaattgcacaagagctcaaaataaatcaatcgtcacagtgtccaaatcttgttacctcgtaccagtcattttatgacaatggcgcaatctcactaatcttggagtacatggacggaggatctctagcagactttctcaagtcagttaaagccatccctgactcctatctttctgccatctttagacaagtgcttcaaggattaatctatcttcatcacgataggcatatcatccatcgtgacttgaaaccatccaatctgttgatcaaccacagaggagaagtcaaaataactgactttggtgtgagtaccgttatgacaaacaccgcaggtttagcaaacacatttgtggggacttacaattatatgtctccagagagaatcgttggaaacaagtacggaaataaaagtgatatatggagcttgggtttagtagtactcgaatgtgcaacaggaaagttcccttatgcacctccgaatcaagaggaaacatggaccagtgttttcgagttgatggaagccattgttgaccaaccgccacccgctcttccttcaggaaatttctcccctgagttatcttcattcatctccacatgtttgcagaaggatccaaacagtcgaagctctgcaaaggaactgatggaacatcctttcttgaacaaatacgactactcggggatcaatctcgcgtcctacttcacagatgcaggatcgccacttgcaacacttgggaacctgtctggtacgttctccgtgtaa

SEQ ID NO: 554 - DNA, 1755 bp, Arabidopsis thaliana
atgatgatgtttaacgagatgggaatgtatggaaacatggatttcttctcttcctccacatctctcgatgtgtgtccattaccacaagctgaacaagaacctgtagttgaagatgtcgactacaccgatgatgagatggatgtggatgagcttgagaagaggatgtggagagacaaaatgcgtttgaaacgtctcaaggagcaacagagtaagtgtaaagaaggcgtcgatggttcgaaacagaggcagtcgcaagagcaagctaggaggaagaaaatgtctagagcccaagatgggatcttgaagtatatgttgaagatgatggaagtttgtaaagctcaaggctttgtttatggtattattcctgagaagggtaagcctgtgactggtgcttcggataatttgagggaatggtggaaagataaggttaggtttgatcgtaatggtccagctgctattgctaagtatcagtcagagaataatatttctggagggagtaatgattgtaacagcttggttggtccaacaccgcatacgcttcaggagcttcaggacacgactcttggttcgcttttatcggctttgatgcaacattgtgatccaccgcagagacggtttcctttggagaaaggagtttctccaccttggtggcctaatgggaatgaagagtggtggcctcagcttggtttaccaaatgagcaaggtcctcctccttataagaagcctcatgatttgaagaaagcttggaaagtcggtgttttaactgcggtgatcaagcatatgtcgccggatattgcgaagatccgtaagcttgtgaggcaatcaaaatgcttgcaggataagatgacggcgaaagagagtgctacttggcttgccattattaaccaagaagaggttgtggctcgggagctttatcccgagtcatgccctcctctttcttcttcttcatcattaggaagcgggtcgcttctcattaatgattgtagcgagtatgacgttgaaggtttcgagaaggaacaacatggtttcgatgtggaagagcggaaaccagagatagtgatgatgcatcctctagcaagctttggggttgctaaaatgcaacattttcccataaaggaggaggtcgccaccacggtaaacttagagttcacgagaaagaggaagcagaacaatgatatgaatgttatggtaatggacagatcagcaggttacacttgtgagaatggtcagtgtcctcacagcaaaatgaatcttggatttcaagacaggagttcaagggacaaccaccagatggtttgtccatatagagacaatcgtttagcgtatggagcatccaagtttcatatgggtggaatgaaactagtagttcctcagcaaccagtccaaccgatcgacctatcgggcgttggagttccggaaaacgggcagaagatgatcaccgagcttatggccatgtacgacagaaatgtccaaagcaaccaaacgcctcctactttgatggaaaaccaaagcatggtcattgatgcaaaagcagctcagaatcagcagctgaatttcaacagtggcaatcaaatgtttatgcaacaagggacgaacaacggggttaacaatcggttccagatggtgtttgattcgacaccattcgatatggcagcattcgattacagagatgattggcaaaccggagcaatggaaggaatggggaagcagcagcagcagcagcagcagcagcaagatgtatcaatatggttctga

SEQ ID NO: 555 - DNA, 1758 bp, Arabidopsis thaliana
atgggttccatcgaagaagaagcaagacctctcatcgaagaaggtttaattttacaggaagtgaaattgtatgctgaagatggttcagtggactttaatggaaacccaccattgaaggagaaaacaggaaactggaaagcttgtccttttattcttggtaatgaatgttgtgagaggctagcttactatggtattgctgggaatttaatcacttacctcaccactaagcttcaccaaggaaatgtttctgctgctacaaacgttaccacatggcaagggacttgttatctcactcctctcattggagctgttctggctgatgcttactggggacgttactggaccatcgcttgtttctccgggatttatttcatcgggatgtctgcgttaactctttcagcttcagttccggcattgaagccagcggaatgtattggtgacttttgtccatctgcaacgccagctcagtatgcgatgttctttggtgggctttacctgatcgctcttggaactggaggtatcaaaccgtgtgtctcatccttcggtgccgatcagtttgatgacacggactctcgggaacgagttagaaaagcttcgttctttaactggttttacttctccatcaatattggagcacttgtgtcatctagtcttctagtttggattcaagagaatcgcgggtggggtttagggtttgggataccaacagtgttcatgggactagccattgcaagtttcttctttggcacacctctttataggtttcagaaacctggaggaagccctataactcggatttcccaagtcgtggttgcttcgttccggaaatcgtctgtcaaagtccctgaagacgccacacttctgtatgaaactcaagacaagaactctgctattgctggaagtagaaaaatcgagcataccgatgattgccagtatcttgacaaagccgctgttatctcagaagaagaatcgaaatccggagattattccaactcgtggagactatgcacggttacgcaagtcgaagaactcaagattctgatccgaatgttcccaatctgggcttctggtatcattttctcagctgtatacgcacaaatgtccacaatgtttgttcaacaaggccgagccatgaactgcaaaattggatcattccagcttcctcctgcagcactcgggacattcgacacagcaagcgtcatcatctgggtgccgctctacgaccggttcatcgttcccttagcaagaaagttcacaggagtagacaaaggattcactgagatacaaagaatgggaattggtctgtttgtctctgttctctgtatggcagctgcagctatcgtcgaaatcatccgtctccatatggccaacgatcttggattagtcgagtcaggagccccagttcccatatccgtcttgtggcagattccacagtacttcattctcggtgcagccgaagtattctacttcatcggtcagctcgagttcttctacgaccaatctccagatgcaatgagaagcttgtgcagtgccttggctcttttgaccaatgcacttggtaactacttgagctcgttgatcctcacgctcgtgacttattttacaacaagaaatgggcaagaaggttggatttcggataatctcaattcaggtcatctcgattacttcttctggctcttggctggtcttagccttgtgaacatggcggtttacttcttctctgctgctaggtataagcaaaagaaagcttcgtcgtag

SEQ ID NO: 556 - DNA, 570 bp, Arabidopsis thaliana
atggatgagtttgttaacctcaaggaaacagagctgaggctgggattaccgggaacagataatgtatgtgaagcaaaagagagagtttcttgctgtaataacaacaataagagagtactatcaactgatactgagaaggagattgaatcatcatcaaggaaaactgaaacatcccctcctcgaaaggctcagattgttggatggccaccagttagatcttacaggaagaacaacattcagagtaagaagaatgaatctgagcatgagggtcaaggaatctatgtgaaagtaagtatggatggtgcaccatacttgaggaaaatagatctgagttgttacaaaggatactcagagttgcttaaagctttagaagtgatgttcaaattctctgtgggagagtactttgagagagatggatataaaggttcagactttgtgcctacttatgaagacaaagatggtgattggatgctcattggtgatgttccatgggagatgttcatatgtacgtgcaagagactaaggatcatgaaaggatcagaagccaaaggtttaggctgtggtgtatga

SEQ ID NO: 557 - DNA, 777 bp, Arabidopsis thaliana
atgaagatcttccacgttccttgtctgcaagacaactactcttatctgataatcgatgagagcaccggagacgcggcggttgtggatccagttgatccggagaaggtgatcgcatcggctgagaagcaccaagctaagatcaagttcgtactcactacgcatcatcactgggatcatgccggtggaaacgagaagattaagcagttggttcctgatatcaaagtatatggaggttctctggataaggtgaagggttgcactgatgcggttgataatggtgacaagctgactttgggtcaggatattaacatattggctctccacactccttgtcacaccaagggtcacattagttattatgtgaacggaaaagaaggagaaaacccagccgtgttcaccggagatacactttttgttgctggatgtgggaagttttttgaagggacagctgagcagatgtatcagtcgttgtgtgtgactctggctgcattacctaaaccgacacaggtttactgcggccatgagtacaccgttaagaacttggaatttgctctaactgtggaaccaaacaacgggaagatacaacagaagttagcatgggcccgtcaacagcgccaagcagatcttcccacaatcccttcaacactggaggaagagctcgaaacaaatccatttatgcgtgttgataagccagagatacaggagaaactcggttgcaagtcgccaattgatacaatgagggaagttcggaacaagaaggatcagtggaggggatga

SEQ ID NO: 558 - DNA, 1350 bp, Arabidopsis thaliana
atggcggaagagacggagaaaaagtacattacgaacgaagatcttaaaaaacacaacaaatctggagatctatggatcgcgattcaaggcaaggtctacaacgtctccgattggattaaaactcatcccggaggcgacacggtgattctcaatctcgttggtcaagacgtcaccgatgctttcatcgcatttcatcccggaaccgcttggcaccatctcgaccatctcttcaccggttaccacatcagagatttccaagtctccgaagtctcacgcgattaccgtcgtatggctgccgagtttcgtaaactcggtctcttcgaaaacaaaggtcacgttactctctacactctagccttcgtcgccgccatgttcctcggagttctctacggtgttttggcttgtacctccgtcttcgctcaccaaatcgccgccgcgcttctcggtctcctctggatccagagcgcttacataggtcacgattctggtcattacgttatcatgtcgaacaaatcttataacagattcgctcagcttctctccggtaactgtctcaccggaatctcaatcgcgtggtggaaatggactcacaatgctcatcatctagcttgtaacagcctcgattacgatccagatctacaacacatccctgtcttcgccgtctccaccaaattcttctcctcattgacctcgagattctacgatcggaaactcacgtttgatccagtcgcgagattcttagtcagctatcaacactttacttattatccagttatgtgctttggaagaatcaatctcttcattcaaacgtttctcttgctcttctccaaacgtgaagtaccagatcgtgctttaaacttcgccggaatcttagtcttctggacttggttcccactcttagtctcatgtctaccaaactggcctgagagattcttcttcgtcttcacaagcttcaccgtcacggcgcttcaacacattcaattcacgcttaaccatttcgctgctgatgtctacgttggtccacccaccggtagcgactggttcgagaagcaagcggcgggaacaatcgatatctcttgtagatcatacatggattggttctttggtggattacagtttcagcttgagcatcatttgttccctcgcttacctcgttgccatctccggaaagtttctccggtggttcaagagctttgcaagaagcataatcttccgtataggagtatgtcgtggtttgaagcaaatgtgttgaccattaacactttgaagacagcagcttatcaagctagagacgtggctaatccggtggttaagaacttggtttgggaagctttgaatactcatggctaa

SEQ ID NO: 559 - DNA, 3255 bp, Arabidopsis thaliana
atgaatactggtggtcggctcattgctggctctcacaacagaaacgaattcgttctcattaacgccgatgagagtgccagaatacgatcagtacaagaactgagtgggcaaacatgtcaaatctgtggagatgaaatcgaattaacggttagcagtgagctctttgttgcttgcaacgaatgcgcattcccggtttgtagaccatgctatgagtatgaacgtagagaaggaaatcaagcttgtcctcagtgcaaaactcgatacaaaaggattaaaggtagtccacgggttgatggagatgatgaagaagaagaagacattgatgatcttgagtatgagtttgatcatgggatggaccctgaacatgccgctgaagccgcactctcttcacgccttaacaccggtcgtggtggattggattcagctccacctggctctcagattcctcttttgacttattgtgatgaagatgctgatatgtattctgatcgtcatgctcttatcgtgcctccttcaacgggatatgggaatcgcgtctatcctgcaccgtttacagattcttctgcacctccacaggcgagatcaatggttcctcagaaagatattgcggaatatggttatggaagtgttgcttggaaggaccgtatggaagtttggaagagacgacaaggcgaaaagcttcaagtcattaagcatgaaggaggaaacaatggtcgaggttccaatgatgacgacgaactagatgatcctgacatgcctatgatggatgaaggaagacaacctctctcaagaaagctacctattcgttcaagcagaataaatccttacaggatgttaattctgtgtcgcctcgcgattcttggtcttttctttcattatagaattctccatccagtcaatgatgcatatggattatggttaacgtcagttatatgcgagatatggtttgcagtgtcttggattcttgatcaattccccaaatggtatcctatagaacgtgaaacatacctcgatagactctctctcaggtacgagaaggaaggaaaaccgtcaggattagcacctgttgatgtttttgttagtacagtggatccgttgaaagagccacccttgattacagcaaacacagttctttccattctagcagttgattatcctgtggataaggttgcgtgttatgtatcagacgatggtgcagctatgcttacatttgaagctctctctgatacagctgagtttgctagaaaatgggttcctttttgtaagaagtttaatatcgagccacgagctcctgagtggtatttttctcagaagatggattacctgaagaacaaagttcatcctgcttttgtcagggaacgtcgtgctatgaagagagattatgaggagtttaaagtgaagataaatgcactggttgctactgcacagaaagtgcctgaggaaggttggactatgcaagatggaactccttggcctggaaacaacgtccgtgaccatcctggaatgattcaggtgttcttgggtcatagtggagttcgtgatacggatggtaatgagttaccacgtctagtgtatgtttctcgtgagaagcggcctggatttgatcaccacaagaaagctggagctatgaattccttgatccgagtctctgctgttctatcaaacgctccttaccttcttaatgtcgattgtgatcactacatcaacaacagcaaagcaattagagaatctatgtgtttcatgatggacccgcaatcgggaaagaaagtttgttatgttcagtttccgcagagatttgatgggattgatagacatgatagatactcaaaccgtaacgttgtgttctttgatattaacatgaaaggtcttgatgggatacaaggaccgatatatgtcgggacaggttgtgtgtttagaagacaggctctttatggttttgatgcaccaaagaagaagaaaccaccaggcaaaacctgtaactgttggcctaaatggtgttgtttgtgttgtgggttgagaaagaagagtaaaacgaaagccaaagataagaaaactaacactaaagagacttcaaagcagattcatgcgctagagaatgtcgacgaaggtgttatcgtcccagtgtcaaatgttgagaagagatctgaagcaacacaattgaaattggagaagaagtttggacaatctccggttttcgttgcctctgctgttctacagaacggtggagttccccgtaacgcaagccccgcatgtttgttaagagaagccattcaagttattagctgcgggtacgaagataaaaccgaatggggaaaagagatcgggtggatttatggatcggtgactgaagatatcctgacgggtttcaagatgcattgccatggatggagatctgtgtactgtatgcctaagcgtgcagcttttaaaggatctgctcctattaacttgtcagatcgtcttcatcaagttctacgttgggctcttggctctgtagagattttcttgagcagacattgtccgatatggtatggttatggtggtggtttaaaatggttggagagattctcttacatcaactctgtcgtctatccttggacttcacttccattgatcgtctattgttctctccccgcggtttgtttactcacaggaaaattcatcgtccctgagataagcaactacgcaggtatactcttcatgctcatgttcatatccatagcagtaactggaatcctcgaaatgcaatggggaggtgtcggaatcgatgattggtggagaaacgagcagttttgggtaatcggaggggcctcctcgcatctatttgctctgtttcaaggtttgctcaaagttctagccggagttaacacgaatttcacagtcacttcaaaagcagcagacgatggagctttctctgagctttacatcttcaagtggacaactttgttgattcctccgacaacacttctgatcattaacatcattggagttattgtcggcgtttctgatgccattagcaatggctatgactcatggggacctctctttgggagacttttcttcgctctttgggtcattgttcatttatacccattcctcaagggaatgcttgggaagcaagacaaaatgcctacgattattgtggtctggtctattcttctagcttcgatcttgacactcttgtgggtcagagttaacccgtttgtggctaaagggggaccagtgttggagatctgtggtctgaattgtggaaactaa

SEQ ID NO: 560 - DNA, 1803 bp, Arabidopsis thaliana
atgtctttttctcaaagtcttgttttgttctttgccatattattacaggaagtggaagaagaggtctcaagatgggaaggctacgccgattggagaaacagagcagccgtgaaaggccgtcacggtggcatgctcgccgcctctttcgtcttagtggtggagatattagagaatctagcgtatttggcgaatgcgagtaatcttgtgctatacctaagagaatacatgcacatgtctccatcaaaatcggcaaatgacgtcaccaatttcatgggcacagcttttctcctagctctcctcggtggtttcctctccgacgctttcttctccacttttcaaatcttcctcatctcagcttccatcgagtttttgggattgatcatactcacaattcaagctcggacaccatccttaatgcctccatcgtgcgatagtcccacatgtgaagaagtgagtggttcgaaggcagcgatgctattcgtggggttgtaccttgtagctttgggtgtgggagggatcaaaggttcattagcatctcacggagcagaacagtttgatgagagtacacctaaaggtcggaaacaaaggtcaacgttctttaactacttcgtgttttgtcttgcttgtggagcactagttgctgtcacgtttgtagtttggttagaagacaacaaaggatgggaatggggattcggtgtttctaccattgctatcttcgtctctattctcatctttctctctggatcaagattttataggaacaagattccatgtggaagtcctctcaccacaatcttgaaggttcttcttgcggcttcggttaagtgctgctcgagtggaagttcaagcaatgcggttgcgagtatgtccgtgagtccctcaaatcattgcgtatcaaaggggaaaaaagaagttgaatcacaaggagaattggaaaagccacgtcaagaagaagctttgcctcctcgggcacaactaactaacagtttgaaagtattaaatggagctgcggatgaaaaacctgtccatagattgttagaatgcacagtccaacaagtggaagatgtgaagattgtcttgaaaatgcttccgatatttgcttgcactatcatgcttaactgttgcttagctcagctctctacattctccgtccaacaagctgcttccatgaacacaaagataggaagcctaaagatacctccagcttccttaccgatcttccccgtcgttttcataatgatcctcgcacctatctacgaccatctcattatcccattcgctagaaaagctaccaagaccgaaacaggagtcactcatctacaaagaatcggagtaggtttagttctttcgatattagcaatggcggttgcagctctagttgagattaaacgaaagggagtggctaaagactccggcttgcttgactcgaaagaaaccttacccgtgactttcctatggatcgcacttcagtatcttttcctagggtcagccgatctattcacactagctggactactagagtatttcttcacggaagcaccttcctcaatgagatctctcgcaacatcgctctcgtgggcttctttggctatggggtattacctaagctcagtgatcgtgtccatagtaaacagcatcacaggaagctcagggaacacaccttggctcagaggaaaaagcataaaccgttacaaactagactacttctattggctaatgtgtgttcttagtgcagctaacttcttgcactacctcttttgggcaatgcgttacaagtatagatcaactggttcaagaagctaa

SEQ ID NO: 561 - DNA, 855 bp, Arabidopsis thaliana
atgatgttcgagaaagacgatctgggtctaagcttaggcttgaattttccaaagaaacagatcaatctcaaatcaaatccatctgtttctgttactccttcttcttcttcttttggattattcagaagatcttcatggaacgagagttttacttcttcagttccaaactcagattcgtcacaaaaagaaacaagaactttcatccgaggaatcgacgtgaacagaccaccgtctacagcggaatacggcgacgaagacgctggagtatcttcacctaacagtacagtctcaagctctacagggaaaagaagcgagagagaagaagacacagatccacaaggctcaagaggaatcagtgacgatgaagatggtgataactccaggaaaaagcttagactttccaaagatcaatctgctattcttgaagagaccttcaaagatcacagtactctcaatccgaagcagaagcaagcattggctaaacaattagggttacgagcaagacaagtggaagtttggtttcagaacagacgagcaagaacaaagctgaagcaaacggaggtagactgcgagttcttacggagatgctgcgagaatctaacggaagagaaccgtcggctacaaaaagaagtaacggaattgagagcacttaagctctctcctcagttctacatgcacatgagcccacccactactttgaccatgtgcccttcatgtgaacacgtgtcggtcccgccaccacaacctcaggctgctacgtcagcgcaccaccggtcgttgccggtcaatgcgtgggctcctgcgacgaggatatctcacggcttgacttttgacgctcttcgtcctaggtcctaa

SEQ ID NO: 562 - DNA, 2208 bp, Arabidopsis thaliana
atgaaggtgcaggagggtttgttcttggtggctattttcttctcccttgcgtgtacgcagctggtgaaggggcaacatcaacctggtgagaattgccaaaataaatgtggcaacatcacaatagagtacccttttggcatttcttcaggttgttactatcccggaaatgaaagtttcagtatcacctgtaaggaagataggccacatgtcttaagcgacattgaagtggcaaactttaatcacagcggccagctacaagttctgcttaatcgatcctctacttgctacgacgagcaaggaaaaaaaactgaggaggacagttcttttacactggaaaatttatctctttccgccaacaacaagttaactgcagtaggctgtaacgctttatcacttctggacacttttggaatgcaaaactactcaactgcatgcttgtcattatgcgattctcccccagaggctgatggagaatgtaatggtagaggttgctgcagagtcgacgtttctgccccgttggatagctatacattcgaaactacatcaggtcgcatcaagcacatgacttcttttcacgactttagtccttgcacctacgcttttctcgttgaagatgataagttcaacttcagttctacagaagatcttctgaatctgcgaaatgtcatgaggttccctgtgttactagattggtctgttggaaatcagacatgcgagcaagttggaagcacaagcatatgcggtgggaacagcacttgtctcgattctactcctagaaacgggtatatctgcagatgcaatgaaggctttgatgggaatccatacctttcagctggttgccaagacgtcaatgagtgtactactagtagtactatccatagacataactgttcggatcccaaaacctgtagaaacaaggttggaggcttctattgtaagtgtcaatctggttaccgcttagataccaccactatgagctgcaagcgtaaagagtttgcatggactacaattcttcttgtaaccaccatcggcttcttggtcattctgcttggcgttgcctgtatacaacagagaatgaagcacctgaaggacaccaagctccgagaacaattcttcgagcaaaatggtggcggcatgttgacacaacgactctcaggagcagggccgtcaaatgttgatgtcaaaatctttactgaggatggcatgaagaaagcaacaaatggttatgctgagagcaggatcctgggtcagggtggccaaggaacagtgtacaaagggatattgccggacaactccatagttgctataaagaaagcccgacttggagacagtagccaagtagagcagttcatcaatgaagtgctcgtgctttcacaaatcaaccataggaacgtagtcaagctcttgggctgctgtctagagactgaagttcccttgttggtctatgagttcatcaccaatggcacccttttcgatcacttgcatggttccatgattgattcttcgcttacatgggaacaccgtctgaagatagcaatagaagtcgctggaactcttgcatatcttcactcctctgcttctattccaatcatccatcgggatatcaaaactgcaaatattcttctggatgtaaacttaactgcaaaagtagctgactttggtgcttcaaggctgataccaatggataaagaagagctcgaaactatggtgcaaggcactctaggttacctagacccagaatattacaacacagggttgttaaacgaaaagagcgatgtttatagttttggggtcgtcctaatggaactgctctcaggtcaaaaggcattgtgctttaaacggccacagtcctcaaaacatctggtgagttactttgcgactgccacaaaagagaataggttggatgagattattggcggcgaagtgatgaacgaggataatctgaaggagatccaggaagctgcaagaattgctgcagagtgtacaaggctaatgggagaggaaaggccaaggatgaaagaagtagctgcaaagctagaagccttgagggtcgaaaaaaccaaacataagtggtcggatcagtaccctgaggagaatgaacacttgattggtggtcacatcttgtcagcacaaggcgaaaccagtagcagcattggctatgacagcatcaagaatgtagcaatattggacattgaaactggccgctga

SEQ ID NO: 563 - DNA, 1218 bp, Arabidopsis thaliana
atgaattccatcttgtcaagcgtccttcctgctcccgaagatcctgttctcagtgtaatttttgcttgtagagatgatcctagtccggttaagttgaatttgagcgcaggtacctatcgaactgaggaaggaaagcctcttgttcttgatgttgtgagaagagcagagcaacagttagccaacgacctgtctagggacaaggaatatcttcccctcaatggacttcctgaatttaataaattaagtaccaagctcatcttaggtgatgatagtcctgcattgaaagagaatagagttgttacaacccaatgtttgtctggtactggttctttgagagttggagctgagtttctagcaacacacaacaaagaaagtgtcattttcgttccaaacccaacgtgggggaaccatccccgtatttttactttggcgggtttgtctgtccagtatttccgttattatgatccgaagagccgaggactcgacttcaaaggcatgctcgaggatcttggcgctgcacctcctggagctatagtggtacttcaagcttgtgcgcataaccccacaggagttgacccaacattcgaacaatgggaaaagattcgacgactagtgagatcgaaaagcttattacctttctttgatagtgcatatcagggttttgctagtggtagccttgacgcagatgcacaagcggttcgtatgtttgtagccgatggaggtgaatgtttgatagctcaaagttatgccaaaaatatgggcctttatggggagcgtattggctctcttacgatcgtatgcacatcagaagatgtcgctaagaaagttgagaaccaagtgctacttgttgtgaggcctatgtatcttacaccacctattcatggtgcatctattgttgccacaattctaaaaaacagtgatatgtacaatgactggaccattgagctgaaaggaatggctgaccgcataattagcatgcgtcaacagttatatgcagctctagaagctagaggaacacctggtgattggagtcacattattaaacatattgggatgtttacttttaccggattgagtgaggagcaagttcgcttgatggccaaagaatatcacatttacatgacttatgatgggaggataagcatggcaagtctaagttcgaagacagtgcctcaactcgctgatgctatacatgctgttgttactcgcatcgcctaa

SEQ ID NO: 564 - DNA, 1686 bp, Arabidopsis thaliana
atggcgccacaagaacaagcagtttctcaggtgatggagaaacagagcaacaacaacaacagtgacgtcattttccgatcaaagttaccggatatttacatcccgaaccacctatctctccacgactacatcttccaaaacatctccgaattcgccactaagccttgcctaatcaacggaccaaccggccacgtgtacacttactccgacgtccacgtcatctcccgccaaatcgccgccaattttcacaaactcggcgttaaccaaaacgacgtcgtcatgctcctcctcccaaactgtcccgaattcgtcctctctttcctcgccgcctccttccgcggcgcaaccgccaccgccgcaaaccctttcttcactccggcggagatagctaaacaagccaaagcctccaacaccaaactcataatcaccgaagctcgttacgtcgacaaaatcaaaccacttcaaaacgacgacggagtagtcatcgtctgcatcgacgacaacgaatccgtgccaatccctgaaggctgcctccgcttcaccgagttgactcagtcgacaaccgaggcatcagaagtcatcgactcggtggagatttcaccggacgacgtggtggcactaccttactcctctggcacgacgggattaccaaaaggagtgatgctgactcacaagggactagtcacgagcgttgctcagcaagtcgacggcgagaacccgaatctttatttccacagcgatgacgtcatactctgtgttttgcccatgtttcatatctacgctttgaactcgatcatgttgtgtggtcttagagttggtgcggcgattctgataatgccgaagtttgagatcaatctgctattggagctgatccagaggtgtaaagtgacggtggctccgatggttccgccgattgtgttggccattgcgaagtcttcggagacggagaagtatgatttgagctcgataagagtggtgaaatctggtgctgctcctcttggtaaagaacttgaagatgccgttaatgccaagtttcctaatgccaaactcggtcagggatacggaatgacggaagcaggtccagtgctagcaatgtcgttaggttttgcaaaggaaccttttccggttaagtcaggagcttgtggtactgttgtaagaaatgctgagatgaaaatagttgatccagacaccggagattctctttcgaggaatcaacccggtgagatttgtattcgtggtcaccagatcatgaaaggttacctcaacaatccggcagctacagcagagaccattgataaagacggttggcttcatactggagatattggattgatcgatgacgatgacgagcttttcatcgttgatcgattgaaagaacttatcaagtataaaggttttcaggtagctccggctgagctagaggctttgctcatcggtcatcctgacattactgatgttgctgttgtcgcaatgaaagaagaagcagctggtgaagttcctgttgcatttgtggtgaaatcgaaggattcggagttatcagaagatgatgtgaagcaattcgtgtcgaaacaggttgtgttttacaagagaatcaacaaagtgttcttcactgaatccattcctaaagctccatcagggaagatattgaggaaagatctgagggcaaaactagcaaatggattgtga

SEQ ID NO: 565 - DNA, 1221 bp, Arabidopsis thaliana
atgtcttcgataatccatggagctggagctgctacgacgacgttatcgacgtttaattccgtcgattccaagaaactcttcgttgctccttctcgcacaaatctttcagtgaggagccagagatatatagtggctggatctgatgcgagtaagaagagctttggttctggacttagagttcgtcactctcagaaattgattccaaatgctgttgcgacgaaggaggcggatacgtctgcgagcactggacatgaactattgcttttcgaggctcttcaggaaggtctggaagaagagatggacagagatccacatgtatgtgttatgggtgaagatgttggccattacggaggttcctacaaggtaaccaaaggccttgctgataaatttggtgacctcagggttctcgacactcctatttgtgaaaatgcattcaccggtatgggcattggagctgccatgactggtctaagacccgttattgaaggtatgaacatgggtttcctcctcctcgccttcaaccaaatctccaacaactgtggaatgcttcactacacatccggtggtcagtttacgatcccggttgtcatccgtggacctggtggagtgggacgccagcttggtgctgagcattcacagaggttagaatcttactttcagtccatccctgggatccagatggttgcttgctcaactccttacaacgccaaagggttgatgaaagccgcaataagaagcgagaaccctgtgattctgttcgaacacgtgctgctttacaatctcaaggagaaaatcccggatgaagattacgtctgtaaccttgaagaagctgagatggtcagacctggcgagcacattaccatcctcacttactcgcgaatgaggtaccatgtgatgcaggcagcaaaaactctggtgaacaaagggtatgaccccgaggttatcgacatcaggtcactgaaaccgttcgaccttcacacaattggaaactcggtgaagaaaacacatcgggttttgatcgtggaggagtgtatgagaaccggtgggattggggcaagtcttacagctgccatcaacgagaactttcatgactacttagatgctccggtgatgtgtttatcttctcaagacgttcctacaccttacgctggtacactggaggagtggaccgtggttcaaccggctcagatcgtgaccgctgtcgagcagctttgccagtaa

SEQ ID NO: 566 - DNA, 696 bp, Arabidopsis thaliana
atggtgggagcgactgtagttagtaaatggactcccctatgtgtggcttcgccgccggagagaaactcggcaagtctcaatccacactgttctccagccagggttaattttagaacagcgttggccgcatttcgtcctcagttccgtcttttctctcgcaattccgcgtctcgccgccgtcttcgcgcttccagctccgccgaatcgggaatcttccttcctcaccttgtagcttctatggaggacgttgaggagacttacattatggtgaaacctgatggcatacaacgaggccttgtaggagaaatcatttctcgctttgagaaaaaggggtttaaacttattgggctcaagatgtttcagtgcccaaaagaattggctgaggagcattataaggatcttagtgctaaatcattctttcctaacctgattgagtacatcacttcaggtccagttgtgtgtatggcttgggaaggtgttggtgttgttgcttcagccaggaagctaatagggaaaacagatccgcttcaagctgaacctggtactataagaggagatcttgctgtgcaaaccggaaggaacattgtgcatggtagtgacagccctgaaaacggcaagcgtgagattggtctgtggttcaaagagggcgagctatgcaagtgggattcggctctagctacatggctaagggagtga

SEQ ID NO: 567 - DNA, 762 bp, Arabidopsis thaliana
atggcggcgactcaacttacagcgtcaccagtgactatgtcagcaaggagcttagcctcgctggatggtctcagagcttcgagtgtcaagttttcatctttgaaaccagggacccttagacagagccagttccgtcgtttggttgtcaaagctgcttctgttgttgcccctaagtatacttcaattaagccattgggagatcgagttttggtgaagatcaaggaggcagaggagaagactttaggtggtatcttacttccatccactgctcaatcaaaacctcaaggaggtgaagtcgttgccgtgggtgaaggaagaactattgggaagaacaaaattgatatcactgtccctactggagcacaaattatctactccaaatacgcaggaactgaggtggagttcaatgatgtgaagcatcttatcctcaaggaagatgatattgttggcattcttgagacagaggacatcaaagatctcaaacctttgaatgaccgagtctttattaaggttgctgaggcggaggagaaaacagctggagggttgttgttaaccgagactaccaaagagaagccttctattggcacggtgatagcagttggaccgggttccctagacgaggaaggtaaaattacgcctctaccagtatcaaccggaagcacagtactttactccaagtatgctggtaacgacttcaagggcaaagatggttccaactacattgccctcagagcttcagatgtgatggctatactttcttag

SEQ ID NO: 568 - DNA, 3006 bp, Arabidopsis thaliana
atggcgccgagtagacgggatttacagcttactccggtcaccggaggttcttcttcccagatcagtgatatggaagaagttggtcttctcgattcgtatcacaacgaagcgaacgccgatgatattttgactaaaatcgaagaaggaagagatgtttccggtttaaggaagattcaggtcggagtcaccggtatgacttgtgctgcttgttctaattccgttgaagcagctttgatgaacgttaatggcgtcttcaaagcctctgttgctttgttacagaatcgagccgatgtcgtcttcgaccctaatttagtcaaggaagaggatattaaagaagctatagaggatgctggatttgaggctgagatattggctgaagaacagacacaagctactttggtgggtcaatttacaattggaggtatgacttgtgcagcttgtgttaactctgttgaaggtattctaagagatcttcctggagtgaaaagagcagtggtagctttgtctacatcattaggagaagttgagtatgatccaaatgttattaacaaggatgatattgttaatgcgattgaagatgctgggtttgaaggttcgcttgtgcagagtaatcagcaggataagcttgttttaagggtggatgggattttgaatgagcttgatgctcaggttttagaagggatacttactagattgaatggggttagacagtttcgtcttgacaggatatctggagagcttgaggttgtgtttgatccggaagttgttagttcgagatctttggttgatgggattgaagaagatggatttgggaagtttaagttgcgtgttatgagcccttatgaaaggttgtcttcgaaagatactggagaggcctcaaatatgtttcggcgttttatctccagtcttgttcttagtattcctctcttcttcatccaagtaatctgcccccacattgctctttttgatgccttactggtatggagatgtggacccttcatgatgggtgattggttgaaatgggccttggtaagtgttattcagtttgttatcggcaagcgattctatgttgcagcatggagagctctacgaaatggttcaactaacatggatgtgctcgtcgctctgggcacgtctgcttcttacttctactctgttggggctcttttatatggagcagtcactggattttggtctccaacatactttgatgcaagcgccatgctgataacttttgtcttactgggaaaatatttagagtctcttgcaaaggggaaaacctcggatgctatgaagaaactagtacaacttacgccagcaacagcgattttactaactgaaggcaaaggaggaaagcttgtaggggaaagggagatagatgcattattgattcagcctggtgatacattaaaagttcatcccggtgcaaagatccctgcagatggtgttgtggtgtggggttcaagttacgttaatgaaagtatggtgactggtgaatcagttcctgtatcaaaagaggttgattcaccagtaatcgggggtactattaatatgcatggtgctcttcacatgaaagctacaaaggtgggatctgatgcagttctgagccagattattagtttggtcgagaccgcccaaatgtcaaaagctcctattcagaaatttgcggattatgttgcaagtatttttgttccggtagtgattactttggcattgttcaccttagtaggctggtcaattggtggagctgttggagcttacccagacgaatggcttccggagaacgggactcactttgttttctcgcttatgttctcaatatccgttgtggtaattgcttgtccttgtgcacttggcttggcaacaccgactgctgttatggtggcaacaggagttggagcaaccaatggtgtattgatcaaaggaggtgatgcattagagaaagctcacaaagtgaagtatgtaatctttgacaaaacaggcaccttaactcaaggaaaagctactgtgacaaccacaaaggtcttctcagagatggaccgtggagaattccttacacttgttgcgtctgctgaggctagcagtgaacacccattggcaaaagctatagttgcgtacgctcggcatttccacttctttgatgaatccactgaagatggcgaaacaaataacaaagatttgcaaaactctggatggttacttgatacctcggatttctctgctcttcccggaaaagggattcagtgcttagtcaatgagaagatgattctggtgggaaaccgtaaacttatgtcagaaaatgccataaacatcccagaccatgtcgagaaatttgtggaagatcttgaagaaagcggaaagacgggagtcattgtagcctataatgggaaattagttggtgtgatgggaatcgcggatcctctaaagcgagaagccgctttggttgtggaaggtctccttagaatgggtgttcgacccataatggttacaggtgataactggagaacagcaagagcagtcgccaaagaggttggtatcgaagatgtgagagcagaagtaatgccagctggtaaagctgacgttatacgttcgctgcaaaaggacggaagcacagtagccatggtaggagacggaatcaatgactctcccgctctagccgctgcagatgtgggaatggcaattggtgcaggaacagatgtagcaatagaagcagcagattacgttctgatgagaaacaacttagaagacgttataacagccatcgatctctctcgaaaaaccttaacacgaatccgattaaattacgtcttcgcaatggcgtacaatgtagtgtcaatcccgatagcagcaggagtgtttttcccggttctgcgggtgcaattaccgccttgggcagccggagcatgtatggcactctcttcggttagtgttgtttgctcttctttgcttcttagaagatacaagaagccaagacttaccactgttttgaaaatcaccacggagtaa

SEQ ID NO: 569 - DNA, 1494 bp, Arabidopsis thaliana
atgcctcaggcaccgatgccagagttctctagctcggtgaagctcaagtacgtgaaacttggttaccaatatttggttaaccatttcttgagttttcttttgatcccgatcatggctattgtcgccgttgagcttcttcggatgggtcctgaagagatccttaatgtttggaattcactccagtttgacctagttcaggttctatgttcttccttctttgtcatcttcatctccactgtttacttcatgtccaagccacgcaccatctacctcgttgactattcttgttacaagccacctgtcacgtgtcgtgtccccttcgcaactttcatggaacactctcgtttgatcctcaaggacaagcctaagagcgtcgagttccaaatgagaatccttgaacgttctggcctcggtgaggagacttgtctccctccggctattcattatattcctcccacaccaaccatggacgcggctagaagcgaggctcagatggttatcttcgaggccatggacgatcttttcaagaaaaccggtcttaaacctaaagacgtcgacatccttatcgtcaactgctctcttttctctcccacaccatcgctctcagctatggtcatcaacaaatataagcttaggagtaatatcaagagcttcaatctttcggggatgggctgcagcgcgggcctgatctcagttgatctagcccgcgacttgctccaagttcatcccaattcaaatgcaatcatcgtcagcacggagatcataacgcctaattactatcaaggcaacgagagagccatgttgttacccaattgtctcttccgcatgggtgcggcagccatacacatgtcaaaccgccggtctgaccggtggcgagccaaatacaagctttcccacctcgtccggacacaccgtggcgctgacgacaagtctttctactgtgtctacgaacaggaagacaaagaaggacacgttggcatcaacttgtccaaagatctcatggccatcgccggtgaagccctcaaggcaaacatcaccacaataggtcctttggtcctaccggcgtcagaacaacttctcttcctcacgtccctaatcggacgtaaaatcttcaacccgaaatggaaaccatacataccggatttcaagctggccttcgaacacttttgcattcacgcaggaggcagagcggtgatcgacgagctccaaaagaatctacaactatcaggagaacacgttgaggcctcaagaatgacactacatcgttttggtaacacgtcatcttcatcgttatggtacgagcttagctacatcgagtctaaagggagaatgaggagaggcgatcgcgtttggcaaatcgcgtttgggagtggtttcaagtgtaactctgccgtgtggaaatgtaaccgtacgattaagacacctaaggacggaccatggtccgattgtatcgaccgttaccctgtctttattcccgaagttgtcaaactctaa

SEQ ID NO: 570 - DNA, 813 bp, Arabidopsis thaliana
atggaagctaattcaggcggaggaggaggagctgaaggcggaagagcggtaaccggaggaggaggaggaggaggagggagcgatgtggaattggtgagcaagacgttgcaagtggagcataagctattctattttgatcttaaggagaatcctcgtggaaggtatctaaagatatcggagaagacgtcggcgacgaggtcaaccatcattgttccttcctccggcatctcttggttccttgatctcttcaactactatgtcaattctgaggaacacgagctttttagcaaagaattgcagcttgattccaaggtgttttacttcgatatcggtgagaacagaagaggacgcttcttgaaggtgtcagaagcatcggttagtagaaatcgaagtaccattattgttccagctggaagctctcctgatgaaggatgggcagctttcaggaatatattggctgagatacatgaagcatcaggactttttgtgatgccaaatcagaaaccttctgatggacaggaacacttggttgatgatgttggagctggttttatacctggacatggtagtcagcagccatcttcttcagaacataatgtggatcgaacaattgactcgccaggttctgacaggtcttccatcattctaccgttatcgggtcttaagcagtttcacgaagtaattggtcactttgtggagatcaccaaagataaaattgaagtattgattctcttagaggatggaaattttcaatcctctaaccatttgaatctggcaacttcaagtcgactgcctgatcgcggtgtgcaatag

SEQ ID NO: 571 - DNA, 924 bp, Arabidopsis thaliana
atgccgccggcgaccggagatatcgatcgtcagatcgagcagcttatggagtgtaaagcgttatctgaaacggaggtgaagatgttgtgtgagcacgcaaagacgattcttgtggaagagtataatgttcaaccggttaaatgtccggttaccgtctgcggtgatatccacggccaattttacgatctaatcgagctttttcgtatcggtggttcttctcctgatactaattatcttttcatgggtgattatgttgatcgagggtattattctgtggagacagtctcacttttggtagcactgaaagttcgttacagagatagacttactatcctaagagggaatcatgaaagccgtcaaattactcaagtgtatgggttttatgatgaatgtttgaggaaatatggaaatgctaatgtatggaagcacttcactgatctttttgattatcttccacttacagctcttattgagagtcaggttttctgtttacatggaggactttcaccttctttagatacacttgacaacatccgatctttagatcgaattcaagaggttccacatgaaggaccaatgtgtgatctcttatggtctgatccagatgaccgatgcggttggggaatatctcctcgtggtgcaggctacactttcggacaagatatcgctactcagtttaaccacaccaatggactctctctgatttcaagagcacatcaacttgtcatggaaggttttaattggtgccaagaaaagaacgttgtgactgtatttagtgccccaaactattgctaccgttgtggcaacatggctgcgattctagagatcggtgagaacatggaccagaatttccttcagtttgatccagctccacgtcaagtcgaacccgaaaccactcgcaagactccagattattttttgtaa

SEQ ID NO: 572 - DNA, 855 bp, Arabidopsis thaliana
atgtctgcttcttctttatttaatctcccattgattcgcctcagatctctcgctctttcgtcttctttttcttctttccgatttgcccatcgtcctctgtcatcgatttcaccgagaaagttaccgaattttcgtgctttctctggtaccgctatgacagatactaaagatgctggtatggatgctgttcagagacgtctcatgtttgaggatgaatgcattcttgttgatgaaactgatcgtgttgtggggcatgacagcaagtataattgtcatctgatggaaaatattgaagccaagaatttgctgcacagggcttttagtgtatttttattcaactcgaagtatgagttgcttctccagcaaaggtcaaacacaaaggttacgttccctctagtgtggactaacacttgttgcagccatcctctttaccgtgaatcagagcttatccaggacaatgcactaggtgtgaggaatgctgcacaaagaaagcttctcgatgagcttggtattgtagctgaagatgtaccagtcgatgagttcactcccttgggacgtatgctgtacaaggctccttctgatggcaaatggggagagcatgaacttgattacttgctcttcatcgtgcgagacgtgaaggttcaaccaaacccagatgaagtagctgagatcaagtatgtgagccgggaagagctgaaggagctggtgaagaaagcagatgcaggtgaggaaggtttgaaactgtcaccatggttcagattggtggtggacaatttcttgatgaagtggtgggatcatgttgagaaaggaactttggttgaagctatagacatgaaaaccatccacaaactctga

SEQ ID NO: 573 - DNA, 717 bp, Arabidopsis thaliana
atggcacttgaaactcttacttctccaagattatcttctccgatgccgactctgtttcaagattcagcactagggtttcatggaagcaaaggcaaacgatctaagcgatcaagatctgaattcgaccgtcagagtctcacggaggatgaatatatcgctttatgtctcatgcttcttgctcgcgacggagatagaaaccgtgaccttgacctgccttcttcttcgtcttcacctcctctgcttcctcctcttcctactccgatctacaagtgtagcgtctgtgacaaggcgttttcgtcttaccaggctcttggtggacacaaggcaagtcaccggaaaagcttttcgcttactcaatctgccggaggagatgagctgtcgacatcgtcggcgataaccacgtctggtatatccggtggcgggggaggaagtgtgaagtcgcacgtttgctctatctgtcataaatcgttcgccaccggtcaagctctcggcggccacaaacggtgccactacgaaggaaagaacggaggcggtgtgagtagtagcgtgtcgaattctgaagatgtggggtctacaagccacgtcagcagtggccaccgtgggtttgacctcaacataccgccgataccggaattctcgatggtcaacggagacgaagaggtgatgagtcctatgccggcgaagaaactccggtttgacttcccggagaaaccctaa

SEQ ID NO: 574 - DNA, 615 bp, Arabidopsis thaliana
atgcagatcttcgagtacaatggaagtgctgttgttgctatggtaggtaagaattgtttcgccatcgccagtgatcggagactcggtgttcagctacagacaatcgccactgatttccagagaatctccaagatccacgatcgtgtcttcatcggtctttctggtctcgccaccgatgttcaaacactataccagcgcttggtgtttcgtcataagctttaccagcttagggaagagagagacatgaagcctgaaactttcgctagtcttgtctcagccatcctttacgagaagagatttggtccttacttatgccaacctgtgattgctggcttgggagatgatgacaagcctttcatttgcacgatggactctatcggagccaaagagttagctaaagattttgttgtatctggaactgcttcagaatcactctatggagcttgtgaggcaatgtacaagccagatatggaagctgaggaattgttcgagacaatatcgcaagcacttctctcatctgttgaccgtgattgtctgagtggttggggagggcatgtttacattgtaacaccaacagagattaaggagaggatcctaaagggaaggatggattga

SEQ ID NO: 575 - DNA, 717 bp, Arabidopsis thaliana
atgagctctcaaatctgcagatctgcttccaaagcagccaaatctcttctctcttcagctaaaaatgctcgcttcttctctgaaggacgagccattggtgctgcggcagcggtttcggcgtcaggaaaaattcctttgtatgcatctaactttgcaagatcatcaggttctggtgttgcttctaagagttggatcactggactcttagctcttcctgctgcagcttatatgattcaagatcaagaggttcttgctgctgagatggaacgaacttttattgctatcaagcctgatggtgtgcaaagaggactgatatcagagatcatttctcgattcgaacgcaagggattcaagctagttggtatcaaagtcattgttccttctaaagatttcgcacaaaagcattaccatgatcttaaggaaagacctttcttcaatggtttgtgtgacttccttagctctggtcctgttattgccatggtctgggaaggagatggtgtgatcagatacggacgtaaactgattggagccactgatcctcagaaatctgagcctggaacaatccgaggagatcttgcagttactgttggcaggaacataatccatggaagtgatggaccagagactgcaaaggatgagatcagtctgtggtttaagcctcaagaacttgtttcttacactagtaactctgagaagtggctctatggtgacaactaa

SEQ ID NO: 576 - DNA, 594 bp, Arabidopsis thaliana
atgagcgcatcaaggttcataaagtgcgtcaccgttggtgatggagctgttggtaaaacctgtttgctgatttcttataccagcaacacctttcccacggattatgttccgactgttttcgataactttagtgcaaatgtggttgttaatggagccacggtgaatcttggattgtgggatactgcagggcaagaggactataacagattaagacctttgagttaccgtggtgctgatgttttcattcttgccttctctctcattagtaaggctagttatgagaatgtttccaagaagtggattcctgagttgaagcactatgctcctggtgtcccaattgtccttgttggaaccaaactagatcttcgagatgacaaacagtttttcatcgaccatcctggtgctgtccctattaccactgttcagggagaggagctgaagaagctaattggagcgccagcttacatcgagtgcagttcaaaatcacaagagaacgtgaagggcgtgtttgatgcagcgatcagagtggtccttcaacctccaaagcagaagaaaaagaagaacaaagcacaaaaggcctgctccatcttgtaa

SEQ ID NO: 577 - DNA, 1671 bp, Arabidopsis thaliana
atgacgacacaagatgtgatagtcaatgatcagaatgatcagaaacagtgtagtaatgacgtcattttccgatcgagattgcctgatatatacatccctaaccacctcccactccacgactacatcttcgaaaatatctcagagttcgccgctaagccatgcttgatcaacggtcccaccggcgaagtatacacctacgccgatgtccacgtaacatctcggaaactcgccgccggtcttcataacctcggcgtgaagcaacacgacgttgtaatgatcctcctcccgaactctcctgaagtagtcctcactttccttgccgcctccttcatcggcgcaatcaccacctccgcgaacccgttcttcactccggcggagatttctaaacaagccaaagcctccgcggcgaaactcatcgtcactcaatcccgttacgtcgataaaatcaagaacctccaaaacgacggcgttttgatcgtcaccaccgactccgacgccatccccgaaaactgcctccgtttctccgagttaactcagtccgaagaaccacgagtggactcaataccggagaagatttcgccagaagacgtcgtggcgcttcctttctcatccggcacgacgggtctccccaaaggagtgatgctaacacacaaaggtctagtcacgagcgtggcgcagcaagtcgacggcgagaatccgaatctttacttcaacagagacgacgtgatcctctgtgtcttgcctatgttccatatatacgctctcaactccatcatgctctgtagtctcagagttggtgccacgatcttgataatgcctaagttcgaaatcactctcttgttagagcagatacaaaggtgtaaagtcacggtggctatggtcgtgccaccgatcgttttagctatcgcgaagtcgccggagacggagaagtatgatctgagctcggttaggatggttaagtctggagcagctcctcttggtaaggagcttgaagatgctattagtgctaagtttcctaacgccaagcttggtcagggctatgggatgacagaagcaggtccggtgctagcaatgtcgttagggtttgctaaagagccgtttccagtgaagtcaggagcatgtggtacggtggtgaggaacgccgagatgaagatacttgatccagacacaggagattctttgcctaggaacaaacccggcgaaatatgcatccgtggcaaccaaatcatgaaaggctatctcaatgaccccttggccacggcatcgacgatcgataaagatggttggcttcacactggagacgtcggatttatcgatgatgacgacgagcttttcattgtggatagattgaaagaactcatcaagtacaaaggatttcaagtggctccagctgagctagagtctctcctcataggtcatccagaaatcaatgatgttgctgtcgtcgccatgaaggaagaagatgctggtgaggttcctgttgcgtttgtggtgagatcgaaagattcaaatatatccgaagatgaaatcaagcaattcgtgtcaaaacaggttgtgttttataagagaatcaacaaagtgttcttcactgactctattcctaaagctccatcagggaagatattgaggaaggatctaagagcaagactagcaaatggattaatgaactag

SEQ ID NO: 578 - DNA, 993 bp, Arabidopsis thaliana
atggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtga

SEQ ID NO: 579 - DNA, 1137 bp, Arabidopsis thaliana
atgatgcttgttcgatctgtatttcgatctcagttgcgaccctctgtctcgggtggtctgcaatctgcttcttgctattcttcattatctgctgcttcagctgaagctgagaggactatcagagaaggtcccagaaacgattggagtagagatgaaatcaagtctgtttatgattctcctcttcttgacctcctcttccatggagctcaggttcatagacatgttcataacttcagggaggtacaacaatgtaccctcctctccataaagactggtggctgtagtgaagactgttcatattgtcctcagtcttcgagatatagcactggagttaaggcacaaagactcatgtctaaggacgctgtcattgatgctgctaagaaggcaaaagaagctgggagcacacgtttttgcatgggtgctgcttggcgagatacaattggacggaaaaccaacttcagccagattcttgaatacatcaaagaaataagaggcatggggatggaagtttgctgcaccttaggcatgattgagaaacaacaagcactagagctaaagaaggctggcctcactgcttataaccacaatcttgatacttcaagagagtactacccaaacgtcatcactactagaagttatgacgatcgccttgaaactcttagccatgttcgtgatgctggaatcaacgtttgttcaggaggaatcatagggcttggtgaggcagaggaagacagaataggtttattacacacgctggcaacacttccttctcaccctgagagtgttcccattaatgctctacttgcagtgaaaggcactcctcttgaagaccagaagccagttgagatatgggagatgatcaggatgattggaaccgcacgtattgtaatgccaaaagcgatggtgagactgtctgctggtagagtccggttctcaatgtccgaacaagctctctgtttccttgctggtgcaaactctatcttcaccggagagaagcttttaaccacaccaaacaatgattttgacgctgaccagctcatgttcaagacattaggcctcattcctaaaccgccaagtttctctgaagatgattctgaatcagaaaactgcgagaaagttgcttccgcttctcactaa

SEQ ID NO: 580 - DNA, 837 bp, Arabidopsis thaliana
atgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccaagcaaaaacaagctcttgcgagacagctgaatctaaggcctagacaagttgaagtgtggttccaaaacaggagagctagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttag

SEQ ID NO: 581 - DNA, 1656 bp, Arabidopsis thaliana
atgataacggtaagcgaagtttcctcttactcttcttcttcttcaaacttcgcgtctctgtctcgtctcaatcacaaatcatcttcgagattgcgaagctcttctctttacaaaggaagcttcttctctgtttcgacaaagaccaggaggaacacttgtaaagccaaatcatggaatctcggtcttgttatcaactctagaagctctgaggcttcggtttttgatccgttggggatcaatccagatgaaacttctggtttaagtagcatttgggaaagctttgtgagtcttttgtcaccatcatttgaaagctcttccggtaacaggcgagataagccgtcttctggtagaggcgtggcagctgctattgaggacagttccattgattttggagatttcttcaaagggccattgccagggaagtttctgaagcttcttgggtttttagctctctctcggcttggaatttacataccactcggcggggttaatcgagaagcttttgttggaaatttggatcagaatagcattttgagcactttggatacattttctggtggaggcataggtagacttggtatatgttctctcgggattgttcctttcatcaacgctcagattgtgtttcagcttcttgctcaagtctatccaaagttgcaagatcttcagaaaaaagaaggtgaagctggtagaaaaaagattcttcagtatactagatatgcttcagttggttttgcgatagtacaagcaatcggacaagtgttttaccttcgtccttacgttaatgacttcagcacggaatgggttgtttcttctgttacgttgttaacgcttggttctgttctcactacatatattggagagagaatctctgatctgaaacttggaaatggcacttccctattgattttcacaagtatcatctcttacttgcctgcatcattcggtagaacaacagcagaggccttacaggaaggaaactatactggtcttggaaccatcgttgtttcatttctcctcttggtactcgggatagtatatgttcaggaagcagagaggaaaattccgctcaattatgcctcgcgatacaccagcaaagctggtgggcttcagaaatctgcttatcttccattcaaggtcaatagtgcgggagtaatgcctatcatattctccacatcatctcttgctcttcctgctactttagcacgatttaccggcatatctgctttgaagaatgttgcttttgctttaacccctggaggttctttctatcttccaaccaatatacttctcatagctttcttcaactactactacactttcttgcaacttgacccggacgacgtgagtgaacaattaaaacgccaaggtgcatcaatccctctagtccgacctggtaaaagcactgctctcttcatcaaaaccgtccttggccggatatcggttcttggttctgcatttctggctgttctagctgctggtcctgctgtagtcgaacagatcactcacttgacagcattcagaggatttgcaggcacttctgttctgatccttgtcgggtgtgcgacagatactgcaagaaaggttcaagcagagataatctcgcaaaagtacaagaacattgagttttacgagcttgacaagtatgatccatga

SEQ ID NO: 582 - DNA, 3564 bp, Arabidopsis thaliana
atgagaaaccattgcttagaactctcttccaattgttcctccattttcgcttcttccaaatccaatcctcgtttctctccttccaagctctcctattccactttcttctctcgctctgccatctattacagatcaaaaccaaaacaagcctcgtcttcttcttccttctccactttccccccatgtctcaatcggaaaagctccctcacgcatgttctcaaacccgtctcagagctcgccgacaccactaccaagcctttttctccggagatcgtcggcaagagaaccgatctgaagaagattatgattctcggcgctggtccgattgtcattggacaagcttgtgagtttgattactctggtactcaagcttgtaaagccttaagagaagagggctatgaggttatcctgatcaattcgaatcctgccactatcatgactgatccggaaactgctaatcggacttatatcgctccgatgactcctgagcttgtcgagcaggttattgagaaagagaggcctgacgctttgttaccaaccatgggtggtcaaaccgcattgaacctcgcggttgctcttgctgagagtggtgctttggagaaatacggtgttgaattgataggagctaagcttggtgcgattaagaaagctgaagatcgtgagttgttcaaggatgcgatgaagaacattgggctaaagactccaccttcagggattgggaccactcttgatgagtgttttgacattgctgagaaaattggtgagttccctttgattatccgtcctgcgtttactttaggtggtactggtggtggaattgcgtataacaaagaggagtttgagtctatatgtaaatcgggtttggctgcgagtgcgacaagtcaagttcttgtggagaaatccttgttgggttggaaagaatatgagcttgaggtgatgagagacttagctgacaatgttgtcattatctgttccattgagaatattgatcctatgggtgtgcacactggtgattccatcactgtggcacctgcacagactctaacggatagagagtaccagcggcttagggattattccattgcgattatacgggagattggtgttgagtgtggtggatctaatgtgcagtttgctgtcaacccggttgatggtgaagttatgatcatagagatgaaccctagggtctcaagatcttctgctcttgcttccaaggctacagggtttcccattgctaaaatggctgccaagttgtctgttggctataccttggatcagattcctaatgatatcacgaggaaaacaccggctagcttcgagccctccatcgattatgtggtgactaagattcctcgatttgcatttgaaaagtttccaggatctcagccattgctaacgacccagatgaaatctgttggggaatctatggctctcggccgtacattccaagaatctttccagaaagctctgaggtctctggagtgtggattctcgggttggggttgtgcaaaaattaaagagctagattgggactgggatcagctgaaatacagcctaagagtcccaaatcctgacaggatccatgcgatatatgctgccatgaaaaagggtatgaaaattgatgaaatctacgagttgagcatggtggacaagtggttcctaacccagcttaaagagctcgtggacgtcgaacagtatcttatgtccggaaccttgtcagagattacaaaagaagacctttacgaagtcaaaaagcggggatttagtgacaagcaaatcgcttttgctacaaagacaaccgaggaagaagtccgtaccaagcggatttctctaggagttgttccatcttacaagagagtggatacatgtgctgcagagttcgaagcgcatacaccatacatgtactcttcatatgatgttgaatgtgaatcagctccaaacaacaagaagaaggttttgattttgggtggagggccaaaccgcattggtcaagggattgaatttgattactgttgttgccacacatctttcgccttacaggatgctggatatgagaccataatgttgaactcaaatcctgaaacagtatccacagattatgatacaagcgataggctctattttgaacctctcacaatcgaggatgttctcaatgttatcgaccttgagaaacctgatggcataatagtgcaatttggtggtcaaactcctctgaaacttgctctgccgatcaaacattatttggataagcacatgcccatgagcttgagcggagcgggacctgttcgcatctggggtacatcacctgactccattgacgctgctgaagacagagagaggttcaatgcaattctcgacgagctgaagattgagcagcccaagggaggcattgcaaagagcgaagctgatgcattagccatagcaaaggaggtagggtacccagttgtggtaagaccttcttatgttctaggtggacgagcaatggagatcgtttatgatgacagtagactaataacctatttggaaaatgcggtacaagttgacccagagagacctgttttggtagataaatatctttctgatgccattgagatcgacgttgatacccttactgattcctatggaaatgtggtgattggtggaataatggagcatatcgaacaagctggtgtgcattctggtgactcagcttgtatgcttccaacacaaaccatcccagcttcttgtttgcaaactattcgaacatggaccactaagctggcgaagaagctaaatgtatgtgggctgatgaactgtcagtacgcaatcacaacatctggggatgtttttttgctggaagccaatccccgagcttcccgtactgtcccttttgtgtcaaaagccattggacaccctcttgccaagtatgcagcgctggtcatgtcgggcaaatctctcaaagatcttaactttgaaaaagaagttatccctaaacatgtctctgtgaaagaagctgttttcccgtttgagaagttccaaggatgcgatgtgatactcgggccagagatgagaagcacaggagaagtgatgagcatcagttctgaattctcaagtgcgtttgcaatggctcagatcgctgcaggtcaaaagctacctctatcaggcacagtcttcctcagcttaaacgatatgaccaaaccgcacctggagaaaatcgcggtgtccttcctcgagcttgggttcaaaatagttgccacctcgggaacagctcatttcctggaactgaaaggcattccagtggagagagtgttgaagttgcatgaaggaagaccacatgctgctgatatggtggcgaatggtcagatccatttgatgttgatcacaagctcgggtgatgctcttgatcagaaagatgggagacagctcagacaaatggctctagcatacaaggtacctgttataaccactgttgctggtgcattggccactgctgagggaatcaagagcttgaagtcaagtgccattaaaatgaccgctcttcaggacttctttgaggtaaagaatgtatcttctttgctcgtctga

SEQ ID NO: 583 - DNA, 1416 bp, Arabidopsis thaliana
atggatcttgtgattggtggaaaatttaagcttgggaggaaaattggtagtggttcctttggagagctttatctaggtataaatgttcaaaccggagaagaagttgctgtcaagctggaatctgtgaaaactaagcatccccaactccactatgagtcgaagttgtatatgctgcttcaaggaggaactggtgttcctaacctcaagtggtatggagttgaaggggattacaatgtaatggttattgaccttctaggtcctagtcttgaagacttgtttaactactgtaatagaaaactctctttaaaaaccgttctcatgcttgcggaccagctgattaacagagtcgagtttatgcatactagaggttttcttcaccgtgatattaaacctgacaacttcttaatgggccttggtcgcaaagcaaatcaggtttatatcattgattttggattggggaagaaatacagagaccttcagactcacaggcacataccgtacagagaaaacaaaaacctcactggaacagctcggtatgcaagtgtgaacactcaccttggagtcgaacaaagtcgaagagatgatttggaagcacttggttatgtgctgatgtatttcctcaaagggagcttaccctggcagggattaaaagctgggacaaagaagcagaagtatgacagaattagtgagaaaaaagtagcaactcctatagaggtcttgtgtaaaaatcaaccgtctgagtttgtttcgtactttcgttactgccggtctctacggtttgatgacaaacctgattactcttaccttaagaggctattccgcgacttgtttattcgagaaggttatcagtttgattatgtatttgactggacagttctgaagtatcctcagattggttccagctctggttctagttcacggacacggaatcatacaactgcaaacccgggcttaactgcaggagcttctctcgaaaaacaggagaggattgctggaaaggagactcgcgagaaccggttctcgggtgcagtagaggctttctcaagaaggcatccggcaacttctactactcgtgatcgctcggcatcaagaaactccgttgatgggcctttgtctaagcatccgcctggtgactcagaaagaccacgcagttcctcaagatatggaagctcttcgaggagagcaattccgtcaagctctcgaccaagttccgcaggtggaccaagcgatagtcgatcctctagccgtctggtgacatcaactggaggagtcggaacagtaagtaaccgcgcatcaacaagccagagaatccaagcaggaaacgaatccaggacgtcgtctttttcgcgtgctgctagaaacactcgagaagatccattaaggaggagcttagagcttctcactctcagaaaatga

SEQ ID NO: 584 - DNA, 1179 bp, Arabidopsis thaliana
atgagttcggacgatgagagagacgagaaggagctgagtcttacctctcctgaagtcgtcaccaagtacaagagcgccgctgagatcgttaacaaggcgttacaggttgttttagctgaatgcaaaccaaaagctaagattgttgatatctgtgagaaaggagactcttttattaaagagcaaacagcaagcatgtacaagaattctaagaagaagattgagagaggtgttgcgttccctacatgcatttctgtgaacaacactgttggtcatttttcaccgcttgctagtgatgagtctgtgttggaagatggtgacatggttaaaatcgatatgggatgtcatattgatgggttcattgcccttgttggtcacacacatgttcttcaagaagggcctcttagtgggcgtaaggctgatgttatcgctgccgcaaatactgcagctgatgttgctctaaggctcgtacgtcctggaaaaaagaacactgatgtaactgaagctattcagaaggtagctgcagcttatgactgcaaaattgttgaaggtgttctttcccaccagctgaaacagcatgtgatagatggaaacaaggttgtgcttagtgtatccagccctgaaacaactgttgacgaagtggaatttgaagagaatgaagtctatgcaatagatattgtggcaagtactggtgatggcaagccaaagctattagacgagaagcaaacaactatttacaagaaagatgaaagtgttaactatcagttgaagatgaaggcctccagattcataatcagcgaaattaaacagaacttcccccgtatgccattcactgcaaggtcactggaggagaaaagggcacggcttggacttgtggagtgtgtgaaccatggtcatttgcaaccatatcctgttctttacgagaagcctggggattttgttgctcagattaagttcacagttttgctgatgccaaatggatcagataggatcacttcacatacacttcaggaacttcctaaaaagaccatcgaagaccctgagatcaaagggtggttagctttgggcatcaagaagaagaaaggtggtggaaagaagaagaaagcccaaaaggcgggagagaaaggagaggcttcaacagaggctgagccaatggacgcaagtagtaatgctcaagaatga

SEQ ID NO: 585 - DNA, 1482 bp, Arabidopsis thaliana
atggggatgaaatttctgaacaagaagggttggcatacggggagtctccgtaacatcgagactgtatggaaggctgagcagaaacaagaggctgagcagaaaaagcttgaagagcttcgtctccagatcttgcaggagagggagcgttctgagtttcgtgctctccaggaacaagccggtctcatcccgagacaagagagattagagtttctgtatgattctggattagctgtagggaagggaagtgcgagtggttcaggtgtttcgtttcagaaagaagagcagcctttagccaaatctgaagctggtagtagtgccagtgagaagccagatcagtcagctcctggtgcgctgtttgaggagaaggcacaatctgctaatgattcgtggaggaaacttcactctgatcctttgcttctcatcaggcagcgtgaacaggaagctcttgccaaaatcaagaataatcctgtcaaaatggctcttattcgtaaatcggtagaagaaaaaggaaagggtaaagatggagacacaaaggagcacaagaagaagcataagcgtaaaagtggaaagcatcagaagcaatcttcatccagacagcggtctgattcggaagaagattctggtgaagagaataacggaagaaaatctcaccatcagaaaacgtcagggactcatgacagacactatgaaagaccaaggtcagatttagaagatgagtcaaaaggaagagagagtcgtgataggcactatgagaaacgaaggtcagaactagatgatgggcacaaaagaagagagagacatgatacgcactatgagagacgaaggtcagaaatggatgatgagtcaaaaagaagagaaagtagggataatcactatgagagacgaaggtcagatttggatgatgagtccaaaagaagagaaagtcatgataagcactttgagagacaaaggtcagatttggatgatgagtacaaaagaagagaaagtcaagataagagacgaaggtcagatattgatgatgaaccaaaaagaagagatgctcgaccgaatgagaaatatcgaaatcgctcccctaaaggcggtgtggaaagggaaaatcttaagagttatggtcaagaggataaaaagaggaaagcagaggatttagacagtggaaaaccgaatgaataccagaatagacgccggaaaggtggctctaagctatcagaagaagaaagagctgctagattgaagcaaatgcaaatggatgcagaggtgcacgaggagcaaagatggacaagattgaagaaagccgatgagaccgatgcagtggaagctgataagaacaaagtatccacgggcaagagctttttggacgatgctaataagagtgtgtatggagttgagaaaggcggaagctcaacaattgaagaaagcgtgcgtcgcagaagctattattcacaacgtggaactgcagctgaaggcaatgcgtttcgacgctga

SEQ ID NO: 586 - DNA, 582 bp, Arabidopsis thaliana
atgggcggtcccggatcatcaccatgtgcttcgtgtaagcttcttcgacgacgatgtgcaaaagattgcatcttcgcaccttattttcctcctgacgatcctcacaaattcgccattgttcataaggtctttggtgccagcaacgtcagcaaaatgttgcaggagctaccagttcatcaaagagctgacgcggtgaatagtctggtttttgaagcaaacgcaagagtaagagatccggtctacggctgcgtaggagcaatctcctacttacaaaaccaagtctcgcagcttcagatgcaactagcagtggctcaagccgagattctttgcattcagatgcaaaatgagccaaccttacagtctcatcatcaagtacttgaactagaccaagaccacaaagctctcttactaaacaacaacaacatcaataactgcaacaccaacaacaacaataacaactttggttatgccatgtcttctggacagttcaactctaactttgcctcaccaagcagcataatgcaaatgcagatgcaaatgcaaatgcaagaccctcttaagcaagaatctctttggacttaa

SEQ ID NO: 587 - DNA, 222 bp, Arabidopsis thaliana
atggcttggcgcaacgcaggatctgccgctcgttctttcgtctccgccaccgcaagatcaccatctctccgttctcccaccacggcgcttcctcgcctccgtcctcctcaatcctccttacctagccgtcgcttcaccttctcatcaccttccaggttccgtgaaatcgataacgagagaataagtcgtaaaatgatacacaatgatggcgaagaagaatga

SEQ ID NO: 588 - DNA, 1170 bp, Arabidopsis thaliana
atggcggagtctgcgatccgaaccatcgtcgaatcaattcactcatcgccgacgcaagccgtcgtgtatctctccggcggtgcctctcagtctttaggttggttaatgtcagttcctggagcttcgaacacacttctcgaagccgtggttccgtattccatgatctctatggttcaattactcggcagggttccgaaccaacactgtagccaatcaatggcgaatgaaatggctttgttagcttataatcgtgctcttaagctttctaagccaggatgtgcggttcttggtgttggttttactggaacgttagcaacttctcgtccaaagcgtggggatcataggttctttttgtcgataagagcttccaaccggatatgggaaacttcagttactctaacaaagggaaaacgaagccgagaggaagaagataaagtggcaagctctgtactgattcaggctatggctaaggcatgccaagtttctgagacacttgactctggcttgactgattctgaggtgcttaatgagtctgtaatccagtttagtgaagaagaagaactagaacagcttatagatggacaaatatgctctaagatctatccattttctaaagaatcatacgggtcggataaagatagaaagattatactgcctggttcttttaacccattacatgacggtgatctcaagctgttggaagctgctatgagtgtttctgaggaaggagggtatccatgttttgaaatatctgcactgaatgcagacaaaccatcgcttacagttacagagattaaagatcgtgtcaaacaatttgaagtacttgaaaagacggtaatagtttcaaatcagcctttcttctacaagaaagctgaactcttcccaggaagcagttttgtaattggtgctgatactgcagcaaggattgttaatccaaagtactatgaaggaagccacaaaaggatgttggaggtactaggtgattgcaaacgaacaggttgcaagttccttgttggtggccgtaatgtagatagtgtattcaaggttcttgacgatcatgagattccaaaggaaataagtacaatgtttacctcaatttcagcagatacattccgtatggatatatcctctacagagctaagaaagaaccaaggaggtgttatttcataa

SEQ ID NO: 589 - DNA, 1173 bp, Arabidopsis thaliana
atgaggaggtgcttctccaaaattactgattgccacttgggtttcaagaattccaacttcttattggttggttctgaagttggttcaggttcagtaacgagaaccattactactactactagtgagcgtttatttagcagtagttatgcagctcatcaagttgatcagataaaagacaatcctgtctctgacatgttgattgataaatttggtcgcttacatacctacttgaggatatctttgactgagcggtgtaatctccggtgtcagtattgtatgccgtctgaaggtgtggaacttactcctaagcctcagttgttgtcacagtctgagattgttaggttggctggtctttttgtttctgctggtgttaacaagattcggttgactggtggcgagcctacggttaggaaagatatcgaagagatttgtctgcagttgtctagtttaaaagggttgaagaatttggctattactaccaacggtatcactcttgcgaaaaaactaccaaggcttaaggaatgcggacttgattcgctgaatatcagcttggatactctggttccagcaaagtttgagtttctgactagacgtaaagggcatgatagggttatgaaatcgattgatactgctattgagcttggatacaatcctgtgaaagtcaattgtgttatcatgaggggattgaatgatgatgagatttgtgattttgttgagttgacacgcgacaagccaatcaatgtccggttcatcgagtttatgccatttgatggaaatgtttggaatgtgaagaaacttgtaccttatgcagaagtgatggataaagtggtcaagaggtttccgagcataaaacgaatgcaagatcacccaactgaaacagctaagaactttacgatcgatgggcattgcggttctgtttctttcatcacatccatgacagaacacttctgtgctggctgcaatagattgagacttcttgcagatgggaacttcaaagtttgcttgtttggtccttcagaggttagtctgagagatcctctccggtctggtgctgatgatgaggcgctaagggaaattataggcgctgctgtgaagagaaagaaagctgcacacgctggaatgcttgacattgctaaaacagctaatagaccaatgatacacattggtggctaa

SEQ ID NO: 590 - DNA, 435 bp, Arabidopsis thaliana
atgcttctcaaagaaacgaaattaagagaaggagaaggttttacgccggagttggagactgatctagatccgccggcgaaaaagcagagccgtcacattcatcgtcggaaatcaagaaagagagacatggaagccaagtttttccggttcttgaagattgttggagttggatacaaagctagagctgaggaagcagggcgtttcttatacctcaaattgggttacagtcacgaagtcgaacttgcggttcctccagcggttcgagtcttttgtttcaagaacaatgtggtttgctgcactggaatcgacaagcaaagagtgcatcagtttgctgcaacggtaaggagttgcaaaccccctgaaccttataagggcaaaggcataatgtacactgatgaagtcgtcaagaagaaacaaggaaagaagtccaaatga

SEQ ID NO: 591 - DNA, 609 bp, Arabidopsis thaliana
atggctatggctacgcgagcgattcgataccagttaccgtcaccgagatttagagctcctagatgcgaatcatcggaaccgattaagcagattcagatccagcaacgaccaagaggtggcgatttagccgagaacgggaagatcgtgctccaaccaaggctttgcacgctgagatcttatggatctgatatggtcatcgctaaaaaggacggcggagatggtggaggaggaggatctgatgttgagttagcgtctccgttttttgagacgcttacggattacatagagagttcgaagaagagtcaggatttcgaaaccatctccggtagactcgccatgattgtatttgcggtgacggtgacggaggagattgttacggggaactcgttgtttaagaaactagatgtggaaggattgagtgaagctattggagctggtctcgccgcgatgggatgcgcggcgatgtttgcttggttaacgatttctcggaacagagtcggacggatctttacagtgagttgcaactcgttcattgactcgttggttgatcagatcgttgatggactgttctacgataccaagcctagtgattggtctgatgatctttaa

SEQ ID NO: 592 - DNA, 423 bp, Arabidopsis thaliana
atgaatatgaagctgcaggttactgtcttgaagggtgatgttatagagaatggatatgaggtggttgatgcagtggaaggcaatggaaacaatgatgatagtggtgatgatggaggagaagacgaagaaggcagtgcagatgatgcagaaggaaaggagaccaagaaaggaccggtaagtgatcctgatttgaacggtgaagctggagataatgatgatgaacctgaaggggatgatggtaacgatgacgaggatgatgataaccatgagaacgatgatgaagatgaggaggaggatgaagacgagaatgatgatggtggtgaagaagacgacgatgaggatgcggaggtagaggaggaggaagaggaagaagatgaagatgatgaggaagcgcttcagccaccaaagaagaggaagaagtga

SEQ ID NO: 593 - DNA, 744 bp, Arabidopsis thaliana
atggagaatgattgcacggtgaatattgtctctctggagaaggatcgcgatgtttcggaggcgtcggctgaatctcagagcgagtcgactctttcgaactcgctcgattccggtgttacggctgagacctctcgttctgatgctgattccaaactggatgaatgtactgcttggacgaatgagaaacacaactcatatcttgattatttagagagctcgtttgttaggcaattatactccttgcttggaggtgggactcagagactttctagaactcgtgatgtgcagtctaactctcataaatcagctgatcagtggaacttacaacatccttgtttgcagtttaccgtcctacaaaatggttgctggcagaaggttaactttggaaagaaacaatcttgtttggagacttcatctgagtttcgttttcacagaaattcattgagaaataagcctgaaaattccaacggaaattacaccatgggaactactgtccaaggagatgtgttatgtcatgacgaaaccaaacactcagaggcgtcagggcagaatttcagagaagaagaagaagaagaagagaagggagaggtgagcaaaaaacgagaaagagaagcaaataacgatgatagttcattgaaggaggatcaggtaaatatagataaagaacaaatacgaaacaatttcacttctactggtgaagttttgctaaagaggctgctacatattctcaggttgtgccggtaa

SEQ ID NO: 594 - DNA, 1278 bp, Arabidopsis thaliana
atggacgatgataatgggctcgagctcagcttgggtctttcttgtggaggatcaacaggaaaagctaagggtaacaataataataatgctggaagctcctcagagaactacagggcagaaggaggcgatagaagtgctaaagtgattgatgactttaagaacttcctgcatccaacttctcaaagacctgcagagccgagttctggttctcagagaagtgattcgggtcaacagcctccacaaaatttcttcaatgacctctcaaaagctcctacaactgaggctgaagcttctacgaaacctttgtgggtggaggatgagtcacggaaagaagcagggaacaaaagaaagttcgggttcccggggatgaatgatgataagaaaaaagagaaggactcgtctcatgttgatatgcatgagaagaagacaaaagcatcccatgtttcaactgcgacagatgaaggatcaacagctgaaaacgaagatgtagcagagtctgaagtaggtggtggttcttcttccaaccacgcaaaggaggtggttcgtcctcctactgatacaaacattgtggacaacttaactggtcaaaggaggagcaaccatggtggatctggcactgaagagtttacaatgcgcaacatgagttacaccgtacctttcacagttcatccgcaaaatgtcgtcactagtatgccttactctttaccgacaaaagagtctggacaacacgcagcagctacaagtctattgcagcctaatgctaatgctggaaatctcccgattatgttcggatactcaccagtccagctccctatgctagataaggacggttcaggagggattgtcgcactttctcaatctccatttgctggaagagttccatcaaactcagctactgcaaaaggcgaaggcaaacaacctgttgcagaagaaggttcatccgaggatgcatcagaacgaccaacgggagacaacagcaacctcaataccgctttctctttcgacttttctgccataaaacctggaatggcagcagatgtgaagtttggaggatccggggcacgtcccaacttaccgtgggtctcaaccactggttcaggcccacacggacggacaatctcaggtgtcacataccggtacaacgcaaaccagatcaaaatcgtatgcgcttgccacggctcgcacatgtcaccggaggagtttgtacggcacgcaagcgaggagtacgttagcccagaatcatccatgggaatgactgcagcgtcagctcacacctga

SEQ ID NO: 595 - DNA, 63 bp, Arabidopsis thaliana
atgcatatgtccatgttgcttgtgtgtgactgtactagtggagatcgcaattggtttgattaa

SEQ ID NO: 596 - DNA, 843 bp, Arabidopsis thaliana
atgccgtttgaatccggtcttggccatgatgagacacaatcacatggcttaatgttgtgcacagagtatctagggtttgagagttacgacatgaggatgtccgataacgaggtggagaacaagatgacttgtcatgcggaggtggagaccgaaagggttgaagcaaagaggaggaagacgaaggagaatgtggtggtgcaagcgcagaaaaaacagtttcctccgcctctctcgtcattaaacagccgtggacagcgatatttttatctccgtccggtgagaaaagacggtagattggaacttacgcaagttatggtcgatcgaccagagattttccacgtttctagagtagatggacggttgagattacattttgtcgatggtgtcgagaatcccattagagcttattctggtcctcaagaaattgtggccttagaagaggaacctaagggtctaggtaatgagaaagagggaggggagattagtagatctgatctggaatgtggtagagagattaatgaagacgacaatgatggtgcatgtaatcaaggaatggatttatctataatcagtgatgatagtggtgcaagaagttggagatgtaaaagtagtcatgatgtttcggtgaatagtaataatgatgttgcacatttccatgatgaccatgacacgagagaatggatgtacaacagtggttttaagatcgtggcaagtaggaaccatgatgagaacaatcatcatcattatcatcatcgtcatcgtcatcatattcatccataccatcatcataatagtaacaataacatgaatttatggacccggacgtacgtgaggaccaggtga

SEQ ID NO: 597 - DNA, 2310 bp, Arabidopsis thaliana
atggagagcagcgaggaagacgacgagtacccatttatagaaagcatcactcctcagtcaaagatcgattccgttcaccagtctctcaccgaaaaggggattagaaagctttgctgtgagcttatggatttaaaggatgctgtggaaaatatgtgcggtgatatgcgtaccaagtaccttgctttcttaagaatatctgaagaagcggtggagatggagcatgagttggttgagctacggaaacatatttcttctcaggggattcttgtgcaggatctgatggctggagtttgccgtgagatggatgattggaatcgattacctggtgatgtacatgacgctgaagtcgaagaggaccccttgcctaatgaagtaaccgatccaaagtctgagttcctggagaaaattgaccttcttttggctgaacataaagtggatgaagcactggaggcaatggatgctgaggaaagaagcagtccagatcttaaaggatcagtcgagatgtcttcttacaagtctgcctttatggaaagaaaggcggttcttgaggatcagctccttaggatcgctaaacaaccctcgatttgtgtagctgaattgaagcatgcattgattgggttaatcagacttggaaaaggaccttcagctcaccaattgcttctaaagttttacgccacaagcctccgcagaagaatcgaggcctttctcccttcatgtttgacttgcccaaacacgtttcctgctactctctctaagcttgttttctctaacatctcagtggctacaaaagaatccgcagccatgtttggtgacgatgataatcccgcatattccaacaaagttgttcaatgggcagagagggaagttgaatatttggtgcggttggttaaagaaaacgcttctccttccgaaacagcttctgcattgcgggcagccagtatatgtcttcaagattgtcttaactattgcaaagtgttggaaccacaaggcttatttctgtctaagctatttttggtgctgttccgaccttatgttgaagaagtgttggagttgaattttagacgggctcgaagggttatctttgacttgaatgaaactgatgagggcttggaatcaccctctgactttgtgacaatattatctgaattcgctatcgcttcagatactatgatgactgattgtagcattcgattcatgcaaattgtgcaagacatacttgagcagttaacacacctagttgtgttacactttggtgagagtgtactaacgaggatattgcaactatatgataaatacatcgactttctgatcaaagccttgcctggccattcagatgaggatggtctacctgagctccaagataataccgtactcgctagagctgagacagattctgagcagcttgcgcttcttggagctgcgtttacaatacttgacgaacttttaccaagatcacttgttaaagtctggaaactccagattgaaaatggcggaggagaaggtgagaatagtgccgctctaaacagtagtgctgcaccggaactgaaagaatggaaacgccatatggttcaagcatttgacaaactcagaaactacttctgtctgcagtttgtcttgagcttcatctactctagggaaggactaacgcgattagacgcactcatttatttaaccgaaacaccagatgacttgcatctgccgtctttaccgtttcaggcattgttttctaagctacaacagttggccataattgctggggatgttctgcttggtaaagagaagctgcaaaagattctactagcgagattaacagagacggttataatctggctatcaaacgagcaggagttttggagtgcattcgaggacgagtcaaatccacttcagccatctggattgcaacagttgatcctcgacatgaacttcacagtggagatagccaggtttgcaggttatccatttaaagtagttcagaaccatgcatcagtggtgatcaatcgagccatcaacatattctcggaaagaggcatcaacccacaaagctcactcccgaagacagagtggttcacagaagccgccaagtcagctatcaacaggctactcatggggtctgaggatgcttcagaaccggaagaatatgagtgtgaagaagaagaagaagacgatcatcacatcgtcctccctgagatggatgacgactcagattccgaagatacatcttcactctccacagtggactcgttcgagtcatttgcctctgcaagcatggctgacctagagagtccatctttcaccgattctgagtcttga

SEQ ID NO: 598 - DNA, 732 bp, Arabidopsis thaliana
atgcaagatccatcacgacccgctacaggttacccatacccatacccatacccgaatccacaacaacaacaaccacccaccaacgggtacccaaaccccgccgccggaaccgcttacccctaccaaaaccacaacccatactacgcgccacaaccaaacccacgcgccgtcataatccgccgtctcttcatcgtcttcacaacattcctcctactcctaggtctaatcctcttcatcttcttcctaatcgttcgtcctcaactaccagacgttaacctaaactcactctccgtctccaatttcaatgtctccaacaatcaagtctctggtaaatgggatcttcaactccaatttcgaaaccctaattcaaagatgtcacttcactacgagactgctctttgcgctatgtattacaatcgtgtctctctatccgagactaggttacaaccgtttgatcaagggaagaaagatcaaacggtggttaatgcgactctctctgtttctggtacttatgttgatggacgtttggttgattctattggtaaagagagaagtgttaaaggaaatgttgagtttgatttgaggatgatttcttatgttacgtttcgatacggtgcgtttcggaggaggagatatgttactgtgtattgtgatgatgttgctgttggtgttccggtgagtagtggtgaagggaagatggttggttcgtctaagagatgcaaaacttattga

SEQ ID NO: 599 - DNA, 1035 bp, Arabidopsis thaliana
atgaaatggttgctcgtcgccgtattgacctctcttacgatcttctccgccttaacacagtcccatctcctccatggatctccggtcaattctctctgcgctgatctcattcatcccgctaattactcctgcactgaacacagtattcaaacaaaggatggttacatattagctcttcaacgtgtagcttctcttggtccaagacttcaatctggtccacctgttttgcttcagcacggtctctttatggctggagatgtgtggttcttgaattcaccaaaagagtcactaggtttcattcttgctgatcatgggtttgatgtttgggttggaaatgttcgtggtacacgttacagttatggacatgtaactttgtctgacactgataaggagttttgggactggagttggcaagatttggcaatgtatgacttggcagaaatgattcagtatctgtattcaatttcaaactccaaaattttccttgttggacattctcaggggactatcatgtcttttgctgctcttactcagccgcatgttgcggaaatggttgaagcagctgcgttgctttgtccaatatcatatttggatcatgtcacagctcctcttgttgaaagaatggtttttatgcatctcgatcagatagaatactatctagattacgagcctcacccatcatctgtcaagaatattcgacatcttttccaaatgattcggaagggaacctttgcacaatacgactacgggtatttcaaaaatctacggacttatgggctgtcgaaacctccagaattcatactaagccacatcccggcatcattaccaatgtggatggggtatggtggaactgatggtttagcagatgtgacagatgtggaacatactctcgcggaactaccttccagtccagagttactatatcttgaggattatggtcacattgactttgtgcttggctcaagtgctaaagaagatgtctataagcacatgattcaatttttcagagcaaaggttaagtctagtagttggtaa

SEQ ID NO: 600 - DNA, 549 bp, Arabidopsis thaliana
atggcgatgtctcatctctttctttcttcttcgcctcaatcttcactggctctgcgacttcactcgacgacccagttcacgttgagctactctaagaacaataaagattgttcctttcagagtgcaaatgaagctaaagtatcaaagagatcgttgctctgtcgtgcaattcatatggaatctggacattcaggggaacaaccaaagaagcttaatttcgataatctgttgaggagaaccaaacatgtttgggataattctccacagccggttaaggaatttccttggaatagagcattcggaaacttcatacagctcgttcttgatctcgctatatcagtcgttaagttcttgttcgttcctatattggcggtttcttccattagtgagatgtcttattgtgctcatgagaggaaacttgctttagtcccatttccattagtcatcggtatggttgtcgctggcgttctacaagaaaccgctttgaagatctcgcctcgtcttaaggtagtagaaaagggaactcccttatcttatagattgttatga

SEQ ID NO: 601 - DNA, 630 bp, Arabidopsis thaliana
atggaagaagcaaagcataatgaagctgaggaagcacaagggattgaagctagggaagcaaaacagattgaagctggggaaacttcaagatcatctaggaaattgattacttttgagccaaagttggttataaacaaaggaatatcggttcttggattcgttctgcggttatttgctgtttttggaactataggaagcgcgcttgccatgggaacaacacatgaatctgttgtctctttgagtcagctcgtacttctgaaagttaaatacagcgacttaccaacgctcatgtttttcgtggttgcaaacgccatttctggtggatatttggttctttctctacctgtgagtatctttcatatcttcagtactcaagctaaaacctcgagaatcatcttgctcgttgtcgacacggtgatgctggctttggttagctctggagcatctgcagcaacagccaccgtgtatttagctcacgaggggaacacaactgctaattggccaccgatctgccagcaatttgacggattctgtgaacgcatctcgggatctctcatcggttctttctgcgcagtgatcttactcatgcttattgttatcaattccgctatctccctctctcgccactaa

SEQ ID NO: 602 - DNA, 1362 bp, Arabidopsis thaliana
atggcgtctaaggtaatctctgccacaatccgcagaaccctaaccaaaccacacggcactttttcccggtgtcgctacttatcaaccgccgctgctgcgacggaggtgaattacgaggatgaatcgattatgatgaaaggagttcgaatttcaggtagacctctttacttagatatgcaagcgacgactccgattgatcctagagtattcgatgcgatgaatgcttcacagatccatgagtatgggaatcctcactcgcgaacgcatctctacggctgggaagctgagaacgccgtcgagaacgcacgaaaccaggtcgcgaaactgatcgaagcttcaccgaaggagatcgtattcgtgtccggtgcaacggaggcgaacaatatggcggtgaaaggagtgatgcacttttacaaggacacgaagaaacatgtgataactacacagactgagcataagtgtgtgcttgattcgtgtaggcatttgcagcaagaaggatttgaggtaacttatttacctgtgaaaactgatggattggttgatttagagatgttgagagaagctattaggccagacacagggctagtttctattatggctgtgaacaatgagattggtgtggttcaacctatggaggagattggtatgatttgcaaagagcataatgttccgtttcatactgatgctgctcaagctattgggaagatacctgttgatgttaagaagtggaatgttgctttgatgtctatgagtgctcacaagatctatggaccgaaaggtgttggtgctttgtatgtgaggaggaggccgagaatcaggcttgagccgttgatgaatggtggaggtcaggagaggggattgcgtagtggtacgggggctacgcagcagattgttgggttcggggctgcttgtgagttggctatgaaggagatggagtatgatgagaagtggattaaggggttacaggagaggttgctgaatggggttagagagaagcttgatggtgttgtggtgaatggttcaatggatagtcgatatgtagggaatttgaatttgtcgtttgcttatgttgaaggagagagtttgttgatgggattgaaggaagttgcagtgtctagtggaagtgcttgtactagtgcgagtttggagccttcttatgtgttgagagctttgggtgtggatgaagacatggctcacacttcgattaggtttgggattggtaggtttaccacgaaggaagagattgataaagcggtcgagcttacggttaaacaagttgagaagttgagggaaatgagcccgctttatgaaatggttaaagaaggtatcgatatcaagaacattcaatggtctcaacactga

SEQ ID NO: 603 - DNA, 1134 bp, Arabidopsis thaliana
atggccgatgctgatgacattcaacctattgtctgtgacaatggtactggaatggttaaggctggattcgctggagatgatgctcccagagcggttttccccagtgttgttggtcgacctagacatcatggtgtcatggttgggatgaatcagaaagatgcgtatgttggtgatgaagcacaatccaaaagaggtatcctcacattgaaataccctattgagcatggtgttgttagcaactgggatgacatggagaagatttggcatcacactttctacaatgagctccgtattgctcctgaagagcacccggttctacttaccgaggctcctcttaacccaaaagccaacagagagaagatgactcagatcatgtttgagacctttaattctccagctatgtatgttgccattcaagctgttctatcactttacgccagtggtcgtacaaccggtattgtgttggactctggtgatggtgtgtctcacactgtgcctatctacgagggtttctcacttccacatgctatcctccgtctcgaccttgctggtcgtgaccttactgattacctcatgaagatccttaccgagagaggttacatgttcaccacaacagcagaacgggaaattgtgagagacatcaaggagaagctttcctttgtcgctgtcgactacgagcaagagatggagacctcgaaaaccagctcctccatcgaaaagaactatgaattacccgacggacaagtgatcacgatcggtgctgagagattcaggtgcccagaagtccttttccagccatcatttgttggaatggaagctgcagggatccacgagacaacttacaactcgatcatgaagtgtgatgttgatatcaggaaggacctttacggtaacattgtgctcagtggtggtacaactatgttctcaggtattgcagaccgtatgagcaaagagatcacagctcttgccccgagcagcatgaagattaaggtcgtggcaccacccgagaggaagtacagtgtctggattggtggttctatccttgcttccctcagcactttccagcagatgtggatctctaaggcagagtatgatgaagcaggtccaggcattgtccacagaaaatgcttctaa

SEQ ID NO: 604 - DNA, 1596 bp, Arabidopsis thaliana
atgaaatttatctacaaccctactctccgacatgttactgtttgcgtcatcaaatctaaagcctttttggcaaataatggtcggaagactactcgtgtcgggatggaccacccggatccgatcaggaaacggtatcgtccttcaagcgcgtacaacgccccattctacaccacaaacggtggtgctccagtctccaacaacatctcttccctcaccatcggagaaagaggtccggttcttcttgaggattatcatttgatcgagaaggttgctaatttcaccagagagaggatccctgagagagtggttcatgctagaggaatcagtgctaagggtttctttgaagtcacccatgacatttcaaacctcacttgtgctgattttctcagagcccctggtgttcaaactccggttattgtccgtttctccaccgttgtccacgaacgtgccagtcctgaaaccatgagggatattcgtggttttgctgtcaagttttacaccagagagggaaactttgatcttgttgggaacaacactccggtgttcttcatccgtgatgggattcagttcccggatgttgtccacgcgttgaaacctaacccgaaaacaaacatccaagagtactggaggattctggactacatgtcccacttgcctgagagtttgctcacatggtgctggatgtttgatgatgttggtattccacaagattacaggcacatggagggtttcggtgtccacacctacactcttattgccaaatctggaaaagttctctttgtgaagttccactggaaaccaacttgtgggatcaagaatctgactgatgaagaggccaaggttgttggaggagccaatcacagccacgccactaaggatctccacgatgccattgcatctggcaactaccccgagtggaaacttttcatccagaccatggatcctgcagatgaggataagtttgactttgacccacttgatgtgaccaagatctggcctgaggatattttgcctctgcaaccggttggtcgcttggttctgaacaggaccattgacaatttcttcaatgaaactgagcagcttgcgttcaacccgggtcttgtggttcctggaatctactactcagacgacaagctgctccagtgtaggatctttgcttatggtgacactcagagacatcgccttggaccgaattatttgcagcttccagtcaatgctcccaaatgtgctcaccacaacaatcaccatgaaggttttatgaacttcatgcacagagatgaggagatcaattactacccctcaaagtttgatcctgtccgctgcgctgagaaagttcccacccctacaaactcctacactggaattcgaacaaagtgcgtcatcaagaaagagaacaacttcaaacaggctggagacaggtacagatcatgggcaccagacaggcaagacaggtttgttaagagatgggtggagattctatcggagccacgtctcacccacgagatccgcggcatctggatctcttactggtctcaggctgatcgatccttgggacagaaacttgcaagccgtctgaacgtgaggccaagcatctag

SEQ ID NO: 605 - DNA, 1002 bp, Arabidopsis thaliana
atggacactcaaaaatggagtataggtttcatatctctcgcttttctcttcatcacttcctcttccgctgagctcctcattaaacagaggaatagaatacaacagttctcacagttcacgaatggagtgacaagagtgtggagggatgaccgaccatcggataagattctttcgataaccagcttctcaataattaggacgagacctgaaccctatgaatcctctgtttttgaggctgttggttacaaatggagattggttttgtacgtgaatggtaatgaaaaggacggtggaaaagatcatgtttcactttacgcgaagatcgtagagacagaatctcttccagtaggatgggaagtgaatgttgatctcaaactctttgtctacaatggaaagctaaacaaatatttgattgttacagtgaaacgatacaacaatgcgacaaaagagttgggttacggacaacttattcctcaatcaacattctacgacgggaacgatgggtaccgtgagcaggacactggtacatttggtgctgagatctacatcgttaaaccagcccaacaaaaagagaaagtcacattcatatcaaaccctccagacaatgttttcacttggaagatacttcatttctctaccttggaagataaagtctatcagtctaacgagtttcttgttggagaccgatactggaaattaggattaaacccgaaaggaggcttagtcccaatcttcctatatgctcaaggctttaaggcaaacgcagttgttacaaccacttatgcagcgactaatctgcggttaaagaatcaacgaagcagcaaccacgtaacaacatatactgcatattggtacctgattccaagcggattaggtttgggagtgaacactataccgttatcagatgtaaaagatgcatcgaaaggatatgtggtgaatgattccattatcattgaagttgaaatgcttacggtctcggtgacgaacattgtatccgcttaa

SEQ ID NO: 606 - DNA, 1950 bp, Arabidopsis thaliana
atggctggtaaaggagaaggtccagcgattggtatcgatctcggtaccacttactcttgcgttggagtttggcaacacgaccgtgttgagatcattgctaatgatcaaggtaacagaaccacaccgtcttacgtcgccttcactgatagcgaacggttgattggtgacgccgcaaagaatcaggtcgccatgaacccgattaacactgttttcgatgcgaagaggttgattggtcgaagatttactgatagctctgttcaaagtgacatcaaattgtggcccttcacgctcaaatctggacctgctgaaaaaccaatgatcgtcgttaactacaagggagaagataaagagttttctgctgaagaaatctcttctatgattctcatcaagatgcgtgagattgctgaagcttaccttggtacaacgatcaagaacgctgttgttactgttccagcttacttcaatgactctcagcgtcaggctactaaggatgctggtgttattgctggtttgaatgttatgcgtatcatcaacgagcctactgcagctgctattgcttacggtcttgacaagaaggctacaagtgttggtgagaagaacgttttgatctttgaccttggtggtggtacattcgatgtctctcttttgaccattgaggaaggtatatttgaagtgaaggcgactgcaggagacactcatcttggtggtgaggatttcgacaacagaatggtgaatcactttgttcaagagttcaagaggaagaacaagaaggacattagtggaaacccgagagctctaaggaggttgagaaccgcctgtgagagagcgaagaggactttgtcatctacggctcagaccaccatcgaaatcgactctctgttcgatggtattgacttctacgctcctatcacccgtgccagattcgaggagcttaacatagatctcttcagaaagtgtatggagcctgttgagaagtgtcttcgtgatgctaagatggacaagaactcaatcgatgatgttgtccttgttggtggctcaacccgtatccccaaggtccagcaattgctcgttgacttcttcaacggcaaggagctttgcaaatctatcaaccccgatgaggctgttgcatatggtgctgctgtccaggcagctattctcagtggtgagggtaatgagaaggttcaagatctcctcttgcttgatgtcacaccactatctcttggtcttgaaaccgctggaggagtcatgactgtcttgatccagaggaatacaaccatccccacaaagaaggagcaagtcttctcaacttattcagacaaccaacccggtgttttgatccaagtctatgaaggcgagagagcaagaaccaaggacaacaacctgttgggtaaattcgagctttctggtatccctccagcaccaagaggtgttcctcaaatcactgtctgttttgacattgatgcaaacggtatcctcaacgtctcggctgaggacaagacaacggggcagaagaacaagatcacaatcaccaacgacaagggaagattgtcaaaggacgagattgagaaaatggttcaagaggcagagaagtacaagtcggaggatgaggagcacaagaagaaggtggacgccaagaatgctcttgagaattacgcatacaacatgaggaacacaatccgtgatgagaagattggcgagaagcttgctggagatgacaagaagaagattgaagactcaattgaagcagccattgaatggctagaagcgaatcagctagcagagtgtgatgaatttgaggacaagatgaaagagctcgagagtatttgcaacccgatcatagcaaagatgtaccaaggcggtgaagctggtggtccagctgcaggaggaatggacgaggatgttcctccttctgccggaggtgcaggtcccaagattgaggaagtcgactaa

SEQ ID NO: 607 - DNA, 1506 bp, Arabidopsis thaliana
atggcgatgaggggcttcacgttgttttcgatccttgtgttgtctttgtgcgcttcgtctatcagaagcgaagagacggagacgaaggagttcgtgttgaccttggatcacactaacttcaccgataccatcaacaaacacgatttcatcgtcgtcgagttctacgccccatggtgtggacactgcaagcagcttgctcctgagtatgagaaggctgcgtcagctttgagcagtaacgtcccaccagtggttcttgctaagattgatgccagtgaggaaacaaacagagaatttgcaactcaatacgaggttcagggtttcccaacaatcaagattttcagaaacggaggaaaggctgttcaagaatacaacggacctcgtgaagctgagggtattgttacttacttgaagaaacaaagtggacctgcttctgctgaaattaagtcagctgatgatgcttctgaggttgttagtgacaagaaggttgttgtggttgggattttccctaaactatctggctccgagtttgattctttcatggccattgctgagaaattgcgctctgagttagatttcgcacatacctcggatgccaagcttcttccccgtggagagtcatctgtaacaggacctgtggtcaggctattcaaaccctttgatgaacaatttgttgattccaaggatttcgatggtgaagctctggagaaatttgtcaaagaatccagcattccacttatcaccgtctttgacaaagatccaaacaaccacccatatgttatcaagttctttgaaagcactaataccaaggcgatgttgttcattaacttcactggagaaggagctgagtctcttaaatcaaagtaccgtgaagttgctacatccaacaagggacagggtcttagcttccttctaggtgatgctgagaacagccaaggtgcattccagtactttggactcgaagagagccaagttcctctcatcatcatccagactgctgacgacaagaaatacctgaaaacaaatgttgaggttgaccagattgaatcatgggtcaaggacttcaaggatggaaaaattgctccccacaaaaaatctcaacctatcccagccgaaaacaacgagccagtgaaggttgttgtttctgacagccttgacgacattgtcttaaactctggaaagaacgttttgcttgaattctatgctccatggtgtggacactgccaaaagcttgctccaatcttggacgaagttgctgtgtcgtaccaaagcgactcaagtgtagtcatcgctaagctagatgcaaccgcaaacgacttcccaaaagatacctttgatgtgaagggattcccgaccatttacttcaaatcagcgagcggaaacgttgtggtttacgaaggagacaggacaaaggaagatttcataagcttcgtcgacaagaacaaggacacagttggagagcctaagaaggaggaagagacaactgaggaagtcaaggatgagctctga

SEQ ID NO: 608 - DNA, 1158 bp, Arabidopsis thaliana
atggttgaacagactcagcaccccacgattcttcagaaggtttctggccaactcttgagctcgagtgtttctcaggacattcgtggttatgcttcggcttccaaaaggcctgctacataccagaaacatgcagcttacggaaactactccaatgctgcatttcaatatcctcttgtggctgcatctcagattgcaactactacttctcctgtgtttgtccaagctccaggagagaagggatttactaactttgctattgatttcatgatgggtggtgtttctgctgctgtgtcaaagactgctgctgctcccattgagcgtgtcaagcttttgattcaaaaccaggatgagatgcttaaggctggaaggcttactgagccatacaagggtattcgtgactgtttcggcaggacaattagggatgaaggtattggttcgttgtggagaggaaacaccgctaatgttatccgttacttccccactcaggccttgaactttgcattcaaagattacttcaagaggcttttcaacttcaagaaagacaaggatggctactggaagtggtttgctggtaacttggcatctggaggtgctgctggtgcctcttcccttctctttgtgtactctcttgactatgcacgtacccgtcttgccaatgactccaagtctgccaagaagggaggaggtgaaaggcagttcaatggtcttgttgatgtctacaagaagaccctcaagtcagatggtattgctggactttaccgtggtttcaacatctcgtgtgctggtatcattgtctaccgtggtctctactttggactgtacgactctgtgaagcctgtcctcctcactggagacctgcaggacagtttcttcgctagttttgctcttggatggctcatcaccaatggtgcgggtcttgcgtcgtacccgattgacacggttagaagaagaatgatgatgacatcaggtgaagcggtgaagtacaagagctcatttgatgcgttctcacagatcgtgaagaaggaaggagccaagtctctgttcaagggtgcgggtgccaacatcctgcgtgccgttgcaggtgctggtgtgcttgctggctacgacaagctgcagttaatcgtcttcggcaagaagtatggatctggaggtgcctaa

SEQ ID NO: 609 - DNA, 672 bp, Arabidopsis thaliana
atggcttcgatgggtggattacacggtgcatctccggcggttcttgaaggaagcttaaagatcaatggctccagccgtctgaatggctctggaagagtggcggtggctcaaaggtctagacttgtcgtcagagctcagcagagtgaggagacttctcgccggtccgtgattgggcttgttgctgctggtttagctggtggctcgtttgttcaggctgtcctcgccgatgctatttcgatcaaagttggccctcctccagctccttccggtggccttcctgggacagataactcagaccaagcaagagactttgcattggcattgaaagacaggttttacttacagccattgccaccaacagaagctgcagctagagccaaagaatctgcaaaggatatcataaatgtgaagccattgatcgacaggaaagcttggccatatgttcaaaacgatcttcgttccaaggcttcttatcttcgttatgatcttaacacaatcatttcctccaaacccaaggatgagaagaagtcactcaaggatctcaccaccaagctcttcgataccatcgacaatctggattatgcggcgaagaagaagagtccttcgcaggctgagaagtactatgctgagacagtctctgctttgaacgaagttcttgccaagcttggttaa

SEQ ID NO: 610 - DNA, 1182 bp, Arabidopsis thaliana
atggagaccagcatcgcgtgctactcacgtgggatccttcccccaagtgtctcttctcaacgatcctctacattggtctctcctccttcctactccacatcctccagcttcaagcgtctaaaatcgagctcaatcttcggagattcactacgattagcaccaaaatcgcaacttaaagccacaaaagctaagagcaatggtgcttcaactgtgaccaaatgtgaaattggccaaagcttggaagagtttttggcacaagcaactcctgacaagggattgagaactttgctgatgtgtatgggagaagcattgagaacaatagcttttaaagttagaacagcttcttgcggtggaacagcttgtgttaattcctttggtgatgaacaactcgctgttgatatgcttgctgataagcttctctttgaggctttgcaatactcgcatgtgtgcaagtatgcttgctctgaagaagtacctgagcttcaagacatgggaggtccagtggaaggtgggtttagtgttgcgtttgatccattggatggatcaagcattgtggatacaaatttcactgtgggaaccatattcggtgtttggcctggagacaagttaaccggaatcactggaggagatcaagtggctgcagccatgggaatctacggtccacgaaccacttatgttttggctgttaagggctttccaggaactcatgagttcttgcttcttgatgaagggaaatggcagcatgtaaaggagacaacagagatcgcagaagggaaaatgttctcaccaggaaacttaagagccacattcgacaactccgaatacagcaagctgattgattactacgtgaaagagaaatacacactgcgatacaccggaggaatggttcctgatgttaaccagattattgtgaaggagaaaggaatcttcacaaatgtgacttctcctacggctaaggcaaagttgaggctgttgtttgaagtggctcctcttggcctgctcatagagaatgctggtggattcagcagtgatggacacaagtccgtgcttgacaagaccatcatcaacctcgacgatagaactcaagttgcttatggctcaaagaacgagatcatccgcttcgaagaaaccctttatggaacatcaagactcaagaatgttcccattggagttaccgcttag

SEQ ID NO: 611 - DNA, 792 bp, Arabidopsis thaliana
atgggagcaattcaagctcgtcttcccttgttcctttctcccccttctataaaacaccataccttccttcattcttcttcatccaattccaatttcaaaatcagatccaacaaatcttcttcttcttcttcttcttcgatcatcatggccagtatcaaggttcacggagttcccatgtccaccgccacaatgcgcgtcctcgctactctttacgagaaagatctccagttcgagctcatccccgtcgatatgagagccggtgcccacaagcaagaggcccaccttgccctcaaccccttcggtcaaattcctgctctcgaggacggtgatttgacgcttttcgagtcaagagccatcacacagtacctagcagaggaatacagtgagaaaggtgaaaagcttatctcccaagactgcaagaaagtcaaggcaaccactaacgtatggcttcaagttgaaggtcaacagtttgaccctaacgcctctaagcttgccttcgagcgtgtctttaaaggcatgttcggcatgaccactgaccctgccgctgtccaagagctcgaaggtaagctccagaaagtcttggatgtctacgaggctaggctcgccaaatctgagttcttggctggtgattccttcactcttgctgatcttcaccacctcccagccatccattacttgttgggtactgactccaaggtgctctttgactctcgccctaaggttagcgagtggattaagaagatctctgccaggcctgcttgggctaaggttattgacctccagaagcagtag

SEQ ID NO: 612 - DNA, 1404 bp, Arabidopsis thaliana
atggcgacgacggttacactcaaatccttcaccggacttcgtcaatcatcaacggagcaaacaaacttcgtctctcatgtaccgtcatcactttctctccctcaacgacggacctctctccgagtaaccgcagccagagccactcccaaactctccaaccgtaaactccgtgtcgccgtcatcggtggtggaccagcaggcggggcagctgcagagactctagcacaaggaggaatcgagacgattctcatcgagcgtaagatggacaattgcaagccttgcggtggcgcgattcctctctgtatggtcggagaattcaacttgccgttggatattattgatcggagagtgacgaagatgaagatgatttcgccgtcgaacattgctgttgatattggtcgtacgcttaaggagcatgagtatataggtatggtgagaagagaagttcttgatgcttatctgagagagagagctgagaagagtggagccactgtgattaacggtctcttccttaagatggatcatccggagaattgggactcgccgtacactttgcattacactgagtacgatggtaaaactggagctacagggacgaagaaaacaatggaggttgatgctgtcattggagctgatggagctaactctagggttgctaaatctattgatgctggtgattacgactacgcaattgcatttcaggagaggattaggattcctgatgagaaaatgacttactatgaggatttagctgagatgtatgttggagatgatgtgtcgccggatttctatggttgggtgttccctaagtgcgaccatgtagctgttggaacaggtactgtgactcacaaaggtgacatcaagaagttccagctcgcgaccagaaacagagctaaggacaagattcttggagggaagatcatccgtgtggaggctcatccgattcctgaacatccgagaccacgtaggctctcgaaacgtgtggctcttgtaggtgatgctgcagggtatgtgactaaatgctctggtgaagggatctactttgctgctaagagtggaagaatgtgtgctgaagccattgtcgaaggttcacagaatggtaagaagatgattgacgaaggggacttgaggaagtacttggagaaatgggataagacatacttgcctacctacagggtacttgatgtgttgcagaaagtgttttacagatcaaatccggctagagaagcgtttgtggagatgtgtaatgatgagtatgttcagaagatgacattcgatagctatctgtacaagcgggttgcgccgggtagtcctttggaggatatcaagttggctgtgaacaccattggaagtttggttagggctaatgctctaaggagagagattgagaagcttagtgtttaa

SEQ ID NO: 613 - DNA, 1731 bp, Arabidopsis thaliana
atgagagaagagacagtttcttggaagtactttaaaagagatgttgttccgttcactgcgatgatcgctatagagtgtacaacggttggatccagcatactgtataaagctgctaccttgagaggatttagcttttatgtctttgtgttttacgcttatgttggtgctacacttgtccttcttctactttcacttatctttggaaggtcgagaagtttgcctacagccaagtcttctcttttcttcaagattttcttacttgcgcttctcgggatggaacaagtaatgttaagaagctctgcaactcaggctaaaatcattggcacaatagtttctatatctggtgctctggttattgttctgtataaaggcccaaaacttcttgttgctgcatcgtttacttcattcgagtcaagttggataattggaggccttttgctcgggacagtatgtctacttgtagaaaaagacttgaattcttggcagcttaaaccaggtttctccctcgcttcagtcatatactcgggactctttgatacatcattgggctcagttatccacacatggggtctccatgtgaagggtccagtctacatatccttgttcaagccgctgtctatcgcaattgcagtcgccatggctgctatattcctcggcgacacacttcatcttgggagtgtgattggatcagtgatattgagctttgggttttacactgtgatttggggcaaagcaagagaggattcaaccaaaacagtaagttcgagaagtttcgatcttcccgatgaacttcttcaagttctaccgtccgatccattcgagcagctagatgtagctcgcaaaatcacatccattgctctctcgacacgtgtctcagctctcgaatcagagtcgtcggatctccgggaacttctcgccgagaaagaaaaagaatttgaagaactccagtctcacgttgagtctctcgaggcttctctttccgatgcgtttcataagctttctctcgctgatggtgaaaaggtccgacccgacccggagaatctgataagagaaaatgcttctttgtctaatactgtcaagagacttcagagagatgtctcaaagcttgagggttttaggaagacgcttatgatgtctcttcaagatgatgaccaaaatgcaggaacaacgcaaatcatcgctaagccgacaccaaacgatgatgatactccatttcaaccttcaagacattcatcaatccaatctcaacaagcttctgaagccattgaaccagctgcaactgacaacgaaaacgatggtatatttgttttgtgttatatcgtagctcctaaaccaagtttatcagctagtcttccgttagtatcacaaactactacgccacggcttactcctcctggttctccaccaatcttatctgcttctggtacaccgaaaacaacttcgagacctatctctcctcgacgccattctgtatcgttcgctaccactagaggcatgtttgatgatactagatcttctatttcaatctcagagcctggttcacaaactgcgagaactcgggttgatggaaaagagttctttcgacaagtcaggagccgattatcttacgagcaatttggtgcatttcttggaaatgtgaaggatcttaacgcccacaagcaaacaagagaagtaaggagaatcctctctcaatcatctttaccctctttcgattcaaaacttggattctga

SEQ ID NO: 614 - DNA, 351 bp, Arabidopsis thaliana
atggcttctacctccgcgatgtcattggtcacaccacttaaccagacccgttcgtctcctttccttaagccattacctctgaaaccatccaaggctttggttgcaactggaggcagagcacagaggcttcaagttaaggccctcaagatggacaaggctttgaccggtatctccgcggctgctcttactgcttcgatggtgattccggagatagctgaagctgctggttctggaatctctccttccctcaagaatttcttgctcagcattgcttctggtggcctcgtcctcactgtcatcattggtgtcgtcgtcggcgtctccaactttgaccctgtcaagagaacctaa

SEQ ID NO: 615 - DNA, 1188 bp, Arabidopsis thaliana
atggctgtctcaactatctactcaacacaagctctcaattcaactcatttcttaacctcttcttcctcctccaaacaagtcttcctctaccgtcgtcaaccacaaaccaaccgtagattcaacacactcatcacttgcgcacaagaaaccatcgtgatcggactagctgctgactctggctgcggcaaaagtacctttatgcggaggctcaccagcgtctttggtggcgctgctaagccaccaaaaggcgggaaccctgattccaacacactcatcagcgacacgaccactgtgatctgtcttgatgattaccattctttggataggtacggtaggaaagagcagaaagtcaccgctttggacccacgcgccaatgactttgatctcatgtatgagcaagtcaaagctcttaagaatggtatagccgtcgagaaaccgatttataaccatgtcactggacttcttgaccctccggagcttattcagcctcctaagattcttgtcatcgaaggtcttcacccaatgtttgatgagcgagtaagagacttactagacttcagtatctacttggacattagcaacgaagtcaaattcgcttggaaaattcagagggacatggctgaaagaggtcacagtttggagagcatcaaagcgagtatcgaagcccgaaagcccgacttcgatgcattcatcgacccgcaaaagcagtacgcggatgcggtcatagaagtgcttcctacgactctgatcccagatgacaacgaagggaaagtgttgagagtgagattgataatgaaggaaggtgttaagtacttcagcccggtttacctgttcgatgaaggttcaaccatctcgtggattccttgcggccgcaaactcacttgctcgtaccctggcatcaagttcaactacgaacctgactcctacttcgaccatgaggtatcagttttggagatggatggacaatttgatagactggacgagctgatttacgtggaaagtcacttgagcaacctctcgaccaaattctacggagaagtcactcaacaaatgctcaaacatgctgatttcccgggtagcaacaacggtactggtcttttccaaaccattgttggattgaagatcagagatctctatgagcagctcattgccaacaaagccactgctcgtgcagaagctaaagcctaa

SEQ ID NO: 616 - DNA, 1509 bp, Arabidopsis thaliana
atggaaacaaagtacagatttgaaatcagcgacggagattcttggaggttatcgaaaacgaccctcacgaccagctccaaaagtggtctcaagaagcggatgaaacctgtttacgtagatggcaatcttcactggttgagaaacgactggagcatcatagcgttcaatcccgagacagagcaagcacgactgattccttgtagcttccatccaacaccggatacgaaggtgcttttcgcagcaaacgatgagaccaatctcctgacattgatatcagggacgaaaaaagcaatctcagtttacacactactcgggtatcacaagtggacactcgcaagccagttcaagaacgtatcaatggaggaatcagatcttgaatgttggaacgtggttgcatatgacggcaagtgtctagtggtgagggagaaaatgatacgttctagtgacattgagcttcatgtgtacgacatggaagctgacagttggggagtttttgagacggccaaatgttggtcccaagacttctacaagtttaagccctcctttttctctattgaggatgacgagcagacaaaggtgcttgtaccttctgatgaccaacgcctttcctatctaactacaattatggaaatgatacaaccagaatcaattatgaaaggagctaaatcaaagactgaaaccaggagctccaagctctctgtgaccaagaagccggctaaaggagcagggcgtggcaaagctgctgctaaggaccccaacaaaccaaagaggccagccagtgctttcttcgttttcatggaagatttccgtgagactttcaagaaggaaaaccccaagaacaagtctgtagctactgttggaaaagctgctggagacaagtggaagtccttgtctgattctgagaaagctccttatgttgctaaggctgagaaacgcaaggttgaatatgagaagaacattaaagcttacaacaagaaactggaggaaggtccaaaagaagatgaggaatctgacaagtcagtgtcagaggtcaatgacgaggatgatgctgaggatggtagtgaagaggttagtgaatcgatcatgaaaggagctaaatctaaggctgaaaccaggagcacaaagctctctgtgactaagaagcctgctaagggagccaaaggtgctgctaaagatccaaacaaacctaagaggccttccagtgccttcttcgttttcatggaagatttccgtgtgacgtacaaggaggagcaccctaagaacaagtctgttgctgctgttggcaaagctggtggtgaaaagtggaaatccttgtctgactctgagaaggctccttatgtggctaaggctgacaagcgcaaggttgagtatgagaagaacatgaaagcctacaacaagaaattggaggaaggccctaaggaagatgaggaatctgacaagtcagtttcagaggttaacgatgaggatgatgctgaggatggcagtgaagaggaggaagacgatgattaa

SEQ ID NO: 617 - DNA, 234 bp, Arabidopsis thaliana
atgaagctctctatgcgtttgatctcagctgttctcatcatgttcatgatattcgtcgccactgggatgggaccagtcactgtggaggcacgcacttgtgagtcgcagagccataggttcaagggtacatgcgtgagtgcatcaaactgcgccaacgtgtgccacaacgaaggctttgtcggaggtaactgccgtggattccgtcgtcgttgcttctgcaccagacattgctga

SEQ ID NO: 618 - DNA, 234 bp, Arabidopsis thaliana
atgaagttctctatgcgtttgatctcagccgttcttttcttggtgatgatattcgtcgccacagggatgggtccagtcacggtcgaggcacgcacgtgtgcgtcgcagagccaaagattcaagggtaaatgcgtgagcgatacaaactgcgaaaacgtgtgccacaacgaaggcttccccggaggtgattgccgtggattccgtcgtcgttgcttctgcaccagaaattgctga

SEQ ID NO: 619 - DNA, 1419 bp, Arabidopsis thaliana
atggccttcaccgcttttctcctcctcctctcttccatcgccgccggcttcctcctcctactccgccgtacacgttaccgtcggatgggtctgcctccgggaagccttggtctccctctgataggagagacttttcagctgatcggagcttacaaaacagagaaccctgagcctttcatcgacgagagagtagcccggtacggttcggttttcatgacgcatctttttggtgaaccgacgattttctcagctgacccggaaacgaaccggtttgttcttcagaacgaagggaagctttttgagtgttcttatcctgcttccatttgtaaccttttggggaaacactctctgcttcttatgaaaggttctttgcataaacgtatgcactctctcaccatgagctttgctaattcttcaatcattaaagaccatctcatgcttgatattgaccggttagtccggtttaatcttgattcttggtcttctcgtgttctcctcatggaagaagccaaaaagataacgtttgagctaacggtgaagcagttgatgagctttgatccaggggaatggagtgagagtttaaggaaagagtatcttcttgtcatcgaaggcttcttctctcttcctctccctctcttctccaccacttaccgcaaagccatccaagcgcggaggaaggtggcggaggcgttgacggtggtggtgatgaaaaggagggaggaggaggaagaaggagcggagagaaagaaagatatgcttgcggcgttgcttgcggcggatgatggattttccgatgaagagattgttgacttcttggtggctttacttgtcgccggttatgaaacaacctccacgatcatgactctcgccgtcaaatttctcaccgagactcctttagctcttgctcaactcaaggaagagcatgaaaagattagggcaatgaagagtgattcgtatagtcttgaatggagtgattacaagtcaatgccattcacacaatgtgtggttaatgagacgctacgagtggctaacatcatcggcggtgttttcagacgtgcaatgacggatgttgagatcaaaggttataaaattccaaaagggtggaaagtattctcatcgtttagagcggttcatttagacccaaaccacttcaaagatgctcgcactttcaacccttggagatggcagagcaactcggtaacgacaggcccttctaatgtgttcacaccgtttggtggagggccaaggctatgtcccggttacgagctggctagggttgcactctctgttttccttcaccgcctagtgacaggcttcagttgggttcctgcagagcaagacaagctggttttctttccaactacaagaacgcagaaacggtacccgatcttcgtgaagcgccgtgattttgctacttga

SEQ ID NO: 620 - DNA, 288 bp, Arabidopsis thaliana
atgacatctactatggttctattcctccttcttcttcttgtgtttccgcatatggataaagccctaggcgcacacgaggaatcccagaaacaaggtgcagaaaagacttaccatgatgcacgctttactattcctattaagccaaaatatattcctaaggttatacgccctacgccaaaagatccgcctattccggaatgtcttcgaaaaggcacatgtagtcgtcttcatttatctcctcctccgccccagaggtctttcaaaggcacaaacgaacctggtcattga

SEQ ID NO: 621 - DNA, 2100 bp, Arabidopsis thaliana
atggcggacgcagaaacctttgctttccaagctgagatcaaccagttgctctccctcatcatcaataccttttactctaacaaggagatcttccttcgtgaactcatcagtaactcttctgatgctttggacaagattaggtttgagtccttgacagacaagagcaagctcgatggtcagccagagctcttcattcacatcattcccgacaagactaacaacaccttgacgattatcgatagtggtattgggatgaccaaggctgatctggtgaacaaccttggaacaattgcaagatctggaaccaaagaattcatggaggcgttggctgctggagctgatgttagcatgattggacagtttggtgttggtttctactctgcttacttggttgctgacaaggttgttgttactaccaagcacaatgacgatgagcagtacgtgtgggagtctcaggccggtggatctttcaccgtcaccagagacacctctggtgaggctcttggtagaggaactaagatggtcctttacctcaaggaagaccagatggagtacattgaggagcgaaggcttaaggatttggtgaagaagcactctgagttcatcagctacccaatctctctctggattgagaagaccattgagaaggagatctctgatgatgaagaggaggaagagaagaaggatgaggaaggcaaggttgaggaagttgatgaggagaaagaaaaggaggagaagaaaaagaagaagattaaggaggtttctcatgagtgggatttggtgaacaagcagaaaccgatttggatgaggaagccagaggagatcaacaaggaggagtacgctgctttctacaagagtttgagcaatgactgggaagagcatttggctgtgaagcatttctcagttgaaggacagcttgagttcaaagctatcctctttgttcccaagagagctccttttgatctctttgacactaagaagaagcccaacaacatcaagctctatgtccgtcgtgtcttcatcatggacaactgtgaagacatcattcctgagtaccttgggtttgtcaagggtattgttgactctgaagatcttcctctcaacatctcaagagaaacattgcagcagaacaagatcctcaaggtcatccgcaagaaccttgtgaagaagtgtcttgagctcttctttgagattgctgagaacaaggaggactacaacaagttctatgaggctttctctaagaacctgaagctcggtatccatgaggactcccaaaacagaaccaagattgctgagttgctccgttaccactcaaccaagagcggtgatgaattgaccagtctcaaggactacgtgacaaggatgaaggaaggtcagaacgatatcttctatatcactggtgagagcaagaaggctgttgagaactctccattccttgagaagctcaagaagaagggtattgaagttctctacatggttgacgctatcgatgagtatgctattggtcagctcaaggaattcgaaggaaagaagcttgtctctgcaaccaaggaaggtctgaaactggatgagactgaagacgagaagaagaagaaagaagagctcaaggagaagtttgagggactctgcaaagtgatcaaggacgttttgggagacaaggttgagaaggttatcgtctctgaccgtgttgtggactcaccctgctgtcttgtaacaggcgagtatggctggactgcaaacatggagaggatcatgaaagctcaagccttgagagacagcagcatgggtggctacatgtcgagcaagaagacaatggagattaacccagagaactccatcatggatgagctgagaaagagagctgatgcagacaagaacgacaagtctgtgaaggaccttgtacttcttctctttgagaccgctcttctcacttctggtttcagcctcgatgagcccaacactttcgggagcaggattcacaggatgttgaagcttggattgagcattgatgacgatgatgttgttgaagccgatgctgacatgcctccacttgaagatgatgccgatgctgaaggtagcaagatggaggaagttgactaa

SEQ ID NO: 622 - DNA, 1335 bp, Arabidopsis thaliana
atgagagaaattcttcatattcaaggaggtcagtgcggaaaccagatcggagctaagttctgggaagttatttgcggcgagcacggtattgatcaaaccggtcagtcatgtggcgatacagatctacagcttgaaaggatcaatgtctattttaacgaagctagcggaggcaaatacgttcctcgtgctgttcttatggatctggagcctggaactatggattctctcagatctgggccgtttggtcagattttccggcctgataacttcgtttttggtcagtctggtgctgggaataactgggcgaaaggtcattacacggagggagctgagttgattgattctgtgcttgatgttgtgaggaaggaagctgagaactgtgattgtcttcaaggttttcaagtttgtcattctttgggaggaggaactggttctggaatgggaacacttcttatttctaagattagagaggaatatccagatcgtatgatgatgaccttttcggtcttcccatctcctaaggtctctgatacagttgttgagccatacaatgctactctttccgttcaccagctcgttgagaatgctgatgaatgtatggttttggataacgaagctctttacgatatctgtttccgtaccttgaagcttgctaatcctacatttggtgaccttaaccatctcatctcagctacaatgagtggtgttacatgctgtcttcggttccctggtcaactaaactctgaccttagaaaacttgctgtgaaccttattcctttcccacgactccacttcttcatggttggttttgcacctttgacatcaagaggatctcaacaatacagtgccttgagtgtccctgagctaactcaacagatgtgggatgccaaaaacatgatgtgtgcagctgatcctcgtcatggtcgttacttgacagcttctgctgtcttccgtggaaagatgagtaccaaagaggttgatgaacagatgatgaacgtccagaacaaaaactcctcatactttgttgaatggattccaaataacgtgaaatcaagcgtctgcgatatagctcccactggtttgaaaatggcatcaactttcattggaaactcaacttcaatccaggaaatgttcaggcgtgtgagtgaacagttcactgccatgttcaggagaaaggctttccttcattggtacacaggagaaggaatggacgagatggagttcactgaagcagagagtaacatgaatgatcttgttgcagagtatcagcaatatcaagatgctacagtcggtgaagaggagtacgaggaggacgaagaagaagaagaagcctaa

SEQ ID NO: 623 - DNA, 1098 bp, Arabidopsis thaliana
atgggcgcggcggggtccaaactcgagaaagctctcggcgaccagttcccggaaggagaacgatacttcggtttcgaaaatttcggcaacacttgttactgtaacagtgttttgcaggctctttatttttgtgctccctttcgtgaacaattgcttgaacattatgcaaataataaagctgatgctgaggagaatctcttgacctgcttggctgacttattttcgcagataagttcccagaagaagaaaacaggagttatcgctccgaagcgctttgtgcaaaggttgaagaaacagaatgagcttttccggagttatatgcatcaggatgcacatgagttcctgaattatttgctaaatgaacttgttgagatcttagagaaagagacacaagccacaaaagcagacaatgaaacttcatcatctcctgaaaagattgcaaatgtactgaaagctcccctggcaaatggtgttcataaagagccaattgttacttgggtgcacaagatttttcagggtatacttaccaacgagacaaggtgtctacggtgtgagacagtaacagcaagagatgaaactttcctagacctgagccttgatattgaacagaacagttcgataactagctgtttgaaaaacttcagctccacagagactctacatgcagaagacaagtttttctgtgacaaatgctgcagtttacaagaagcgcagaagagaatgaagattaagaaaccgccacacatcttagttatacatctgaaacggttcaaatacatggaacagttgggccgctacaagaagctatcgtacagagtcgtcttccctctggaactgaaactcagcaacacagtggatgaatatgtggacattgagtactctctctttgcagtcgtggttcatgtcggaagtggacctaaccacggtcattatgttagcctcgtgaaatcccataaccactggctcttctttgatgatgagagtgtcgaaataattgaagaatctgctgttcaaacattcttcggttcatcgcaagagtactcaagtaatactgatcatggctacatcttgttatacgagagcctcggaacaagatag

SEQ ID NO: 624 - DNA, 1281 bp, Arabidopsis thaliana
atgggtaattgtttagattcatcagctaaagtggataatagcaaccatagcccacatgctaattctgcttcttcgggctctaaagtttcaagcaagacaagccgttcaacgggtccttcaggactaagcacaacttcttacagcacagatagtagttttgggccattaccaacacttaggacagaaggagagatactttcatcgcctaacctaaaagctttcactttcaacgaactcaagaacgcgactaagaactttcgtcaagataatctactaggggaaggaggtttcggttgtgtattcaaaggatggattgatcaaacatctctcactgcttcacgtcccggttctggaatcgttgttgctgttaagcagcttaagcctgaaggttttcaaggtcataaagagtggttgactgaagtaaactatcttggtcaacttagtcacccaaatcttgtattactagttgggtattgcgcggaaggcgaaaaccggcttcttgtatatgaattcatgccaaaaggaagcttggagaatcatctttttagacgtggggcgcagccacttacatgggcaataaggatgaaagtggcggtaggtgcagctaaagggctaacttttcttcatgaagcaaagtcacaagtgatatacagagactttaaagctgctaacattctactcgacgctgacttcaatgctaagctttcagatttcggattggcaaaagcaggtcctactggtgataatacacatgtgtcaacaaaggtcattggtactcatggatatgcagctcctgaatatgttgccacaggtagattaaccgcaaagagtgatgtgtacagcttcggggtcgtgctactagaactaatatcaggacggcgtgccatggacaattcgaatggaggaaacgagtatagtcttgtagattgggcaacaccgtaccttggcgataagcgaaagctttttcgcataatggacacgaaactagggggtcaatatccacaaaagggagctttcacagctgctaatcttgcattgcaatgcttaaatcccgatgcaaaactccggccaaaaatgtcagaggttttagtcacattagaacagctagaatccgttgctaaacctggaaccaaacacacccaaatggaatctccaagatttcatcattcttctgttatgcagaaatctccggtaagatatagtcatgatcggcctctgctgcacatgactcctggtgcatcgcctttaccttcttacactcaatctcctcgtgtaagatga

SEQ ID NO: 625 - DNA, 651 bp, Arabidopsis thaliana
aatgaactcattttctgccttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctatta

SEQ ID NO: 626 - DNA, 1461 bp, Arabidopsis thaliana
atgcgagcgattcatatcgtgacgacgcgattgagctcgagctttagacctattcttcttcttgacttggtttcttcttgttcgcctcctcgacagttctctatccctaggcgcctaatctgtgccgccgccaatggaggaggcaggtcaggttccattgttgctcctttggtgactgaagaagactttcacaagaagatcgatgtcaatcctcctaaaggaactcgtgattttcctcctgaggatatgcgtctccgcaattggctctttaaccacttcaaagaggtctcacggttatatgggtatgaggaagtggattatccagtactggagacggaggcattgttcatcagaaaagctggggaagagattagagaccaactttactgctttgaagatagaggaaatcggcgtgtagcattgaggcctgagcttacaccttctttagccaggcttgtcatacagaaaggaaaatctgtttcccttccattgaagtggtttgcaattgggcagtgttggcgatatgagagaatgacaagaggaaggcgacgtgagcattaccaatggaatatggatattattggtgtgcctcaagtaactgctgaagcagaactaatttcatctatagtcaccttcttcaagcgaattggaatcactgcgtcagatgtgggttttaaggtttcaagccgcaaggttttacaagaattgctaaaaaagtatggtgtacccgaagacctgtttggaagagtttgtatcattatagacaagatagaaaagataccaattgatgaaataaaaaaggaacttgggttcacggggatatcagaagatgctattgaacaattactgcaagtgctttctgtgaagtccttggatgatttggaagatataattggtggagcaggagaagccattgcagatttgaaacaactcttctcacttgctgaaaagtttggttattcagagtggatacagtttgatgcatctgttgtgcgcggtcttgcttattacactggtatcgtcttcgagggatttgatcgaaaagggaagctgcgagctatatgtggtggtgggagatatgataggttactctctacttatggaggtgatgactttcctgcttgtggttttggtttcggcgatgctgtaatagttgaattgctcaaagagaaggatttgttgccagaactgggacaagaagtagagaacatagtgtgtgcgttggacaaagatctccaaggagctgcagccacagttgcaacagctctcagagacaaaggccaaaccgttgatttggtattagagagtaaaccgctgaaatgggtgttcaagagagcagctcgggtaaacgcaagaaggctggttctggttgggaaaacagagtgggaagatggttcggtcagtgttaaggtgttgtcttcaggtgagcagttccaagtcaaactcagtgacttagagtag

SEQ ID NO: 627 - DNA, 525 bp, Arabidopsis thaliana
atgacgagggtttatgtcgggaatttggacccacgcgtcaccgaaagagaactcgaagacgaattcaaggccttcggtgttcttcgcaatgtctgggtagctcgtagacctcctggctacgcattcctcgagttcgatgacgaaagagatgctttggatgcaatcagcgcattggatcgaaagaatgggtggcgtgtggagctttctcataaagataaaggaggtcgtggaggtggtggtggtcgtcgtggaggtattgaggattccaagtgctatgagtgtggcgtagaagccctagtccccgtcgtcgtaggagtccagattatgggtatgctcgcagcccgcgtggaagaagatctcctccaaggcgtcgcagtgttactccacctcgccgtgggaggagctacagcagatcccctccttatcgtggttcacgccgtgattctcctcgccgcagagactcgccctatggtcgacggtgtgaaactggaccctgaagagaaagaagctattactaagctatga

SEQ ID NO: 628 - DNA, 2160 bp, Arabidopsis thaliana
atggatgggatgaagctttcgttcccaccggaaagtccaccactttcagtcatcgttgctctttctctctcagcttctccggtgacgattgattcttccgccgctgcaacaaccgtcccttcttttgtcttctccgacgggaggaaattgaatggagccaccgttcttcttcgctatgttggtcgatcagcgaaaaagcttcctgatttctatggcaacaatgcttttgattcttctcagattgatgagtgggtagattacgcatctgtcttctcttctggttcagagtttgagaatgcttgtggtcgtgttgataagtatctcgagagtagcacgtttcttgttggccattctctttccattgctgatgtcgctatttggtcagctcttgctggaactggtcaaagatgggaaagtttgaggaaatctaaaaagtatcagagtcttgttagatggttcaattcgatattagacgagtacagtgaggtgcttaacaaggttctagcaacttatgttaagaaaggatcagggaagcctgttgctgcacctaagtctaaagatagccaacaagctgtgaaaggagatggtcaggataaaggtaagcctgaagtggacttgccggaagcggagattggaaaggttaaactccggtttgctccagagccaagtggttatcttcacataggacatgctaaggctgcgttgctgaacaagtatttcgctgagcgttaccaaggggaagtgattgtgcgttttgatgatactaaccctgctaaagaaagcaatgagtttgtggataatcttgtgaaggatattgggaccttggggatcaagtatgagaaagtgacatacacttcggactattttcctgaattgatggatatggcggaaaaactgatgcgtgagggtaaggcatatgttgatgacacaccgagggagcagatgcagaaagagaggatggatgggattgattcgaaatgtaggaatcatagcgtcgaggagaatttgaagctatggaaggaaatgattgcaggaagtgagagaggattacagtgctgtgttcgtgggaaattcaacatgcaagatcccaacaaagccatgcgtgacccggtttattaccgatgcaatcctatgtctcaccaccgtatcggggataagtataagatatatccaacatatgactttgcttgcccgtttgttgattcccttgaaggtataacgcatgctcttcggtctagtgagtatcatgaccgaaatgctcagtactttaaagttctggaggatatgggactgcgacaggttcagctttacgaattcagccggttaaacctagtttttacacttctcagtaagcgcaagcttctctggtttgtccaaactggattggttgacgggtgggatgatccacgtttcccgacagtccaaggaattgttcgtagaggtttgaaaatcgaggctctgattcaattcattctcgagcagggggcttcgaagaatctaaatttgatggaatgggacaaactttggtctataaataagagaataattgatcctgtgtgccctagacacactgctgtggttgcagaacgtcgtgtactatttaccttaacggatggtcctgatgagccgtttgttcgcatgataccaaagcacaagaaattcgaaggtgctggagaaaaggcgaccactttcactaagagcatttggctcgaggaagctgatgcgagtgccatatccgttggtgaggaagtaactttgatggattggggaaatgctatcgtaaaggaaatcacaaaggacgaggagggtcgtgtcactgccttatctggtgtcttgaatctccaaggttctgtaaagactacaaagctgaagctgacatggcttcctgatactaatgaattggtcaatctcacattaacagagtttgattatctaatcaccaagaagaagctggaagatgatgatgaagttgctgattttgtgaatcctaacacaaagaaggaaacattggcacttggtgattcgaatatgaggaatctgaaatgtggagatgtgattcagcttgagaggaaaggctatttcagatgtgatgtgccttttgtcaaatcttcaaagcccattgtcttattctccattccagatggaagagccgctaagtga

SEQ ID NO: 629 - DNA, 558 bp, Arabidopsis thaliana
atgactcgaccgtcaagattacttgagacggcggcgccaccaccacaaccgtcggaggagatgatcgcagcggaatccgacatggtggtgatcttgtcggctcttctttgcgctcttatctgcgttgctggtctcgccgccgtcgtacgatgcgcttggctccggcggtttacagccggaggagattcgccgtcaccgaacaaaggcttgaaaaagaaagctcttcagtctcttccaagatccactttcaccgccgcggaatcaacctccggcgccgccgctgaagagggagactcgacggaatgtgctatttgcctcactgacttcgccgacggtgaagaaataagagtgcttcctctttgtggtcattctttccacgtggagtgtattgacaaatggctagtttctaggtcttcttgtccttcttgtcgcaggattcttacgccggtgagatgtgaccggtgtggtcatgcttctacggcggagatgaaagatcaagctcatcgtcatcaacatcaccaacactcttctactaccattcctacgtttcttccttaa

SEQ ID NO: 630 - DNA, 1458 bp, Arabidopsis thaliana
atggctatggcgagtttatatcggcgatctcttccttctcctccggccattgacttttcttccgccgaaggcaagctaatcttcaatgaagcgcttcagaaaggaactatggaaggatttttcaggttgatttcgtattttcagacacaatccgaacctgcgtattgtggtttggctagtctctcagtggtgttgaatgctctttctatcgatcctggacgtaaatggaaagggccttggaggtggtttgatgaatcaatgttggattgctgcgaacctctggaagtagtgaaggaaaaaggcatttcatttggaaaagttgtctgtttggctcattgttcaggagcaaaagttgaggctttccgtacaagtcagagcaccattgatgatttccgcaaatttgtcgtcaaatgcacgagttctgagaattgtcatatgatctcaacatatcaccgaggtgtatttaagcagactgggactggtcacttttcacctattggtggctataatgctgagagagatatggctttgattcttgatgttgctcgtttcaagtatccccctcactgggttcctcttaaacttctttgggaagccatggacagtattgatcagtcaacagggaaacgtagagggttcatgctcatatctagaccacacagagaacccggattgctctatactctgagctgcaaggatgaaagctggatcgaaatagccaagtatttgaaggaagatgttcctcgtcttgtaagttcacagcatgtagattctgtggagaaaatcatatcagttgtgttcaagtcacttccatcaaatttcaaccaattcatcagatgggtggctgagatccgaattacagaggactcaaaccaaaatctcagcgcagaggagaagtctaggctgaaactaaagcaattggtgctgaaggaagtgcacgaaactgaactgttcaaacacatcaataagttcttatccacagtgggttatgaagacagtctgacttatgctgctgcaaaggcttgttgccaaggagctgaaatcttatccggaagcccatcaaaagagttttgttgtcgggaaacttgcgtgaaatgcatcaaaggtcctgatgactctgaaggcacggtggtgactggagttgtggtgcgtgatgggaatgaacaaaaggttgatctgttagtgccatcgacgcaaactgagtgtgaatgtggtcctgaagcaacttatccagcaggaaacgatgtgttcactgcacttctattggctttacctccacagacatggtcagggatcaaagaccaagctcttatgcatgaaatgaagcagctcatttccatggcttccctcccaactttgcttcaagaagaggtattgcatcttcgacggcaacttcagctgctaaaacgatgccaagagaacaaggaagaggatgatctcgctgctcctgcctattag

SEQ ID NO: 631 - DNA, 1188 bp, Arabidopsis thaliana
atgtcaggtttagcttgtaattcgtgtaacaaagacttcgaagacgacgctgagcagaagtttcactacaaatccgaatggcaccgttacaatctcaagcgcaagatagctggtgttcctggagtaacagaggcactatttgaagctagacaagctgctatagctcaagagaaggttaaagctgttgaagcaccgatgctttatagttgtggaatctgtaacaaaggttacaggagttccaaggctcatgagcagcatcttaagtcgaagagtcatgttttgaaggcttcgacgagtactggagaggaggataaagcgatcatcaagcagcttccgcctcgtcgtgttgagaagaataacactgctcaattgaagggttcgattgaggaggaagagagtgaagatgaatggattgaggttgattcggatgaggatttggatgcggaaatgaatgaggatggtgaagaagaagatatggatgaagatggtattgaatttgagttggatccggcttgttgtttgatgtgtgataagaagcataagactatagagaaatgtatggttcatatgcataagtttcatgggttcttcattcctgatattgagtacttgaaggatcctaaagggtttctgacctacctcggtctaaaggtcaagagagacttcgtgtgtctgtactgcaatgaattgtgccatccatttagtagtttggaagctgttcgtaagcatatggacgccaaaggtcattgcaaagtgcattatggtgatggtggtgatgaagaagatgcagaacttgaagagttctatgactacagcagcagctatgtcaatggagacgaaaatcagatggttgtgtccggtgagtcagtgaacactgtagagctttttggtgggtctgagcttgtgatcaccaagagaaccgataacaaagtaacgtctaggactcttgggtctcgagaattcatgcgctactacaaacagaagccagcaccgtcttctcagaagcatattgtcaactctctaacctccaggtacaagatgatgggtctagcaacagtgcagtcaaaggaggccatagtgaggatgaaggtgatgagagagatgaacaaaagaggagcgaaaagcagtgtcaggctcggaatgaagagcaacgtcatcaggaatctgcccaacaatgtcacctattag

SEQ ID NO: 632 - DNA, 2847 bp, Arabidopsis thaliana
atggcgaaagcaatcagagttgtgttgttatgtgtttctgtcttgtgggttgttccaaaggaatgtgcttgtagaagtaatttctctagaaactcgtcttcttcttcttcttcttctttgcggccattaagacagaggccaagctctgtgaatgttggagctctgtttacttatgattcttttatcggaagagcggctaaacccgcggttaaagcagctatggatgatgttaatgctgaccaaagtgttcttaagggcatcaagcttaatatcatctttcaagactcaaattgcagtggatttatcggcaccatgggagctttgcagctgatggaaaacaaagtggttgcagccattggtccacaatcttcagggattgctcacatgatctcctatgtagctaatgagcttcatgtacctctcttgtcatttggagcaacggatccgactctctcctctctgcaatttccttatttcctccgcaccacgcagaatgattacttccaaatgcatgcgatcgcagattttctatcatattccggatggagacaagtcattgcgatattcgttgatgatgagtgtggcaggaacgggatatctgtccttggcgatgtattagccaagaaacgctcgaggatctcttacaaggctgcaattactcctggtgcagattctagctccatcagagacttgttggtttctgttaatctgatggaatctcgggtttttgttgtccatgtgaatcctgactctggtttaaacgttttttctgtggctaaatctcttggaatgatggcaagtggttatgtttggatcgcaacagactggcttcctacagctatggattccatggagcacgtggattcagacacgatggatctcttgcaaggagtggttgcttttcgccactacacaatcgagagtagtgtcaaaagacagtttatggcgagatggaagaatcttagaccaaatgatggctttaactcttatgcgatgtatgcttatgattctgtttggttagttgctcgtgccctcgatgttttcttcagagaaaacaataacataactttctccaacgatccaaatctgcacaaaacaaatggtagcactattcagctatcagcactaagtgttttcaatgaaggagagaagtttatgaagatcattcttgggatgaatcatactggtgtgacgggtccaatccagtttgattcagatagaaaccgggttaatccggcttatgaagttctaaacttagaaggtacagctccacgcacagtcgggtactggtcaaatcattcgggtctctctgtggtccatccagagaccttgtactctaggcctccaaacacatctacagcaaaccagcgtcttaaaggaatcatatatccaggagaagtaactaagcctcctcgtggttgggtgtttcctaataatggaaaaccgctcagaatcggggtgcctaaccgtgtgagctatacagattacgtttctaaggataaaaacccgcctggcgttagaggctactgcattgatgtctttgaagccgctattgaattgcttccatatcctgttccacgtacttatatactatatggagacgggaagagaaatccttcttatgataacctcgtcaatgaagttgttgcggataattttgatgtagctgtaggagatatcacaatcgtcacaaacagaacaagatatgtagatttcacacaaccgtttatagaatcagggcttgtggtggtggctccggttaaggaggccaagtctagtccttggtcattcctgaaaccattcactatagagatgtgggctgtcactggaggcttctttctctttgtgggagccatggtctggattctcgaacaccgcttcaaccaagaattccgtggccctcctaggcgtcaactcattaccatcttctggtttagcttctcaacaatgttcttctctcatagggagaacacggtgagttcactggggaggtttgtgctgatcatttggttattcgtggttctgatcatcaactcgagctacacggccagtctcacttcgatcctaaccattcgacagctgacatctcggattgaaggaatagatagcttggtaacgagcaatgaaccaattggagttcaagacggtacctttgctcggaactatctaatcaacgagcttaacatactaccttcaaggattgttcctctgaaagacgaagaacagtacctttctgctctgcaacgcggtcccaacgctggcggtgtggcagccattgtagatgagcttccttacatcgaagttcttttgacaaatagcaactgcaaattccgtacagtagggcaagagttcacacgcacaggctggggtttcgcattccagagagattcccctttagctgtagacatgtcaacggctatcttgcaactatctgaagaaggcgagctcgagaaaatccataggaaatggcttaactacaagcatgaatgctcgatgcagatctcaaacagtgaggactctcagctttcactaaagagtttctggggactcttccttatctgtggcatcacttgcttcatggcactcactgtcttcttctggagggttttctggcaataccagaggttgctaccagaaagtgcggacgaggaaagggcaggcgaagtgtctgagccatctcgatcagggagaggttcacgagcaccgagtttcaaggaattgataaaagttgtggataagagggaagcagagatcaaggagatacttaagcagaagagtagcaagaaactcaaaagtacccaaagtgcagctgggacttcacaatcacaacatggcgaaattacttaa

SEQ ID NO: 633 - DNA, 1398 bp, Arabidopsis thaliana
atggtttcctctcagcgtcctgtccccaacaaaatccagaaacagcaatatctatccatcagcccttcaaattctgtcttgaaagatgatgttgaacttgagttctctgatgtgtttggtccactccccgaagaggccaatgatattgcttacgacgagcctgctgttgtctacagtcgatcccactccttggttggcccgtgttcgctcgatagtcattctttgaagctgaccaagctcaccttactagagactgaggactcaattgacttggtggagtgtctcgaaggtgaatctttaaaagaaaatgatgatttctctggtaatgacgacagtgacaatgagaaagctttagagggagatctggtgaaagtctcaggtgtagtaggcatagatgattttgaggttatgaaggttgttgggaaaggtgcgtttgggaaagtctaccaggtgaggaaaaaggagacctctgagatatacgctatgaaagtcatgaggaaagatcacattatggagaagaaccatgctgaatacatgaaagctgagcgcgatattcttacaaaaattgatcacccattcattgttcaacttaaatactcttttcagaccaagtacaggctgtatcttgtgctcgactttataaacggaggtcatcttttcttccaactctatcaccaagggcttttcagagaggacttggctcgagtgtacactgcagaaatcgtctctgcagtttcccatctccatgagaaaggcataatgcacagagatctgaaacccgaaaacatactcatggatacagatggccacgtgatgctaacagattttggtttagcaaaggaatttgaagaaaacacaagatcaaactccatgtgcggaactacggagtatatggcacctgaaattgttcgaggaaaaggacatgataaagcagctgactggtggagcgtagggattcttctgtatgagatgctcacaggaaagccaccgtttctcgggagcaaaggaaagatacagcagaaaattgtgaaggacaagatcaagcttccgcagtttctgtctaatgaagctcatgcaatactgaaagggctgctgcaaaaagagccagaaaggcgacttggaagtggactgagcggagcagaggagataaaacagcacaaatggttcaagggaataaactggaagaagctggaggctagagaagtgatgccaagtttcaagccggaagtatcgggaaggcaatgcatagcaaattttgacaagtgttggactgacatgtctgttttggattctccggcgagcagtcccagttcggatcctaaggccaacccttttaccaatttcacttacgtcaggcctcctccttcattccttcaccagtccacaactactttgtag

SEQ ID NO: 634 - DNA, 2013 bp, Arabidopsis thaliana
atggaaggtcaaggttgttgtggcggcggcggcggaaagacggagatgataccgacggaggaagctctgagaatagtattcggcgtctctaagcgtctgcctccggtaatcgtatcgctgtatgaagcacttgggaaagtgttggcggaagatattcgagctcctgatcctttacctccatatcctgcttccgtcaaggatgggtacgcagttgttgcttcagatggtcctggagaatatccggtgattactgaatcaagagctgggaatgatggtttgggtgtgactgttactcctggaactgtggcttatgtgacaactggtggacctatacctgatggtgcggacgcagttgtccaagttgaggacactaaagtaattggagacgtctcaactgaatcaaaaagagtaaaaatactgattcaaaccaagaaaggcaccgatatccgtagagtgggttgtgatattgagaaagatgcaactgtactaacaactggagaaagaattggtgcctcagaaatcggcttgctagcaaccgcaggagtaaccatggtgaaggtatatcctatgccaatagttgctattctctctactggagatgaacttgtggagccgacagctgggactttaggtcgtgggcagattagggactcaaatcgagcaatgttagtggcagcagtgatgcagcagcaatgcaaagttgttgaccttggaattgttagagatgatagaaaagaacttgagaaggttttggacgaggccgtatcctctggagttgatattattttaacttctggtggtgtttcaatgggagacagggatttcgtcaagccattactcgaagagaaagggaaagtatatttcagcaaggtattgatgaaacccgggaaacctttgaccttcgccgagattagagcaaaaccaactgaaagtatgctggggaaaacagtccttgcatttggattacctggaaatcctgtgagctgtttggtttgtttcaatatctttgttgtgcctacaatccgccagcttgcaggatggacaagcccccatccactgagagtgcgacttcgacttcaggagcccatcaagtctgatcccatccgccccgagtttcatcgggccataatcaaatggaaagacaacgatggatcagggactcccggatttgttgctgagagcactggacatcagatgagcagtaggcttttaagtatgaggtcggctaatgctttgttggagttgcctgctacgggaaatgtgctttctgctggaagttctgtatcagctataattgtttctgatattagtgccttttcaatagacaagaaagcctcattatcagaaccaggctctattcggaaagaaaagaagtacgatgaagtacctgggcctgagtataaagtggctattcttaccgtcagtgatactgtctcagctggggctggacctgatcgaagtgggcccagagctgtgtcagtagttgattcctcgtctgaaaaactggggggagctaaggtagttgcaacagctgttgtccccgatgaagtggaaagaataaaagacattcttcagaaatggagcgatgttgacgaaatggatctcattcttacacttggtggtactggcttcactccaagagatgtaacacctgaagcaacgaaaaaggtgatcgagagagaaacacccggtctcctctttgttatgatgcaagagagcttaaagatcactccatttgcgatgctctcgcgctctgcggcaggaattagaggctcaacattgataatcaacatgcctggaaacccaaacgcagtggccgagtgtatggaggctctgttacctgcattgaaacacgcactgaagcagatcaaaggagacaagagagagaaacatccgaagcacatacctcacgcagaagccaccctaccgactgatacatgggaccaaagctataagtcagcctatgagacgggagagaagaaagaagaggctggatgttcttgtactcactaa

SEQ ID NO: 635 - DNA, 1308 bp, Arabidopsis thaliana
atggcgagctcggttttatcagaatgtggttttagacctctccccagattctaccctaaacacacaacctcttttgcctctaaccctaaacccactttcaaattcaatccaccacttaaacctccttcttctcttctcaattcccgatatggattctactctaaaaccaggaactgggcattgaatgtggcaacacctttaacaactcttcagtctccatccgaggaagacacggagagattcgacccaggtgcgcctcctcccttcaatttggcggatataagagcagccatacctaagcattgttgggttaagaatccatggatgtctatgagttatgttgtcagagatgttgctatcgtctttggattggctgctgttgctgcttacttcaacaattggcttctctggcctctctactggttcgctcaaggaaccatgttctgggctctctttgtccttggccatgactgcggacatggtagcttctcgaatgatccgaggctgaacagtgtggctggtcatcttcttcattcctcaattctggtcccttaccatggctggaggattagccacagaactcaccaccagaaccatggtcatgtcgagaatgacgaatcatggcatcctttgcctgaaagcatctacaagaatttggaaaagacgactcaaatgtttaggtttacactgccttttccaatgctcgcataccctttctacttgtggaacagaagtccagggaaacaaggttctcattatcatccggacagtgacttgtttcttccaaaagagaagaaagatgttctgacatcaactgcctgttggactgcaatggctgctttgcttgtttgtctcaactttgtcatgggtccaatccagatgctcaaactatatggcatcccttattggatatttgtaatgtggttggacttcgtcacttacttgcaccaccatggacatgaagacaagctcccttggtatcgtggaaaggaatggagttacctgagaggagggctcacaacattagatcgtgactacggatggatcaataacatccaccacgatattggaactcatgtgatacatcatcttttcccgcagatcccacattatcatctagtagaagcaacagaagcagctaaaccagtactaggaaagtactacagagaaccgaaaaactctggacctctgccacttcacttactgggaagcctcataaagagtatgaaacaagaccatttcgtaagcgatacaggagatgtcgtgtactatgaggcagatccaaaactcaatggacaaagaacatga

SEQ ID NO: 636 - DNA, 1473 bp, Arabidopsis thaliana
atgtctctctcttccctcactctcgactccaatccaagattcgctgttggtggaccttatcaccgccgttatcctcctcttcaccaccctcgaagcttcgtctcttgctctgctaaacgtccagctgtctccgcttcactgagcgtcgccgctgattcagccgccactgagtctcttggacggattggatcactgagtcaagtatctggtgtactcggttgccaatggggagatgaaggtaaaggcaaactcgttgacatcttagcccaacactttgacatcgttgctcgttgtcagggtggagctaatgctggacacactatatacaattcagagggaaagaaatttgcacttcaccttgtgccttcaggtatcctgaatgaggatactacttgtgtcattggaaacggagttgtggtgcatttgccaggtctcttcaaagagattgatggtttggagtccaatggtgtctcctgtaaaggaaggattttggtctctgatcgcgctcacttgttattcgatttccatcaagaggttgatgggctcagggaatctgagcttgccaagtcgttcattggcaccaccaagaggggaattggtcctgcctactctagtaaagtgataaggaatggtattagagtaggtgatctcaggcacatggatactttacctcaaaagcttgaccttttactatcagatgcagcggcaaggtttcaagggttcaagtatactcctgaaatgcttcgggaagaagttgaagcatacaagagatacgctgacagattggagccctacattactgacactgtccatttcatcaatgactcgatttcgcagaagaaaaaggttttggtcgaaggtggtcaagctacaatgttggacattgactttgggacttatccttttgttacttcctccagcccctcagccggtgggatctgcacaggtcttggtattgcaccaagtgttgttggtgatctaattggagtggtaaaagcatacactacaagagttggttcaggtccattcccgacagaaaatttgggcacaggtggtgaccttcttaggttagctggacaggagtttggcactacaactggtcgtcctcgtcggtgtggctggcttgacattgttgccctgaaattttcttgccaaatcaatggatttgcatcacttaatctcactaagcttgatgtactttcggatctgaacgaaatccagctgggtgtggcttacaagaggagtgacggcacccctgttaaatcattccctggtgatcttcgtcttctcgaagaactgcatgtggagtatgaagtcttacctgggtggaagtctgacatatcctcggtcagaaactactctgatcttccaaaggctgctcagcaatatgttgagaggattgaagaactcgtgggtgtgcccattcattacattggtattgggcccggtcgtgatgcccttatatataaatga

SEQ ID NO: 637 - DNA, 798 bp, Arabidopsis thaliana
atgtcgtcttctcgggaagagaatgtgtacttagccaagttagctgagcaagctgaacgttatgaggaaatggttgagttcatggagaaagttgcaaagactgttgacaccgatgagcttactgtcgaagagagaaacctcttgtctgttgcttacaagaacgtcattggtgctaggagagcttcctggaggatcatatcttccattgaacagaaggaagaaagcagaggaaacgatgatcatgtttccattatcaaggactacagaggaaagatcgaaactgaactcagcaaaatctgtgatggaatactcaatcttctggattctcaccttgttcccactgcatctttggccgagtccaaagtcttttacctcaaaatgaaaggagattaccacaggtaccttgctgagtttaagactggagctgagaggaaagaagctgctgagagcactctggttgcttacaagtcagctcaggatattgcacttgctgatttagctcctactcatccgattagactgggacttgctcttaacttctctgtcttctactacgagattctcaactcacctgatcgtgcctgcagtctcgcaaaacaggcttttgatgaggccatttctgagctggatacattaggagaagaatcatacaaagacagtacgttgataatgcaacttctccgtgacaatctgaccctttggaactctgacatcaatgatgaggcgggcggtgatgagatcaaggaggcgtcaaaacatgagccggaagaggggaaaccagctgagacagggcagtga

SEQ ID NO: 638 - DNA, 1512 bp, Arabidopsis thaliana
atgtctcttttctccttccccatctccactgagttgcttccatggcttctcctacttttgattcctccacttcttatcttctttcttcttcgttcccctaaaaatcttccaccaggtccaccaagattacctatcttaggaaacatccaccagctcggatccctccctcaccgcagtctcagagatctctctctcaaatatggcccagtcatcaccgtctatctcggcagcgtccgtaccgtggttgttcactctccggagacggcggaggaagttctaaaacttcacgactccgagtgttgtactcgtccaaagctatctatcaccaaaagctttttctatgatggacttggtctagggtttactaaatggggtgattactacagagatgtgcggaaactctgtgttcttgaacttttctccgttaaacgagccaactcgttccggaacataagagaggaggagctgagtcgactcgttaactcgttttctgactcggcgtcatctggatcttccgttgaccttaccgcaaatttggctaagttcgtcgcgagctttacgtgtcgaatggcgtttggattgagttttcaaggaagtggaatggataacgagacgtttctggagctgttcacggaggcgaacagagtgatcggaaaattcgcggcggcggatatattccccgggtttggctggatcttggatcggatcagtggtcttgattctagccggaggaagagttttcaagatcttgatacgttttaccagaaagctattgttgaccatcgggagaagaagaaaactgaagaccgtgaagatctcattgacgtcttgctcaagttacagagtcaagaaaccaaacttggttcttcaagaatcaccgatacacatatcagagctattattatggatttgtttgtagcaggagtagacacatctgttatcactttggattggacaatggcagagctttcaagacatccaagagtaatgaagaaagtacaagccgagattcgtgaacacgtaggagacaaaggtatagtgacatacgatgatctcgaggctctagtctacatgaaaatggtgatcaaggagacttggaggttacacgcaccgagtcctattctgattccaagagaagcaatgactaacttcaagatcaagggttatgatatttaccctggaacgcgtattcatgtcaatgcttgggctattggacgtaaccctgatgtatggaaggatcctgatgagtttataccagagagatttgttgatagcaatgtggaaactaaagggacaagttttgagctgttgccgtttgggagtggacgcagaggttgtcccgcaatgtacgtgggattaagtacggtggagtacacattggcgaatcttttgtatcattttgattggaaagcgactgaggaagtgagtgttgaagaagcacctggtctcactagccacaggaagcatcctcttcaccttgttcctgttaatgtcatcaaccgcaagctttag

SEQ ID NO: 639 - DNA, 678 bp, Arabidopsis thaliana
atggtaatggaaacagagtcaaagttccatgttttagctgttgatgatagtctttttgatcggaaaatgattgagagattgcttcaaaagtcttcatgtcaagtaactacagttgattcaggctctaaagctctggaatttctgggtttaagagtagatgacaacgacccaaatgcactctctacatcgccacaaattcatcaggaagttgaaataaatctaataattacagattactgtatgcctggcatgactggttatgatttgctcaagaaagttaaggaatcagcggcgtttagaagtatacctgtagttataatgtcatctgagaacgttcctgcaagaatctccagatgtttggaagaaggagctgaagagtttttcttgaaaccagtgaagttagctgatcttaccaagttgaaacctcatatgatgaaaacgaagttgaagaaagaaagtgagaaaccagttgccatagaagagattgtggtgtctaaaccggagatagaagaagaagaagaagagtcatcagtgattgaaatcttgcctctccaccaagaaattgaatccgaacaacttgaaccaatgttgagtagtaataagagaaaagcaatggaagaagtggtttctactgatcgatcacgtcctaaatacaatgatatcacaacctcggtctga

SEQ ID NO: 640 - DNA, 1179 bp, Arabidopsis thaliana
atggcgtttgccggcgttttgccgattgttttcttgcttatattatcatcagcggatctagcagcgagtcaatcacagcccggtccaacaaatcaaccgtataactacggcagactaagtccagccatggcagtgatcgtcgtgatcctaatcgctgctctcttcttcatgggcttcttctctatctacttccgtcactgctcaggcgtaccagacgccggtgtttctccagctggtggagctagatccagagcaaccgtcaacgcggcggcgcgtggtctcgacgtttcagttgtcgagacttttcctacgttcttgtactcagatgtgaaaacgcagaagcttggtaaaggagagttagagtgtgcgatatgtttgaacgagttcgaagacgacgaaacgctgcgtttgcttcccaagtgtgatcacgtgtttcatccgcactgcatcgatgcttggctcgaggctcacgtgacttgtcccgtttgcagagcgaatcttgctgaacaggtagctgaaggtgagtcagttgaaccgggaggaactgaaccggatcttgaattgcagcaggttgtggtgaatcctgaaccggtggttactgcaccggtaccggaacaattggtgactagtgaagtcgattcgaggagattacctggtgtaccggtggatcttaaaagagttaaattctcgagatcgcatacgacgggacattcggtggttcaaccgggagaatgtaccgaacggtttactcttcggttaccggaagatgtgaggaagaggataatgaaggattggaaattgaaccggacgaatagtcttctggttcttcctagaggagggagttcgaggagaggtaaaccgattgaccggtcaagggctcggtctgatcgatggttgtttcgtaaaacgccttcgtttctgtggaggagtcgtgatgatggttcgattaggttaggtgctaccggtagcgttcgagccagtgctgtaccgaattcaaccggtagtgattcggtacgtgcaggagaccggtgggcttttcttagaaacgcgtcgtttttgtggaggaactcttcggtacatgtgccaagaggaggagtcaataaagacggcgaaggaacttcggttaaatcgaccggtgcaagtggctcaactagcggttcggtgagattaccggtttag

SEQ ID NO: 641 - DNA, 1320 bp, Arabidopsis thaliana
atggtgacactaacaccatcttctgctagtaccccaaaaacatcttttgatttcatgaagaataacaacagtcacagcagtctctatgtttcttcttcttcttacttgagcagcaaggaagatgctcttgtcacgaccaagaagctcatggaaccaagcaaaacactaaacatgagcattaatccaaaacaagaggagtttggtgatgagaagaaaatggtgaagaaagctcctgaagatccagagattggtgtgtttggagctgagaagtacttcaatggagacatggattcagaccaaggttctagtgttctgtctctgacaaacccagaagttgagagaaccgtcgtcgactcgaagcagagcgcgaagaaatctactggtactccgagtgtccggtctgaatcaagctggaatagtcagagcgtgttgcttcagaacaaactggtgaatagctgcaacagttccttcaaggaaaagaagaacagtaatggtcagattcaaaaggtgaccaataataagaagagttttctcgcaaatttggggtgtaaatgcgcatgctctgatggggattctgtagatgtcgaggagaaaacctcggtcaagagaagcgctgatccgaatatctctgttatcacaatgagatcttctgcggatatgaacacagaactgatcaagattcagaagcaagaggagttatcacagaggaagtctcttgaagtttttggatctccagtggctattgagaagaagagtagtgttgttcagaagaaactaccattgcctccatggaaatcgagaacagaggaggacgacacaaagagtgaagggagtgattcaagctcggatcttttcgagatagagggtcttacagggaaccctaaaccttttcttacgaggcaaggaagtgatccagcttcacctacgtgttatgcgccaagtgaagtaagcgtagagtggagcatagtgacagcaagtgcagcagatttctctgttatgtcagaatgtgcaacaagtcctgtaagaagaaaccgacctactcagattcctcgaatccctattaccgctaaatcagcaccgcagagacggaaatcgagtagcagcagcggagggaatggtttcttgatgagctgcaagagtcataaatctgttatggtttctggtgatttagacagaagaagcagcatgaacaagacacaaccgagttacgttcctagattcccaatggagactactaaacctaagagtttcgaaacacgaagaaggatcagcaacagctcgatttctcacacacaatcatctcttctttatagtcagtga

SEQ ID NO: 642 - DNA, 234 bp, Arabidopsis thaliana
atggatcctagcatggcaaacaacccggaattgcttcaattcctcgcccaagagaaagaaagagcaatggtgaacgaaatggtgtcgaagatgacaagtgtgtgctgggacaaatgcatcacaagcgcaccgggaagtaagttcagctcaagcgagagttcttgcctcactcattgtgctcaacgctacatggatatgagtatgatcatcatgaaacgctttaattcgcagtaa

SEQ ID NO: 643 - DNA, 2199 bp, Arabidopsis thaliana
atgaaggtacaggagggtttgttcgtggtggctgttttctaccttgcttatacgcagctagtcaaggggcaacctcgcaaggagtgccaaactagatgtggcaatgtcgcagttgagtacccttttggtacttctccaggttgttactatcccggagatgaaagtttcaatcttacttgcaacgagcaagagaagctcttctttggcaacatgccagtcatcaacatgtctctcagcggccagcttcgtgttcggctagttagatccagagtttgctacgatagtcaaggaaaacagactgactacattgcccagcggaccaccctgggtaatttcactctctctgaacttaacagatttactgtagtaggttgtaacagttacgcatttctccgcacatctggagttgaaaaatactcaactggatgcatatcaatatgtgattctgccacaacgaaaaacggatcatgttctggtgaaggttgctgccagatccctgtccctagaggatactcttttgtcagagtaaaaccacatagctttcacaaccatcctactgtgcatctgtttaatccttgcacctacgcctttctcgttgaagatggtatgtttgacttccatgctttggaagatctcaacaatctgcgaaatgttactacgttccctgtagtactagattggtctatcggagacaagacttgcaaacaagtagaatacaggggcgtgtgtggtggtaacagcacatgtttcgattctactggtggaaccgggtataactgcaaatgtttagaaggttttgaggggaatccataccttccaaacggttgtcaagacatcaatgaatgtattagtagtagacataactgttcggagcatagtacctgtgaaaacacgaaggggagcttcaactgtaactgcccatctggttaccgcaaagattcccttaatagctgtactcgtaaagtcaggcctgaatactttagatggactcaaatttttcttggaaccaccatcggcttctcggttatcatgcttgggattagctgtctacaacagaaaattaagcaccggaagaacacagagctccgacaaaaattcttcgagcaaaatggtggaggcatgttgatacagcgagtctcgggagcagggccatcaaatgttgatgtcaaaatcttcactgagaaaggaatgaaggaagcaactaatggttaccatgagagcagaatcctgggtcagggaggccaaggaacagtgtacaaagggatattgccggacaactccatagttgctataaagaaagctcggcttggaaaccgtagccaagtagagcagttcatcaacgaagtgctagtgctttcacaaatcaaccataggaacgtggtcaaggtcttggggtgttgtttagagacagaagtccccttgttggtctatgagttcattaacagtggtacccttttcgatcacttgcacggttccttgtatgattcttcacttacatgggagcaccgtctgaggatagcaacagaagtagcaggaagtcttgcatatcttcactcttctgcttctattccaatcatccaccgagatatcaagactgctaatattctcctggataaaaacttaactgcaaaagtagctgactttggtgcatcaagattgataccgatggataaagagcagctcacaacaatagtgcaaggcactctaggttacctagacccagaatattacaacacagggttgttaaacgaaaagagcgatgtttatagttttggggtcgtcctaatggaactgctctcaggtcaaaaggcattgtgtttcgaaagaccacattgcccaaaaaatcttgtgagttgttttgcttctgccacaaagaataataggttccatgaaattattgatgggcaagtgatgaatgaggataaccagagagagatccaggaagctgcaagaattgctgcagagtgtacaaggctaatgggagaggaaaggccaaggatgaaagaagtagctgcagagttagaggccttgagagttaaaacaactaaatataagtggtcggatcagtatcgtgagacaggggagattgaacacttgctcggcgttcaaatcttgtcagcacaaggcgaaaccagtagcagcattggctatgacagcatcagaaatgtaacaacattggacattgaagctggccgttga

SEQ ID NO: 644 - DNA, 1188 bp, Arabidopsis thaliana
atggacggtggttcaggtcaaccggcggctgatacagagatgacagaagctcctggaggttttcccgcggcggctccatcgcctcagatgcctgggattgagaatattccggcgactcttagccatggtggtaggtttattcagtataacatatttggaaacatcttcgaggtcaccgctaagtataagcctccgatcatgcctattggcaagggtgcttatggcatcgtttgttcggctatgaattctgaaactaacgagagcgttgcgattaagaaaattgctaacgcttttgacaataagattgatgctaagaggactctccgtgagatcaagctgcttcgtcacatggatcatgaaaatattgttgcaatcagagatattatcccgccaccattaagaaacgctttcaacgatgtttacatcgcgtatgagttaatggacactgatctccatcaaatcattcggtcaaatcaagcattatccgaagaacattgccagtattttctttaccagatcctccgtggattgaaatacattcactctgcaaatgtgcttcacagggatttgaaaccaagtaatctcctcctgaacgcaaactgcgacctaaaaatctgcgattttgggctagctcgagtcacttctgagagtgatttcatgactgaatatgttgtcacgagatggtaccgtgcaccagagcttctcttaaactcttctgattatactgcagctatcgatgtttggtctgtaggctgtattttcatggagttaatggaccgtaagccactcttccctggacgagatcatgtccatcagcttcgcttgctcatggagctcataggaactccatcagaagaagagctcgagttcttgaacgaaaacgcaaagcgatacataagacagcttccaccttatcctcgccaatccatcactgataagttcccgacagtgcatcctttagctatagaccttatcgagaagatgttaacatttgatcctagacggagaatcacagttttagacgcattggcccatccatacctgaactcgttgcacgacataagcgatgagccagagtgtacaatacctttcaactttgattttgaaaaccatgcactctcagaggagcagatgaaggaactaatctaccgcgaggcgcttgctttcaatccagaatatcagcaatag

SEQ ID NO: 645 - DNA, 501 bp, Arabidopsis thaliana
atggcttcttcaggtttcagcggcgatgaaactgcgcctttcttcggattcctcggcgccgccgctgcgctcgttttctcctgtatgggagcagcgtacgggacggcgaagagtggagttggagttgcgtcgatgggagtgatgagacctgaacttgttatgaaatcgattgttcctgttgtcatggctggtgtgttaggtatttatggtttgatcatcgctgttatcatcagtactgggattaaccccaaggccaagtcttattacctattcgatggctatgctcatctctcttctgggctagcttgtggtcttgctggtctctctgctggtatggctattggaatcgtcggtgatgctggtgttagagcgaatgcgcaacaaccgaagctgtttgtgggaatgattctgattctcatctttgcggaagcgcttgcactgtatggtctcattgttggtatcatcctctcatctcgagctggtcagtctagagctgagtga

SEQ ID NO: 646 - DNA, 2241 bp, Arabidopsis thaliana
atggtgggggcgatggcaaacaatggaagaatccggtcagcttttccggtgactaatgggtcaaaagatctgacgccgaacagtgctccggcgagtacaaccggatctgaatatggtcctgttgagttcacaagagaagacgttgaaactcttcttaatgaacgaatcaagtacaagagcaaattcaactacaaggagagatgcgagaatatgatggattatataaaaagacttagactttgcattagatggtttcaagaacttgagttggattatgcttttgagcaagagaagttgaagaacgcattggaattgaatgagaagcattgtgttgacatggaggttagtttgaaaaacaaagaagaggagctgaatatgataattgaagagctgaggaaaaactttgaatctgttcaagttcaacttgccagggaacaaacggagaagttggcggcgaatgattctcttggaaaagagaaagaagcaagactttctgttgaaaaggcacaagctggtctcacagaagagctaggaaaagcacaaggagatcttcaaacggctaaccagaggatacaatccgtgaatgacatgtacaaactgttgcaagagtataactcaagcttgcagctgtataacagcaagctacaaggtgatcttgatgaagctcacgagactataaaacgcggtgagaaagaacggactgccattattgaaaatattggcaacttgaagggtcagttttcagcattacaggaacaacttgctgcttctaaggcttctcaagaagatatcatgaagcagaaaggtgaattggtaaatgaaattgcgagtctcaaggtagagcttcagcaagtcaaagatgaccgtgatcgccatttagtggaagttaaaaccttacaaaccgaggcaaccaagtacaatgacttcaaagacgccataaccgagcttgagactacatgttcgtcccagagtacccagatacgacagttgcaggatcgactagtgtctgatctatctacctttgagaaaatgaatgagtatgaagaccagaagcaaagcattatcgatctgaaaagtcgcgtagaagaagcagaacttaaactcgttgaaggagaaaaactacggaagaagttgcacaataccattcttgaactgaaaggtaacatacgtgtgttctgtagagttagacctctattgccgggtgagaacaatggagatgagggaaaaactatttcttacccgacatccctagaagcacttggccgtggtattgacttgatgcaaaatgcgcaaaagcatgctttcacatttgataaggtttttgcgccgactgcatcacaagaagatgtcttcactgagatttctcaacttgttcaaagtgctctcgatggttacaaggtgtgcatttttgcatatggacaaactggatcgggaaaaacttacaccatgatgggtaggccaggaaacgtcgaggaaaaaggtctgatcccgcgatgtttggagcaaatatttgagacgaggcagtctcttcgatctcagggttggaaatacgaactgcaggtatccatgttagaaatatacaatgaaacgatccgagatctcctgtcaacaaacaaagaagcagtaagaacagacagtggtgtttctccacagaaacatgctattaaacatgatgctagtggaaacacgcatgtcgctgagcttactattttggatgttaaaagctctcgggaggtttcattcctcttagatcatgctgctcgtaacaggtctgtagggaagactcagatgaacgagcaatcttccagaagccattttgttttcacgctaagaatctctggtgttaacgagagcactgagcaacaagtacaaggtgtcttgaacctgattgatcttgcggggagtgagcgtttatcgaagagtggatcaaccggagatagacttaaagaaactcaagcaatcaacaaaagtttgtcgtcgctaggcgatgtcatattcgccttagcaaagaaagaagatcatgtaccattccgaaactcaaagctcacatatcttctccagccttgcttaggcggtgacgcaaagacgctaatgtttgtgaacattgcaccggaatcttcttcaaccggtgagtctctctgctctcttagattcgcagcgagagtgaatgcttgcgagattggaacaccacgtaggcagactaacatcaaaccattggaaaatcggttgagccttggatga

SEQ ID NO: 647 - DNA, 1170 bp, Arabidopsis thaliana
atgggaggttgtttcagcaatcggattaaaacagatattgcttccagtacatggctaagttcgaaattcttgagtagagatgggagcaagggctcgtcgaccgcttccttctcttatatgcctcgaacagaaggcgagatcttgcaaaatgctaatctcaagaactttagtctcagtgaactgaaatctgcaactaggaatttccggcctgatagtgtggttggtgaaggtggatttggttgcgttttcaaaggctggatcgatgagtcctctctcgctccttctaaaccggggaccgggattgtcattgctgtgaaaagacttaaccaagaagggtttcaaggtcatcgagagtggctggctgagatcaattatttaggccagctggatcatcctaaccttgtgaaactgattggatactgcttggaagaggagcacaggcttcttgtttacgagtttatgactcgtggtagtcttgagaatcacttattcagaagaggaacattctatcagccactttcatggaacacgcgggttcgtatggctcttggtgcagctagaggacttgcttttcttcacaatgctcaaccgcaagttatataccgagacttcaaagcatctaacatcttgctagattcgaactacaacgcaaagctttcggatttcggtttggctagagatggtccaatgggtgacaacagccatgtttctaccagagtcatgggaactcagggatacgctgctccagaatatctagctacaggtcatttatcggtgaagagcgatgtatacagttttggggttgtgttactggagttgttatcaggaagacgagcaattgacaagaatcaaccagtaggagaacacaatctcgtggattgggcaagaccctacttaacaaacaagagaagacttctgcgagtgatggatcctcgtctccaaggtcaatactcactaacccgagctttgaaaattgcagttcttgcactcgattgcatatctatagatgccaagagtagaccgaccatgaacgaaatcgtcaagacaatggaagaacttcatatccagaaggaagcatcaaaagagcagcagaatcctcaaatcagcattgacaacatcatcaacaaatctccacaagctgtgaattatcctaggccttcaattatgtaa

SEQ ID NO: 648 - DNA, 621 bp, Arabidopsis thaliana
atggggaacaagagattcaggtctgataataatgcagggaaaccaacttccgtcgaagctactaggatttgggcgactaaggtcatcgaagactttcgagcctctgggaacgaagtttacacgtttgagcataatctatcaaataacgaacgtggagtgattcatcagatgtgcaggaaaatgggtattcaatcgaaaagttctgggcgtggggaacaaaggcgtctttcgatattcaaaagtaggcataagaatggaaacaagaatgaagctaatgagaaatcaaataaagagaagctcaaatgtgtgtcatttccgccgggagcagatgttattctgcaggagttatttactcattacccaccttgtgatggagatacggctgcaacatcgtttaccaagtactctggtaacaagggtaaacaaggacaatggaaagatgattttttccggaaaccacagattagcagtgaggagattctagaaaaagtggcatctttgagttctagacttaagaaggataaagctcttaaggagatcactaagctgcggtcaaagcttcccatcacatcctttaaagacgcaattacatctgcagtggaatccaatcaggttctgtga

SEQ ID NO: 649 - DNA, 1134 bp, Arabidopsis thaliana
atggccgatggtgaggatattcagccacttgtctgtgacaatggaactggaatggtgaaggctggttttgctggtgatgatgccccgagagcagtgttcccaagtattgttggtcgtcctaggcacactggtgtcatggttggtatgggtcagaaagatgcttacgttggtgatgaagctcagtccaagagaggtatcctcactctgaagtatccaatcgaacatggtattgtaagtaactgggatgacatggaaaagatatggcatcacactttctacaacgagcttcgtgttgcccctgaggagcacccagttctactcacagaggcacctcttaaccctaaagctaacagggagaagatgactcagatcatgtttgagacattcaatgtccctgccatgtatgttgccattcaggccgttctttctctctatgccagtggtcgtacaaccggtattgtgctcgattctggtgatggtgtgtctcacactgtgccaatctacgaggggtatgctcttcctcatgctatccttcgtcttgatcttgcgggtcgggatctcacagactcactcatgaagattctcactgagagaggttacatgttcaccactaccgcagaacgggaaattgtccgtgacataaaggagaaacttgcttatgtcgctcttgactacgagcaagagctagagacagccaagagcagttcttcagtggagaagaactacgagctacctgatggacaagtcataaccatcggagctgagagattccgttgtcctgaggttctgttccagccatcgctcatcggaatggaagctcctggaatccatgaaacaacttacaactccatcatgaaatgtgatgtcgatatcaggaaggatctctatggaaacatcgttctcagtggtggttccaccatgttcccaggaattgctgaccgtatgagcaaagagatcaccgctcttgcacctagcagcatgaagatcaaggtggttgcaccgccagagagaaaatacagtgtctggatcggaggatcaatccttgcatccctcagcaccttccaacagatgtggatttcaaagagtgagtacgatgagtcaggtccatcgattgttcacaggaaatgcttctaa

SEQ ID NO: 650 - DNA, 1446 bp, Arabidopsis thaliana
atggcttccgctgccgcaagttccgccttttcactccttaagtccaccggcgctgttgcttcctccgccggaactcgcgcacgtgcctcccttctgccaattccctctacctctgtttccgcgcgtcctctaggcttctccgccactctagattcccgtcgtttctctctccacgttgcttccaaagttgaatcggtgcgtgggaagggaagcagaggagtggtttctatggcgaagaagagcgtcggagatctgacctcagctgatttgaaggggaagaaggttttcgtgagagctgatctcaatgtacctctcgatgataatcagactatcactgacgataccagaatccgtgccgccattccaacgatcaagtatttgattgaaaatggtgctaaagttatcctctccactcatctgggaaggccaaagggagtcaccccaaagtttagtttggctcctcttgtccctaggctctccgagcttcttggtattgaggtcacgaaagctgatgattgtattggcccagaagtggaaagcttggtggcttctctacctgaaggtggagttttgcttcttgagaacgtcaggttttacaaggaggaagagaagaacgatcctgagtttgctaagaagcttgcttctctagctgacctttatgtcaatgatgctttcggaactgctcacagagctcatgcttctaccgaaggagtcactaagttcttgaagccttcagttgctggtttccttttgcaaaaggaactggactacctagttggtgctgtttcaaacccaaagagaccatttgcagccatagtgggtggttccaaagtctcatccaagattggagttattgaatcgcttctggagaagtgtgatattcttcttcttggtggtggaatgatcttcacattctacaaggcacagggtctttcagttggttcgtcccttgttgaagaagacaagcttgaattggctacagaactccttgccaaagctaaggccaaaggagtctctcttttgttgccaacagatgttgtagttgctgacaagtttgctcctgatgccaacagcaagattgtgcctgcatcaggcattgaggacggatggatgggactggacattggtccagactctatcaaaactttcaacgaagctctggacacaacacaaacagtcatttggaatggacctatgggagttttcgagatggaaaagtttgcggctggaacagaggcgatagcgaataaactagcagagctaagtgaaaaaggagtgacaacgataataggaggaggagactcagtggctgcagtggagaaagtaggagtagcaggagtcatgagtcacatctccactggtggtggagccagcttggagctgttggaaggaaaagtacttcccggtgtgatcgcccttgatgaagcaatcccagtcactgtttag

SEQ ID NO: 651 - DNA, 1836 bp, Arabidopsis thaliana
atggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccatatccgagcgatgttgataagcatatattggcccgacaaactggtttatcaagaagtcaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtttga

SEQ ID NO: 652 - DNA, 990 bp, Arabidopsis thaliana
atggaacctcatgaagcagaaacgtttgtgaacaagagaaccctttatgctcccattgagccatatagcagtggaaatttaaaggtttcagatgttcacactctctactgggagcaatcaggcaaacccgatggacacccggttgtttttcttcacggcgggccgggaggagggacggctcctagtaataggagattcttcgatccggagttttatcggattgttctgtttgatcagagaggtgcggggaagagtacaccgcatgcttgtttggaggaaaacaccacatgggaccttgtgaatgatattgaaaaactaagagaacatttgaaaatacctgaatggctggtttttggaggatcatggggaagcactctagctcttgcatacagtcagtctcaccctgacaaggttactggtttggtccttagagggatctttttgttgcgtaaaaaggagattgactggttttacgagggcggtgctgctgctatttaccctgatgcttgggaggagttcagagatcttattccagaaaacgagagaggtagtagccttgtggacgcgtatcacaaaagattgaattctgatgatctggaaattcaatacgcagctgcaagagcttggactaaatgggaaatgatgactgcttatcttcgtccaaatcttgaaaacgttcaaaaggcagaggatgataaattttcattggcgtttgcaaggattgaaaatcactactttgttaacaaaggtttcttcccgtcggactcacacttgctagacaatgttgataaaatacgacatatcaagaccaccattgttcagggaaggtatgacgtatgctgtcctatgatgtctgcttgggatctgcacaaagcatggccagaggcagaactcaagattgtttatgatgctgggcactcggcaaatgagccaggaatatcagcggaactcgtggttgccaatgaaaagatgaaagcacttatgggatga

SEQ ID NO: 653 - DNA, 1905 bp, Arabidopsis thaliana
atggcggtaggcgatcagacggagcagaattacttgccgaagaagaagaaatccgaaacggaagatgataagaggaagaaaattgttcccgggagcttgttgaaagctgtggtgcgacctggaggaggtgattcgagccccgttgatggtgatcaggttatttatcactgcactgtacggacactggatggtgtagttgtggaatctacgaggtcagaatctggagggagaggtgtaccgatcagagatgtcttgggaaacagcaaaatgattcttggattgctcgaaggaattcccacgatgcacaagggtgaaattgcaatgttcaagatgaaacctgaaatgcactatgcagagattgattgtccagtctcagctccagaaaattttccaaaagatgatgagcttcattttgagattgagttgttggatttttctaaagccaagattgcaagtgatgatctgggggtcatcaagaagattctaaatgaaggtgagggctgggaatctcccagagaaccctatgaagtgaaagccagaatatctgctaaatccggtgatggacacgtgatcttctctcacacagaagaaccttatttcttcacatttggaaaatctgaggtgcctaaaggtcttgaaatcggaattggaaccatggctcggaaggagaaggcagtgatatatgttcgcaagcagtacttgactgaatctcctttgttgcatatagatcaagaccttgaggaagttcattttgaggttgaactggtacatttcattcaggtgcgggacatgcttggagatggacgtctcataaaacgtcgaattcgagatggaagaggcgagtttccaatggattgtcctctccaagatagtcgtttaagcgttcactacaagggcatgcttctcaatgaagagaagactgtcttctatgatagcaagattgacaataatgatcaaccgttggagttcagttcaggagaaggactggtccctgaagggtttgagatgtgtactcgtttgatgctacctggggagattgctcttgttacatgcccccctgattatgcatatgacaaatttccgagaccacctggcgtgtctgaaggtgcacatgttcagtgggagattgaactccttggtttcgaaacgccaagagactggactggcttgaacttccagagcatcatggacgaggcagataaaatcagaagcacgggtaataggcttttcaaagaaggaaaatttgagctcgcaaaagcaaagtacgaaaaggtgctccgggaatttaatcatgttaacccacaagatgaagatgaaggaaaaatatttggtgacacaaggaatatgttacatctgaatgttgcggcttgcttgcttaaaatgggagagtggaggaagtctatagagacatgcaataaggttctagaagcaaagcctggtcatgtgaaaggtctataccgccgcggaatggcttacattgcaggtggagagtatgatgacgctagaaatgacttcaatatgatgatcaaagtggataaatcatcagaagctgatgcgaccgctgctctattgaaactgaagcagaaggaacaggaagcggagagcaaggctagaaaacagttcaaaggattattcgacaagagaccgggggagataaccgaagttggttcagaaataagagaggagtctaaaactatagaagaagtagatgagacaaaggataatgatgatgatgaaacactggaagaagaaggagctacgacagtgagcacggaaaggaagaggaaatggtcggagaaagcctggccgtttctgaagaacgtgatgctccaaatcggaatccagcttggtgttgttctgatagggattttgattttccagtttgtgagcgccaaatttacatga

SEQ ID NO: 654 - DNA, 1044 bp, Arabidopsis thaliana
atgggctgttcgttttcaggattgaacgcactttacgacgccgtcaacggtggaggtgacgtatggatcaatgagaatcgattcaggatcgtgaggcagctcggcgaaggaggtttcgcattcgtctttttggtcaaggaaattgtcgccgacgcttcctccgccgcatccggtggtggtctagctaagaaagtcaaggatccggctcatctctccgctgacggaacttatgctatgaagaaagttttgattcagaacaaggagcaattggaattggtgcgtgaggagatccgtgtttcttcattgttcaatcaccctaatttgcttccactccttgatcatgccattatttctgttaaggacggccaagagggagcttggaaacacgaggccttcttgctgtttcctgttcacttggatgggaccttgctggataatttcactttgatgaaggctaaaaaagaaactttctcaacaactgatgttttgcacatattccgtcagctttgtgatggacttaaacacatgcactctctggagccaccatatgctcacaacgatgtcaaacctggcaacgtccttttaacacgtagaaaaggacagcctcctcttgcgatattgatggactttggaagtgctcgcccatcacggaagcaaatccgttcccgtcaagaggccttacagttacaggaatggacatctgagcattgctcagcaccgtttcgagctcccgagctctgggattgcccaagccatgctgatattgatgagagaacagatatctggtcactaggctgcacattatatgcaataatgtatggtgtgtctccattcgagtatgcgcttggagaatctggtggaagtcttcagcttgcaatcgtgaacgctcagatcaaatggccaaacactggaccaaaagcttcttaccctgaagctcttcaccagttcgtaacttggatgctgcaaccacaagctgctgttcgaccgcgcatagacgatatcatcatccatgtcgacaaattgatcgctaaattcaccaaatga

SEQ ID NO: 655 - DNA, 1515 bp, Arabidopsis thaliana
atggtgagtcttctatcttttttcttgcttctactcgtccccattttcttcttgttaatcttcaccaagaagatcaaggagtcaaaacaaaatcttcctcctggcccagcaaagcttccgatcatcggaaacctacaccagctccaagggttgcttcataaatgtcttcacgatctctccaagaaacacggacctgtgatgcatctccgtctagggtttgccccaatggtcgtaatttcatcaagtgaagcagctgaagaagctcttaaaacacatgaccttgagtgttgttcaagacctatcactatggcctcaagggttttttcgcgtaacggtaaagacatcggatttggggtttacggtgatgaatggagagagctgcgtaagctttcggttcgcgaattctttagcgtgaaaaaagttcaatccttcaagtatattagagaggaagagaatgacttgatgatcaagaaactgaaagaattggcttcgaagcaatctccggtggatttgagcaaaatcctctttggtctcactgcgagtatcatattcagaaccgcctttggacaaagtttctttgataacaagcatgtcgatcaggaaagcatcaaagaactgatgtttgaatctctgagcaatatgacttttagattctctgattttttccctactgctggtcttaaatggtttataggctttgtgtcaggccaacataagaggctttacaacgtcttcaacagggttgatactttttttaatcatatagttgatgatcatcactcgaagaaagcaactcaagatcgtcctgatatggtcgacgctatcttagatatgatagataatgaacaacaatatgcatctttcaagctcaccgttgatcatctcaaaggagtcctctcaaatatatatcacgctggaattgacacaagcgccatcaccttgatttgggcgatggcagagctcgttagaaacccgcgggtaatgaagaaagctcaagacgagatccgaacttgcattggaatcaaacaggaaggaagaatcatggaagaagatcttgataagcttcaatacttgaagcttgtggtgaaagaaaccttaagactacacccagcagctcctcttttacttcctcgagaaacaatggctgatatcaagattcaaggctacgacattcctcagaaaagagctcttcttgttaatgcatggtctataggacgagatccggaatcctggaaaaatcctgaagagtttaacccggagaggtttattgattgtcctgtggattacaagggacatagctttgagttgttaccatttggttctggtcggagaatttgtccaggaatagctatggcgatcgcaaccattgaattggggctcttgaatttgctctacttctttgattggaatatgcctgagaagaagaaagatatggacatggaagaagctggtgatctcactgttgataagaaagttcctcttgagcttctgccagttattcgcatcagtttgtag

SEQ ID NO: 656 - DNA, 798 bp, Arabidopsis thaliana
atggcgcttgcgtatgatcctctcttcattacatcggacaaatctttgtccgcctttgatgttgcctcttcaccgcctcagcccatgaatttaacacaagacgagctcaaacgtatcgccgcttacaaagccgtggaattcgtcgagtccggcatggttctcggtctcggaaccggctccaccgccaaacacgccgtcgaccgaatcggcgagcttctccgtcaaggcaaactcgagaacatcgttggtataccaacgtctaagaagacgcaggagcaggctctgtctctcggcatccctctctctgatctcgacgcacaccctgtcatcgatctctccatcgacggcgcagacgaggtcgacccttttctcaacctggtaaaaggcagaggagggtctctgcttcgagagaagatgatcgaaggagcttctaagaagtttgtggtgattgttgacgactccaagatggtgaagcatattggtggaagcaagcttgctcttccggtggagatagtgcccttttgctggaagttcacggcggagaagctccggagtctgctggaaggatacgggtgtgaagcgaatcttcggttgggagagaaagggaaggcctttgtgacagacaatgggaattacatagtggatatgcatgtggaagaggatatgggagatttgggagcagtgagtgatgcgattctgaggctaccgggagtagtggaacatgggatgtttctggatatggcttctactgttatcattgcaggtgagcttggtgttaagatcaagaacaaacactga

SEQ ID NO: 657 - DNA, 1083 bp, Arabidopsis thaliana
atgtcgacttctaagaccataaccttcactctcttcatagcagcactactctcgtcctgcgacgcagccacaaacgctacatcgcaaccactatttccagcgattcttatctttggcgattcaacagttgacacaggtaacaacaactaccactcacaaacaatcttcaaagccaaacatcttccttacggaatcgatctcccaaaccacaaagctagtggaagatttacaaatggcaaaatcttttccgacataatcgcaacaaaactcaacatcaaacagtttgttcctcccttcttacaaccaaatctctctgaccaagagattgtaaccggagtctgttttgcatcagccggtgcgggttacgatgaccataccagtctctctacgcaagcgattcgtgtcttggaccaacaaaagatgttcaagaattacattgctcgtcttaaaagtatcgtaggagacaagaaagctatggaaatcataaaaaatgctttggtggttataagtgcagggcctaacgattttatcttgaactattacgatattccttcaaggcgtcttgagtttcctcacatttctggttaccaagactttgttcttcaaaggcttgacaatttcgtgcgggagctttacagtttaggttgccggaaaattatggtaggaggtttaccgccgatgggttgtttaccgattcaaatgactgctaaattccgaaacgctctaaggttctgcttggaacaagagaaccgagactctgtcttatacaatcagaaacttcagaatctattacctcaaatcgaagcatcgcttacaggaagcaagatcctttactccaatgtctatgaccctatgatggacatgatgcaaaaccctagcaaatacggtatagatgatacaatctctttcttgtttggcaaggatttaaagagacgaagagaggatgttgtggaacagggcatttggagacgagcttcatgtgtaatgctttttctccaacgtgtagaaatcactcggagtttttgttctttgactcgattcatccatccgaagctacttataattatatgggcaattttctag

SEQ ID NO: 658 - DNA, 915 bp, Arabidopsis thaliana
atggacgaaggagacctagaagcaatagtcagaggctactccggctccggagacgcgttttccggcgaaagttccggtacgttttcaccttcgttttgcctaccgatggagacgtctagtttctacgaaccggagatggagacaagtggcttagatgagctcggtgaactttacaaacccttttaccctttctccacacaaacgatcctcacaagctcggtctctctccctgaagattcaaaacctttccgagatgacaagaaacaacgatcacatggttgtcttttatccaacggatcaagagctgatcatatccgaatttcagaatccaaatcaaagaaaagcaagaagaatcaacagaagagagttgttgagcaagtgaaagaagagaatctgttgtcggacgcatgggcgtggcgtaaatacgggcagaaacccatcaaaggatctccatacccaaggagttattacagatgcagtagctcaaaagggtgtttggcaagaaaacaagtcgaaagaaatcctcaaaacccggagaaattcaccataacatacactaatgagcacaatcatgaactaccaacccggagaaactcattagccggttcgactcgagcaaaaacttcccaacccaaaccaaccttaaccaaaaaatccgaaaaagaagttgtttcttcccctacaagtaatcctatgatcccatccgctgatgaatcttctgttgcggttcaagaaatgagcgttgcggaaacgagtacgcaccaagcggctggagcaatcgagggccgccgcttgagtaacggtttaccatcggatttgatgtccgggagcggaacttttccaagttttaccggtgacttcgatgaactattgaatagccaagagttcttcagtgggtatttatggaattactag

SEQ ID NO: 659 - DNA, 2589 bp, Arabidopsis thaliana
atggcggagatcgggaagacggtgttagatttcggctggatagcggcgagatccacggaggtcgatgtcaacggcgttcagctcactaccaccaatcctccggccatcagttccgaatctcggtggatggaagccgccgtacctggaactgtattgggcacattggtgaaaaacaaagcaattccggatcctttttatggacttgaaaatgaagcgatcacagatattgccgattccggaagggactactacactttctggttcttcactaaattccaatgtcaaaggttattgaatcaatacgtgcatttgaatttccgtgccatcaactactctgcacaagtgtttgtaaatggccacaagacagagcttcccaaagggatgtttcgcagacatacacttgacgtcactgatattctccatcctgagagcaatttacttgctcttattgttcatcccccagatcatcctgggactatacctcccgagggaggccaaggtggtgatcatgagcctgtaagaataattgatccccatttggtctcaaccttctttgacgattacaagagagcttacttgcatgtgactgctgaactggaaaacaaaagcacatggaatactgaatgttctgtgaatattcaaataacagccgaactcgaaaacggtgtctgtttagtagagcatcttcagacagagaatgttttgatccctgctcaaggacgtattcagcacacatttaaaccactctatttctataaacctgaattgtggtggcccaacgggatgggaaagcaaaacctttatgacatcttgatcactgttgttgtgaatgaattcggagaatctgattcgtggatgcagccatttggattccgaaagattgagagtgttattgatagtgttactggtggaaggctgttcaagatcaacggagagccgatcttcatccgtggtggcaattggatactatcagatggactgttacgtctctctaaagaacgttacagaaccgacataaaattccatgcagatatgaacatgaacatgatccgttgctggggcggtgggttggctgaaaggccagagttttatcacttttgtgatatctacggcttgttggtgtggcaagagttttggatcactggcgatgttgatggaagaggtgttccagtatcaaatccgaatggaccactagaccatgaattattcctcttatgtgctcgtgatactgtcaaacttctgagaaaccatccaagcctggctctttgggtgggtggaaatgaacaagttccgccaaaagacataaatgaggctctaaagcaagaccttaggcttcattcttattttgaaacccaattgttatcagacaaagattcagatcctagtgtttatcttgacgatggaaaggggaacttcactgacggcccttatgagattcaataccctgaagatttttttaaagacacatattacaagtatgggttcaatccggaggtcggctcggttggaatgccagttgcagagacgataagagcgacaatgcctccagaaggttggacgattcctctgttcaaaaagggtttggacgggtttattaaagaagtgccaaatcgaatgtgggattatcacaagtacattccatattctaatcctggaaaagtgcatgaccagattctgatgtacggtactccagagaatctcgatgacttctgcttgaaggctcaactggtaaactacattcagtacagagctctattcgagggttggagttcgcaaatgtggacgaagtacacgggtgtcttgatctggaagaaccaaaatccatggactggtctcagaggtcaattctacgatcatcttctcgaccaaacagccagtttctatggctgccgttccgctgcagagccagtccatgtacaattgaacctggcaagttactttgttgaggttgtaaacacgacttctaaagagctgtcggatgtggcaatagaggcatcagtatgggacctagacgggaactgcccatactataaagtgtttaaaattgtctctgccccaccaaagaaagttgtgaaaatatcggaattcaagtatccgaaagcagcaaacccaaagcatgtatatttccttcttctcaaactgtacactgtctcagacaaagcagttatatcccggaacttctactggctgcatctgcctggaaaaaattacacactcttggagccgtacaggaagaagcaaatacctctcaagatcacttgcaatgcagttatggtgggttcaagatatgagctggaggtcaatgttcataacacatctagagctaacttagccaaaaacgttgtccaggaagacgaaaaacatagcaaccgtggtttgaaagtagtggaaatgaagggatcggattcaggagttgctttcttccttcgtttctcagttcacaatgcagagacagagaaacaagatacgaggattctaccagtacactactcagacaactatttctcactagttccaggcatgaagaagtctcctcgtgttatgcttcagggctggaactaccctgataggtttagtgtttttggttga

SEQ ID NO: 660 - DNA, 2844 bp, Arabidopsis thaliana
atggaaaacccttttgcttctagagaaaaggggtttggtaattattcagattttccaacagaacaaatggatggtttaagctcaaactttggttctggcgttaggaatttgatctctgatgatatgttcaacccttcctccgagcttatgaatttcgactctttggccgcatggtgtaacagcccttccgctactgatatattgttcgcccaatatggtctgtcgaactcccaacctatgccttttggagctttcacttcatttcatgtagctgacccgaaggctaccagtctcactcgttcgttctatgatttggaaagctcttactatggtgaagaaagatcgtcagcacaggaaatgaattctcagtttcatcgctcttcagatagcgatgagttaagtggtaaacgacgcaaggttgttaatcagaagattggttttcctaacgtactcaactgtactattcccaggtctttgagccactcattagatgagaagatgcttaaggcattaagcttatttatggagtcctcaggttcaggtgagggcattttagcgcaagtttggacccctatcaagacaggagatcagtacttgctcagtacttgtgatcaggcctatttgcttgatccgaggttttctcagtaccgtgaagtgtcaaggagatttacgtttgctgctgaagcaaatcaatgttcttttccgggtcttcctggccgagtctttatctcgggagtacctgaatggacatcaaacgttatgtattacaagaccgatgagtatttgcgcatgaagcatgcaattgacaatgaagtccgtggttccattgcaatacctatccttgaagcttctgggacatcttgttgtgctgtcatggaactcgttacatccaaggaaaaacctaattttgatatggagatggactctgtttgccgtgctctccaggctgtaaacttacggacagcagccattcctcgtcctcagtatctttcaagtagtcaaagagatgccttagctgaaatacaagatgttcttcgaacagtatgtcatgcacacaagttgcccttagctcttgcctggattccttgtagaaaggatcaatctataagggtttctggacaaaaatctggtgaaaattgtatactttgcatagaggagacagcttgttatgtgaacgatatggagatggaaggctttgtgcacgcatgtttggagcattgtctaagagaaaaagaaggaattgttggtaaagctttcatatccaaccagccgttcttttcttctgatgtgaaggcatatgacatcagtgaataccctattgttcagcatgctcgaaagtacggtctgaatgctgctgtcgctataaaactgaggagcacttacactggtgaagatgattacatacttgaactgttcttgcctgtaagtatgaaaggaagcttggaacaacaacttctattagacagcctttcgggtacaatgcagagaatttgtcgaactttgagaactgtttcagaagtggggtcaactaaaaaagaagggactaaacctggatttcggagtagtgatatgtctaatttcccgcagacaacgtcttcagaaaattttcagacaatatcattggattccgagtttaactctactagaagcatgttttcgggtatgtcctctgataaagaaaacagtatcacagtatctcaaggcactttggagcaggatgtgagcaaagcaagaacaccagagaagaagaaaagcactacagagaaaaatgtgagcttaagcgctctccaacaacacttctctgggagtctaaaggatgctgcaaaaagccttggtggtgagacttccgcatatttccaagcatgggtttattttttttgtccaactacattgaaacggatatgcaggcaacatgggatcatgaggtggccatctcgtaagattaacaaagtgaacaggtcactaaggaaaatacagacggtactggactcggtccaaggtgtagaaggaggactaaagttcgactcagcaactggcgaattcattgcagttagaccttttattcaagaaattgatacccaaaagggtctgtcgtctcttgataatgatgcacatgcaagaagaagtcaggaggatatgcctgacgatacttcattcaagctccaggaagctaaatctgtcgacaatgccattaagttagaggaggatacaaccatgaatcaagcaagaccaggatcattcatggaggttaatgctagtggtcagccatgggcttggatggccaaagagtctggcttgaatggcagtgaaggaataaagagcgtttgcaacttaagctctgtggaaatttcagatggaatggatccaacaatccgatgcagtggcagtattgttgaacctaaccaatccatgtcatgcagcatatcagattcatcaaatggctcaggcgcagttctgcgtggaagctcatctacttccatggaagattggaaccaaatgagaacccacaacagtaatagcagcgagagtggatcaacaacgctgatcgtaaaggccagttatagagaagacactgtacgtttcaagttcgagccatcagttgggtgtcctcagctctacaaagaagttggaaaacgttttaaactgcaggacgggtcgtttcagctgaagtacttggatgatgaagaagaatgggtgatgctggttacagattctgatctccaagaatgtttggagatattacatggtatgggaaaacactcggtgaagtttctcgttcgtgatttgtctgcccctctaggtagttctggtggcagtaatggttatcttggaacaggcttatga

SEQ ID NO: 661 - DNA, 1344 bp, Arabidopsis thaliana
atgagaaaattgtataggaagctggtttcattcagagacccatttgctagggtcaagagacatgttagttcacattcagggtttagagctttcagcgacagaaaatggttgttcccttttctagctagcttgatcatgtccattactcttctgattttgttaatttctggccaattcgacaacttctttggggaagaagatcaattaccagttgatgttgtttcagagtctaatgactactttgtagaatcagatttcaagcaatctatgaattcgacggctgatgttaatccagagcctcctagattagcttatttaatatcgggaacaaaaggcgatagtcataggatgatgaggactttacaagctgtgtaccatcctagaaaccagtatgttctgcatttggatcttgaggctccacctcgagaacggatggagctggccatgtccgtgaagactgatccgactttccgtgaaatggagaatgttcgtgtgatggctcagtctaatcttgttacttataaaggccctacaatgattgcttgtactcttcaagccgtttcaatcttgctaagagaaagcttacattgggattggtttcttaaccttagtgcctcggattatcctctagtaacacaagatgatttgttgtatgtcttctcaaatctgtctcggaatgtcaatttcatcgagaatatgcagctcaccggatggaaactgaatcagagggctaaatcaatcattgttgatcctgccctatacctatcgaagaaatccgatatcgcttggactactcaacggcgatcacttccaaattctttcaggctattcactggctcagcttggataatgttgactcggtctttcctcgagtactgcatttggggatgggataatttcccaagaacaatactaatgtactacacaaatttcgtatcttctcctgaaggatacttccacacagtaatctgcaacagcaaagagtttatcaacactgcaatcggtcacgaccttcactacattgcttgggacagtcctccaaagcaacaccctagatctctctcgttgaaggattttgacaatatggtcaagagcaaagctccatttgcacgcaagttccacaaaaacgatcctgcgttagacaagatcgataaagagctattgggacggacacaccggtttgcaccaggaggatggtgtgtcgggagttcagctaatggcaatgatcagtgctctgtgcaaggtgacgactcggtgttgaaaccaggacctggttctgagaggttgcaggagcttgttcaaacactttcctctgaagaatttaggcgaaaacagtgttcttga

SEQ ID NO: 662 - DNA, 1242 bp, Arabidopsis thaliana
atggacagtgtaattaggtttaggaacagtatcaagatcaacagatctcgtgcttactacaaatcagaggagtcagatatcacggaaggagttgtgccatcggctgatggctcagctgaagctattttagttgaaggaaatctacagaacgcatctccatggtggcagcagtttcctagacgctgggtgatcgtcttgttatgcttttcgtcttttcttctttgcaatatggaccgtgtgaacatgagcattgcaattcttcccatgtcacaagaatataactggagtagtgcaactgttggcttaattcagtcctctttcttctggggctatttacttactcagattctgggaggtatatgggcagataagtttggcgggaagggtgttgcaatgcctgctatgaacaacatgctttctaaatggatccctgtctcagagagaagcagatcgcttgcactggtctatagtggcatgtatcttggttccgtcacaggattggcattctctcctatgctaatcaccaagttcggatggccatctgttttctactcgtttggctccctcggaagtatatggtttttgctatggctaaaatttgcatatagctctcccaaggatgacccggacctaagtgaagaagaaaaaaaggttatactgggaggtagcaaaccaagggaacctgttacagtgattccatggaagctaatactgtctaaacccccagtctgggctctcataatttcccacttctgccataattggggaactttcatactattgacatggatgcccacatattacaatcaggcacggagttcagcttcagttatatccttactgtttaatattttttgtgaacaagtcttgaagttcaacctcactgaatccgggctactatgcgttttgccatggctaaccatggctgtttttgctaatattggaggttggattgctgatactcttgtgagcagaggtctttcaattacaaacggctctgatgcattctctcagtcgggtctctactctaatcatcaagacattggcccacgatacgctggtgtactcttaggactatcaaacacagcaggagtcctagctggtgtctttggcactgcagctactggttacatcctccaacgaggttcatgggatgatgtgttcaaagtagcagttgcactgtatctaattggaactctggtctggaacttgttcgcaaccggagaaaaaattctcgactag

SEQ ID NO: 663 - DNA, 876 bp, Arabidopsis thaliana
atggcgtctaaatcgaagcagcatcttcgttatcagccgcgaaaatctgtgtcacgatcaacacaagctttcacggtgcttatacttcttctcgtagtgattctgattcttctgggtctcgggattttgtcactacctaatgctaatagaaactcttccaagacgaatgatttgaccaacattgtacgaaagagtgagacgagttctggagatgaagaagggaatggtgaacgttgggttgaagttatttcttgggagcctcgtgctgttgtttatcacaatttcttgactaatgaagaatgtgagcacttgatcagccttgctaaaccgagtatggttaagtcaaccgtggtagatgagaaaaccggtgggagcaaagatagcagagtgagaactagctcaggaacttttcttagaagaggacatgacgaagttgtcgaggtgattgagaaaaggatttcagatttcaccttcattcctgttgaaaatggtgaaggtcttcaagttcttcactaccaagttgggcagaagtatgagcctcactatgactatttcttagatgagttcaacaccaagaatggaggacaacgaatagctactgtgcttatgtacctctctgatgtcgatgatggtggcgagactgtgttccctgcagcaagaggaaacattagtgctgtcccatggtggaacgagctctcaaaatgtggtaaagaaggactatctgttctaccaaagaagcgagatgctttacttttctggaacatgaggcctgatgcatctctagacccttcgagcttgcacggtggatgtccagtggtgaaaggaaacaaatggtcatccacgaaatggttccatgtccacgagttcaaggtttaa

SEQ ID NO: 664 - DNA, 1755 bp, Arabidopsis thaliana
atggcgaggacgacgcgagaaagagtgaaatcgttcataaacaatagatggctagtgtttgttgcggccatgtggattcagtcttgcgctggcatcggttacttgttcggcagcatctctcctgtcatcaagagctccctcaactacaaccagaaacagctctccaggctcggtgtcgccaaagatctcggcgatagtgtcggcttcctcgctggtactctctccgagatcttgcctctctgggccgctcttctcgtcggctctgtccagaaccttgtcggctatggctgggtttggcttatcgtcaccggtcgtgctcccattcttcctttatgggctatgtgtatcctcatttttgttgggaacaacggggagacctacttcaacaccgctgcattagtttctggtgttcagaactttcccaagagccgtggtcctgtcgtcggtatcctcaaggggtttgctggcctcggcggtgccatcctctcccaggtatacacaatgatccactcctctgaccgtgcatccctcatcttcatggttgctgttgccccttcagttgttgttgttcctctcatgttcttcatcagacccgtcggtggtcacagacagatccgttcttctgatgccaccagcttcaccgtcatctatgccgtctgcattctacttgctgcctatctcatggcagtgatgcttgttgaagatttcattgatcttagccattcaatcatcattgctttcaccgttgtcttgtttgccattcttcttgtacccatcttcataccaatcgcaacgagttgcttcacagcatcaaccgacccctgtgacacgctcgaagaacctctccttggcgatcagcaaggtcaggatccgggacagtccaccacccctgaccatggtcctgagcttatatttagtgaagtggaagacgagaaaccaaaagaagtagatttgcttcctgcagtggagagacataagagaattgctcagttgcaagcaaagctgatgcaagcagctgcagagggtgctgttcgggtcaagagacggaggggccctcacagaggcgaggattttactttaactcaagcactcgttaaagccgatttctggctcatcttcttctccctcttgctcggatctggttcgggtctaacggtcatagataaccttgggcagatgagtcagtctctcggttacgataacactcacgtctttgtgtccatgattagcatttggaacttccttggacgcattggaggcggttatttctccgaactcatcgtcagggactatgcgtacccaagaccggttgctatagcagtggctcagcttgtaatgtcagtaggacacatcttctttgcatacggatggcctggagctatgcacatcggcacactattgattggacttggctatggtgctcactgggccatcgtcccagccactgcctctgagctctttggtctaaagaagtttggagctttatacaatttcctgacgctggccaacccagcgggatccttagtcttttcggggctgatcgcaagttccatttatgaccgcgaagcagagaggcaagcacaaggatccttgttcaatcctgacgatgtcctgagatgccgaggttccatctgttacttcttgacgtcactcataatgtctggattctgcctcattgcggccgccttgagtatgatccttgtgcaacgtacgaagccggtttacacaaatctctacggcaaaacccgcaactga

SEQ ID NO: 665 - DNA, 1674 bp, Arabidopsis thaliana
atggcgtctcttctcgcaaacggtatctccagcttctctccacaacccacttccgattcctcaaaatcaccaaaagggtttcacccaaaacccgaatccttaaaattcccatctcccaaatccctaaatccaacgagaccgatcttcaaactcagagccgatgttggaatcgattctcgtcccatcggagcttctgaatcatcatcatcaggtacatcaaccgttagctcaactgataaacttcaacagtatttccaaaatctcgattacgataagaagtacggattcgttgaagatatcgattccttcacaatccctaaaggtttatctgaagagacgattcgtttgatttcgaaattgaaagaggaaccagattggatgcttgagtttaggttcaaagcttatgctaagtttctgaaactagaagaacctaaatggtcagataatagatatccttcgattaatttccaggatatgtgttattactctgctcctaaaaagaaaccaactttgaatagtttagatgaagttgatcctcagcttcttgagtatttcgataagttaggtgttcctttaacagagcagaaacgtttggctaatgtcgcggttgatgcggttatcgatagtgtttcgattgctactactcataggaagactttagagaagtctggtgttatcttctgttcgatatctgaagctattagggagtatccggatttgattaagaagtatttaggtagagttgtgcctagtgatgataattactacgctgctttgaactctgcggttttcagcgatgggtctttctgttatataccgaagaacactagatgtccgatgcctatttcgacttatttccggattaacgcgatggagactggtcagttcgagaggactttgattgttgctgaggaagggagttttgttgagtatttagaaggatgtactgctccttcttatgatacgaatcagcttcatgctgctgtggttgagctctattgtgggaaaggagctgagattaagtactccacggtgcagaattggtatgctggggatgaacaaggtaaaggtgggatttataattttgtcacaaagcgtggtctttgcgctggggatcgttccaagatctcgtggactcaggttgagacagggtctgcgataacttggaagtacccgagcgtggttttagaaggcgatgattctgttggcgagttttactccgtggcattgactaataactatcagcaagctgatacagggactaagatgattcacaaaggaaagaataccaaaagtagaatcatttcaaagggaatttcggccgggcattcgagaaattgttaccgtggtcttgttcaggtgcagtccaaagctgagggtgctaaaaatacttcgacttgcgactcaatgcttatcggagacaaagcagctgcaaatacctatccttacatccaggtaaagaatccatcggcgaaagtagagcacgaagcgagtacctctaagattggagaagatcagctattctatttccagcagagaggaatcgatcacgagagagcattagcggcaatgatctctggtttctgcagagatgttttcaacaagttacctgatgagtttggagctgaagttaaccagcttatgagcatcaagcttgaaggatcagtgggttaa

SEQ ID NO: 666 - DNA, 504 bp, Arabidopsis thaliana
atgatgctcaagcaagctgcgaagaaggccctagggcttacgtcacgtcaatcaacaccgtggtctgttggtatcctccgaacctaccatgagaacgtcatcgaccactacgataatccccgcaacgttgggtctttcgataagaatgatcccaacgttggtacgggactcgtaggagctcccgcttgtggtgatgtgatgaagcttcaaatcaaggtcgatgagaagactggtcaaatcgttgatgctcgctttaagacttttggttgtggttcagccatcgcttcttcatctgttgccactgaatgggtgaaaggcaaagctatggaggatgttctgaccatcaaaaacaccgaaatcgcaaagcatctttctctcccaccagtcaagctccactgcagtatgttggcggaggacgctatcaaggcagctgtgaaagactacaaggagaagcgtgtgaagacaaatggtgctgcagcagcaggagaaaccacacaggcttga

SEQ ID NO: 667 - DNA, 3375 bp, Arabidopsis thaliana
atgggttggtggatctttgagtttaagaaagaatcaaaatctatgtttgttggggttttgtttctcttgactcttctggtttggacttcagagagtttgaatagtgatggtcagtttctcttggagttgaagaacagaggatttcaagattcgttgaaccgtttacataattggaacggcattgacgagacgccgtgtaattggataggtgtgaattgcagctcacaaggcagtagtagtagtagtaatagtctggtggtgacatctcttgatttgagttctatgaatctctctgggatagtaagtcctagcattggtggtttagttaacttggtctatcttaacctcgcgtacaacgcgttaaccggagatattcctcgggagattggaaactgttcgaagctggaggttatgtttttgaacaataaccagtttggtggttccattccagtcgagatcaacaagttatcgcagttgagaagtttcaacatttgcaataacaagctttcaggtcctttgccagaagagattggtgatttatacaatctagaagagcttgtggcttatactaataacttgaccggtccattgcctcgttctttaggaaatctcaacaagttgacgacatttcgagcagggcagaacgatttctcggggaatatacctactgaaattggtaaatgtcttaacttgaagttgctcggtcttgctcagaatttcatttctggagagcttcccaaggaaattgggatgcttgttaaacttcaggaggtgattctgtggcagaacaagttttcagggtttattccgaaagatattgggaatttaacaagtcttgagactcttgctttgtacggtaactcattggttggacctataccatcagagattggtaacatgaagtccttgaagaagctctatctttaccaaaaccagttgaatgggactatcccaaaggagcttggaaagctttccaaagtaatggaaatcgatttctcggagaatttgttgagtggggagattccagttgagctgagcaagatcagtgagttgaggctgctctatttgtttcagaacaagttaactggaatcataccaaatgagctcagtaagttgaggaatttggcgaaactcgatctctccatcaactccttaaccggtcctattccaccgggtttccagaatcttacgtctatgcgccaacttcagcttttccacaattccctcagtggtgtaatccctcaaggtcttggtttgtacagtcctctatgggttgttgacttctcagaaaaccaactttcaggaaaaataccgccttttatctgtcaacagtctaatctcattctgttgaatctcgggtctaacaggatatttggaaatattccaccaggtgtattgcgctgcaaatctctgctgcagcttcgtgttgttggaaaccgactcactggtcagtttccgactgagttatgcaagcttgtcaacctttctgctattgagttggatcaaaaccggtttagcggaccactacctcctgagataggcacgtgtcagaagctgcaaagacttcatcttgcagctaaccaattttcctctaatctacccaacgaaatcagtaaactctccaacctggtaacatttaacgtttcctcaaactctctcactggaccaatcccctctgaaatagccaactgtaaaatgcttcaacgacttgacttgagccggaacagtttcatcggttctttacctcccgagcttggaagccttcatcagctcgagatactcagactctcagaaaatagattctctggcaacataccgtttaccattggaaaccttacccatctaactgagctgcagatgggaggaaacttgttttcaggaagtataccgcctcaactcggtttactctcgagtctgcagattgcaatgaacctgagctacaatgatttcagtggtgaaatacctcccgagatcgggaatcttcatctgctaatgtacctatctctgaacaacaaccatctcagcggcgaaatcccgaccacattcgagaacttatccagtttactcgggtgcaacttttcctacaacaacctcaccggacagcttccacatacgcagatctttcaaaacatgactctaaccagttttctcggaaacaaaggactctgtggcggccatttgagaagctgtgaccctagccactcctcttggcctcacatttcatctctaaaagcgggttctgctcggagggggagaatcatcatcatcgtgtcttcagtcattggcggtatctctcttttactaatcgcgattgtcgttcatttcctaagaaatcccgtggaaccaacggctccttatgtgcacgacaaggaacccttttttcaagaatccgacatttactttgtcccgaaagaacgattcacagtcaaagacattttggaagcaacaaaaggcttccacgatagctacattgtcggtagaggcgcttgcgggaccgtttacaaagcagttatgccttcaggtaaaacaatagcagttaaaaaactcgaatccaacagagaaggcaacaacaacaacagcaacaacactgataacagtttccgcgccgagattctaacactaggcaaaatccgtcacaggaacattgtcaggctatacagtttctgttaccaccaaggatcaaactcgaacctcttgctctacgaatacatgtctcggggaagccttggcgagttacttcacggcgggaaatcacatagcatggattggccaactcggtttgctatcgcactcggtgcagcggaaggtctcgcttacttacatcatgattgtaaaccaagaatcattcaccgtgacatcaaatcgaataacattctcatcgatgagaatttcgaagcccatgttggagatttcgggttagcaaaagtcatcgacatgccactatcaaaatccgtctcagccgttgctggatcctacggttacatcgctcccgagtatgcatacacaatgaaagtaacagagaaatgcgatatctacagctttggagttgttcttcttgaattgttaaccgggaaagctccggttcagccgctagagcaaggcggagatcttgccacgtggacaagaaaccatatcagagatcattcgttaacatctgaaatccttgatccttatctaacaaaggtagaggacgatgtgattctcaatcatatgatcacagtgacgaaaattgccgtgctctgtacgaaatcttcgccgtctgatcgaccgacgatgagagaagtagtgttgatgcttatagagtccggtgaacgtgccggaaaagtaattgtgtctacaacgtgcagtgatttacctccaccggcgccgccgtga

SEQ ID NO: 668 - DNA, 2316 bp, Arabidopsis thaliana
atgtcaaatttgcgtttgcgtttactttctctcgtgtccatcctctactgcatcgctgctctccgatgtcgtccagaccaaaccgaaaccattaaacgtttcaaaaacgagtttgcgttctctagcatctgcagaaatgacaccaacttctttagcggtgtggtctgcgataacacgaccggtgcggtcacggttctagaactccccggtggatgtttacgtggcactctcagaccaaacagtagcctctttgagctaagtcatctccgttacctaaacctctctttcaacaacttcgattcttctcccttgtcctctgcttttggtcagctcaacaatctagaggtcttgcttctatcctctaatggcttcactggccaagttccttcttctatacgtaacctaaccaaacttacccaattaaatcttccccacaacaagctcaccggtgatttaccctcacttgtacagaatctaaccaagcttttagctttagacctttcttataatcaattctctggaaccataccttcttcttttttcaccatgcctttcttgtcttatcttgatttaagtgagaatcatctcactggctcatttgaaatctctaattcttcgtctaaacttgagaacttaaatcttgggaataaccattttgaaacagagatcatagatcctgttttgaggttagttaatctcaggtatctaagcctctctttcctaaacacaagccacccaattgacttatcaattttctctcctctccagtctttgacacaccttgatcttcacggcaacagtttaacactaacgagtgtgtattcagacattgactttccaaagaacatggagatcttgctcttgtctggatgcaacatcagtgaattccccagattcttaaagtccttaaagaagttatggtatttagatctttccagcaacagaatcaaaggaaacgttcctgattggatatggagtcttcctcttttagtctctctggatcttagtaacaattcattcaccggtttcaacggttcattggatcatgttttagccaactcatcggtccaagtactagatattgctttaaactctttcaaaggatcattccctaatccaccggtctctatcatcaacttgtctgcttggaacaatagtttcacaggagacattcctctctcggtctgtaacagaacctctcttgatgttcttgatctgtcctacaacaacttcactggctcaattcctccatgtatgggtaatttcaccatagtgaatctccggaagaacaagttggaaggaaacattccagacgagttttatagcggtgctttgacgcagacacttgatgttggatacaatcaactaaccggagaacttccaagatctctcctgaattgctcattcataaggtttcttagtgtggatcacaacagaatcaatgattcatttcccttgtggctcaaggcattgcccaatttgaaagtccttactctccgttcaaacagtttccatggtcctatgtctccaccagatgatcaaagttctcttgcatttcccaagctccagatacttgaaatatcgcataacagatttacgggaagcttaccaacgaattactttgcgaattggagtgtaaaatctctcaagatgtatgatgaagagaggctatatatgggagactattcgagtgatcggtttgtttatgaagatactttggatttgcaatacaaaggtctatacatggagcaaggcaaggttcttactttctactccgccattgatttctctggcaacaagcttgaaggagagattccagaatctattggtcttttgaaaacattgattgctctcaacttatcaaacaactcattcactggacatattccgatgtctttcgctaatgtgacagagctcgagtcattggacttgtcagggaacaaactctcgggggaaattccacaagaactcggaagactatcgtatttagcgtacatagatgtctctgataatcaactcactggtaaaataccacaaggaacacaaatcatagggcagcctaaatcctcatttgaaggaaattcagggttatgtggtcttcctcttgaagaaagctgtttaagagaagacgcaccatcgacacaagagcccgaagaagaagaagaagaaatattggagtggagagcagcggcaatagggtatggaccaggggtgttgtttggattggcaattggacatgttgttgctttgtacaagccagggtggttcatcaagaataatggtcagaataggcttagaggcatcagacacccttag

SEQ ID NO: 669 - DNA, 3018 bp, Arabidopsis thaliana
atgactcgtttacccttacctttccttttcttcttcctcacgtcaatacccttatctgtcttttcgcagttcaacgaccagtcaacgcttctgaacctgaaacgcgatctcggagatccaccgtctctccggctgtggaacaacacatcttcaccgtgcaactggtcggagatcacttgcaccgccggaaatgtcaccgggatcaatttcaagaaccagaacttcactgggacagttccaacgacgatatgcgatttgtcgaatctcaatttccttgacttatcgtttaattacttcgccggcgagtttccgacggttctttacaattgcacgaagcttcaatatctcgatctctctcagaaccttctcaacggctcacttcccgtcgacatcgaccgtctctcaccggaactcgactatctcgacttagctgctaacggattctccggcgatatccctaaaagtctcggacggatctcgaagctcaaggtattgaatctgtaccagagcgaatacgacggtacgtttccatcggagatcggagacttatcggagcttgaagaacttcgactagcgttaaacgataagtttactccggctaagattccgatagagtttgggaagttgaagaaactcaagtatatgtggttagaggagatgaatttgatcggagaaatctcacccgttgttttcgaaaacatgacggatcttgagcacgttgacttatcggtcaataacttaacgggtcggatcccagatgttttattcgggttgaagaatctcaccgagttttatctcttcgctaatggcttaaccggagaaatccccaaatcaatttcggcgacgaacttggtatttcttgatctctctgctaataatttaaccggttcgattccggtatcaatcggaaatctaacgaaattacaagtgttaaacctcttcaacaacaagttaaccggagaaattccaccggttatcggaaaactaccgggattgaaggagtttaaaatcttcaacaacaagttaaccggagaaatacctgcagagattggagttcattcaaagctggagagattcgaagtttcggagaatcagttaaccggaaagttaccggaaaatttgtgcaaaggtggtaaacttcaaggagtggttgtgtactcaaacaatcttaccggagaaatccctgagtcgctcggagattgtggaacgctcttgactgttcagttacagaacaatgacttctccggcaagtttccttctcggatctggaatgcttcaagtatgtatagtctacaggtgagtaacaactcattcaccggagagttaccggagaatgttgcttggaatatgtcgaggatcgagattgataacaatcgattttccggtgagattccgaagaaaatcggtacttggtcttccttagttgagtttaaggcgggaaacaatcagttttctggtgagtttccgaaggaattgacttctctttcgaatctcatatcgatctttctcgatgagaatgatctcaccggtgaattaccggatgagatcatctcatggaagtcgttgataacgttaagtttatccaagaacaagctttccggggaaattccgagagctttaggattgttgccacgtctgctcaatcttgatctatcggagaatcaattctccggtggaatcccaccggagattgggagcctgaagctgacaacatttaatgtgtcatcaaatagactcactggaggaataccagagcaacttgataatcttgcttacgagagaagtttcttgaacaactctaatctttgtgcagacaacccggttctcagcttaccggattgtcggaaacagcgccggggatcaagagggttccccgggaaaatcctcgcgatgattctagtcatcgcggttctgcttctcaccattactctgtttgttacgttctttgtggttagggactacacaaggaaacaaagaagaagaggtctagagacgtggaaactcacttcatttcatagagtagattttgcggaatccgacatcgtgtcgaatctgatggaacactacgtgatcggtagtggcggatcgggcaaagtttacaagattttcgtcgaaagctcgggacaatgtgtggcagtgaagaggatatgggacagcaagaaactggaccagaaacttgagaaggagtttattgctgaagttgagattcttggaacgatcaggcactcgaatatagtgaaactattgtgttgtatctcaagggaagattcaaagcttctagtgtatgagtatctcgagaaacgcagtcttgatcaatggttacatggaaagaagaagggaggtaccgtagaggctaataaccttacatggtcacagaggttgaatatcgcagttggagcagctcaaggactttgctatatgcatcatgattgtactcccgcaatcatacatagagatgtcaagtcgagtaacatcttgcttgattctgaattcaacgcgaagattgcagatttcgggttggctaaactgttgattaagcaaaaccaagaacctcataccatgtcagctgttgctggatcctttggttacattgctccagaatacgcatatacgtcaaaggtagatgagaagatcgatgtgtacagcttcggggtagttttgctagagctggtgactggaagagaaggaaacaacggagatgaacacacaaacttagcagattggtcatggaaacattaccaatctggaaaaccgaccgcagaggcgtttgatgaggacatcaaagaagcttccacgactgaggcgatgacaacagttttcaagctaggtctcatgtgtactaacacattgcctagtcatagaccttccatgaaagaggtcttgtatgttctgcgccaacaaggacttgaggcgacgaagaagactgcaacagaggcatatgaggcacctctactagttagtttatcgggtcgaaggacaagtaaaagggtagaagatgaagatttaggttttgtataa

SEQ ID NO: 670 - DNA, 3234 bp, Arabidopsis thaliana
atggaaccattcgttgttaaggagaacatcatcgcatctgcttcttcgccgatgaagaagcgacggatcgatcacactgagtcagctgatggttctgcgattaacgcttctaactccagtagcatcggtttgaacaacagcatcggtggtaacgatacggtgatgagcatggcggagtttggtaacgacaactccaacaatcaggagatcgatgaagatcttcatagcagacagctcgccgtttacggccgtgagactatgaggaagcttttcgcttccaacgttctcatctctgggatgcagggccttggtgttgagattgccaagaatattattctagctggtgtgaagtcagtgacccttcacgatgaaaatgtggttgagctatgggacctatctagtaactttgttttcacggaggaggacattggtaagaatagagcacttgcttctgttcacaagttgcaagaactcaacaatgctgtggctgtctcaactttgactgggaagttaaccaaagagcagctttctgatttccaggttgtggtatttgtggatatctcttttgagaaagcgacagagattgatgattattgtcacagtcatcagcctcctattgcattcatcaaggctgatgttagggggctgtttgggtctttgttttgtgattttggacctcattttactgttcttgatgttgatggggaggaacctcactctggcatcatcgcttctgttagcaatgaaaatcctggatttgtttcgtgtgtcgatgatgagaggctcgagtttgaagatggaaatttggttgttttctctgaagttgagggaatgacagagctaaatgatggaaaaccaaggaagataaaaaatgtcaagccattttcatttaccctggaggaagacacctctagctatgggcaatatatgaagggtggcattgtgactcaggttaaacaaccaaaggtgttgaactttaaacctcttagagaagcacttaaagatccaggcgactttcttctaagtgacttttcaaagtttgaccgaccacctcttctccacttagcattccaagcacttgataggttttcgtctcaagcaggccgatttccgtttgctggttcagaagaagatgctcagaaactagtggaaattgcagttgacattaatgagggtttgggtgatgcaaggttggaagatgtcaactctaaactgttgcggcatttggcctttggatccagggctgttctgaatcctatggctgcaatgtttggtggcattgttgggcaggaggttgtcaaggcatgctctgggaaattccatcctatctttcagttcttttactttgattcggtggagtcactccccaaggaacctcttgatgcatcagagtttagaccacaaaatagccgttacgatgcacagatctctgtatttgggtctactcttcagaagaaactcgaggatgccagagtttttgttgtaggggctggtgctcttggatgcgagttcttaaagaacttggctttgatgggtgtgtcatgtggcacccaagggaagctaactgtcaccgatgatgatgtaattgagaagagcaacctgagtcgtcagtttctttttcgagattggaacataggacaggctaaatccacagttgccgcaacagcagcagctggaataaattctcgcctcaacattgatgctctgcaaaatcgtgttggacctgagaccgagaatgtctttgacgacagcttctgggagaatttgacagttgtggtgaacgctttggacaatgtcactgcaaggctttatgttgattcaaggtgtgtgtatttccagaagcctctcctcgagtcaggaaccctaggtgcaaagtgcaacacacagatggttatccctcacctcactgagaactatggtgcctcgagagacccaccagagaaacaggctccaatgtgcaccgtgcactcatttcctcacaacattgatcattgcttaacatgggctcgctctgaatttgagggtttgcttgagaaaacaccagctgaagttaatgcatacctctcagatcctgttgaatacatgaaagcgatgagaactgctggtgatgcccaagcaagggatactttgggacgtgttgttgagtgcctcgagaaagaaaagtgcaattcattccaggattgcataacctgggctcgtctgaggtttgaggactacttcgccaaccgtgtgaagcagttatgttacacatttcctgaggatgctgctactagtacaggagctccgttctggtctgccccaaagagatttcctcgcccactccaattctcctcaaccgacctgagccatatcaactttgtcatggctgcatctatcttgcgagcagagacattcggaatccctactcctgagtgggctaaaacccgagcaggactagccgaggctgtggaaagagtaattgtccccgactttgagccgaagaaagatgcaactattgtgacagatgagaaggctacaactttgtctacagcttcagtcgatgatgcagcagtaatcgatgaactaaacgcaaaactagtgcggtgcaggatgagcttgcagccagagttcaggatgaaggcaatccagtttgaaaaggacgatgataccaactaccacatggatatgatcgctgggctagccaacatgagagcaaggaactacagtgttcccgaggtggacaagcttaaagccaagttcatagccggaagaatcatacccgcgattgcgacatcaactgcaatggcaacaggttttgtttgccttgagatgtacaaggtcttagacgggtcacacaaagtagaagactacagaaacacatttgctaacttagcacttccgctcttctccatggctgagccggttccacctaaagtggtgaagcaccaagaccaaagctggactgtttgggaccggtgggtgatgaggggaaacccgaccctaagggagttgctagactggctaaaagagaaagggctaaacgcatacagcatatcttgcggaagcagtttactgtacaacagtatgttctcaaggcataaagagaggatgaacagaagagtggtggatcttgcaagagacgtggctggggttgaattgcctgcttatagacgtcacgtggatgttgtagtcgcttgtgaagatgataatgatgctgacgttgatatccctctcgtatcagtctacttcgcctga

SEQ ID NO: 671 - DNA, 1431 bp, Arabidopsis thaliana
atgtcagccatggaagcactgattctccagctgcatgaaatcggcgccgtgaaattcggcaatttcaagctcaaatctggaatcttttctccggtttacatcgaccttcgtctcatcgtctcttatccatccctcttaacacagatctctcaaactctcatctcttctcttccaccttctgcaaccttcgacgtcgtctgtggtgttccttacactgctctccctatcgccactgttgtctctgtttccaatggtatccctatgcttatgcggcgtaaggagattaaagactatggaacatctaaagctattgaaggaatcttcgaaaaggatcaaacttgtttgataattgaagatcttgtaactagtggtgcttctgttctcgagactgctgctcctcttcgtgctgtggggttaaaggttagtgacgcggtggttttgattgataggcaacaagggggtagggagaatctagcggagaatgggattaagttacattcgatgattatgttgacggatatggttagggttttgaaggaaaaggggaaaattgaagtggaggttgaagtgaatttgcttaagtttttggaagagaatcgtagggttagtgttccaagtgtggagaaacctaagcctaagcctagggttttggggttcaaggaaaggtctgagctttctaagaatccgacagggaagaagctgtttgatattatgttgaagaaggaaaccaatctttgtttagctgctgatgttggaactgctgctgaattgcttgacatcgcagataaggtgggaccagagatttgtctcttgaagactcatgttgatatactgcctgatttcacccctgactttggctctaagctccgtgcgattgcagacaagcacaaatttctcatatttgaggatcgcaagtttgcagacattggtaacactgtcactatgcagtatgaaggaggcatctttaaaatattggagtgggctgatattatcaacgctcatgtaatatcggggccaggaatcgtggatggcctgaaattgaagggtatgcctcgtggtagaggtttgcttttgcttgctgaaatgagctctgcaggtaacctggctacaggagactacactgcagcagctgtgaaaatcgcagacgctcattctgattttgtgatgggattcatctcggtgaatccagcatcttggaaatgcgggtatgtgtatccgtctatgattcatgcaacacctggtgttcaaatggtgaaaggtggtgatgcacttggtcagcagtataacactccacactctgtgattactgagaggggaagtgatattataatcgtgggacggggaatcataaaggcggaaaacccagcagagacggctcatgagtatagagttcaaggatggaatgcatacttggagaaatgctctcagtag

SEQ ID NO: 672 - DNA, 1563 bp, Arabidopsis thaliana
atgacaggtttgcttaatgacagggagctttatagcaataacattacaggggagatacctgaggagcttggcgacttggtggaactagtaagcttggatctttacgcaaacagcataagcggtcccatcccttcgtctcttggcaaactaggaaaactccggttcttgcgtcttaacaacaatagcttatcaggggaaattccaatgactttgacttctgtgcagctgcaagttctggatatctcaaacaatcggctcagtggagatattcctgttaatggttctttttcgctcttcactcctatcagttttgcgaataatagcttaacggatcttcccgaacctccgcctacttctacctctcctacgccaccaccaccttcaggttttcacttccattttcttcttagtgtttcttgtcggggggcaaatgactgcagcaatagcagggggagttgctgcaggtgcagcacttctatttgctgttccagccattgcgtttctgaagaagacccagaggttcatttaggacaactcaaaaggtttaccttgcgtgaactgttagttgctactgataactttagcaataaaaatgtattgggtagaggtggttttggtaaagtgtataaaggacgtttagccgatggcaatctagtggctgtcaaaaggctaaaagaagaacgtaccaagggtggggaactgcagtttcaaaccgaagttgagatgatcagtatggccgttcataggaacttgcttcggcttcgtggcttttgcatgactccaactgaaagattacttgtttatccctacatggctaatggaagtgttgcttcttgtttaagagagcgtcctgaaggcaatccagcacttgattggccaaaaagaaagcatattgctctgggatcagcaagggggcttgcgtatttacatgatcattgcgaccaaaaaatcattcaccgggatgttaaagctgctaatatattgttagatgaagagtttgaagctgttgttggagattttgggctcgcaaaattaatgaattataatgactcccatgtgacaactgctgtacgcggtacaattggccatatagcgcccgagtacctctcgacaggaaaatcttctgagaagactgatgtttttgggtacggggtcatgcttctcgagctcatcactggacaaaaggctttcgatcttgctcggcttgcaaatgatgatgatatcatgttactcgactgggtgaaagaggttttgaaagagaagaagttggaaagccttgtggatgcagaactcgaaggaaagtacgtggaaacagaagtggagcagctgatacaaatggctctgctctgcactcaaagttctgcaatggaacgtccaaagatgtcagaagtagtgagaatgctggaaggagatggtttagctgagagatgggaagaatggcaaaaggaggagatgccaatacatgattttaactatcaagcctatcctcatgctggcactgactggctcatcccctattccaattcccttatcgaaaacgattacccctcgggtccaagataa

SEQ ID NO: 673 - DNA, 2574 bp, Arabidopsis thaliana
atgagaggaggggctttgttatgcggacaagtccaagatgagattgaacagctttcgagagagagtagtcattttagtctttctactggaattttaccttcacttggtgcaagaagtaatcgacgagttaagcttaggagattcgttgtatctccttatgatcacaaatacaggatatgggaggctttcctagtggttcttgtggtttacacagcttgggtttcgcctttcgagtttgggttcttgagaaagccaaggccaccactatctatcaccgataacattgtgaacgcattcttcgccatcgatatcatcatgacattctttgttggttacctcgataaatcgacttacctcattgttgatgaccgtaaacagattgcatttaagtacttgcgttcttggttccttcttgatcttgtttcaaccattccctcagaggctgctatgagaatctcatctcagtcttatggattgtttaacatgcttcgtctttggcgtcttcgcagagtcggtgccttgtttgccagactagagaaagaccgcaacttcaactacttttgggtccgatgcgcaaaactcgtttgtgtcactctttttgcggttcattgtgctgcatgtttctattaccttatcgcagcgcgcaattctaaccccgcaaagacctggattggtgcaaatgtagcaaacttcctagaggaaagcttgtggatgagatatgtgacttccatgtattggtccatcactactctaaccactgttggttatggtgatctgcatcctgtgaacacaaaggagatgatatttgatatcttctatatgctcttcaacctcggattaaccgcttacttgattggtaacatgacaaatttggtagtccatggaacaagtcggactagaaattttagagatacaatccaagctgcttcaaattttgctcatagaaaccatttaccacctcgtctgcaagatcaaatgcttgcacatttatgtttgaaataccggactgactctgagggtctgcaacagcaagaaactcttgatgcactcccaaaggccattagatcgagtatatcacactttcttttctactccctcatggataaagtctacctgtttcgaggagtatccaatgacctgctttttcaactggtctcagaaatgaaagctgagtatttcccaccaaaagaagatgttatcttgcagaacgaagcgccaacagacttctacatccttgtgaacggaaccgcggacttggtggatgtagatactggaacagaaagcattgtgagagaggttaaagctggagacattataggggagataggggtgttatgctacagaccacaactgtttactgtgaggaccaaacgtttgtgccaactgttgcgtatgaaccgtacaactttcttgaatattattcaggccaatgttggtgatggtaccataatcatgaataatctacttcagcatttgaaagaaatgaatgatccggtgatgacgaatgttctgctggagatagaaaacatgcttgcacggggtaaaatggatcttcctctcaatttatgctttgctgcaataagagaagacgatttacttttacatcagttactaaagagaggacttgatccaaatgaatcggataacaatggcagaacacctctgcatatagcagcatcaaaaggaactctaaattgtgttcttcttctgttggagtaccacgcagaccccaattgcagagacgcggaagggagtgtaccactgtgggaagcaatggtggaagggcatgagaaagttgtaaaggtactgttagaacatggcagtaccatagacgcaggggatgtgggtcattttgcttgcacggcggctgagcaaggaaacttgaaactactaaaagaaattgttcttcatggtggagacgttactcgtcctagagccacaggcacctctgcgctccataccgctgtatgcgaagagaacattgagatggtaaagtatcttctggagcaaggtgcggatgttaacaagcaggatatgcatggttggacgccgagggatcttgctgagcaacaagggcatgaggatattaaagccttattccgagaaaagttacatgagaggagagtgcatatcgagacaagttcttcggtacctatactcaaaaccgggatccggttcctcggaagattcactagtgaacccaacatccgtcctgcatcaagagaagtgtctttcaggattcgagaaacaagagcaagacgtaaaactaacaacttcgataactcgttgtttggtatattagcaaatcaaagcgtacccaagaacgggctagctacggtagatgaaggcagaactggaaacccggtgagagtgacgattagttgtgcagagaaagatgacatagccgggaagctggtactgcttcctgggagtttcaaggagttgctagaattgggttccaacaagtttggtattgttgctaccaaagttatgaacaaagacaacaatgcagagattgatgatgtagatgttataagagatggagatcatctcatctttgcaactgattcttaa

SEQ ID NO: 674 - DNA, 1296 bp, Arabidopsis thaliana
atgaatgtggtgcggagattaacgagtattgcctctggacgtaatttcgtttcttctgataacgtaggagaaactgagacgccgagatcaaagcctaaccagaatcgtgaagaaacagagtctacggaaactacgtcgtacgagaaagattctgtctcttcctcagagaactctgatcatttaccaaaggaaatccgtgaggatatggactgtggaatcatcaagggaaatggaacagaatctggacggattattaccaccaaaaagaagggtttgaatgatcaaaaagacaagacaatctcttacagagctgaacatgtaattggcactggctcattcggtgttgtctttcaggctaagtgcttagagacggaagaaaaagtagcaataaagaaagtgttacaggacaagagatacaaaaacagagaacttcagatcatgcgaatgcttgatcatcctaatgtcgttgagctcaagcattctttcttttccacgactgagaaagacgagctttatcttaaccttgttcttgagtatgtacccgagactatttaccgcgcttccagatcttacaccaagatgaatcagcatatgcctttgatttatattcagctctacacctatcagatttgccgtgctatgaattatctgcatcaagtggttggagtgtgtcaccgtgacattaagccgcagaatctgttggtcaataatgttacgcatgaagtaaagatatgcgattttgggagcgccaaaatgctgattccaggagaaccaaatatatcttacatatgctcaaggtattacagagctcctgaactcatatttggagcaaccgaatacacaagtgcgatcgatatgtggtctgtaggttgtgtcatggctgagctttttcttggacatcctctattccctggagaaaccagtgttgatcaattggtggagatcattaagattttagggacaccagcaagagaagagataaagaacatgaatcctcgttacaatgattttaagttccctcagatcaaagctcagccgtggcacaagattttccggagacaggtatctccagaagcaatggatcttgcctctagattgctccagtattcaccaaacctgagatgcacagcgcttgaagcatgtgcacacccattcttcgatgatctgagagacccgagagcatccttgcctaatggaagagcacttcctccattgtttgatttcacagctcaagaacttgctggggcatctgttgaactgcgtcatcgcttaatacctgagcatgcaaggaaatga

SEQ ID NO: 675 - DNA, 1953 bp, Arabidopsis thaliana
atggcgggtaaaggtgaaggtccagctatcggtatcgatctcggtacaacctactcttgcgtcggtgtttggcaacatgaccgcgtcgaaatcatcgccaacgatcaaggcaaccgcaccactccttcctacgttgctttcactgacagcgagcgtctcatcggggatgctgccaagaatcaagtcgccatgaaccctaccaacaccgtcttcgatgctaagcgtctaatcggaagaagatacagtgatccctctgttcaagcggataagagtcactggccttttaaggttgtttccggtccaggtgagaagcctatgattgtggttaaccacaagggagaggagaaacagttctctgctgaggaaatctcgtcgatggttcttattaagatgcgggagattgcagaagctttccttggttctcctgttaagaacgctgtcgttacagttcctgcttatttcaacgactctcagcgtcaagcgactaaggacgctggagttatctctggtctcaacgtgatgcgtatcatcaatgagccaactgctgctgctattgcttacggtcttgacaagaaggcgtcgagtgttggcgagaagaatgttttgatctttgatttgggaggtggtacttttgatgtgtctttgcttacgattgaggaaggtatctttgaagtcaaggcaactgctggtgacacgcatcttggtggtgaggacttcgacaacaggatggttaatcattttgttcaggagtttaagaggaagaacaagaaggatattactgggaacccgagagctttgaggaggcttaggacagcttgtgagcgggcgaagagaactctttcttcgactgctcagacgactatagagattgactctctttttgagggtattgatttctacactaccatcactcgtgctaggttcgaggagctcaacatggatttgtttaggaagtgtatggagccagtggagaagtgtttgagggatgctaagatggacaagagcagtgttcatgatgttgttcttgttggtggctctacaaggattcccaaagtgcagcagcttttgcaagacttcttcaatgggaaagagctctgtaaaagcattaacccggacgaggctgttgcttacggagcagctgtgcaagctgcaatcttgagcggtgaagggaatgagaaggtccaggacttgttacttcttgatgtcactcctctgtccttgggtttggaaactgccggtggtgttatgactgttttgattccgaggaacaccacaattccgaccaagaaagagcagatattctctacctattcagacaaccagcccggtgtactgatccaggtctacgaaggagagagggcacgaacaaaggacaacaaccttttgggaaagttcgagctcagtggtataccacctgctccacgaggtgtaccgcagattactgtctgtttcgacatcgacgccaatggtatcctgaatgtgtcggctgaggacaagacgactggtcagaagaacaagatcacaatcacaaacgacaagggaaggttatcaaaggaagagatcgagaagatggtacaagaggcagagaagtacaaggctgaggatgaagaacacaagaagaaggtggatgcaaagaacgctctcgagaactatgcatacaacatgaggaacacgatcaaggacgagaagatcgcatctaagcttgacgcagctgacaagaagaagattgaggatgcaatcgaccaagctattgaatggttagatgggaatcaactggctgaggcagatgagttcgaggataagatgaaggagctcgagtctctttgcaaccctattattgcaagaatgtaccaaggagctgggcctgatatgggtggtgcaggaggaatggatgacgacacacctgctggtggtagcggcggtgctggcccaaagattgaagaagttgattaa

SEQ ID NO: 676 - DNA, 861 bp, Arabidopsis thaliana
atggaaggcaaggaagaagacgttagagttggagctaacaagttcccggagagacaaccaatcggaacatcagctcagagtgacaaggactacaaggaaccaccaccagctccgtttttcgaacctggtgagctttcttcatggtctttttggagagctgggatcgctgagttcatcgctacttttctctttctctacatcactgtcttgactgttatgggagtgaaaaggtcaccgaacatgtgtgcttccgtcggaatccaaggaatcgcttgggctttcggtggtatgatatttgccttagtctactgtaccgctggtatctccggtggacacatcaacccagcggttacttttggtctgttcttagcccggaagctgtcgcttactagagctctgtactacatagtgatgcagtgcttgggagctatctgtggtgctggagtggttaaagggttccagcctaagcaataccaggctctaggaggaggagctaacactgtggctcatggttacaccaagggaagtggtcttggagctgagatcattggcacattcgttcttgtatacacagtcttctcagcaactgacgccaagagaaatgctcgtgactctcatgtccctattcttgcaccactcccaatcgggtttgcggttttcttggttcacttggcaaccatcccaatcactggcacaggcatcaacccagctagaagccttggagctgcaatcatctacaacaaagaccattcctgggatgaccactgggtgttttgggttggccccttcattggagctgcacttgctgctctttaccatgtggttgtcatcagagccatccccttcaagtccagaagctaa

SEQ ID NO: 677 - DNA, 2472 bp, Arabidopsis thaliana
atgaggaagaggacgctcgtgtccgttttgttccttttctcgcttctgtttcttcttccagatcaaggaagaaagttacacgcgaatgcagaagagagttccgatgatgttacagatccaccaaaagttgaggagaaaattggtggtcacggtggtttatcgacggattccgatgtagttcatagagagtctgagtcgatgtcaaagaagacgcttcgcagtaacgcggagaagtttgagttccaagctgaggtttctcggcttatggacattattatcaactctctatacagtaacaaggacattttcttaagagagttgatctccaatgcttctgatgccttggacaaaattaggttccttgcactcactgacaaagacgttttgggtgaaggtgacactgctaagcttgagatccagattaagctagacaaagccaagaagattctttctattcgagaccggggaattggtatgactaaggaagacttaatcaagaaccttggtaccatagcaaaatctggaacgtcagcttttgttgagaaaatgcaatcaagtggggatttgaaccttattggacaatttggagttggattctactctgcctatcttgttgctgactacattgaagtcattagcaagcacaatgatgacagccagtatgtatgggaatcaaaggctaacggtaaatttgctgtttccgaggatacatggaatgagcctcttggacgtggaaccgagattagattacatcttagggatgaagctggcgagtacctagaagaaagtaaacttaaggaattggtgaagagatattctgaattcattaacttccctatctccctctgggctagcaaagaggttgaaaccgaggtcccagttgaggaagatgaatcagctgatgaggaaactgaaaccacctctaccgaggaagaaaaggaagaagatgctgaggaggaagatggtgagaaaaagcagaaaaccaagaaggtgaaagaaacagtttatgaatgggagcttctgaatgatgttaaggctatatggctgagaagtccaaaggaggtgacagaggaagagtacactaaattctaccactctctctcaaaggattttaccgacgagaagccaatggcttggagtcactttaatgctgaaggtgatgttgaattcaaggctgtgttgtatgttcctccgaaagctccccatgatctatacgagagctattacaacagcaacaaggcgaacttgaagctatatgtcaggagggtgttcatctcagatgaatttgatgagcttctgcctaagtatttgagtttcttgaagggtcttgttgactctgacacattgcctctaaatgtatcaagagaaatgcttcaacaacacagcagcttaaagacaattaagaagaagcttatccgaaaggcgcttgatatgatccgcaagcttgctgaagaagatcctgatgaaatccatgatgatgagaaaaaagatgtggagaagtctggtgagaacgatgagaagaagggtcaatacacaaaattctggaacgagtttggcaagtctgtcaaactaggtatcattgaggatgctgctaacaggaaccgcttggcaaaacttcttcgttttgagacaacaaagtccgatggaaaattgacttccctggatcagtacattaagagaatgaaaaagagccaaaaggacatattttacatcacaggaagcagcaaggaacagctagagaaatctccattcctggagaggctcatcaagaagggctatgaggtcatcttcttcacagacccagttgatgaatacttgatgcaatacctgatggattacgaagacaaaaagttccagaatgtgtccaaggaaggactgaaggttgggaaagattcaaaagacaaggagctgaaggaagcattcaaggagctaacaaagtggtggaaaggaaatctcgctagcgaaaacgtagacgatgtcaaaatcagcaaccgtttggctgacactccatgtgtagtcgtaacatccaagtttggatggagtgctaatatggagaggatcatgcagtcccaaactctctcggatgctaataagcaagcttacatgcgcggaaagagagtcctcgagatcaacccacgacaccctatcatcaaagaactcaaggatagaattgcaagtgacccagaggatgagagtgtgaaggaaacagcacagctcatgtaccagacagctttgatcgagagtggattcatactcaccgacccaaaagactttgctgcccgtatttataactcagtcaagagcggtctgaacatcagccctgatgcagtagccgacgaggaaatcgaggcagcagaggaaccagagaccagtgaggcaactgagacgaaatcagatgacttggctggtggtctaaacattgaagccgaacccgttgagcaacaagaagagaacaccaaggacgaactgtag

SEQ ID NO: 678 - DNA, 825 bp, Arabidopsis thaliana
atgtcagaggtggaaatagagaacgctgctacgatcgaaggaaacaccgctgcggatgcgccggtgacggatgcggccgttgagaagaagcctgcagcgaaaggacgaaagacgaagaatgttaaggaagtgaaggagaagaagactgttgctgccgctccgaagaagagaactgtttcatctcatcctacttacgaagagatgattaaggatgcgattgttacgttgaaagagagaactggatctagccaatacgcgattcagaagttcatcgaggagaagcgtaaggagcttcctccaacattcagaaagctgttgcttctcaatctgaagagactcgttgcttctgggaagcttgtgaaggtcaaagcctcgtttaaactcccatcggcgtcggctaaagcatcatcccctaaggcggcagcggagaaatctgctcctgcgaagaagaaaccggcgactgtggcggttaccaaggcgaagagaaaggtcgctgcggcttccaaggctaagaaaacaatcgccgttaaacctaagactgctgctgctaagaaagtgaccgcgaaggctaaggctaagcccgttcctcgtgccactgctgctgcaactaagaggaaagctgttgatgcgaagcccaaggctaaggctagaccagccaaggcagccaaaacggccaaggttacatctccggctaagaaagctgttgctgccacgaagaaagttgctacggtggccacaaagaagaagactccggttaagaaggttgtgaagccaaagacggttaagtctccagcaaagagggcttcttctagggttaagaagtga

SEQ ID NO: 679 - DNA, 222 bp, Arabidopsis thaliana
atggcgtcgagaaactccgtcaccggattcgcgttgttcagttttgtattcgccgtcatcttatctctcgccggcgctcaatccctggctccagctcctgctcccaccagcgatggaacatcgatagatcaagggatagcgtatttgctaatggtggtggcgttagtgctgacttacctaattcatcctcttgatgcttcttcttcctactccttcttctaa

SEQ ID NO: 680 - DNA, 1962 bp, Arabidopsis thaliana
atggctggtaaaggagaaggtcctgcgatcggtatcgatcttggtacgacgtactcttgcgtcggagtgtggcaacacgaccgtgttgagatcatcgctaatgatcaaggaaacagaaccactccctcgtacgttgctttcactgactccgagaggttgatcggtgatgctgctaagaaccaagtcgccatgaaccctgttaacactgttttcgatgcaaagaggttgattggtcgtagattcagtgacgcatctgtccaaagtgacagacagttatggcctttcactatcatctccggaactgcagagaaaccaatgattgtcgtcgaatacaagggagaagagaaacagttcgctgctgaagagatctcttccatggttcttattaagatgcgtgagatcgctgaggctttccttggcactacggtcaagaacgctgtcgtcactgttcctgcttacttcaatgactctcaacgtcaggctacaaaggatgctggtgtcatcgctggtttgaatgttttgcgtatcatcaacgagcccactgctgcagccattgcttatggtcttgacaagaaggccacaagtgttggagagaagaatgttttgatctttgatcttggtggtggtacttttgatgtctctcttcttacaatcgaagagggtatctttgaggtgaaggcaacagctggtgatactcatcttggtggggaagattttgacaacagaatggttaaccattttgttcaagagtttaagagaaagaacaagcaggatatcaccggtcaaccgagagccctcaggagattgagaacagcttgtgagagagcaaagaggactctttcttccaccgctcaaacgaccatcgagattgactctttatatggtggagctgacttctattctccaatcacccgtgctagattcgaagagatgaacatggatctctttaggaagtgtatggagcctgttgagaagtgtctccgtgatgctaagatggacaagagcactgttcacgagattgtccttgttggtggatccacccgtatccctaaggttcagcaattgcttcaggacttcttcaacggcaaagagctttgcaagtctatcaaccctgatgaggctgtagcttatggtgcagctgttcaggctgcgatcctaagcggtgaaggaaacgaaaaggtccaagaccttctcttgcttgatgtcacacctctctcccttggtcttgaaactgctggtggtgtcatgaccactttgattcaaagaaacacaaccattccaaccaagaaggaacaggtcttctcaacttattcggacaaccagcctggagtgttgatccaagtttttgaaggtgagagggctaggaccaaggacaacaacctcctcggtaaatttgagctttctggaattccccctgctccacgaggtgtccctcaaatcactgtctgcttcgacattgacgccaatggtatcctcaacgtctctgctgaggacaagaccactggaaagaagaacaagatcacaatcactaatgacaagggtcgtttgtctaaagaggatattgagaagatggttcaagaagcggagaagtacaagtctgaggatgaggagcacaagaagaaggtcgaggccaagaacgctcttgagaactacgcttacaacatgaggaacaccatccgtgatgagaagatcggtgagaagcttccagctgcagacaagaagaaggttgaggactctattgaggaagcaatccaatggctagatggtaaccaattgggtgaagctgacgagtttgaagacaagatgaaggagttggagagtgtttgcaatccgatcatcgctaagatgtaccaaggaggagctggtggtgaagctggtggtcctggagcttctggaatggacgaggatgaagctcctcctgcatcaggtggtgctggtcccaagatcgaggaagtcgactaa

SEQ ID NO: 681 - DNA, 1569 bp, Arabidopsis thaliana
atggcgctcttgtctcaagcaggaggatcatacactgttgttccttctggagtttgttcaaaggctggaactaaagctgttgtttcgggtggcgtgaggaatttggatgttttgaggatgaaagaagcttttggtagctcctactctaggagtctatctaccaaatcaatgcttctccattctgttaagaggagtaagagagggcatcaattgattgttgcggcaagtcctccaacggaagaggctgtagttgcaactgagccgttgacgagagaggatctcattgcctatcttgcctctggatgcaaaacaaaggacaaatatagaataggtacagaacatgagaaatttggttttgaggtcaatactttgcgccctatgaagtatgatcaaatagccgagcttcttaatggtatcgctgaaagatttgaatgggaaaaagtaatggaaggtgacaagatcattggtctgaagcagggaaagcaaagcatttcacttgaacctgggggtcagttcgagcttagtggtgcacctcttgagactttgcatcaaacttgtgctgaagtcaattcacatctttatcaggtaaaagcagttgctgaggaaatgggaattggtttcttaggaattggcttccagcccaaatggcgtcgggaggatatacccatcatgccaaaggggagatacgacattatgagaaactacatgccgaaagttggtacccttggtcttgatatgatgctccgaacgtgtactgttcaggttaatctggattttagctcagaagctgatatgatcaggaagtttcgtgctggtcttgctttacaacctatagcaacggctctatttgcgaattccccttttacagaaggaaagccaaacggatttctcagcatgagaagccacatatggacagacactgacaaggaccgcacaggaatgctaccatttgttttcgatgactcttttgggtttgagcagtatgttgactacgcactcgatgtccctatgtactttgcctacagaaagaacaaatacatcgactgtactggaatgacatttcggcaattcttggctggaaaacttccctgtctccctggtgaactgccttcatataatgattgggaaaaccatctgacaacaatattcccagaggttcggttgaagagatacttggagatgagaggtgctgatggaggtccctggaggaggctgtgtgccctgccagctttctgggtgggtttattatatgatgatgatagtctccaagctatcctggatctgacagctgactggactccagcagagagagagatgctaaggaacaaagtcccagttactggcttaaagactccttttagggatggtttgttaaagcatgtcgctgaagatgtcctgaaactcgcaaaggatggtttagagcgcagaggctacaaggaagccggtttcttgaacgcagtcgatgaagtggtcagaacaggagttacgcctgcggagaagctcttggagatgtacaatggagaatggggacaaagcgtagatcccgtgttcgaagagctgctgtactaa

SEQ ID NO: 682 - DNA, 972 bp, Arabidopsis thaliana
atgaagaaccaaagcagcttctccattgttgctcttcttctcattttcttttcctcatctgtctttgctcagctgcagacaaatttttaccggaagtcatgtcctaacgtggaaactattgtccgcaatgccgtccgccaaaagttccagcagacttttgttacggctccggccaccctccgccttttcttccatgattgcttcgtccgtggatgtgatgcttcgatattgctggcatcaccatctgagaaggatcaccctgatgacaagtcactagccggagacgggtttgatacggtggcaaaggcaaagcaggcccttgatagggaccccaactgccgtaacaaagtctcatgcgctgacattttggctctcgccactcgtgacgtcgtcgttttgaccggaggaccgaactatccggtagagctagggaggagagacggcagactatcgacagtggctagcgttcaacacagtctaccccagcctagtttcaaattggaccaacttaacactatgttcgctcgtcacggtctatcccaaaccgatatgattgcactctcaggagcacatactataggattcgcacattgtggcaagttttcgaaaagaatttacaattttagtcctaaacgtccaattgatccgactttgaatattcgttacgccttacaattgagacaaatgtgccccattcgggtcgacttgaggatcgcaattaacatggatcctacttctccaaatacatttgacaatgcttatttcaaaaacctccaaaaagggatgggtttgttcacgtcagatcaagttttgttctctgatgaacgatctagatcaactgtcaattcatttgcttctagtgaagcaacttttagacaagcttttatttcggctataacgaagttgggtcgggttggagttaaaaccggtaacgcgggtgagataagacgggattgttcacgtgttaattag

SEQ ID NO: 683 - DNA, 1551 bp, Arabidopsis thaliana
atggagaaactaacttttctcagccttctcctgcatttcgtcgtcttcatcgcttcaacgataccgtcttcatcgttcctcttgaatgatcgcacctttgagagatcgaacttgccgtctacgcgcgcggagaagctgatccgtgagctaaaccttttcccgcagcaggatctgaatgtgatcgatgtcgctgatttgcctctcactgctgcggagggaccggggattgttgaacggaagttcgtattcccgaatatacttgccgatggtggccctactgtcgacgatttaggtcatcatgctggttattacaagctcccgaaatctcgtggcgcaagcatgttctacttcttcttcgagtcacggaacaagaaggatgctcctgttgtgatttggttgacgggagggcctggatgtagtagtgagttggctgtgttctatgagaatggtcctttcaagatcactagtaacatgtctcttgcttggaatgagtatggatgggatcaggtttccaatcttctgtatgttgatcagcctgttggaactggtttcagctacacgacagataaaagtgatatccgtcatgacgaaactggagttagcaatgatctttatgattttctgcaggctttctttgcggagcaccctaagttggcaaaaaacgacttttatattactggagagtcatatgctgggcactatatcccagcttttgcttcccgagtccataaaggaaacaaggctaatgagggagttcatattaacctaaagggattcgctattggaaatgggcttacagatcctgcactccaatacccagcctatcctgactacgctttggaaatgggtctaatcacgcaaaaagagcatgatcgcttagaaaagattgtcccactgtgcgaactatcaatcaagctttgtggaactgatggcacaacttcttgtttggcatcatatcttgtctgcaactctttgttcagtggtgtaatgagtcatgctggtggagtaaactattacgacatcaggaagaagtgcgtgggaagtttgtgctacgatttctcaaacatggagaaatttttgaatctgcaatctgtgaggaagtcacttggtgttggggacatagactttgtctcctgcagtacttcagtctatcaggcaatgcttgtagattggatgaggaatctcgaggttggaattcccacgctcttggaagatggaatcagcctccttgtgtatgctggagaatatgatcttatctgcaactggctcggtaactcgaggtgggtgaatgcaatggagtggtcagggaaaacaaactttggggcggctaaagaagttccgtttattgtggatggcaaagaagcaggcttgttaaagacttatgaacaactcagtttcctcaaggtgagagatgcaggacacatggttccaatggaccagcctaaagctgcattgaaaatgctgaagcgatggatggagaattcacttatcgaagatgctactgtgactgttgctgctcagggaggagaggaactggttgctcagatgtga

SEQ ID NO: 684 - DNA, 1080 bp, Arabidopsis thaliana
atggcggaaaactacgaccgtgccagtgagttaaaagcattcgacgagatgaagattggcgtgaaaggactcgtcgacgccggagtcacaaaagtcccgcgcattttccataacccgcatgttaacgtagcaaaccctaagcctacatcgacggtggtgatgattccaacaatcgatctaggtggcgtgttcgaatccacggtcgtgcgagagagtgtagttgcgaaggttaaagacgcaatggagaagtttggatttttccaggcgattaaccatggggttccacttgatgtgatggagaagatgataaatggtattcgtcggtttcacgaccaagatccagaagtgaggaaaatgttctatacccgagacaaaaccaaaaagcttaaatatcactctaatgctgatctctatgagtctcctgctgcgagttggagagataccttaagttgtgtcatggctcctgatgttccaaaagcacaggacttacctgaggtttgtggggagatcatgttggagtactcaaaggaagtgatgaagttagcggagttaatgtttgaaattttatcagaagctttagggttgagtcctaaccacctcaaagaaatggattgcgcaaaaggtttatggatgctctgtcattgttttccaccctgtcctgagccaaaccgaacattcggcggcgctcagcacacagacagatctttccttactattcttcttaacgacaacaatggaggacttcaagttctctacgatggatactggatcgatgttcctcctaatcccgaagcacttatctttaacgtaggagatttcctccagcttatctcgaatgacaagtttgtaagcatggagcatagaattttggcaaatggaggtgaagagccgcgcatttcggtcgcttgtttctttgtgcatacttttacttcaccaagttcgagagtatatggacccattaaagagcttctgtctgagctaaaccctccaaaatacagagacaccacctcggaatcctccaatcactatgtggctagaaaacctaatgggaattcttcgttggaccatttaaggatctga

SEQ ID NO: 685 - DNA, 1569 bp, Arabidopsis thaliana
atgcctgccggtggattcgtcgtcggggatggccaaaaggcttatcccggcaaactcactccctttgttctcttcacttgcgttgttgctgccatgggcggtctcatcttcggatacgatatcggaatctccggtggtgtgacgtctatgccgtctttcctcaagcgattcttcccgtcggtgtatcggaaacaacaagaggacgcgtcaacgaaccagtactgtcagtacgatagcccgacgctaacgatgttcacatcgtctctatatctagcggcgctaatttcgtcgctggtggcttccaccgtgacaagaaagttcggacggcggctctcgatgctcttcggcggcatactcttctgcgccggagctctcatcaatggtttcgccaaacatgtttggatgctcatcgtcggtcgtatcttgcttggtttcggtatcggtttcgctaatcaggctgtgccactgtacctctctgagatggctccatacaaatacagaggagctttaaacattggtttccagctctcaattacaatcggaatcctcgtcgccgaagtgctaaactacttcttcgccaagatcaaaggcggttggggatggcggctcagtctcggaggcgcggtggttcctgccttgatcataaccatcggctccctcgtcctccctgacactcccaattcaatgatcgagcgtggccaacacgaagaagccaaaaccaagctcagacgaatccgtggtgtcgatgacgtcagccaagagtttgacgatttggtcgccgctagtaaagagtcgcagtcgatagagcacccgtggagaaacctcctccgccgcaagtaccgaccacatctcacaatggccgttatgattccgttctttcaacagctaaccggaatcaatgtgattatgttttacgctccggttttgttcaacaccattggtttcacgaccgatgcttctctcatgtccgctgtggtcactggctcggttaacgtggccgctacgcttgtttctatctacggtgttgacagatggggacgtcggtttctctttcttgaaggtggtacacaaatgcttatatgccaggctgtggttgcagcttgcataggggccaagtttggggtagacgggacccctggtgagctaccaaagtggtatgctatagtggttgtaacgttcatttgcatctatgtggcgggttttgcgtggtcgtggggcccactagggtggttagtaccgagtgaaatcttcccgttggagataaggtcggcggcgcagagtatcaccgtgtccgtgaacatgatcttcacgttcattatcgcgcaaatcttcttgacgatgctttgtcatttgaagtttgggttattccttgttttcgcctttttcgtggtggtgatgtcgatctttgtatacattttcttgccggagacgaaagggattccgatagaggagatgggtcaagtgtggaggtcacactggtattggtcaaggtttgtggaggatggtgagtatgggaatgcgcttgagatgggcaagaacagtaaccaagctggaacgaagcatgtttga

SEQ ID NO: 686 - DNA, 240 bp, Arabidopsis thaliana
atgtcggacaaaggtcgtcccttgccaaaatttggtgaatgggatgtgaatgatccagcatcagcagaaggttttacagtgatattcaacaaagctagggatgagaaaaagaccggtggcaaaccgggatcacccggtaaatccagtgagggtcatgttaaatctggaggaggagatcctagtaaacctcagcctaaaaaatggctctgctgcatgcaagctccagctgtggactcttga

SEQ ID NO: 687 - DNA, 546 bp, Arabidopsis thaliana
atgggcgtcgctgttctaaatccccaggattgcttgaaagatccattctctcacatgaaacaacatcgtaatcctagcgcatgtcccaacaggcagaagaagacggtctccaacaaccgtacacgccggagtcctcctcgtagtcaatcctccagatcttcttctcctcctgtagcgccgccgcttcctcctcctcgtgcggctgtctctgctttcgttccaaagggaacccttaagaagagtcttagcaataccgttgccgttagccaggtgagaatccttaagcgcggcgaagaaatccccaaggagacttcagatctggttgtggaaatgtcagatctgggatctactcgtcggattggaccagatccgggtttgattccgggtcagatccgtttatctggccgcaaatcgaaatcagcaccgttttacgccggtcctgtgaccatgacctcgccgcctcctagcgatgtcccgcttccagctttcttcacgaagaaggcaacaaatgatctcatcaggatccttcgcctagacatcgcctga

SEQ ID NO: 688 - DNA, 864 bp, Arabidopsis thaliana
atggatcggcaaagttccgatgacatcatgaaatttctcgacggcatggctagctccgacgatgttctttttggcttcctcgacgaaggaaaccactcaccggaggattataacttcgccgccggcgacgaatccgaagttgacaacgataccaccgattgtaattcagaagagaacagaaaattttggcaagaacacgaacaacttctccaggcgacactgtataggacaagttcaattgagacaaagataagacaagcaactaaggaagcgttgaaagtagttagatcaaagggtttggtatgtgtctgccggagaccggttaccgacggttgtcgtagctgtttacgcggcgaagtatctagcctcctccgagaagctggctatgattgcgtcatttccaaatctaagtggagaagctctcatgagatccctgcaggtgagcatgaatacttggaggtcgtggacaaatcggtttcaaagaaaggcgagatccgggtggtgatcgaactatgttttagggcggagtttgagatggcgagaggcagtgaagagtacaagcgactcatcggaatgttaccggaagtgtatgtcgggaaaacggagaggctaaaatcattaataaagatattgtgcaccgcagcgaagaagtgtatgaaagacaagaagatgcacatgggtccttggagaaaacacaaatacatgcaggctaaatggtttggaacttgtgagagaaaatctgtgtcgccagtatccgaaactgaggagaatatgtttccggtggcaaagcagagggtttctatgttgaattatggtctttttggtgctggaataggccgtccgaccgttgtagcggttgtgtga

SEQ ID NO: 689 - DNA, 486 bp, Arabidopsis thaliana
atggcggaagaacatcgatgcgagacgcctgaaggtcaccgtctctgcgttaacaactgcggtttcttcggaagctcagcgacaatgaatctatgttcaaactgttacggcgatctctgtctcaaacaacaacaacaagcttccatgaaatcaaccgtcgaatcatctctctctccggtgatcgcacctgttctcgaaaactacgcggcggagttagagatcccgacgacgaagaagacagaggagaaaaaaccgattcaaattccgacggagcaaccgtctccgccgcaacggccgaatcgatgcaccgtatgtaggaaacgggtcgggttaaccgggtttatgtgtcggtgtgggacgactttttgtgggagtcataggtatccggaggttcatggttgtacgtttgatttcaaatcggcgggacgtgaagagatcgcgaaagctaatccgttggttattgcggcgaagcttcagaaaatatga

SEQ ID NO: 690 - DNA, 627 bp, Arabidopsis thaliana
atggcaactcaagccgccgggatcttcaactccgccataacaaccgccgcaacctccggcgtcaagaaactccactttttctcaacaacccaccgtcccaaatccctctccttcaccaaaaccgcaatccgcgccgagaaaacagattcctccgccgccgctgctgcagcccccgccacgaaagaagctcccgtgggattcacgccaccgcagctagacccaaacacaccgtctccgatcttcgctggaagcaccggtggtcttctacgtaaagcgcaagtggaagagttctacgttatcacgtggaactcaccgaaagaacagatctttgagatgccgacaggaggagcagcgatcatgagagaaggtccgaatcttctgaagctagcgaggaaagagcagtgtttagctttggggacaaggcttagatccaagtacaagatcacttaccagttttacagagtgtttcctaacggtgaggttcaatatcttcatcctaaagatggtgtttatccagagaaggcgaatccaggaagagaaggtgttggtctcaacatgagatctattgggaaaaatgttagtcccattgaagttaagtttactggcaaacaaagttatgatttgtaa

SEQ ID NO: 691 - DNA, 387 bp, Arabidopsis thaliana
atggctcctctcaagaactcctttgtaacatctctggtcattgcactaacattcacaagcttcttcaccagcctatccgctcatcgtcaccttctccaatcaacaccagtgactcagcctccagctttaacattcccacctctgcccaaaaccactatgccaccggttccttctctaccaactccaggacaacaaacgttgccacagccacaaccaactctgccacagcccactgggttgccaccgatgccgagcacacagataccatcattgcccaaccaggtgcagcccacaatccctaacattccacagatcaacttccctagcaactttcccttcaactttcctttcaacattcctttccttactccaccaccttcaaagtaa

SEQ ID NO: 692 - DNA, 219 bp, Arabidopsis thaliana
atggcgaaaccgttgggaacaaccggtgaatttttccggcgaagggatgagtggaggaagcatccgatgctatcgaatcaaatgagacacgcacttccaggtatcggaatcggtgttggtgccttctgcgtttacctcgtcggtgaacagatctatagcaaactcatggctccttcttctcaatcatcgcatcagaaacaacccgctccatctcactga

SEQ ID NO: 693 - DNA, 4146 bp, Arabidopsis thaliana
atggcttcgcttgtgtattctccattcactctatccacttctaaagcagagcatctctcttcgctcactaacagtaccaaacattctttcctccggaagaaacacagatcaaccaaaccagccaaatctttcttcaaggtgaaatctgctgtatctggaaacggcctcttcacacagacgaacccggaggtccgtcgtatagttccgatcaagagagacaacgttccgacggtgaaaatcgtctacgtcgtcctcgaggctcagtaccagtcttctctcagtgaagccgtgcaatctctcaacaagacttcgagattcgcatcctacgaagtggttggatacttggtcgaggagcttagagacaagaacacttacaacaacttctgcgaagaccttaaagacgccaacatcttcattggttctctgatcttcgtcgaggaattggcgattaaagttaaggatgcggtggagaaggagagagacaggatggacgcagttcttgtcttcccttcaatgcctgaggtaatgagactgaacaagcttggatcttttagtatgtctcaattgggtcagtcaaagtctccgtttttccaactcttcaagaggaagaaacaaggctctgctggttttgccgatagtatgttgaagcttgttaggactttgcctaaggttttgaagtacttacctagtgacaaggctcaagatgctcgtctctacatcttgagtttacagttttggcttggaggctctcctgataatcttcagaattttgttaagatgatttctggatcttatgttccggctttgaaaggtgtcaaaatcgagtattcggatccggttttgttcttggatactggaatttggcatccacttgctccaaccatgtacgatgatgtgaaggagtactggaactggtatgacactagaagggacaccaatgactcactcaagaggaaagatgcaacggttgtcggtttagtcttgcagaggagtcacattgtgactggtgatgatagtcactatgtggctgttatcatggagcttgaggctagaggtgctaaggtcgttcctatattcgcaggagggttggatttctctggtccagtagagaaatatttcgtagacccggtgtcgaaacagcccatcgtaaactctgctgtctccttgactggttttgctcttgttggtggacctgcaaggcaggatcatcccagggctatcgaagccctgaaaaagctcgatgttccttaccttgtggcagtaccactggtgttccagacgacagaggaatggctaaacagcacacttggtctgcatcccatccaggtggctctgcaggttgccctccctgagcttgatggagcgatggagccaatcgttttcgctggtcgtgaccctagaacagggaagtcacatgctctccacaagagagtggagcaactctgcatcagagcgattcgatggggtgagctcaaaagaaaaactaaggcagagaagaagctggcaatcactgttttcagtttcccacctgataaaggtaatgtagggactgcagcttacctcaatgtgtttgcttccatcttctcggtgttaagagacctcaagagagatggctacaatgttgaaggccttcctgagaatgcagagactcttattgaagaaatcattcatgacaaggaggctcagttcagcagccctaacctcaatgtagcttacaaaatgggagtccgtgagtaccaagacctcactccttatgcaaatgccctggaagaaaactgggggaaacctccggggaaccttaactcagatggagagaaccttcttgtctatggaaaagcgtacggtaatgttttcatcggagtgcaaccaacatttgggtatgaaggtgatcccatgaggctgcttttctccaagtcagcaagtcctcatcacggttttgctgcttactactcttatgtagaaaagatcttcaaagctgatgctgttcttcattttggaacacatggttctctcgagtttatgcccgggaagcaagtgggaatgagtgatgcttgttttcccgacagtcttatcgggaacattcccaatgtctactattatgcagctaacaatccctctgaagctaccattgcaaagaggagaagttatgccaacaccatcagttatttgactcctccagctgagaatgctggtctatacaaagggctgaagcagttgagtgagctgatatcgtcctatcagtctctgaaggacacggggagaggtccacagatcgtcagttccatcatcagcacagctaagcaatgtaatcttgataaggatgtggatcttccagatgaaggcttggagttgtcacctaaagacagagattctgtggttgggaaagtttattccaagattatggagattgaatcaaggcttttgccgtgcgggcttcacgtcattggagagcctccatccgccatggaagctgtggccacactggtcaacattgctgctctagatcgtccggaggatgagatttcagctcttccttctatattagctgagtgtgttggaagggagatagaggatgtttacagaggaagcgacaagggtatcttgagcgatgtagagcttctcaaagagatcactgatgcctcacgtggcgctgtttccgcctttgtggaaaaaacaacaaatagcaaaggacaggtggtggatgtgtctgacaagcttacctcgcttcttgggtttggaatcaatgagccatgggttgagtatttgtccaacaccaagttctacagggcgaacagagataagctcagaacagtgtttggtttccttggagagtgcctgaagttggtggtcatggacaacgaactagggagtctaatgcaagctttggaaggcaagtacgtcgagcctggccccggaggtgatcccatcagaaacccaaaggtcttaccaaccggtaaaaacatccatgccttagatcctcaggctattcccacaacagcagcaatggcaagtgccaagattgtggttgagaggttggtagagagacagaagctcgaaaacgaagggaaatatcccgagacaatcgcgcttgttctttggggaactgacaacatcaaaacatatggggagtctcttgggcaggttctttggatgattggtgtgagaccaattgctgatacttttggaagagtgaaccgtgtcgagcctgtgagcttagaagaactaggaaggccgaggatcgatgtagttgttaactgctcaggggtcttccgtgatctctttatcaaccagatgaaccttcttgaccgagctatcaagatggtggcggagctagatgagcctgtagagcaaaattttgtaaggaaacacgcgttggaacaagcagaggcgcttggcattgatattagagaggcagcgacaagagttttctcaaacgcttcagggtcatactcagccaacatcagtcttgctgttgaaaactcgtcatggaacgatgagaaacagcttcaggacatgtacttgagccgcaaatcgtttgcgtttgatagtgatgctcctggagcaggaatggctgagaagaagcaggtctttgagatggctcttagcactgcagaagtcaccttccagaacctggattcttcagagatttctttgactgatgtgagccactacttcgattctgaccctacaaatctagttcagagtttgaggaaggataagaagaaaccaagctcttacattgctgacactacaactgcaaacgcgcaggtgaggacactatctgagacagtgaggctggacgcaagaacaaagctgctgaatccaaagtggtacgaaggaatgatgtcaagtggatatgaaggagttcgtgagatagagaagagactgtccaacactgtgggatggagtgcaacgtcaggtcaagtagacaattgggtctacgaggaggccaactcaactttcatccaagacgaggagatgctgaaccgtctcatgaacaccaatcccaactccttcaggaaaatgcttcagactttcttggaggccaatggtcgtggctactgggacacttccgctgaaaacatagagaagctcaaggaattgtactcgcaggtggaagacaagatcgaagggatcgatcgataa

SEQ ID NO: 694 - DNA, 1875 bp, Arabidopsis thaliana
atggaagctgtgattcaaaccagagggcttctctctttacccaccaaacccatcggagtgagaagccaacttcagccttcccatggcttaaagcagagacttttcgccgcgaagccaagaaatctacatgggttgtctctatcctttaacgggcacaagaaatttcaaacctttgagccaaccctgcatgggatttcgatttcccacaaagagagaagcaccgagttcatatgcaaggcggaggccgcggctgctggcgacggagctgtcttcggcgaaggcgattccgcagctgttgtagcctcgccgaagattttcggtgtggaggttgcaaccttgaaaaagattatccctttaggattgatgttcttttgtattcttttcaattacacaattctgagggatacaaaggatgtcttggtggtgacggcgaaaggaagttctgctgagattatacctttcttgaagacttgggtgaatcttcctatggccattgggtttatgctcctctacactaaactctccaatgttctctccaagaaggctctgttttacactgttattgtccctttcatcatctactttggggcctttggtttcgtcatgtaccctctcagcaactatattcacccggaagctctcgcagataagctccttacaaccctcggcccaagattcatgggtcctattgcaatattgcggatttggagtttctgtttgttttatgttatggctgagctttggggtagtgtggtggtctcagttctcttctggggctttgctaatcagatcacaactgtggatgaagccaagaaattctatcctttgttcggacttggagccaatgttgcactgattttctcaggaagaaccgtgaaatacttctctaacttgagaaagaatcttggtcctggagttgacggctgggcagtttcgttgaaagccatgatgagcattgtggtgggaatgggactcgccatttgtctcctctattggtgggtcaatagatatgttcctcttccaacccgtagcaagaacaagaaggagaaaccgaagatgggaacgatggaaagcttgaagttcttggtatcatcaccatacattagagatcttgctactttagtggtggcatacggtattagtatcaatcttgtggaagtcacatggaaatcaaagcttaaagctcagttccctagcccgaatgagtactcagcatttatgggagacttctcaacctgcacgggtgttgcaacattcacaatgatgcttctcagccaatacgtattcaataagtatggttggggagtagctgcaaagatcaccccaactgttctgctattgactggtgttgcgttcttctctctaatattgtttggcggcccattcgcaccacttgttgccaagcttggtatgacaccgctacttgcagctgtgtatgtcggtgcccttcagaatatcttcagcaagagtgccaagtacagcttgttcgacccttgcaaagaaatggcctatatcccattggatgaggacaccaaggttaaaggcaaagctgcgattgacgtggtctgcaacccattagggaaatcagggggagctttaatacagcagttcatgatcttatcctttggatcactagcgaattcaacgccgtatctaggaatgatcttgttggttattgtcactgcgtggttagctgcagctaagtcgctggagggacagttcaacagcttgcggtctgaagaagagcttgagaaggaaatggagagagcttcatcggtgaagatccctgtcgtgtctcaggacgaaagcggaaacggttcccttggagaatctcctagcagttcaccggagaaatctgctcccaccaacttataa

SEQ ID NO: 695 - DNA, 684 bp, Arabidopsis thaliana
atggctcagaacgatacagtgaagctgataggttcttggtctagcccttattcccttagggcacgtgtggctctacacttgaaatctgtcaagtacgagtacttagacgaacctgatgttcttaaagaaaagagtgaactccttctcaaatctaaccccatccacaagaaagtccctgtcctcctccatggtgacctctccatctctgagtccctcaacgttgttcaatacgtcgacgaggcttggccctccgttccttcaatccttccttctgatgcctatgatcgcgcatctgctcggttttgggctcagtacatcgatgacaagtgttttgcggcggtggatgcggtggtcggagcaaaagacgacgaagggaaaatggcggcggtgggaaagctgatggagtgtttggcgatacttgaagaaacgtttcagaagagcagcaaaggattagggttctttggaggagagaccatcggctaccttgacattgcttgttcggctcttttaggtccgatctctgtgatcgaggcgttttccggcgtcaagtttctccggcaagagacaacacctgggttgatcaaatgggccgagaggtttagggcccatgaagctgttaagccctacatgccaaccgtcgaagaggtcgttgcattcgcaaagcaaaagttcaatgttcagtga

SEQ ID NO: 696 - DNA, 495 bp, Arabidopsis thaliana
atgccagcgggtcatggagttcgggcgagaacgagggatctgttcgcgaggccattcaggaagaagggttacattccactctcgacttacctgagaaccttcaaggtcggcgattacgtcgatgtgaaggtgaatggtgcgatccacaagggtatgcctcacaagttctaccacggtcgtactggtcgtatctggaacgtcactaaacgcgccgtcggtgttgaagtcaacaaacagattggcaacaggatcataaggaagaggattcatgtgcgtgtggagcatgtgcagcaatcaagatgtgctgaggagttcaagctgaggaagaagaagaatgatgagctcaaggctgcagccaaagccaatggtgagaccatcagcaccaagagacagcctaaaggacccaaaccaggattcatggtcgaaggaatgaccttggagactgtcactccaatcccgtacgatgtcgtcaacgatctcaagggaggctattag

SEQ ID NO: 697 - DNA, 1374 bp, Arabidopsis thaliana
atgattccaaacggaagcttaggctggccggtgatcggagaaaccctaaacttcatcgcttgtggttattcttctcggcctgttaccttcatggacaaacgaaagtctttatacgggaaagtgttcaaaacgaacataatagggacaccaatcataatatcaaccgatgcagaggtgaataaagtggtgctccaaaaccatgggaacacatttgtccctgcataccctaaatcaattacggaactacttggagaaaactctattctcagcatcaatggacctcatcaaaaaaggcttcacacgctcattggcgcgttcctcagatctcctcacctcaaagaccggatcactcgagacattgaggcctcggttgttctcactttggcgtcttgggctcaacttccattggttcatgttcaggatgagatcaaaaagatgacgtttgagatattagtaaaagtgttgatgagcacatctcctggtgaagatatgaacattctcaaacttgagttcgaagaattcatcaaaggtttgatttgtatcccaatcaaattccctggcactagactctacaaatccttaaaggcgaaagagaggttaataaagatggtaaaaaaggttgtggaggagagacaagtggcgatgacaacgacgtctccggcaaatgacgtggtggacgtacttctaagagacggtggtgattcagagaagcaatctcaaccgtcagatttcgtcagcggaaagatcgtagagatgatgatacccggagaggaaacaatgccaacggcgatgaccttggctgtcaaattcttaagtgacaaccccgtcgctctagccaaactcgtggaggagaatatggagatgaagaggcgtaaattggaattgggagaagaatacaagtggaccgattatatgtctctctcttttactcaaaatgtgataaacgaaacgcttagaatggctaacattattaacggggtgtggaggaaagctctcaaggatgtagaaattaaaggttacttaataccgaaaggatggtgtgtattggcatcattcatatcggttcacatggatgaagacatttatgataatccctatcaattcgatccgtggagatgggacagaattaatggatcggcaaacagcagtatttgcttcacaccctttggtggtgggcaaaggctatgtcctggtttagagctgtcgaagctcgaaatatccatctttcttcaccaccttgtaacccggtacagttggacggctgaggaagacgagatagtgtcatttccgactgtgaagatgaagcggaggctcccgatccgagtggctactgtagatgatagtgcttctccgatctcacttgaagatcattaa

SEQ ID NO: 698 - DNA, 2790 bp, Arabidopsis thaliana
atgaaaccgttctcaaagaacgatcggcgacggtggtcatttgattcagtttccgccggaaaaaccgccgtcggaagtgcatcaacttcaccgggaactgaatactccattaacggtgatcaagagttcgttgaagtcacaatcgatcttcaagacgatgacacaatcgttcttcgtagcgtcgagccagcaaccgccattaatgtcatcggagatatctccgacgacaacaccggaataatgactccggtttcgatttcgagatctccgacgatgaaacgaacttcatctaatcggttccgacaattctcacaagagcttaaagccgaagctgtggcgaaagcgaaacagttatctcaggagttgaaacgattctcatggtctcgttctttctcaggtaacttaaccactactagtaccgccgctaatcaaagcggcggtgctggtggtggtttggtgaactcggctttagaagcgcgagcgttgcgaaagcaacgtgctcagttagatcggactcggtctagtgctcaaagagctcttcgtggtttgagattcattagcaataagcaaaagaacgttgatggttggaacgatgttcaatcaaatttcgaaaaattcgaaaaaaatggttacatctatcgctccgatttcgctcaatgcataggaatgaaagattcgaaagaatttgcattggaactgttcgatgcattgagtagaagaagaagattaaaagtagagaaaatcaatcacgatgagctttatgagtattggtcacaaatcaacgacgagagttttgattctcgtctccagatcttcttcgacatagtggacaagaatgaagatgggagaattacagaagaggaagtaaaagaggaacaagcagaggaatatgcagctttgattatggaagagttagatcctgaaagacttggctacatagagctatggcaactagagactttgcttctacaaaaagacacatacctcaattacagtcaagcattgagctatacgagccaagcattgagccaaaaccttcaagggttaaggggaaagagtcgaatacatagaatgagttcggatttcgtctacattatgcaagagaattggaaaaggatatgggttttatccttatggatcatgatcatgatcggattattcttgtggaaattcttccaatacaagcaaaaagatgcatttcatgtgatgggatattgtttactcacagccaaaggagcagctgaaacacttaaattcaacatggctctaatacttttcccagtttgcagaaacaccattacttggcttagatccacaagactctcttacttcgttccttttgatgataatatcaacttccacaagacaattgctggagccattgtagtagctgtgatccttcatattggagaccatcttgcttgtgatttccctagaattgttagagccaccgaatacgattacaatcggtatctgtttcattactttcaaacaaaacagccaacatacttcgacctcgttaagggacctgaaggaatcactgggattttaatggtcattttgatgattatttcattcacattagcaacaagatggtttaggcgtaacctagtcaagcttcctaagccatttgatcgactaaccggttttaacgccttttggtattcgcatcatttgttcgtcattgtttatatcttgcttattcttcatggtatcttcctctatttcgccaagccttggtatgttcgtacgacatggatgtatcttgcagtaccagttttactctatggtggagaaagaacacttaggtacttccgttctggttcttattcggttcgactgcttaaggttgctatatatcctggtaatgttctaacgctacaaatgtcgaaaccaactcaatttcgttacaaaagcggacaatacatgtttgtccaatgtcctgcggtttcgccattcgagtggcatccattctcaattacttccgcacctgaagatgattatatcagcattcacattagacaacttggtgattggactcaagaactcaaaagagtattctctgaagtttgtgagccaccggttggcggtaaaagcggacttctcagagccgacgaaacaacaaagaaaagtttgccaaagctattgatagatggaccgtacggtgcaccagcacaagattataggaaatatgatgttctcttattagttggtcttggcattggtgcaactccatttatcagtatcttgaaagatttgcttaacaacattgttaaaatggaagagcatgcggattcgatctcggatttcagtagatcatcagaatacagcacaggaagcaacggtgacacgccaagacgaaagagaatactaaaaaccacaaatgcttatttctactgggtcacaagagaacaaggctcttttgattggttcaaaggtgtcatgaacgaagttgcagaacttgaccaacggggtgtgatagagatgcataactatttaacaagtgtgtatgaagaaggtgatgctcgttctgctctcattacaatggttcaagctcttaatcatgccaaaaatggtgtcgacattgtctctggcactagggtcagaacacactttgcaagacctaattggaagaaggttctcacaaagctaagttccaagcattgcaatgcaagaataggagtgttttattgcggagtaccggttttagggaaggagcttagcaaactatgcaacacattcaatcaaaaaggttcaaccaagtttgaatttcacaaggagcatttctaa

SEQ ID NO: 699 - DNA, 1860 bp, Arabidopsis thaliana
atggctgctaccgctgctgcttctgttgtccgttacgcacctgaggatcatactcttcccaagccctggaaaggccttatcgatgatagaactggttacttgtacttttggaatcctgagaccaatgttactcagtacgagaaaccaaccccctctctacctcctaagttttctcccgccgtttctgttagctcttccgttcaggttcaacaaactgatgcctatgctcctcccaaggatgacgataagtactccagaggctctgaacgtgtgtccaggttttctgagggtggcaggagtggaccgccttattcgaacggtgctgctaatggagttggggattctgcttatggtgcagcatctaccagagttcctcttccttcatcagctccagcaagtgaactatcccctgaggcctattcccgccgtcatgaaattactgtcagtgggggccaagtaccaccacctctaatgtcctttgaagctactggttttccacctgagcttctgcgggaggtactcagtgcaggtttctctgctccaactccaattcaagctcagtcatggcccattgctatgcaaggtagggacatagtagccattgctaaaactggctcgggaaaaactttgggttacttgattcctggatttttgcatcttcaacgtatccgaaatgattcgcgaatgggcccaacaatcttggtattgtctccaacgagagagctggccacacaaatccaagaagaagctgttaaatttgggaggtcatcaagaatttcgtgtacgtgtttgtatggtggtgcaccaaagggccctcagttgagggatttagaaagaggagcagatatcgtggttgcaactcctgggagattgaatgatatccttgaaatgaggaggattagtctgcgtcagatatcttatcttgtgctagatgaggcagatagaatgttggacatgggttttgaacctcagataaggaagattgtgaaagaaattcccactaagcgtcaaacccttatgtacacagctacatggccaaagggagttaggaaaattgcagctgacttgcttgttaaccctgctcaagtcaacattggcaatgttgacgagcttgtggctaacaagtcaatcacacagcatattgaagtggtagcaccaatggagaaacagaggaggttagagcagatcttgcggtctcaggaaccaggctcaaaggtgataatattctgctcaaccaaaaggatgtgtgatcaactaacacgcaatctaacccgccaatttggagctgctgctatacatggagacaagtcccagcctgagagagacaatgttcttaatcaattccgcagtggcagaactccggttcttgtagcaaccgatgttgctgctcgtggtctggacgttaaggacatcagggcggtcgtaaactatgatttccccaatggagtggaagactatgttcatagaatcggaagaacaggaagagctggagcgactggtcaggcattcacattctttggtgatcaagattcgaaacatgcttcggatctgatcaagattttggaaggagcaaaccagcgagttcctcctcagatccgcgaaatggctacacgtggtggtgggggaatgaacaaattcagtcgttggggacctccttccggcggccgtggtcgtggtggcgactctggttatggtggcagaggtagctttgcttcccgtgacagtagaagcagcaatggatggggaagagagcgagaaaggagccgtagccctgagagattcaacagagctccaccaccgtcttccaccggatctcctcctcgcagcttccacgagacgatgatgatgaaacacagatga

SEQ ID NO: 700 - DNA, 1077 bp, Arabidopsis thaliana
atggccaccgcttcaatcttccccgccgccgtgaccgtcaccagagatgtgacatctcttcttaatccatcttctctgataatcggaaaatcattatctccttcaaagttcagctcaatcaaatcctccgtttcattttcccgcaaaaccctaactccaattcgatactcttcatctcccgccgatcactcacccgccaccgccgtggaagcgatcacgaatcgatccaaaacctccttgaaatctcgtctccgtggaggagaaactctctacggtctctttttactctccttctcgccgacattagccgagatcgctgctcacgccggttacgattacgtcgtcgttgatatggaacatggtcccggaggtataccggaagctttggattgtattcgagctcttaacgccgccggaacatcagccattctccgattaccggaaaactcaccaacctgggctaaaaaagctctagatctaggtccacaaggaatcatgttcccaatgatcgaatctcgtaaagacgctaccaaagcggtgtcgtattgccggtttcctcccgacggtatccgtggatcggcgcacacggtggtgagagcttctaactacggaatcgatgaagggtatttaagtaattacgcagaggagattctgattatgtgccaggtggaatcaggtgaaggagtgaagaaagctgatgaaatcgcagccgttgatggtgttgactgtgtgcaaatgggaccgttggatcttagtgcgagtttagggtatttgtgggatcctggacataagaaagtgagagagatgatgaagaaggctgagaaatctgtgctgaccactgatccggcgaaaggcggggcttacttgtcgggtttcgcgatgccgcacgacggagctggtgagattcggggacgtggttaccatatggtcgccggagctgttgatgttggattgtttaggaatgctgctgttgaagatgtgaggagattcaagatgggtttggtcaatgaatcggacagtgaggattcgtcggaacatgataaagatgttgatgatgagaagtactggagcgaataa

SEQ ID NO: 701 - DNA, 1023 bp, Arabidopsis thaliana
atggagtcttcggttttcgactttggatcggagtcggggaacatgaatttcgacgagaccgtgccactgagccaacgattggagtggtcagacgtggtcccattgactcaggacgatggtccgaatccagtggtgccaattgcctacaaggaagagttccgcgagactatggattacttccgtgcgatttacttttccgacgagcgatctcctcgcgcactacgactcacggaagaaaccctcctcttaaactccggcaactacacagtgtggcatttcaggcgcctagtactcgaggcccttaatcacgacttgtttgaagaactcgagttcatcgaacgcattgctgaggataactctaagaactaccaactgtggcatcatcggcgatgggttgcagagaaactgggtcctgatgttgcagggagagaacttgaatttacccgtagagtactttcacttgatgccaaacattatcatgcttggtcacataggcagtggacactacgggcattaggaggatgggaagatgagctcgattactgtcacgagctccttgaagctgacgtctttaacaattccgcctggaatcagaggtattatgtcatcacccaatctcctttgttgggaggcctagaagccatgagagaatctgaagtaagctacacaatcaaagccattttaaccaatcctgcaaacgagagctcatggcgatacctaaaagctctttacaaagacgacaaagaatcctggattagtgatccaagtgtttcctcagtctgtttgaatgttctatcccgcacagattgcttccatggattcgctctgagcacccttttggatcttctatgtgatggactgagaccaaccaacgagcataaagactcagtgagagctctagctaatgaagaaccagagactaacttggccaatttggtgtgtactattcttggtcgtgtagatcctgtaagagctaactattgggcatggaggaagagcaagattacagtggcagcaatttga

SEQ ID NO: 702 - DNA, 522 bp, Arabidopsis thaliana
atgagatgcaaggtagtatatgcagcaagaacaacaacaagaaccaaagtaacaaaaacaatctctaaaaccatatcaatgggactacaaggtcagctctccgacgtgtcatcagattcgatcccactgatgctactggctctcctcgcaactttcttcagacacgtccggtctcttctcctcttcccttcttctgcccccgttgttgttgttacttcaaacctcagcgtcctcgccgaccagctcaacctaaatcgcctcttctcgtaccgctactccgacaacgcagcctctgactgcatcgtgtgtctgtctaaactcaagaccggagaagaagtgaggaagctagattgcagacacgtcttccataagcagtgtttggaaggctggcttcaacatctcaacttcaattgcccgctctgtagatctccattgctacctcatcatcatcagggacatggcagtgatgcgtcgatctcagccttccctcttcgctctacctctactgcatcatctcattga

SEQ ID NO: 703 - DNA, 2766 bp, Arabidopsis thaliana
atgctctttcaggcttgcggtgctaaatactccatcaaggatgatctgcttgatgagactgatgtcgatgatgttgtcgtttcccttgttaatcttgctagagccggggaactcgaagattatcagagttccagaaagaaggaactcaagaacttcaaagaaaatcttgtttccttctggaataatctcattatcgagtgccaaaacggaccattgtttgatagagtcttgttcgacaagtgcatggactacattatcgcactgtcatgtactccacccagagtttaccgtcaaactgccacgctaatgggcctccaactagtcacatctttcatttctgttgcaaacacactcggttcacagcgagaaaccacccaaagacaattgaatgctgaaagcaagaagagagctgacggccctcgtgtggactccctcaacaaaaggttgtctgttactcatgaacagataactacactggaggacatgatgcgcaaaattttcactgggttgtttgtacaccgatatcgagatattgataacgatattcggatgtcatgcattcagtctctgggcatttggattttgtcttatccttctcttttcttacaagatctgtatttaaaatatcttggatggacgcttaatgacaaaaatgctggagtgaggaaagcttctctattggcattgcaaaaactttatgaaatggatgaaaacgtccccactcttggtcttttcactcagagattttccaatcgaatgatcgagatggctgatgatgttgatatgtctgcagctgtatgtgctatagggcttgtaaagcaactgctaagacaccagctgatacctgatgatgacctaggccctttgtacgatttgcttattgatcaacctcaagaaatcagacgtgcgataggagagttagtgtatgaccacttgatcgcacagaagtttaacagttctccgtccagtcttacagagtctaagagaaattacttttcactgttgcacgttcattatatagctgtgacgtgtaccttctgcagtttttataccatcgtcatgatgctgcttttcttacaggactggaagtgtatcatctctatgcttttggatcagaatcctcgaactgggtctactactgacgaggactcgacaaacttgatcagacttctgtttgtgtcaatcagaaaggctgtcggggagaagataattccttcaacggataatcgaaagcagtatcacagtaaagctcagcgagaaatatttgaaaacaacaggaaagacataactgtggccatgatgaagaattatccacagcttctacgtaaattcatggctgacaaagcaaaagtgtcatctttggtcgagattattatatttatgaaacttgagctctattctcttaaaagacaggagcagagttttaaagctgccgtccgactcataaaggatgcttttttcaaacacggggagaaggaagcactaagatcttgcgtcaaggctataacattttgtgcgtcagaaagtaaaggggagcttcaagatttttcacgtgggaagcttaaagatcttgaagatgagcttttagataagatcacttctgcaattagagaagtcaaggatggaaatgatgaatactccctcctagtaaatctgaaaaggttgtatgagcttcaattgtcaaagcctgtgcttgttgagagcatgttcgatgagattgctttgacgctccataatttcagaaatttggacgaagagatctgtgctatactcgccgaaacatggtgtttgtttagaaagtcaaattatgactcgggtaaacttgaaagattaggatactgtcccgacagtgtctttcttgagaaattttggaaactctgtgcagaaatgtttaacacttcagatgagaccgatgaggaggatgaaaataaggaatacattgaagagacaaacagagatgtttcagtcattgctgcctgcaagttggttgctagtgatgtggttccaaaggattatctaggaccagagatcatatcgcatcttggtatgcatggacctggtgtaacaggcatcataaagaatcttattacattcttaaggaaaaaagaagatgacatctctaatatctatctcgaatccttgaaacgggcctatcaccggtattcaagtgaactttctagtggccgtgaagaatccagagtagataaatgtcttgaagagtggcgggagcttgcaggtgggctctcaggaatgtatatcggggctgcgcgcaacaaatacagattggagatattgagtgtggtgaaggaaggtgttgagtttgcttttagggacgccccaaagcaactgttgtttctggaagttgctatccttccatttgcaaccagactctcagtgtctgacatcattgacattaagaaggacgttcaggggcgtatagtgcatgttaatacagacgaagatcccagtggatggcgtccttgcttcaccttcttggaaaccttggaggagaaatgcttgaaaaacgaggatttacaagacgacaaggaagcagcaaatgtaagacgcaggggacggccaagaaaacgtccggaaacagagcgaaagagactgtttgatgagcaaagtggaagcgatgaggatgagtctattagtggcgggtcagacagagaagataagctcgacgaggacgctcctctaatcgagacaattagatcggctgccagacggaaagcgctcaagggtgaacggtccaagggacactga

SEQ ID NO: 704 - DNA, 1488 bp, Arabidopsis thaliana
atggagacgaagccaaaccctagacgtccttcaaacacagttctaccatatcaaacaccacgattaagagatcattaccttctgggaaaaaagctaggccaaggccaatttggaacaacctatctctgcacagagaaatcaacctccgctaattacgcctgcaaatcgatcccgaagcgaaagctcgtgtgtcgcgaggattacgaagatgtatggcgtgagattcagatcatgcatcatctctctgagcatccaaatgttgttaggatcaaagggacttatgaagattcggtgtttgttcatattgttatggaggtttgtgaaggtggtgagctttttgatcggattgtttctaaaggtcattttagtgagcgtgaagctgtcaagcttattaagacgattcttggtgttgttgaggcttgtcattctcttggtgttatgcatagagatctcaaacctgagaatttcttgtttgatagtcctaaagatgatgctaagcttaaggctaccgattttggtttgtctgtcttctataagccaggacaatatttatatgacgtagttggaagtccgtactatgttgcaccagaggtgctaaagaaatgttatggacctgaaatagatgtgtggagtgctggtgttatcctctacattttactcagcggtgttcctcccttctgggcagagactgagtctggaatctttagacagatattgcaagggaagttagatttcaaatctgacccgtggcctactatctcagaagctgctaaagatttgatctataaaatgctcgaaaggagccccaagaaacgcatttctgctcatgaagccttgtgtcacccatggattgtcgatgaacaagcagcaccagacaagcctcttgatccagcagtcttatctcgtctaaagcagttttctcaaatgaataagattaagaaaatggcattacgggtaattgctgagagactttcagaggaagaaattggaggtctgaaggaattgttcaagatgatagacacagacaacagcggaacgattacttttgaagagctcaaagcgggtttgaagagagtcggatctgaactgatggaatcagaaatcaagtctctcatggatgcggctgatatcgacaacagtggtacaatagactacggagaattcctagcagcaaccttacacatgaacaagatggagagagaggagaatctggtggctgcattttcgtactttgacaaagacggaagcggttatatcaccatcgatgagcttcagtcagcttgcacagagtttggtctatgtgatacacctctggacgacatgatcaaggagattgatcttgacaatgacgggaagatcgatttctcggagtttacagcaatgatgaggaaaggagatggagttgggagaagcagaaccatgatgaagaacttgaacttcaacattgctgatgcttttggagttgatggtgaaaaatctgatgactga

SEQ ID NO: 705 - DNA, 921 bp, Arabidopsis thaliana
atgccgttaaacggagatctcgaccgtcagatcgaacagctaatggagtgtaagccgttaggtgaagcagacgtgaagatcctttgcgatcaagctaaagcgattcttgttgaggaatataatgttcaaccggttaagtgtccggttacggtatgcggcgatatccatggccagttttatgacctaattgagctatttcgtattggtggtaatgctcctgatactaattacctcttcatgggagattatgtagatcgtggctactattctgtagaaacagtctctctattggtggcattaaaggtgcgttacagggacagacttacgatcctgcgagggaatcatgagagccgtcagattacacaagtctatggtttttatgacgaatgcttgaggaaatacggaaatgcaaatgtgtggaagtattttacggaccttttcgattatctccctcttacagcactcatagagagtcaggttttctgtttgcatggaggcctttcaccttctctggatactcttgacaatatccgaagcttggatcgaatacaagaggttccacacgaaggaccaatgtgcgatctactctggtctgatcccgacgatcgttgtggatggggaatatctcctcgtggtgctggttacacgtttggacaggacattgctactcagtttaatcataacaatggactgagtctgatctcaagagcgcatcaacttgtaatggaaggctataattggtgtcaggaaaagaacgtagtgacagtgtttagtgcaccgaactactgttacagatgtggaaacatggccgcaattcttgagattggagaaaagatggaacagaacttccttcaattcgatccagcacctagacaagtcgaacccgataccacgcgcaagacccctgattattttttgtga

SEQ ID NO: 706 - DNA, 195 bp, Arabidopsis thaliana
atggattctcaaatcaaacacgccgtggtcgtgaaggtcatgggtaggactggttctcgtggtcaggtcactcaggttagagtcaaattcactgattcagaccgtttcatcatgaggaacgtgaaaggacccgtcagagaaggagatgtcctcactctcctcgagtccgagagagaagctagaagactccgttga

SEQ ID NO: 707 - DNA, 1128 bp, Arabidopsis thaliana
atggtgactaaagcagaaaaacaattcgccaaaaatttcaacatagacgatctccctgacgtccctgccggacttcctccacatctcaaagcccagcaaactcgtgtcgtctctaaaaacaacgctcctgctcatactgcgagtgccatttactcgggtacctatgtttcttctacggaagaggacgacaatgtgaagctaggaaacttctatgataacttcaaagttgatgtggttagtctcacaaagacagatatggaatttgatatgattggtattgatgcagcgtttgccaatgcattccgaaggatccttatagctgaggttccttcaatggctattgaaaaagtgttgatagcgtacaacacatcggttattatagacgaagttcttgctcacaggatgggtcttattccaattgccgcagatccaagactttttgaatatttatccgaacatgatcaggcgaatgaaaagaacaccattgtattcaaactccatgtgaaatgtccgaaaaatagaccacgtcttaaagttttaacgagtgatttaaaatggttaccaaatggaagtgagcttctgagagaatcggaaaataaaacctcaaagccaaaaacttacacttcattcagttgcagccaagattcattacctgaatttgctaataatcctatcactccatgcgacctcgatatcttgatagcaaaactcgcccctggtcaggaaatcgagctcgaagctcatgcggttaagggcattggtaaaacacatgcaaagtggtctccagtagggactgcttggtatagaatgcatcctgaggtggttctacgtggggaagttgaggatgaacttgctgaacgacttgtaaacgtctgcccacagaatgttttcgacattgaagacatgggaaaaggtaagaaaagggcaacagtagcgcagccacgtaagtgcacattgtgtaaggaatgcgtaagagacgatgatttggtagaccatgtggatcttggcagtgttaagaaccattttatatttaacattgagtccaccggatcactgcctccagaggttctcttcactgaagctgtgaagatattggaagctaaatgtgaagctataaccgacttttga

SEQ ID NO: 708 - DNA, 693 bp, Arabidopsis thaliana
atgttcgccaacaagttcccgggcgtctacgcagccacttgtctctccgtcgaagacgccgtcaacgctcgatcaataagcaattgcaatgtcctcgcattctccggcatcaaaacatccccggaaaccgccttggaaatcttcgacgcttggatcaaaactcctttcaaatctccttgtcctgcgtccggatccgaaccatggagctcagttatctcttccttcctcgacaattctctctccgagatgtctcagattggaaagtcaaccgccggcgattcaacaaccaagaagatcgatgaaacaaccgcgtcttgcgtaatttgctgcttggcgaagaacagagagttcactccagtggacatcatgccgggaggctcgatgaagatcgttagagagacgccgacgtcggcgattgtaagattcaaagcgggaagtgtggaaccggcgcatcaccacacattcggccatgaccttgtagtcataaagggaaagaaaagtgtgtggaatctgagcaagaaggagagagctgatctcgttgacggcgattacctattcactcccgccggtgatgttcaccgagtcaaatatcacgaagacactgagttcttcatcacttgggatggccattgggacatattccttgacgaagacctcgaaactgcaaagaaagccatcgaagaagaagcttga

SEQ ID NO: 709 - DNA, 774 bp, Arabidopsis thaliana
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 710 - DNA, 831 bp, Arabidopsis thaliana
atgatcgccgccggagctaaatcgctattagggctttcgatggcttctccaaaagggattttcgatagcaattcaatgagtaattcaagatctgttgttgttgttcgtgcttgtgtttctatggatggatctcaaactctgagtcataacaaaaatggatctattcctgaggttaaatccattaacggtcacacgggacaaaagcaaggacctttgtctacggtcggaaactcgacaaatataaagtggcatgaatgttctgttgagaaagttgatagacagagattgcttgatcagaaaggatgtgtgatttgggtcaccggtcttagtggttcagggaagagtactttggcttgtgctttgaatcagatgttgtatcaaaaggggaagctttgttatattcttgatggtgataatgttaggcatggcttaaaccgtgatcttagctttaaagctgaggatcgtgcagagaatattcgtagagttggagaggttgctaagctttttgcggatgctggaataatctgcattgcgagtttgatatctccttatagaacagatagggacgcttgtcgaagtttgctccccgagggagattttgttgaggtgttcatggatgtaccgcttagtgtttgcgaggcgagggatccaaagggtctttacaagcttgctcgtgcaggaaagatcaaaggttttaccgggatcgatgacccttacgagccaccattgaactgcgagatttctctaggacgtgaaggaggaacttctcctatcgaaatggcggaaaaggtcgtcggatacttagataacaagggttatcttcaagcataa

SEQ ID NO: 711 - DNA, 1155 bp, Arabidopsis thaliana
atggcttcttcactgaagaagcttatctcaagctttctacttgtcttatactccaccaccatcattgttgcttcatcagaatctcgatgtaggcgttttaaatcgatcatcagctttggtgattccatcgcagacaccggaaattatctccatctctctgatgtcaatcaccttcctcaatccgcctttcttccttatggcgaaagcttcttccatcctccctccggtcgtgcctctaatggccgtctcatcatcgacttcattgccgaattcttgggactaccatacgtaccgccttactttggatcccaaaacgttagcttcgaacaagggatcaattttgcggtgtatggagcaaccgcattggaccgagcgtttcttttgggaaaaggaattgaatctgatttcaccaatgttagtttaagtgttcagcttgacaccttcaagcagattttgcctaacttatgcgcctcgtctactcgtgattgcaaagagatgcttggagactcgctgatactcatgggagagattggaggaaacgactataattacccattttttgaaggaaaaagtatcaatgaaatcaaagagcttgttcctctaatcgtcaaagctatttcttctgctattgtggatttgattgatttagggggcaaaacatttttggtacccggaggcttcccaacaggatgttctgcggcgtatcttactctatttcagaccgtggcagaaaaagaccaggaccctttaacaggttgttacccattgctcaacgaatttggcgagcaccacaacgaacagctaaagacagaactcaagcgactccaaaaattctatcctcatgtcaacatcatttacgctgactaccacaactccttataccggttttatcaagaaccagctaaatacgggtttaagaacaaacctttagctgcttgctgtggagtcggaggtaaatacaacttcactattggtaaggagtgtggatacgaaggagttaactattgtcaaaatccttctgagtatgtgaactgggatggttatcatttaaccgaagccgcctaccagaagatgactgagggtatactcaacggtccctatgcaactcctgctttcgactggtcctgccttggctctggtacagtggatacataa

SEQ ID NO: 712 - DNA, 1389 bp, Arabidopsis thaliana
atggcagtagctacacattgtttcacttcaccttgtcatgaccgtattcgatttttctcaagtgatgatggtattggtaggcttggcattacaagaaagaggatcaatggcactttcttgctcaagattttacctccaatccaaagtgctgatctcagaacaactggtgggagatcctcacgtcctttatctgcattcaggtcaggattctctaaggggatatttgacattgtgccattaccatcaaagaatgagctgaaagagctgaccgctccgctgttgctaaaactcgtgggtgttttagcttgcgcgttccttattgttccatctgcagatgcagttgatgcacttaaaacttgtgcatgcttattgaagggatgcaggatagaactcgcaaagtgcattgccaaccctgcctgtgcagccaatgtcgcgtgccttcagacctgcaataaccgtccagatgaaaccgagtgccagattaaatgtggggatctgtttgagaacagtgttgttgatgagttcaacgagtgtgctgtgtcgagaaaaaagtgtgttcctagaaaatctgatctcggagaatttcctgccccagacccttctgttcttgtacagaacttcaacatctcggactttaacgggaagtggtacattacaagtggcttgaatccaacctttgatgccttcgactgccagctgcatgagttccacacagaaggtgacaacaagcttgttggaaacatctcttggagaataaagaccctagacagtggattctttactaggtcagccgtacaaaaattcgtgcaagatcctaaccaacctggtgttctctacaatcatgacaacgagtaccttcactatcaagatgactggtatatcctgtcatcaaagatagagaataaacctgaagactatatatttgtatactaccgtgggcgaaacgatgcttgggatggatatggtggtgcagttgtatacacgagaagttctgtattacccaatagcattataccagaactcgaaaaagcagcaaaaagcataggcagagacttcagcacattcattagaacggataacacatgtggtcctgaacctgcgctcgtggagagaattgagaagacagtggaagaaggtgaaaggataatcgtaaaagaggttgaagagatagaagaagaggtagagaaggaagtggagaaggtcggtaggactgagatgaccttgttccagagattggctgaaggatttaatgaactgaagcaagacgaggagaatttcgtgagagagttaagtaaagaagagatggagtttttggatgagatcaaaatggaagcaagtgaggttgaaaaattgtttgggaaagctttgccaatcaggaaggtcaggtag

SEQ ID NO: 713 - DNA, 1881 bp, Arabidopsis thaliana
atgctcaaacagtttcttcttctccaatccttctccttcttcctcttcaatgtagttatcgtcggaggaagaacattcggcggcggtttctcagcggaggagaatccatttactccaaaagcatctctagttcgttactggaacaaagagattcgtggccaatctcccagatcggagtttttaatctcaaaagcttcaccactcaacgccgtagactcagcaactttctcaaaactcgccgccgcgaactcgctgccgactcgttttcccgatttctgctccgccgcgaatctcttctgttttcctgatttaggagcgagtctcgagaaacacgacgacgacgttaaattctccgtttatgaccagaagaacttcactaactacggcaatgctcgtgccggaggagcagattcgttcaaaaactactcgaaagacggtaatgtcgtaaccgattcgttccggagatacagccgtaacgcggcgggtcacgacgataaattcactgtctacggtgaaaacagtaacgtggtagaggaaggattcaattcatacggaacattcggaaccggcggcgccggagatttcactaactaccaaaacaacgtgaacaatccaacgagtcgattcacggcgtattccgacggaggtaacggtcgatctcaaacattcaaaacctacacacacgaagctaacgccggtaacggtcaatcattcacaagctacggcaaaaacggaaacggagttcctaacgagttcacttcttacggcgtctcctccaatgtaatcggctccggtttctctaactacggcgagagtggaaacgcggcgaacgataccttcacaagctacggaagcgacggtaatgtacctcagaacaattttaataactacggtgcttccggtaacgccgccgtggataccttcgcgaattacagagacaaggccaacgtcggagacgattcgttctcatcctatgcgaaagattcgaattcggagaaggttaatttcgtaaattacggtcaatctttcaatcccggttcagaaactttcaccggttatggcaaaggagctgaaggaagcaaactcagcttcaaaacctatacaccaaactctactttcaaggactacgccaaaaagggcgtcgcttttgctaaatacaacgtttcaacaaccaccgcgaacaccgtcggcgatggcaaaaccgtaaataaatggatcgaaccgggtaaattctttagagaatcgtcgcttaaagaaggtacagtgattcctatgcctgatattaaagataaaatgcctaaaaggtcgtttttaccccggagtataattacgaaactacccttctctacttctaaactcggtgagattaagagaatcttccacgccgttgagaattcgacgatgggaggtataatcaccgacgcagtgacggagtgcgagaggccaccgagcgtcggagagacgaaacggtgcgtaggatcagcggaggatatgatcgatttcgcgacgtcggtgttaggtcgtagcgtggtgcttagaacaacggagaacgtagccgggtcaaaggaaaaggtagtgatcgggaaagtcaacggaatcaacggtgggaaattaacgaaagctgtgtcgtgtcatcagagtttgtacccgtatctattgtattactgccactccgtaccaaaggttcgggtatacgaagctgatcttctagagttgaatagtaagaagaagattaaccacgggattgccatctgtcacatggacacgtcatcatggggtccgagtcatggagctttcttagctctcgggtcaaaaccgggtcggatcgaagtttgtcactggatatttgagaacgacatgaactgggctatcgctgattag

SEQ ID NO: 714 - DNA, 1479 bp, Arabidopsis thaliana
atgtcgatttacgtcgcgtcgcgacggctctccggcggaacaactgtgacggcgctgcgttatgccacctctctgagatcttattcgacctcgtttagggaggagagggacaccttcgggccgattcaagttccttccgataaattgtggggagcccagacgcagagatcgctgcagaacttcgaaatcggtggtgagcgcgagcgaatgcctgaaccaattgtccgcgcttttggcgtcttgaagaaatgcgctgccaaggttaacatggaatacggtcttgatccgacgattgggaaagcaattatgcaagctgctcaggaagtagctgagggaaagctcaatgatcatttcccccttgttgtctggcaaactggtagtgggactcagagtaatatgaatgctaatgaggtcattgctaatagagcagctgagattcttggtcgcaaacgtggtgagaaatgtgtgcacccaaatgaccatgtgaacagatcacaatcttctaacgacacttttcctaccgtcatgcacattgcagctgcaaccgagattaattcgaggctcatccctagtttaaaaactttgcatagcactttggaatctaagtccttcgagttcaaagatattgtgaaaattggaagaactcacactcaagatgctacacctttgacactaggacaagaatttggtggctatgctactcaagttaagtatggactaaatagagtcacctgcactcttcctcgcctctatcagcttgcacaaggtggaactgcggttgggacaggattaaacactaagaaagggtttgatgtaaagatagctgctgcagtagctgaagaaacaaacttgccatttgtcactgcagaaaacaagtttgaagctctggctgcacacgatgcttgtgttgaaaccagtgggtcacttaacacaatcgccacatcgctgatgaagatcgccaatgatatacgttttcttggaagtggcccaagatgtggtcttggtgaacttgtactacctgaaaatgagccaggaagcagtatcatgcctgggaaggtaaatcctacacagtgtgaggccttgactatggtttgtgcacaggttatgggaaaccatgtagctgtgacagttggtgggtcaaatggtcatttcgaattgaatgtattcaagccggtgatcgcgagtgctcttttacattccgtcagattaatagcagatgcttcagcttcgttcgagaaaaactgtgtgaggggcattgaggccaacagagaaagaatctcaaagctattgcacgagtctcttatgcttgtgacatcattgaatccgaaaatcgggtatgacaatgctgcagcagttgccaagaaagctcacaaagaaggatgtacattgaaggaagcggctctgaatttaggcgtgcttactgcggaagagtttgatacacttgttgttcctgagaagatgattggtccctccgattga

SEQ ID NO: 715 - DNA, 1011 bp, Arabidopsis thaliana
atggaggtcgaaagagtccaagacatttcatcttcttctctactaacagaagcaatcccgttggagttcatcagatcagagaaagaacaaccagcgatcacaacattccgaggtccaacgccggcgattcccgtcgtcgatctaagcgatcccgacgaagaaagcgtgaggcgcgcggtggtgaaagcgagtgaagaatgggggctattccaagtggttaaccacgggattccgacggagctgatacgacgtttacaagacgtcggaagaaaattcttcgagcttccttcgtcggagaaagaatccgtcgctaaaccggaagattcgaaagacattgaaggatacggaacaaagcttcagaaagatccagaaggtaaaaaagcttgggtcgatcatctcttccatcgaatctggccaccgtcatgcgtcaattacagattctggcctaagaatccacctgaatacagggaggtgaatgaagagtatgcagtgcatgtgaagaagctatcggagacgttattagggattctctcggatggattagggttaaagcgtgatgcgttgaaagaaggtctcggcggagagatggcggagtatatgatgaagattaactattatccgccgtgtcctcggccggatttagctttaggtgtaccggctcatacagatctcagtggaatcactcttcttgttcctaacgaagttcctggacttcaagttttcaaagatgatcactggttcgatgcagagtatattccctccgccgtcattgttcacatcggcgatcagattctgaggttgagtaatgggaggtataaaaatgtgttgcataggacgacggtggataaagagaagacgaggatgtcgtggccggttttcttggagcctccccgtgaaaagattgttggacctttaccggaactaaccggagatgataatcctccaaagtttaaaccgtttgctttcaaggattacagttaccgcaagctcaataaacttcctctggattga

SEQ ID NO: 716 - DNA, 621 bp, Arabidopsis thaliana
atggcggttggtgaggtcatgaggatggagattcccgccggtggagatttgactgttactactccggagttgcatgttcttgccgtcgatgatagtattgtggatcgtaaagtcatcgagaggttgcttagaatctcttcttgtaaagtgacgactgtagagagtggaactagggctttgcagtatcttggcttagatggaggcaaaggggcttctaatcttaaggatttgaaggtgaatttgatagtgacggattactcaatgccaggactttcaggatatgatctccttaaaaagattaaggaatcttcagcattcagagaagtaccagtagtgattatgtcatctgagaacatcttacctcgtatacaagaatgtctcaaagaaggagcagaggaattcttgttgaaaccggtgaagctagcagatgtaaagcgaatcaaacaacttataatgaggaatgaagctgaggaatgcaaaatcttaagccattctaacaagagaaagcttcaagaagacagtgatacatcatcatcaagtcatgatgatacttctatcaaggactcttcatgttcaaaacgaatgaaatcagaatctgaaaaccttttttctctactttga

SEQ ID NO: 717 - DNA, 2058 bp, Arabidopsis thaliana
atgtcctacgcatctctcagcgtcaaggacctgaccagccttgtttcaagatccggaaccggttcgtcttcttcgctcaagcctccgggtcagacccgccccgtcaaggtcatcccgcttcagcatcctgacacctccaatgaagctcgtcctccttcgattcctttcgacgatatcttctccggatggacggcgaagatcaagcgcatgaggctcgtcgattggattgatactctctttccttgtttccgatggattcgaacttaccgatggagcgagtattttaagctcgatctcatggctggtatcaccgtcggtataatgcttgttccccaggcaatgtcgtatgcgaaactagctggccttccaccaatttacggtctatactcttcatttgtgccggtatttgtctatgccatatttggctcatcccgtcagcttgcaattggacctgtagcattggtttctcttctcgtctctaatgctttgggtggaatcgctgatacgaacgaggaattacatattgaattggccattttgttggcgcttttagttggaatcttggagtgcatcatggggctcttaaggcttggatggcttattcgtttcattagtcactcagtcatatctggatttacaagtgcttcggccattgtgattgggttatctcaaataaaatatttcctggggtatagcattgcccggagcagcaagattgtgccaatagtagagagcataatagctggagctgataagtttcagtggccacctttcgtgatgggatctcttattctggtgattcttcaagtgatgaaacatgtgggaaaagccaaaaaggaacttcagttcttacgagcagcagcgccactcaccgggattgtgctcggtacaaccattgcaaaagtgtttcatccgccttccatctctctggtgggagaaatacctcagggccttccaacattttctttcccaagaagttttgatcatgcaaaaacgttgcttccaacatcagctctcattactggtgttgccatcttggaatctgtgggaattgccaaagcgcttgcggcaaaaaacagatatgagttggattcaaattcagagttgtttggtcttggtgttgcaaatatattggggtcattattttctgcatacccagctacaggatccttttctaggtcagctgtgaataatgaaagtgaagctaagactggcctatcagggcttataacaggaatcatcattggatgttctctactgttcttgacaccgatgtttaaatacataccacagtgtgctttggcagcaatagtgatatctgccgttagtggcttggtggactatgacgaagctattttcctctggcgtgtggacaagagggatttttcgctttggaccatcactagcaccataacattgttcttcggaatagagatcggtgtccttgttggtgttggtttttcactagcattcgttatccacgagtctgcaaaccctcacattgctgtcttggggcggcttccaggcaccactgtgtacagaaacataaagcagtatccagaggcttacacatacaacgggattgtgatagttcgaatcgattctcctatttactttgccaacataagttacatcaaggacagactacgagaatatgaagtagctgttgacaaatacacaaaccggggactggaggtggatagaataaattttgtaatcctggaaatgtctcctgttacacacatagattcgagcgcagtggaagccttgaaagaactgtatcaagagtataaaacaagggatattcagctagcgatatcaaacccgaacaaagatgttcacttgacaatagcaagatcaggaatggtggagctagttggcaaggaatggttctttgtgagagtacacgacgccgtacaggtgtgtctacaatacgtacagagctctaacttggaggacaagcatttaagttttacgagacgatatggtgggagcaacaacaattcatcctcctccaacgcgctgttgaaggagccattgttatcagtggagaaataa

SEQ ID NO: 718 - DNA, 756 bp, Arabidopsis thaliana
atgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagttgaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcaacaagatggaatgggagcaggaccaagtgtgaataattacatgttgggttggttaccttatgacaccaactctatttga

SEQ ID NO: 719 - DNA, 945 bp, Arabidopsis thaliana
atggcggatcaagctatgacggatcaagatcaaggagctgttactctctacagcggcacagccattaccgacgcgaagaaaaaccatccgttctctgttaaggtcggattagctcaggtacttcgtggcggcgccattgttgaagtttcctcggttaaccaagctaagctcgctgaatccgccggcgcatgttctgtaatcgtctcagatccggttcgatctcgcggcggtgttcgtcgtatgccggatccggttctcatcaaagaggtaaaacgagctgtgtctgtacctgtgatggcacgagctcgcgttggtcattttgttgaggctcagatcttggaatctcttgcggttgattacattgacgagagcgagattatctctgttgcggatgatgatcatttcatcaacaaacataatttccgatctccgttcatttgtggttgccgtgatacaggagaagctttgaggagaatcagagaaggtgctgctatgattaggatccaaggagatttaaccgcaacaggtaacattgcagagactgtgaagaacgttaggtcattgatgggtgaagttagagtcttgaacaacatggatgatgatgaggtgttcacgtttgctaagaagatttcagcaccgtatgatcttgtggctcagactaagcagatgggtagggttccggttgttcagtttgcatcaggtgggatcacgactcctgctgatgcagctttgatgatgcagctaggttgtgatggggtttttgtgggttctgaggtttttgatggtcctgatccgtttaagaaacttaggagcattgttcaagctgttcaacattacaatgatcctcatgtgttggctgagatgagttctggattggagaatgcaatggagagcttaaatgttcgtggtgacaggattcaagactttggccaaggcagtgtttga

SEQ ID NO: 720 - DNA, 672 bp, Arabidopsis thaliana
atggaggagttggcgcatccgtacgttccgagagatctgaacctacccggatacgtaccaatctcaatgtcaatgtcctccatcgtctctatctacctcggttcttccctccttgttgtctccctcgtctggcttctcttcgggaggaagaaagctaaacttgataagttgcttatgtgttggtggacattcactggtctcactcatgttattctcgagggctatttcgttttctcccctgagtttttcaaggacaacacttctgcttatcttgctgaagtttggaaagaatatagcaaaggtgattcgagatacgtaggtagagattctgcagttgtatctgttgaagggatcactgctgttatcgttggcccagcttctctcctagctatttatgccattgctaaggagaagtcgtatagctacgtgcttcagcttgcgatttcggtttgccagctctacggatgtttggtttatttcattactgctatcttggaaggagacaactttgccacaaactctttctactattactcctactacatcggggctaactgttggtgggtcttgataccttcactcatttctttccgttgctggaaaaagatttgtgcagctgctgccattgccaacaacaacgtcgagacaaagacgaagaagaaaacccgttga

SEQ ID NO: 721 - DNA, 855 bp, Arabidopsis thaliana
atggcgatcacttacttgcttcctctgtttctttctcttatcatcacctcctctgtttcagctaatttccaaagagacgttgagatcacttggggtgatggtcgtggacagatcaagaacaatggagagcttctcactttatctctagataaatcctctggttctggattccaatccaaaaacgagtacttgtttggtaaagtctccatgcaaatgaagcttgtccctggaaactccgcaggaacagtcacaacactttacttgaaatcacctggaacaacatgggacgagatagatttcgagtttttagggaattcaagtggagaaccttacacacttcacacaaatgtctacacacaaggcaaaggagacaaagaacaacaattcaaactctggtttgatccaacagctaatttccacacttacactattctctggaacccacaaagaatcattttcaccgtcgatggaactccgatcagagaattcaagaacatggagtctctaggcactctgtttcccaagaacaaaccaatgagaatgtactcgagtctttggaacgctgatgattgggcaacgagaggtggtttggtcaaaaccgattggtctaaagctcctttcactgcttcttaccgtggctttcaacaagaagcttgtgtttggtcaaacggcaagtcttcttgtcctaatgcctcgaaacaggggactactactggctcgtggttgtcacaagagcttgactcaacagctcaacaaaggatgagatgggtgcagaggaactacatgatctataattattgtacggatgcgaagaggttccctcaaggtcttcctaaagagtgcttagctgcatag

SEQ ID NO: 722 - DNA, 1491 bp, Arabidopsis thaliana
atggcgtcgacagtctcagttcaaccgggtcggatccggatcctaaagaaaggctcatggcaaccgttggatcaaacggtgggtcccgtcgtttactggatgttcagagatcaacggttgaaagataactgggcgttaatccacgccgttgatctggcaaacagaaccaacgcgccggtggccgtcgttttcaatctgttcgatcaatttctggacgcaaaagcgaggcaattagggtttatgttaaagggtttgcgtcagcttcaccaccaaatcgattctctccaaattccgttttttctcttacagggagatgcaaaggagacaatccctaatttcctcacagaatgtggagcttcacatctggttactgatttctctcctttacgggaaatccggcgttgtaaagatgaggttgtcaagagaacgagtgattcattagcgatacatgaagttgatgctcacaatgtagttccaatgtgggctgcttcgagtaaattggagtacagtgctagaacaattaggggtaagatcaacaagctactacctgattacctcattgagtttcctaaacttgagccgccgaagaagaaatggacggggatgatggataagaagcttgttgattgggatagcctcattgataaagttgtaagggagggtgcagaagttcctgaaattgaatggtgtgtgcctggagaagatgcagggattgaagtattgatggggaataaagatggttttttgacgaagaggttgaagaattattcaactgaccggaataatcctataaagccgaaagcactctctggtctctctccttatctacatttcgggcaggtatcagctcagcgttgtgccttggaggcgcgtaaagtccggagtacttcccctcaggcggtagacacattcttggaagaattgattgtgcgaagagaactctccgacaatttttgctattatcaacctcattatgattctttgaagggagcttgggagtgggcacgcaagtcactaatggatcatgcttcagataagagggaacacatttactcgttggagcagttagagaagggactgacagcagatcctctatggaatgcttcacagttagagatggtttatcaagggaaaatgcacggtttcatgcgaatgtattgggcaaagaagattctagaatggaccaagggacctgaagaggctctctcaatatccatctatctaaataacaagtatgagattgatggtcgtgacccgagtggatatgttgggtgcatgtggtctatatgtggcgttcatgatcagggatggaaagagaggccggtttttgggaagatacggtacatgaactacgcgggttgcaaacggaaattcaatgtggatagttacatctcttatgtcaagagtttggtgtcagtaacaaagaagaagaggaaagctgaagaacagctcaccagagactctgttgatcccaagataactattgtttag

SEQ ID NO: 723 - DNA, 828 bp, Arabidopsis thaliana
atggcatcacacgaccaccatcatcatcatcacgatcatgagcatgaccacgagaaatcagacggcggagaagggaaggcgtcgtgggtggggaaggacgggaaggtgtaccatagccacgatggactcgcacctcactcacacgaacccatctactctcctggctacttcagtcgccgagctcctccgcttcacgaccgtaacttctctgagagagcttttaccgtcggtattggcggtcccgttggcactgggaaaacggcattgatgcttgctctttgtagattcttgagggacaaatatagtcttgctgctgtgacaaatgatatattcacgaaagaggatggtgagtttctggtgaagaatggggctcttcctgaggaaaggattagagctgttgaaacaggtggatgtccacacgctgctatccgtgaagatatcagtatcaatttgggtcctcttgaggagttatctaacttattcaaggctgatttgcttctttgtgaatccggtggagataatttagctgctaatttcagtagagaactagctgactatatcatctacatcatcgatgtatcggctggtgataaaataccccgtaaaggcggccctggaatcactcaagctgatcttctggtgataaacaagactgaccttgcagcagctgttggggctgacttatcggtcatggaaagggattcactacgcatgcgtgatggagggccatttgtctttgctcaggtgaagcatgggcttggagtcgaggaaatcgtgaaccatgtcatgcactcatgggaacatgcgaccgggaagaagcgccagtga

SEQ ID NO: 724 - DNA, 1395 bp, Arabidopsis thaliana
atgatgtccaacggtggtgattcgtcggaaattgtccgggaactggaagagttaaagctcaagaaggcagaaatagagcaccgtatttcgaccctcgaagctaagctccaggatacggcggcagttgaactgtacgacgccgtatccaacggtgactcttatctgacggcaccggagcttgaacatgggttatctccagatcagatttaccgttatagtcgtcaactgttacttccttcgtttgctgttgaagggcagtcaaatcttttgaagtcttcggtattagttattggagcaggaggactaggttcacctgccttattgtatcttgcagcatgtggtgttggtcagttgggtattatcgatcatgatgttgtagagctcaacaatatgcataggcagattatacacacagaagcatttattggacatcccaaagtgaaatctgctgctgctgcttgtcgctcgataaattcaacgatcaaagttgatgaatatgtggaagctcttcgcacttccaatgctttggaaatcctcagccaatatgatatcatagtcgatgcgactgataatcctccaagccgttacatgatcagtgattgttgtgtcttgttaggaaagcctttggtgtcgggtgctgcgcttggtatggaagggcagcttacggtttataatcataacggaggcccgtgttaccggtgtctttttcccactcctccacctacctcagcgtgccaaagatgttctgatagtggagttcttggagtagtgccaggtgttattggttgtctacaagcgctagagacaattaaactcgcaagcctggtgggagaaccactctctgaacggatgcttctttttgatgctttatcagcaaggatgcgcattgtcaagatcagaggcaggtcatcacagtgcaccgtgtgtggagacaattcatctttcaataagcaaacttttaaagattttgactatgaggacttcactcaatttcctttatttgcgggcccattgaacctgcttcctgcagaatcaagaattagcagcaaggagttcaaagaaattcttcaaaagaaggaacaacatgttctgctcgatgttcgaccttcacatcactataagattgtctctctcccggattcactcaacatccctcttgcaaacttagagactcggttaaacgagcttacttcagctcttaaagaaaagggaaatggccatgcgaacactgaatcttgcacaaatcctagtgtcttcgttgtatgcagacgcgggaatgattcacaaagagctgttcaatatcttcgtgagtcgggttttgattcggctaaggatataattggaggactggaagcttgggcagccaatgtcaaccccaacttccccacctactag

SEQ ID NO: 725 - DNA, 2487 bp, Arabidopsis thaliana
atggttccatcggagatagaatctctaggagacgaatctgatcgtcgtttcgccaatctgagaggtctgcgatggcgcgtgaatctcggtgttcttccgtttcagtcttcttccatcgatgatcttcgtaaagctacagctgaatctcgcagaagatatgctgctttaagaagacggctcttgattgatccacatttgtctaaagatgttcgaaattcccctgatctctctatcgacaatcccttatcacaaaaccctgatagtacatggggtcggttcttccgtaacgcagagctagagaaaacattggatcaagacttgtctaggttatatccagagcattggagttactttcaagctcctggatgtcaaggcatgttaaggcgtattctactcttgtggtgccttaaacatcccgagtacggttatcgacaagggatgcatgagcttttggcgccactgctttatgtacttcatgttgatgttgatcgtctctctgaagtgcgtaaaagttatgaagatcatttcatagacagattcgatggtttatcttttgaagaaagagatattacttacaactttgaattcaaaaagtttctggaggatttcacggatgatgagattggtggtattcaggggaattcaaagaaaataaagagtctagatgagctcgatcccgaaatccagtctattgtgaggttaagtgatgcttatggagctgaaggtgaactcgggattgtcttgtccgagaaattcatggagcatgatgcttactgcatgtttgatgctctaatgaatggagttcatggttgtgttgcaatggctggattttttgcttactctccagctagcggatcccacacgggtttacctcccgttcttgaagcttccactgcgttttaccatcttttatcattcgttgattcgtctctccatagtcatttagtagaactcggagttgaacctcagtactttgggcttcgctggttacgagttttgtttggaagagagtttttgcttcaggatttattgatagtgtgggatgagatattctcagcagataacacgacgagaacagatgcggataacaatacaaaccagagctacaagatctttgattctcctcggggagctctaatctcgggaatggcagtttcgatgatattatgtttaagatcatcattgcttgctactgaaaacgcagcttcttgtctccagagactattgaatttcccagagaagattgatgtgaggaagataatagagaaagctaagtcattacaaactttggctttggatgatgatgtacgatcatcagctctatcgataaatgatggctttgatcagagcatcagtccagcagtaccggcgagaactaacagttttccttccggatccacatctcctaaatctccattgataattaccccacaaagttattgggaggatcaatggagagttctacacaaagccgccgaggaagagaaaaagagtccttctccaatacagaagaaaaagccttggttcagggtgaaaagacttttcagagcagagtctgagccaactcatagcgccaagtcaccaaatgggaaaagtgaagtcaagatatcatcagttgcgcgaaacttgcttgaagattttaatcggcagcttgtttctgaacctgtggaagctaatccaatagatgttgtgaacaatgaagatagctcaattcgagaaaccgaggatataaacacggattttgaaactgctgctgaagagagtatagtaatggaggagaattcttctgatcttttctcagatccaaacagtcctctcagagactcaaactacattgagaatgattcggatagcagtaacgagtcaaatctatttcctgatgaaacagttaaagatcgagaaacaagcgtagtagattcgcctctttccatttcttctcaaccgagcatggagtttatagtatctctgtctaaagatcaagaaacaagcgtagtagattctcctcttcccgtttcttctcaaccgagcatcgagtttccagtaactcagtctaatgatgaagacaacgctgcagataaatctgtggccaatatcaaggagcgtagtaaggttttaccaggaaaattccagtggttttggaagtttggacgcaatgtcactgctgaggagacgagatgtaatggagtcgaaagtagtaagagcgatttagtttgctcttctgagtcacattctcttccacaggcttcatcttcgggcagcaaaggagacacagaccagaatgtgatgaatactctgaaaaaccttggcaattcgatgctcgaacacattcaggtgatagagtcagttttccagcaagaacgaggtcaggttcaggcaggactaattgagaatttatctaagaacaatttggtcgaaaagggacaagtcacagccatgactgctctgaaggagcttcgaaaaattagtaatcttttgttggaaatgtga

SEQ ID NO: 726 - DNA, 849 bp, Arabidopsis thaliana
atggcggagaaaaatgcgagcgcggtggacggtgcaattagggttagtggaatgcagttttcttacgatgttcaagatcctattttcttcgattttaatctcgatcttcccgctggatctcgttgcctcttggttggtgccaatggatctgggaaaactacgttattgaagattcttgctggaaaacatatggttggaggaaagaatgttgtacaagtgcttgatcgctcagcatttcatgatacagagcttgtttgtagtggtgatttgtcttacctaggaggatcatggagtaaaactgctggttctgctggtgatattccactccaaggagacttctcagcagaacatatgatatttggagttgaagggattgatcctttcagaagagagaagttgattgatcttcttgatatcaatcttcaatggcgtatgcataaggtttctgatgggcagagacgtcgagtgcaaatatgtatgggtctattacatccgttcaaggtattactactggatgaagttactgttgacctcgacgttgttgctaggatggatttgttggagttctttaaagaagaatgtgaacagagaggagctacaattgtatatgcaactcatattttcgacgggctcgagacatgggctagtcatttggcttacattaatggaggagagctgaaactctcggccaagttagatgagatcaaggatctcaaaacctcaccaaatctgctatctgttgttgaagcttggctccggtctgaaaccaaagttgagaaaaagacgaagaagaaacctgttgttacctctccatttatgtcgtctagacaaatggcatattaccgatga

SEQ ID NO: 727 - DNA, 555 bp, Arabidopsis thaliana
atgccttcaaattcaggagatgataatgttcttcaagttctcataaagaactttgatgtccttgctctcccattggttacactcgtctatcctctatatgcatcagtgaaagcaatagagacaagatcattaccagaagatgaacaatggcttacttactgggttctttacgcacttatctctctctttgaactcactttctccaaacctctcgagtggtttcctatatggccatacatgaagttgtttgggatctgttggttagtgttaccacaattcaatggagcagaacatatctacaaacatttcattagaccattctacagagatcctcaaagagctaccaccaaaatttggtatgttcctcacaagaaattcaatttcttccctaaacgcgacgacgacgacattctcactgctgctgaaaaatacatggaacaacacggtaccgaagcgtttgagcgaatgatcgttaagaaggatagttatgaaagaggtaggagtagtagaggaatcaataatcacatgatctttgatgatgactataggtactaa

SEQ ID NO: 728 - DNA, 264 bp, Arabidopsis thaliana
atggattcatactcttcgccgccgatgggaggttcaggtagttcggtttcgcccgaagtaatgatggagtcggtcaagactcagctcgctcaagcttacgccgaagagttaatcgagactttgaggacaaaatgttttgacaagtgcgtaacgaagccaggatcaagcctcggtggaagtgagagtagctgtatttcgagatgtgttgaacgttacatggaagctactgcaatcataagtcgttctcttttcactcaacgttga

SEQ ID NO: 729 - DNA, 1269 bp, Arabidopsis thaliana
atgtcttcttctgtagcagtgttatgggttgctacttcttctctaaatccagacccaatgaacaattgtgggttggtaagggttctagaatcttctagactgttctctccttgtcagaatcagagactaaacaaaggtaagaagaagcagataccaacttggagttcttcttttgtaaggaaccgaagtagaagaattggtgttgtgtcttcaagcttagtagcaagtccttctggagagatagctctttcatctgaagagaaggtttacaatgttgtgttgaaacaagctgctttggtgaacaaacagctaaggtcttcttcttatgaccttgatgtgaagaaaccacaagatgttgttcttcctgggagtttgagtttgttgggtgaagcttatgatcgatgcggtgaagtttgcgctgaatatgctaagacgttttatcttggaactttgcttatgacacccgaaaggcgaaaggcgatttgggcaatctacgtttggtgtagaagaactgatgaacttgtggatgggccaaatgcttcacatataactcccatggctttagatagatgggaagcaaggttagaagatcttttccgtggtcgtcctttcgatatgcttgatgctgctctcgctgatacagttgctagatacccggtcgatattcagccatttcgagacatgatcgaaggaatgagaatggacttgaagaaatcgagataccagaacttcgatgatctatacctttactgctactacgtcgctggaaccgtcggattgatgagcgttccggttatgggaatcgatcctaagtcgaaagcaacaaccgaaagtgtttacaacgctgccttggcccttggtatagccaatcagcttactaacatactcagagacgtaggcgaagatgcgagaagaggaagggtttatctgcctcaggatgaattggctcaggctggtctttcagatgaagacatattcgccggaaaagtaactgataaatggagaaacttcatgaaaatgcagcttaaacgagcaagaatgttcttcgacgaagctgagaaaggcgtcaccgagctcagtgccgctagcagatggcctgtatgggcttcattgctattgtacaggagaatactggacgagattgaagcgaatgattacaacaattttactaagagagcttatgtggggaaagtcaagaaaattgcagctttgccattggcttatgctaaatcagtactaaagacttcaagttcaagactatcgatatga

SEQ ID NO: 730 - DNA, 1404 bp, Arabidopsis thaliana
atgcaaagcagtgtgtatcgtgataaagctagctcgatcgcgatgatcttagaaactcagaggaatgttgaattccctcatcggatcgttgataagcgtcccaggaaacgtccccgattgacttgggatgctgctccgcctcttcttcctcctcctcctccacccacggtatttcaacctccgttgtactatggtccggagtttgcgagtggtttagttcccaattttgtttacccaaacatgttctataatggccttcctcgtcagggctctcctccctggagaccagatgataaagacggccattatgtctttgttgttggggatactttgactccacgatatcaaattctcagcaaaatgggtgaaggtacatttggacaagtattggaatgctttgataataaaaacaaagaagtcgtggcaatcaaagttatacggtccataaacaagtatcgtgaagctgccatgatcgaaattgacgtgctgcagaggcttacaaggcatgatgtcggtggttctcgttgtgtgcaaatacggaattggtttgactatcgtaatcatatttgtattgtatttgagaagcttggaccaagcttatatgattttctccgcaaaaacagctaccgttcatttcccattgatcttgttcgggagcttggcagacaacttttggagtctgttgcatatatgcatgatttacggctgatccacacggatttgaagccggagaacattcttttggtatcgtctgaatatatcaaaatacctgattataagtttctatcccgacccacaaaagatgggtcatacttcaagaatctgcccaagtcaagtgccatcaagctcattgatttcggaagtacaacatttgaacatcaagaccataactacattgtatccacaagacattaccgcgcaccagaagttatcctaggggttggatggaactatccatgtgatctgtggagtattggttgcatacttgttgaactttgttcgggagaggcgcttttccaaacgcatgaaaacttggaacatttggccatgatggaaagggtcctaggacctttaccacctcatatggtgctcagagccgaccggcgctctgagaaatacttcagacgaggtgcgaagttagactggcctgaaggtgcgacatcaagagacagcttaaaagcagtatggaaacttccccggctaccgaacctgataatgcagcatgtggatcactcagccggtgatctgatagacctattacaaggtctgcttcgatatgatccaacagagaggttcaaggcaagagaagcactgaaccatcccttcttcacaagaagccgggaacagagtataccacccttcaacccaaaccctcatccatttttatacaaccaaaagaactaa

SEQ ID NO: 731 - DNA, 1116 bp, Arabidopsis thaliana
atgagtttgatttccaaatccttggcaagaattgaatgttcgccatttttttatccaagagcttcagaaatcactaccggaaaacggataacctctccgcaaatccgtttatacactgcggcggccgtcggcgggaaaactggaaatggagaaaggaaacaaagagccaaagcaccggcgaaaactccggaggcagtgacacctgtgaaaccgctggagattgcgtcagtcacggcgacgacggagaatgaattgcctcggcctaatgagatagcttacgagagtgaagtagcgaattgggttaatctgattggatttgttgatcaaccagttcaattcgaagcttcttctgatggcaaattctgggctggtactgttatttcccagaggtctgcttcagattcctctggtttctggattccgataatatttgaaggcgatttagctaaaaccgcagctcgatatgtaagcaaagacgatcaaattcatgtgtctgggaagctgtttatagattctcctcctccaaatatgacttatgcacaagccaatgttcaggtattggtccagaatcttaactttatacagcctatgtccccgtctccgtcgccatttatggttatgtcatcatctgaaaaggaagaaagtggtatcaagaagcagcctgctagagctaagcaggatatagtcattgatgaagcttcagattcttggaatcacctcattgaaaatcctaaagaatggtgggatcaccgggaaaataaagtcaatggattggtaaaacctaggcatcctgatttcaaaagcaaggacagtagtttttcgctgtggctcaataaggctcctaattgggttttgccaaaactcgaaggactcgagttcgatgttctagtccctaaagccagagttgtaaaacaacttaaaggagaagaatcatggaaggacttggttcagaacccagataaatggtgggacaatagaatcgacaagagaaatgcaaaagcccctgatttcaagcacaaggagacaggtgaagcactgtggctaaacgagtctcctacttgggtattaccgaaactgccaccagtcaagaagaaacaagaaagtattgtcttttag

SEQ ID NO: 732 - DNA, 1935 bp, Arabidopsis thaliana
atgggttgcataatctctaagaagaagtctccaaagaggaatccaccatggaaagaaacattagagaagcgttcttcaaggatcaattcgtcgaggattgatgattctagccaaactaaagaggaacaagataggtcgaataaagttaggttgattgaatctgaaaagtttagttcaagtaggttttctgagaaacatcaggagattgctgagattggtgatactgatgaagatgaagatgatgatcatcatccacctgaggagttgaagagagagcctagtgttgtgattcctccaagtcctgaaaccgtttcaaaggaggctgaattggctgctggatggcctgcttggctagtctcagtggctggtgaggcacttgtgaattggactccacgacgtgctagtacctttgagaaattggagaaaattggccaaggtacatatagcagtgtatacaaggctcgtgatcttactaataacaagattgttgcactcaaaagagtccggtttgatcttagcgatttagagagtgttaagtttatggcgagagagattattgtaatgagaaggcttgatcatcctaatgtacttaagttagaagggttgatcactgcctctgtttcatcttctctgtacttggtttttgagtatatggatcatgatctcgtcggacttgcttccatacctggtatcaagttttcagagcctcaggttaaatgttatatgcaacaacttctaagcgggcttcatcattgtcacagtcgtggtgttctgcatcgtgatataaagggctctaatctactgattgatagtaatggagtcttgaagattgcagattttgggttagcaacgtttttcgatccacagaactgcgttccattaactagccgtgttgtgactctttggtatcgacccccagagcttctacttggagcttgtcattatggtgttggggttgatttgtggagcacaggctgtatcttaggtgaactatattccgggaaaccaatcctggccgggaaaaccgaggtagagcaactgcataaaatcttcaagctatgtggttcaccgacagaagattactggaggaaactaaagctaccaccttcagctgcatttagacccgctcttccatatggaagacgtgtagcagagatgtttaaagacttgccaacgaatgttctttcccttttggaggctttactctccatagatcccgatcggagaggctctgcagctagagctcttgagagtgagtatttcagaacagagccgtttgcttgtgatccatcttctctaccaaaatatcctcccagcaaagagattgatgccaaaatccgcgatgatgcgaaaaggcaacgacccacccaggagaagcatgagagacaagactctcagacaagacgatcacacgaaagaaaactgatcccgccggtaaaagctaataatccatcactttcaacagctgtggagaatccttatctaagaagctgtgttccgggtaattcacaaagacaaatgcaggacatgacctgcaacaatccaacaagcggaagagtctctcactcaggtccgatgatgaaaaaccggaatcttagtcggttaacatacgtgaaggacaatgcagcccctagaataccttcatatagggctaactcagcaggacaaggaggcggttatgttgggtcagatcaacaaatgatggatcagcaaaggaaggaattgagaacattcaacagagctgacactatggataatagtaaaagacaaaccaaaatcccaaatgacccatcttggtatgattcaggggataacaagatgtacatgtccggtccattactggctcagccaagaaaagtggatcagatgctggaagaacacgaccggcagctccaagatttcaccagacagaaagcaaaacactgcagaaactaa

SEQ ID NO: 733 - DNA, 1212 bp, Arabidopsis thaliana
atggcgtctctgcaactctgcgacggttatcttctcttcaagccctctgtttctcctcgattcctctctcaacgcatttctcatcgcctaatccctaaagcctcatcttctcctcctccatctccatcaccatcatcgtcctcttcatccttatctttcagtcggcgggagcttctgtaccaatcggcagctgtatcactctcgctttcttccattgttggaccagcgagagctgatgaacagttatccgaatgggaaagagtgtttctcccaatcgatcccggtgttgttcttctcgacattgctttcgtccccgacgaacctagccgagggtttttacttggaacgagacagactttgttagagactaaagatggtggaagcacttggaatccacgttcgattccttcagctgaagaagaagatttcaattatagattcaattcgattagctttaaaggcaaagaaggatggattattggcaaacctgcgattttattgtacactgctgatgctggagagaattgggataggattcctctaagttctcagcttcctggagatatggtgtttataaaagcgacagaagataagagtgcagagatggttactgatgaaggtgctatttatgttacttcaaacaggggatataactggaaagctgctattcaggaaactgtttcagctaccttgaacagaacagtatccagtggaatcagtggtgctagttactacacgggaactttcagtgctgttaatcgttcacctgatggaagatatgtcgctgtttcgagccgtggtaacttctttctgacatgggagcctgggcagccttactggcaaccacacaatagagctgttgctagaagaattcagaacatgggatggagagctgatggtggtctttggcttcttgttcgtggtggaggactttatcttagcaaaggtactgggattacagaggagtttgaagaagttccagtacaaagccgtggctttggcattctagatgttggatatcgctcagaggaagaagcatgggcagcaggaggcagtggcatactactgagaacaagaaatggaggcaaatcatggaaccgtgacaaagctgctgataatatcgcagctaacctatacgcagtcaaatttgtggatgacaagaaaggatttgtgcttggcaacgatggagtcttgctccgatatgttggctga

SEQ ID NO: 734 - DNA, 1203 bp, Arabidopsis thaliana
atgttcaaagaagaagaaataagctacaacaaccaaaaaatgatcaagctttgcttcatgacttctcatggttattcaatccctggccttggtcttcctcaagacctctgcaacaccgaaatcatcaagaatagccggtctcatctggtgaatcccggagcaagacaagagatcatacctgcaagctccttcaatctgaatacagaactcttggaaccatggaaaccggtttcttcatttagccaattcgtggagattgattcagccatgatgaaacctctgctcatggatgttcatgagacggcaccagaatctctgattttgagctttggaatcgctgataagtttgcaagacaagaaaaggtgatggagtttcttctgtctcagtcagaggagttcaaggaaaaaggattcgatatgtcgctgttaaatgaattgatggagtttgagtctatgaaatccagttctcagctacgaccgtatgatacttcctctgttctttacttgaatcaagaattagggaaaccggttttggatctcgttagggatatgatggagaatccagagttctctgtgcgatcgaatgttcaatttgtcaaggaattcaacaacaaaatggagacagctctcaccgcttatcccacactttcagagtgttctcatattcgtattctttttttcattcgaacaagtcctgagaaaagcaggctcaagtcaccaaggaaacacaacacgaagcgaaaagctaaagagagggacctatacaaaagaaatcatctccacgcttacgagagccttctctctttaatgataggcaatgatcatcgacacaaacacacaacagtactctctttacagaaatcatgtggagagctctcagagcttctgactcagttctctatcactgctgctggaactggaatcgctgtgctcttttctgtcgtatgtagccttgcttcaaggcgtgtacccttttgcgcaaataagttcttcgacactgggcttggtttgagtttggtaatactgtcatgggctgtgaatagactcagggaggtgattgttcatgtcaataggaaagcgaacaagccatgttcaagtttgaaagatgacgaaatcataaacagtgtggagagaagtatgaaggaggtttactacagagctgcaacggtaatcgcggtgtttgcgcttaggtttgcatgttga

SEQ ID NO: 735 - DNA, 984 bp, Arabidopsis thaliana
atgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagttgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggataatagccaatggaaacgaaaataggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttga

SEQ ID NO: 736 - DNA, 1143 bp, Arabidopsis thaliana
atgttgcgagctttagcacggcctctcgaacggtgtttgggaagcagagctagtggtgatggtttactctggcaatcggaattgagacctcacgctggcggtgattattcgatcgcggtggttcaagccaattccaggcttgaagatcagagtcaggttttcacatcttcttctgctacttacgtcggtgtatacgatggtcatggtggacctgaagcttctagattcgttaacagacatctctttccttatatgcacaaatttgcaagagaacatgggggattatctgtagatgttatcaaaaaggcattcaaagaaacagaagaagagttttgtggtatggttaaacgatcccttcccatgaaaccgcaaatggctactgtaggatcttgctgtcttgttggtgcaatctctaatgacacactgtatgttgctaatcttggggactcgagagccgttcttggaagcgttgtttcaggggttgatagtaataaaggtgccgtagctgaacggttatctactgatcataatgttgctgttgaagaagtgagaaaggaggttaaggcacttaaccctgatgactcacaaatcgtcttatacacacgtggagtttggcggattaaaggcattattcaggtatcgagatcaattggggatgtatacttgaaaaaaccggagtattacagggacccgattttccagcgacatggaaatcccattcctttgaggagacccgcgatgacagccgaaccctccattatagtaaggaagcttaagccacaggacttgtttctgatatttgcatcagatggtctctgggaacatcttagtgatgaaacagccgtagaaatcgtcctcaaacacccaagaactggtattgcccgaagacttgtaagagctgctctggaagaagcggcaaagaagagagaaatgagatatggagatataaagaaaatagccaaaggaattcgacgacatttccatgacgacataagcgttattgtagtttatctagatcaaaacaaaaccagttcatcgaatagtaaattggtgaagcaaggaggtatcaccgctccaccggatatctactcattacactctgatgaagcagagcaacgacggttactcaatgtgttatactga

SEQ ID NO: 737 - DNA, 1005 bp, Arabidopsis thaliana
atgagatcgtcttgttgctcctctgcgattggtgggttcttcgaccatcgacgtgaattatcaacctcaacacccatttccactcttcttcctcttccatcaaccaaatcttctttctctgttcgttgttctcttcctcagccatcaaagccacgctctggaaccagctctgttcacgccgttatgacactcgctggatcgttgacagggaagaaacgagtggatgagagtgagagtttgactcttgaaggtattagaaactctttgatccgtcaagaggacagcattatatttgggctattggagagagccaagtactgttacaatgctgatacttatgatcctactgcttttgacatggatggtttcaatggttctttggttgagtacatggttaaaggcactgagaagcttcacgctaaggttggtaggtttaagagtcctgatgaacatcctttcttccctgatgatctaccagagcctatgttgcctcctcttcagtacccaaaggtgttgcattttgctgctgattcgataaacataaacaagaagatatggaacatgtacttcagagaccttgttccaagacttgtgaagaaaggcgatgatggtaactacggctcaacagctgtctgtgacgctatctgccttcagtgtctctcaaagagaatccattacggtaaatttgttgcagaagctaaatttcaagcctcacccgaagcatacgagtccgccatcaaagcacaagataaggatgcactgatggatatgctgacattcccgactgtggaagatgcgataaagaagagagttgagatgaaaacccgaacatacgggcaagaagtgaaagttgggatggaggagaaagaagaagaagaagaagaagggaatgaatctcatgtttacaaaatcagtccgatcttagttggtgacttatatggagattggatcatgcctttaacaaaagaggttcaagtggagtacttgctcagaagactggactga

SEQ ID NO: 738 - DNA, 2232 bp, Arabidopsis thaliana
atgagatcgatgagatctgggagagacaacaacatctgcttcctgggttttctctcctttgcccttatctcccttccctccttgtcacttgctcttaccaatcctgacgatgttgcggctattaacagtctcttccttgcactggagtctcctcttctccccggttgggttgcatctggaggtgacccatgtggtgagagctggcaaggtgttctatgtaatgcttcccaagtagaaacaataattctcatcagtgccaatcttggaggagagcttggtgttggcttaaacatgtttacctctcttaaagcaatggattttagcaacaatcacattggaggaagtatcccatccacgttgcctgtttcattgcagaacttgtttctttcaggtaacaactttacaggaaccatcccagaatctctttcctccttaaaatctttgtctgtcatgtccttgaacaataaccttttgtctggcaagatacccgatgtctttcaagaccttggccttatgatcaatatagatttgtctagcaacaatctgagtggaccattacctccttccatgcagaatctttcgactcttacatccttgcttttgcagaacaatcatctttcaggagagcttgatgttcttcaagatcttcccctcaaggacttgaacgttgagaacaacctcttcaatggacctataccagaaaagttgttgagtataccaaatttcataaaaggcggtaatctgtttaacgtcactattgctccatcgccttcacctgaaacacctccaagtccaacatcacctaagcggccattttttggaccaccatctcccaatgcatcagctggtcatggtcaggcacacgtgagatcacccccttctgatcatcacccatcccgaccaactcctcaagggaaagaagactcatttaccagtaaaagaattatttggatatccattcttggggctttttcatttgtggttttggccttgatttcaagaaagtcacatgtttgttttctcttcttcaatgaaattcaaacaaaagacaaggaggctagaccaaaagagagagtaggaggtgcttcgaagctgcatggtggggcagaaagaagcgtaggaagtgaatcaaagcaggagagtcatgagatagacatgaatggcaatgctatggatttgatgcatccctcatcaattccacctatcaaaagggtcatcgcaaaggcgactgaacctgctgaagcatctctaaaaaggacaaccagtaaatcccatggtcccttgacagctgtgaagcatttcacggtcgcatctctacaacaacacacaaatagcttttcccacgaaaaccttattggaacaggcatgcttgggagtgtctacagggcagagcttccaggtggaaagctcttcgctgtgaggaagttggataagaagtctcccaatcatgaagaagaaggcaaatttttggagctagtgaataatatagatagaatacggcatgccaatattgtccaactcgtgggtttctgttctgagcacagtcaaaggcttctgatccatgagtattgtaggaacggtacactgcacgatttgctgcatattgatgacaggttgaagattgaactatcatggaatgtccgtgttaggattgcactagaagctgcaaaagctctggagtatctgcatgagatctgtgatccacctagtatccaccgaaatttcaagtctgcaaatattctccttgatgacgatataagggtgcatgtctcagactgcggcttggctcctctaatctcctcaggtgccgtaagtcagttatcgggtcaactcttagcggcctacggatatggagctccagagtttgaatatgggatctatacaatgaaatgtgatgtctacagttttggagtagttatgttagaactcttgacaggtcgcaagtcatatgacaagaaacgggatagaggagagcaatttctggtgagatgggcaatcccacagcttcacgacattgatgcattagcgaagatggtcgacccatccctcaagggtgactatccagccaagtcgctgtcacactttgctgatgtgatatcacgttgtgttcagtcggaaccagagtacaggccactaatgtcagaagtggttcaagacctctcagacatgatccagagagaacatcggagaaatgactcaaatggggataatcagtatacgggaagaagatag

SEQ ID NO: 739 - DNA, 1158 bp, Arabidopsis thaliana
atgttggtgtccgcaagggtagagaaacaaaagcgtgttgcttatcaggggaaggcgacagtgcttgctctcggtaaggccttgccgagcaatgttgtttcccaggagaatctcgtggaggagtatctccgtgaaatcaaatgcgataacctttctatcaaagacaagctgcaacacttgtgcaaaagcacaactgtcaagacacgctacacagtcatgtcacgggagacgctgcacaaataccctgaactagcaaccgagggttccccaaccatcaaacagaggcttgagattgcaaacgatgcggttgtgcagatggcatatgaagcgagcttggtttgcatcaaggaatggggaagggcagtggaagatatcactcatcttgtctacgtttcctccagtgagttccgtttgcccggaggtgatctttacctctcggcacagctgggccttagcaacgaggttcagagagtgatgctgtattttcttggatgctatggaggtttgagtgggctgcgcgtggccaaagacattgctgagaacaacccagggagccgtgtgttgctcaccacctctgagactaccgttctggggttccgcccacccaacaaagctcgtccttacaacttagtcggggctgcactctttggagatggagcagctgccctgatcatcggagcagaccctacagagtcggaatctcctttcatggagcttcactgtgctatgcagcagttcctgccccaaacacagggggtgatcgacgggcggctgtcagaagagggcataaccttcaagctaggaagagacctccctcagaagatcgaagacaacgtggaggagttctgcaagaagctagtggcaaaggctggctctggtgcgttggagttgaatgaccttttctgggcagttcatcctggtggaccagccatcctgagcgggctggagacaaagctgaagctgaagccggaaaagctggaatgcagcagaagggcgttgatggattatgggaacgtaagcagcaacaccatcttctacataatggacaaagtcagagatgagcttgagaagaaaggcacagagggagaagagtggggtctgggcttagctttcggaccgggaatcactttcgaaggctttctcatgaggaacctctaa

SEQ ID NO: 740 - DNA, 1317 bp, Arabidopsis thaliana
atgttacgagaatcagacggtgagatgagtttaggaacaacaaactcaccgataagcagcggaacagagagttgcagcagtttcagccggttatcattcgacgcgccgccgtcaactatccccgaagaagaaagcttcctttctctcaaacctcaccgatcctcagatttcgcttacgcagagatccgaagacgaaaaaaacaaggcctaaccttccgagattttcgcctcatgcgtcgtatcggcgccggcgacatcggaacagtttacttatgccgtctagccggagacgaagaagagagccggagctcgtattttgcgatgaaagttgtggataaagaagctcttgcgttgaagaagaagatgcatagagcagagatggagaaaacgattttgaaaatgcttgaccatccatttttgccgactctttacgctgagtttgaagcctcacatttctcttgcatcgttatggaatattgctccggtggtgatttacactctctccgtcatagacaacctcaccggcgattctccctctcttccgccagattttatgccgccgaagttctagtggcgttagaatatctacacatgttgggtatcatctacagagatctgaagcctgaaaatatcttagttagatccgacggtcacattatgctctctgactttgacctctctctatgctccgactcaatcgcagccgttgaatcttcctcgtcttcgccggagaatcaacaactccgttcaccgcgacgattcactcgtctcgctagacttttccaacgagtcttgcggtctaaaaaggttcagactttagaaccaacccgtctctttgttgctgaaccggttactgcccggtccggttcgttcgttggtacgcatgaatacgtggcaccagaagttgcttcaggtggatcacatggtaatgccgttgactggtgggcctttggagtgtttctctacgagatgatatatggcaagactccgttcgttgcgccgactaatgacgtcattctccgtaacattgtgaaaagacagttgagtttcccgactgattcgccggcgactatgtttgagcttcatgcgcggaatttgatttccgggttgcttaacaaagatccgactaaaagacttgggtcacggcgaggtgcggcggaggttaaagtgcatccttttttcaaaggtctaaactttgcgctcattcgtacgcttactccgccggagattccttcttccgtcgtcaagaagccgatgaaatcggcgacgtttagtggtagaagtagtaacaaaccagcggcgttcgattacttttga

SEQ ID NO: 741 - DNA, 1299 bp, Arabidopsis thaliana
atggattcacagctagtcttgtctctgaagctgaatccaagcttcactcctctttctcctctcttccctttcactccatgttcttctttttcgccgtcgctccggttttcttcttgctactcccgccgcctctattctccggttaccgtctacgccgcgaagaaactctcccacaaaatcagttctgaattcgatgacagaatcaacggcgctctctctcccgacgctgattcccgcttcctcgaccgccaaaaggctttagaggcagctatgaatgacattaacagttcatttggtaaaggaagtgtaacaagattggggagtgctggtggagcattagtggagaccttttcgagtggtattttgactcttgatcttgctttaggtggaggcctaccaaagggtcgggtagtcgaaatatatggaccagaaagtagtggcaagaccacgctagcactccatgctattgctgaagtgcagaagcttggaggcaatgcaatgcttgttgatgcagagcatgcctttgatccagcgtattctaaagcattaggtgttgatgtagaaaatttgatagtgtgccagccagataatggcgagatggctttagaaaaccgtatgtgtcgctcaggtgcggttgaccttatatgtgttgattctgtttcagcacttactccacgagctgagattgaaggtgagattggaatgcagcaaatgggtttgcaagctcgtcttatgagtcaagctcttcgtaaaatgtcaggaaacgcctctaaagctggtgttttctcttatgctattaagattggtgtgtactatgggaatccagaggtgactagcggaggaattgcgttaaagttcttcgcgtcggtccgtctagaaattcgttctgctgggaagatcaaatctagcaaaggggatgaagatattggtcttcgggctcgtgtaagagtgcagaagagcaaggtttcaagaccgtataagcaagcagagtttgagattatgtttggggaaggagtcagtaaactgggatgcgttcttgattgtgctgaaattatggaagttgtggtcaagaaaggttcctggtacagctacgaagaccaaaggctcgggcaaggaagagagaaagcactgcagcacttaagggaaaaccctgctcttcaagacgaaattgagaagaaagtgagattgttgatgttagatggagaagttcatcgatcaactcctttgatgagcagcagctcttcctcggcttcacatcgcgaagaagaagaagaagactcgcttgacgatttccaatga

SEQ ID NO: 742 - DNA, 1047 bp, Arabidopsis thaliana
atggcgtcaactatcatcttcattctaactatttttttaagttacagaacttcgctagctacatctcgtggtagcctttttgaagcttctgccattgagaaacatgagcaatggatggctcgattcaatcgcgtttactctgacgaaaccgagaaaagaaatcggtttaatatcttcaagaagaatttggagttcgtccagaacttcaacatgaataataaaatcacgtacaaggttgatatcaacgagttctctgatcttacggacgaagaatttcgggcgacacacactggactagttgtgcccgaggctataaccagaatttcaactctgtcttcgggcaaaaacacggtgccgtttagatatggtaatgttagtgataatggcgagagcatggattggagacaagagggggctgttacacccgttaagtatcaaggccgatgtggaggatgctgggcgttttccgcggtggcggcagtggaaggcattacaaagattactaaaggcgagcttgtatcgctatcggagcaacaactcttagactgcgacagagactacaatcaaggatgtcgtggagggataatgtcgaaagctttcgagtacataatcaaaaaccaaggcatcactactgaggataactatccataccaagaatcacaacaaacttgtagttcatcaactaccctatcatcgtcttttcgtgcagccacaatcagcggatatgagaccgttccaatgaataatgaggaagcgttgctacaagcagtgtctcaacagcctgtttctgtggggatagaagggacaggggccgcgtttaggcactactcgggaggggtattcaacggagaatgtgggacggatttgcatcatgcggttacaattgttggttatggaatgagtgaagaagggactaagtattgggtggtgaagaattcttggggggaaacttggggagaaaatggttacatgaggatcaagagagacgtggatgcaccccaaggaatgtgtggtttggccattcttgctttctatccacttgcttga

SEQ ID NO: 743 - DNA, 342 bp, Arabidopsis thaliana
atgacaactccagcagtgaagaccggtttgttcgttggattgaacaaaggacacgtcgtcaccagacgtgagctagctcctcgtcccaattctcgcaaagggaaaacgagcaagaggaccatattcataagaaaactgattagggaagtagctggaatggctccttatgagaagagaatcactgagcttctcaaggttgggaaagacaagcgtgctcttaaggttgctaagaggaagttgggtactcacaagagagctaagaggaagagagaggagatgtctagtgttctccgcaagatgaggtctcttggtggtgctgctgctgctgagaagaagatgtag

SEQ ID NO: 744 - DNA, 321 bp, Arabidopsis thaliana
atggcgtcaatgaccatgacatcttcatttctccctaccgtctcaaaccttccggcaaacatctccagcaacagcagacgaagcctcacggtggtcaaagcctccgggagtgaaaacacaaccagcttggagaacaagaagcaagaacagagcatgaagatgaggagggatcttgtcttcacagctgcagctgcagctgtgtgctccttagctaaggtggcaatggcagacgatgagccaaagagaggaacagaagctgccaagaagaagtatgctccagtctgtgtcacaatgcctaccgccaagatatgccgtaactga

SEQ ID NO: 745 - DNA, 2343 bp, Arabidopsis thaliana
atggtggaagaagatttaaaccagattggtggtaatagtaattacaatggagaaggaggcgacccagagagcaacacacttaaccaacctctagttaaggctaatcgaacactttcttcaactccacttgctttggttggtgccaaagtttcccatatcgaaagcttggactatgaaataaacgagaacgatctgtttaagcatgattggagaaaaagatcaaaggcacaagtacttcaatacgtgttcttgaaatggacgttagcttgtcttgttggtcttttcactggtttaatcgctactctcatcaacttagctgttgaaaacatcgccggctataagcttttagccgttggtcacttcctcactcaagaaagatatgttacaggtctgatggtgcttgttggggcgaatttgggactgacgttggtggcgtctgtgctttgtgtgtgctttgctcctacggcggctggacctggaatccctgagatcaaagcttatcttaatggtgtagatactcccaacatgtttggtgctactactatgatcgttaagattgttggaagcattggagcggttgcagctggacttgatctaggtaaagagggtcctctagttcacattggaagctgcatagcttctttgcttggacaaggtggaacagacaaccaccgtatcaagtggcggtggcttcgttacttcaacaacgatagagaccgcagggatctgattacatgtggctcagctgcaggagtgtgtgcagccttcaggtcacctgttggaggtgtacttttcgccctcgaggaagttgctacttggtggagaagtgccttattgtggcggactttcttcagcacagcggttgttgtggttgttctaagagagttcatagagatctgcaattcagggaagtgtgggttgtttggaaaaggagggctaatcatgtttgatgtgagtcatgtaacttatacttaccatgtaactgatataatccctgtcatgttgattggtgtaatcggtggaattcttgggagcctgtacaatcatcttctgcataaagttctcaggctttacaatctcatcaatgagaagggtaagatccataaggtgcttctcagtcttacagtatcactctttacatctgtttgcctttatggccttcctttcttagcgaaatgcaagccttgtgacccctcgatagatgagatatgcccgacgaatggaagatcgggtaacttcaaacagttccattgccctaaaggttactacaatgatctagctactctgcttctcaccaccaacgatgatgctgtcagaaaccttttctcttccaacactcccaatgagtttggtatgggttccctttggatattctttgtgctatactgcatcttggggcttttcacatttggtattgcaacaccgtctggtctcttcctccccatcatcctcatgggtgctgcatatggccgaatgcttggcgctgcaatgggatcatacacaagtattgaccaagggctttatgctgtccttggtgcagctgcactcatggctggatcgatgagaatgactgtgtcactctgtgttatattccttgaactcaccaacaaccttcttttgcttcctataacgatgatcgtgcttctgatagccaaaactgtgggagacagctttaacccgagtatatatgacatcatcttgcatctaaagggcttacctttcttagaagcaaatccagagccgtggatgaggaacctcaccgttggtgagcttggtgatgctaagcccccggttgtaaccctgcaaggtgttgaaaaggtttcaaatatagttgatgtgctaaagaacacgacgcataatgcattccctgttttagatgaagcagaagtacctcaagtgggtctagcaactggggctacagaactccacgggttgatcttgagagcgcacctcgttaaagttctgaaaaagagatggttcttgacagagaaaagaagaacagaggagtgggaggtcagagaaaagtttccatgggatgaattggctgaaagagaagacaactttgacgacgtggccatcacaagcgctgaaatggaaatgtatgtcgatcttcatcctctcaccaacacaacaccttacacagtcatggagaacatgtcagtggccaaggctttagtacttttccggcaagtgggactccggcatttgcttattgttcccaagattcaagcctcaggaatgtgtcctgtggtagggatcttaaccagacaggacctaagggcatacaacattctacaagcctttcctctcttggaaaaatccaaaggtggaaagacacattga

SEQ ID NO: 746 - DNA, 453 bp, Arabidopsis thaliana
atgtcgaagagaaagaccaaagagccaaaggttgagaatgtgactcttggaccagctgttcgtgaaggagagcaagtctttggagttgttcacgtctttgcttcattcaacgacactttcattcacgtgactgatttgtctggacgggaaacacttgttcgcatcactggtggaatgaaggtgaaagccgacagagatgagtcctcaccttatgctgctatgcttgcggcacaagatgttgctcagcgatgcaaggaacttggaatcactgccatacatgtgaaactccgtgccactggtggtaacaagaccaagacccctggacctggtgctcagtctgctctaagagcccttgcccgttctggcatgaaaattggtcgcattgaggatgtgactccaatcccaaccgacagtacccgcagaaagggtggaagaagaggaaggaggctctga

SEQ ID NO: 747 - DNA, 438 bp, Arabidopsis thaliana
atggcgaaggcagataagaaaccagcggagaagaaaccggcagagaaaactccggcagccgaaccagcagcagcggcagagaagaaaccaaaagccggaaagaaactcccgaaggaaccagccggcgccggagacaagaagaagaagagatcaaagaagaacgttgagacatacaagatctacatcttcaaggtgttgaagcaagttcatccagatatcggaatctccagcaaagccatgggaatcatgaacagtttcatcaatgatatctttgagaaacttgctggtgagtcttcgaagcttgcgaggtacaacaagaagccgacgattacttctagggagattcagactgcggtgagacttgtgttgcctggagagttggcgaaacatgctgtttctgaagggactaaggcggttacgaagtttacgagttcttag

SEQ ID NO: 748 - DNA, 777 bp, Arabidopsis thaliana
atgggtcgtgtcatcagagctcaacgtaagggtgcgggttccgtcttcaaatcccacactcaccaccgcaaaggtccggctaagttccgtagcctcgatttcggcgagagaaatggttacctcaagggcgtcgtgacggagatcatccacgatcctggtcgtggtgctcctcttgctcgtgtcactttccgtcatcctttccgtttcaagaaacaaaaggagctcttcgtcgccgccgaaggtatgtacaccggtcagttcttgtactgcggtaagaaagctactctcgtcgttggaaatgttctccctcttagatctattcctgaaggagctgttgtctgcaacgtcgagcatcacgtcggtgatcgtggtgtcctcgctagagcttctggtgattacgccattgttatcgctcacaaccctgacagcgacactactaggattaagttgccatcgggttcgaagaagattgtcccaagtggatgcagggctatgattggacaagttgctggaggtggaagaactgagaagccgatgctcaaggcaggaaacgcgtaccacaagtaccgtgtgaagaggaactcatggcctaaggttcgtggtgtggctatgaatccagtggagcatcctcatggaggaggtaaccatcagcacattggtcacgccagtactgttaggcgtgatgcacctcctggacagaaggttggtcttattgctgcaaggaggactggtcgtctcagaggtcaagctgctgcttcagctgccaaggcagactag

SEQ ID NO: 749 - DNA, 615 bp, Arabidopsis thaliana
atgggtgcgtacaaatacgtgtcggagctatggaggaagaagcagtcggatgtgatgaggtttcttcagagggttaggtgttgggagtatcgccagcagccttccattgttcgtcttgttcgtcccactcgtcccgacaaggctcgtcgtctcggctacaaggccaagcaggggtttgttgtctaccgtgttcgagtcagacgtggtggacgcaagaggccagtgcctaagggtatcgtgtacggtaaacccaccaaccagggagtgacacagctcaaattccagcgtagtaagagatctgttgctgaggaacgtgctggtcgcaaactgggaggccttagggttgttaactcctactggctcaatgaggactctacctacaagtactacgagattatccttgtagaccctgcacacaatgccgtccgaaatgatccaaggatcaactggatctgcaaccctgtgcacaagcacagagaactcagaggtctcacctccgaaggaaagaagaatcgtggtcttcgtggaaagggtcacaacaaccacaagaacagaccttcccgcagggcaacctggaagaagaacaacagtatctctctccgtcgttaccggtga

SEQ ID NO: 750 - DNA, 261 bp, Arabidopsis thaliana
atggttcttcaaaacgatatcgatctgcttaacccacctgctgagcttgagaagaggaagcacaagctcaagcgtcttgtccagtctcccaattccttcttcatggatgtgaagtgccaaggctgcttcaacatcactactgttttcagtcactcgcagactgttgtggtgtgcggaaactgccagacaattctgtgccagcctacaggaggaaaggcaaagctcaccgaaggatgctctttcaggagaaagggtgattga

SEQ ID NO: 751 - DNA, 408 bp, Arabidopsis thaliana
atggtgaagttcttgaagcagaacaaggccgtgatccttcttcaaggacgttacgccggaaagaaagccgtcatcatcaaatccttcgacgacggtaaccgtgatcgtccttacggacactgcctcgtcgccggactcaagaagtacccgagcaaagtcatccgcaaagactcagctaagaagacagctaagaaatctagggttaagtgtttcatcaagcttgttaattaccagcatctgatgcctactcgttacacactcgacgtggatctcaaggaagtggcgactcttgatgctcttcagagtaaggataagaaggttgctgctcttaaggaagctaaggctaagcttgaggagaggttcaaaaccggtaagaacagatggttctttaccaagctcaggttctga

SEQ ID NO: 752 - DNA, 501 bp, Arabidopsis thaliana
atgccgccaaagttggatccgagtcagatcgttgacgtgtacgtccgagtaaccgggggagaagtcggagcagcgagttctctagctcccaaaatcggtccgctaggtctcgcaccaaagaagatcggagaagatatcgcgaaagaaaccgcaaaggaatggaaaggattacgtgtaaccgtcaagctcacagtgcagaatcgtcaggcgaaagtgacggtggttccatcagcagcagcactcgtcatcaaggcgttgaaagagccggagagagataggaagaaggtgaagaacattaagcataacgggaacatctcgtttgatgatgtgactgagattgctaggatcatgagacctagatctattgctaaggaattgagtggaacagtgagggagattctgggaacttgtgtgtctgttggttgtactgtggatgggaaagatcctaaagatattcaacaggagattcaagatggtgaagttgagattcctgagaactga

SEQ ID NO: 753 - DNA, 363 bp, Arabidopsis thaliana
atggtgcagcgtcttgtttaccggtcgcgacacagctacgccaccaaatcgaaccagcaccgtatcgtcaagactccaggaggtaaattggtgtatcaaaccacaaagaagagagctagtggccccaaatgtcctgttactggcaagcgtattcaaggaatccctcacttgaggccctctgagtacaagaggtcaagattatcaagaaacaggaggactgtaaaccgagcatacggtggagtcttgtctggttctgcagtcagggaaaggatcattcgggcattccttgtcgaagagcaaaagattgtgaagaaagtgttgaaactccaaaaggctaaggagaaagtagcccccaaggcttaa

SEQ ID NO: 754 - DNA, 534 bp, Arabidopsis thaliana
atgattatctcagagaacaatcgcagagagatctgcaaataccttttcaaagagggagtatgctttgctaagaaggatttcaatctcccaaagcatccgttgattgatgtaccaaacctgcaagtgattaagctcatgcagagtttcaagtccaaggagtacgttagggagacatttgcgtggatgcattattattggtttctgactaatgaaggaattgagttcttgagaacttatcttaaccttccttccgatgttgtccctgctactttgaagaagtctgctaagcccggtggtcgtccctttggtggcccacctggtgatcgccaaagaggaccacctcgctctgatggagaccgtcccagatttggtgaccgtgatggataccgtggaggcccacgtggtggtgatgagaagggtggagctccagctgatttccagccgtctttccaaggaggtggtggtaggcctggttttggccgtggtgcaggcggttacagtgcagcagcaccatctggttcagggttcccttga

SEQ ID NO: 755 - DNA, 264 bp, Arabidopsis thaliana
atggccgctcgttcactctccggtgccgttaaatctctttgtccgccgcatccggaaaatgtaacagcagcaggattgagtaagggaggttccaccagagttatggtggggaagatggaacagagaggtttagatcaagaggcagagtctgcttggggaccagatccagttactggatactacagaccttccaatcgtgcggctgagattgatccagctgagctcagagagttgcttttgaaaaacaaagcaaagtctttctga

SEQ ID NO: 756 - DNA, 426 bp, Arabidopsis thaliana
atggggagatctatggtgctaatctcggcggttgtactggcttttctagtggcggcgccgataccagaagtaacagccaagaaatatttagtcggcgacaaaaagttctggaaccccaacattaactataccctatgggctcaaggcaaacatttctacgtcggagactggctttattttgtgttctatagagaccaacacaacattcttgaggtaaacaaggctgattatgaaaaatgtatctccaaccgcccaatacgtaattatacacgtggagctgggagagatattgttcctctctatgagactagacgttattatctacttgatggaagaggtggttgcgttcaaggcatgaagctagatgttttagttgagactcctcctcctcctcctccttttactcctcctcctccagcacaataa

SEQ ID NO: 757 - DNA, 651 bp, Arabidopsis thaliana
atgaagctcgccgctagcctcaaccgcctcagccccaaacgtctcttccgtaccaaatcaaaagcttccgtctccagatctgagccttcttccttcagctccaatgcttcttcctcttcctctgatggatcttacggtaacctcaaacaaggtccaaccgcgactccgatcagtgttctccctcaaaactccggcgatttttacactgagcttgttcaagcttttaaactgatcgatcgtgatgacgacggtgttgtttccagaggagatctcgcggcgttgattagcaggttaagtcatgaaccaccgagtcaagaagaggtgagtttgatgctaagagaagtagacggcggagacggtggttgtatcagccttgaagatcttgctagccgtgtcgctggtacttccggtgaaggctctgttgagacggaggagctgagagaggtgttcgagatttttgacgtggatcgtaacggaaaaatatcggcggaggagttacacagagtttttggagtgatcggagatgaacggtgcacgttagaagagtgtatgcgtatgatagcgacggttgatggaaacggtgacggttttgtttgcttcgatgacttttgccgcatgatggttccagcgatgaatgatcatcatcattag

SEQ ID NO: 758 - DNA, 1248 bp, Arabidopsis thaliana
atggcggatcagagttctaagccgttgcagtttttcgtgagactactcgacggaaaatcattaaccctaagtttctcctctccgttagcttatggcgagcagatcaagcagcggatcttcgagcaaacgaagatcccgacgcatctacagagattgataagcggaggataccaaatctccgatggatccgcgatttctcagcctgacgccaccgtgaatcttgtcctttcactccgtggaggtaaaggaggattcggatcgttacttcgtggtgggggtatgaaagctgggcagaagaagacgaacaacttcgatgcttgtagggatatgagtggacggagattgaggcatgtaaacgcagagaataggcttcaggagtggaaggatggtgaagaagggaggaaccttgagaaaaaggctcttgagtatctgaagaagcaatccaataaagtgaaacaaggtgttggaaatggagctacgcagaagtatgttaataagtataaggaagaatctgataagtgtattttggctgttgatttggctttgaatgaatctttcaagaatgggaagagaaaagcgaagattggtgctgaatctgagaagaagaagcgtctcaaaatatggaaggggaagagagctgttgaagatagtgacagtgatgatagcgacgacgaggaagatgagaaatctgttgttctaaacaatggtggtcatgatggtgattcatctggtaaatcttcatgcaatagtggttcagaggaagagaacgacgctgtaatgcaccgcagtttcgatgtggttaaggaagagatcaccggtgttcaagggattattgaagaggagatgaatgatttacctgtttctgttgctgttgatgatgctaatactgttgctgatgaaatggatcaacttgaaaaggtggagaaatcaagtggagacgcagggaagaatctggttgatgtagcttgtgaaacgttaattacgtctgcagctgttaagagagaaggaactgcgaaagaaacagtgtctgttgatgcagtatgttgcaaacctgttgaaccacttaactttgatgacttcaattcaccagcagacatggaggttttggggatggagagattgaagactgagcttcagtcacgtggtctgaagtgcggagggacattgcgagagcgagctgcgaggctatttttacttaaatcaacgccactcgataagctcccaaagaaattactggccaagaaatga

SEQ ID NO: 759 - DNA, 1176 bp, Arabidopsis thaliana
atggcgtctgctagcttcgttaagcctaacaccctctcttctccatggatcggccaacgctcctttgctcacacctctgcttcttcttctcctcctcctcgagtctccttcgcgatccgcgccggtgcttactccgacgagcttgttaaaaccgccaaaagcattgcatcccctgggagaggtatcttggcgatcgatgagtccaatgcaacctgtgggaagaggcttgcttctatcggcttggataacaccgaggacaaccgtcaggcctacaggcaacttctgcttaccactcctggcctcggcgattacatctctggttccattctcttcgaggagactctttaccagtccaccaaggacggtaagacctttgtcgattgcttgcgcgatgccaacatcgtccctggcatcaaagttgacaagggcttgtctcccctagccggttccaacgaagagtcttggtgccaaggcttggatggattggcctcacgctctgctgagtactacaagcaaggcgctcgttttgccaagtggaggacagtggtgagtgttccctgcggtccttcagcactggctgtgaaggaagctgcgtgggggctggctcgctatgcagccatctctcaggataatggtcttgtccccattgtggagccagagatccttctggacggggaccacccaatagagaggactctggaggtggcagagaaagtgtggtcagaggtgttcttctacttggcacagaacaacgtcatgtttgagggcattctgttgaagccgagcatggtcaccccaggcgctgagcacaagaacaaggcctctcccgagaccgttgcagatttcacgctcaccatgctgaaaaggagggttcctccggctgtcccagggatcatgtttctgtcaggaggacaatcagaggcagaggccacactgaacctgaacgccatgaaccagagcccaaacccatggcatgtgtccttctcatacgcacgtgccctgcagaactccgtgctcagaacatggcaaggcaagccggagaagattgaggcctcgcagaaggcactgttggtgagggcaaaggccaactcactggcccagctcggcaaatactcagccgagggagagaacgaggatgccaagaaaggaatgtttgtcaagggttacacctactga

SEQ ID NO: 760 - DNA, 3060 bp, Arabidopsis thaliana
atggcggtcaaatgtttctctctttatctgattctggcggcgattgtaatcggcggcgtcacctccgagtacatagagtacaacacaaaaccgagaatcgtccctgagaaaatcaatgttcacttagttcctcactcacacgacgatgtaggttggcttaagaccgttgatcagtactacgtaggctccaataactccattaggggagcttgtgttcagaatgtattggattctgtaatcgcttcattgcttgatgatgaaaatagaaagtttatttatgttgaaatggctttctttcaaagatggtggaggcaacaaagcaatgctaagaaagttaaagtcaagaagcttgttgactctggtcaacttgagttcataaatggtggaatgtgtatgcatgatgaggcaactccacattatattgacatgattgatcagactacattaggccatcagtttattaaaactgagtttggtcaggttcctagagttggttggcagattgatccctttggacattctgcagtacaagcttacctgcttggtgctgagtttggctttgattcgctgtttttcgctagaattgactaccaagatcgtgcaaagaggttaagagagaagacacttgaggttatttggcaaggttccaagtctcttggctcttcttcacagatatttactggtgtattcccaagacattatgaccctcctgaagggttcacgtttgaaataaatgatgtatcagctcctatccaggatgatcctctcctttttgactacaatgttcaagaaagagtcaacgactttgtagcagcagccctcgcacaggttaatgtgaccaggacaaatcatataatgtggttaatgggaactgacttccgttaccagtatgcatattcgtggttcagacagatagacaagtttattcattatgttaacaaggatgggcgtctcaatgttctgtattcgacaccatctatctacaccgatgcaaaatatgctgcaaacgagtcctggcccctaaagactgatgatttcttcccgtatgcggacaaacctaatgcatactggacagggtactttacgagcaggccagcctttaagaaatacgtgagggatttaagtggttactatctggcagctcgacaattggaattcttgagaggaagggatagttcaggaccaacaactgatatgctagccgatgctttggcaattgctcaacaccatgatgcagttagtggtacacaaagacaacatgtggctgcagattatgctcttagactctcaatgggctacctgcaggccgagaaattggttgcctcttccctttcctttctatcagcagcaaaatcaagtactgaaaagaagaatcctggcacaaaatttcagcagtgtcccctgcttaatattagttactgtcctgcatctgaagctcgtctgttgagcgggaaaagcctggtggttgttgtttacaattctctaggatggaaacgagaagaagttgtccgagttcctgtgtcgtctgaaaatgttattgtgaaagatgcatctgggaaagaagtcgtgtttcagcttctacctctttcagaaatcgctttgagaattagaaatgagtatgtcaaagcgtatctgggaagatcaccacgggatactgcaaaacacgtgcttgcatttacagcttcagtaccacctcttgggttcagctcgtatgtaatctcagacactggacgaacagcgcgtggactatctgcatcatatgttacttctggaagcatgaatcaaaatgtagaagttggccagggaaatctaaagttacgctattcagaagaaggagttaaaataactcgtcacttaagtaccaaaaatcaggttactgcagaacagtcatatgcttattatattggaagcaatggaactgacaaggatcctcaggcttctggagcttacgtttttcgaccagatggtgtgcttccaattaaatctaaagaagaggctcaattgactattgttcaaggacctttgttcgatgaagtgcaccaggagcttaactcctggatatcacagattaccagagtgtacaagggaaaaaaccatgctgaaattgagttcacaattgggcctataccagctgatgatggtattagcaaagagattatcactaaacttacaaccaccatgaagacaaatggaacattttacacagactcgaatggccgtgacttcatcaagcggattcgggacttcagaacagattgggacttgcaagtgtaccaaccggttgctgggaactattatcctctaaatctcgggatatacatgcaagataaaacctcagagctatccgtgttggtggatcgagctgtaggtggatccagcttagagaacggccagatcgagttgatgcttcatcggagaatgcagcatgatgacattagaggtgttggtgagattcttaatgaaacagtctgtctccctgaaggatgcaaaggattaacgatacaagggaagttttatgtacagatagataaacctggagatggggcaaaatggcgtcgaacatttggtcaagaaatttattctccactacttatagcattcacagaacaggaaggagatagttggattaattcacataagacgacattctcagcgtttgaaccgtcatattcattaccaaaaaacgtcgcattactcaccctccaggagttggaaaatggggaagttcttctaaggcttgctcacttattcgaggttggggaggatagtgagtactcagttatggcaaaagtagagctcaagaaactattccacaacaaaaagataagggaagtaaaggagacaagtctttccgggaaccaagagaaggcggagatggagaagagacggctaatctggaaagtagaaggctcggccggggaggaagtgaagagaggagaggcggtggacgcagagaagctagtggttgagcttgttccgatggaaattcgaaccttgttgatcaagtttgatgatcaaattgaaatggttggtgataaagagcagcaacataggttatga

SEQ ID NO: 761 - DNA, 921 bp, Arabidopsis thaliana
atggtggcggctggtaaatccgacctttccttgcccaaaactttcgcctgcagtgccttcgctgcttgcgtcggcgaggtatgcacaattccattggacactgctaaagttaggcttcagctccaaaagtctgctcttgctggtgatgttactctgcctaaatatcgaggattgttgggaactgttggtaccatagcaagggaagaagggttacgttcactatggaaaggtgttgtacctggattgcatcgtcaatgcctatttggaggtcttaggattggaatgtatgagccggtgaaaaacttgtatgttggaaaagactttgtaggtgatgttccattgagcaagaaaattcttgctggtttgacaacaggtgcactgggtatcatggtagcaaatcccactgatcttgtgaaagttaggcttcaggccgaaggaaaactagctgcaggtgcgccaagacggtattctggagcgctgaatgcttattcaacaattgtgagacaggaaggagtccgagctctttggactggtcttggacctaacgtagcaagaaacgctattatcaatgctgctgaattagcgagttacgatcaagtgaaagagacgatcttgaagattccgggtttcactgacaacgttgtcacacatattctatctggactgggagcaggattctttgctgtctgcatcggctctcctgtcgacgtggttaagtcaagaatgatgggagattctggtgcttacaagggcaccattgactgcttcgtcaaaactctgaagagcgacggtcctatggcattttacaagggtttcatccccaactttggacgccttggctcatggaacgtaatcatgtttttgaccctcgaacaggcaaagaagtatgtccgggaactcgatgcgtccaaaagaaactga

SEQ ID NO: 762 - DNA, 885 bp, Arabidopsis thaliana
atgaagagactaagcagctcagattcaatgtgtggtctaatctccacttctacagatgaacagagtccaagagggtacggaagtaattaccaatctatgcttgaaggttacgatgaagatgctacactaatcgaggaatattccggcaaccaccaccacatgggtctatcggagaagaagagaagattaaaagttgaccaagtcaaagctcttgagaagaatttcgaacttgagaataaactcgaacctgagaggaaaactaaattagcacaagagcttggacttcaacctcgtcaagtagctgtttggtttcagaaccgtcgtgcacggtggaaaacaaaacagcttgaaaaagattacggtgttcttaagggtcaatacgattctctccgccacaatttcgattctctccgccgtgacaatgattcccttctccaagagattagtaaaatcaaagctaaggtaaacggtgaagaagataacaacaacaacaaagctattacggagggtgttaaggaagaggaagttcacaagacggattcgattccttcgtctcctctgcagtttctagaacattcctctggttttaactaccggcgaagcttcactgacctccgtgaccttctaccgaattccaccgttgtcgaggctggatcttccgatagttgcgattcaagcgccgttcttaacgacgaaacaagttctgataacggaagattgacgccgcctgtgacggttactggcgggagtttcttacagtttgtgaaaacagagcaaacagaggatcacgaggattttctaagcggtgaagaagcttgtggtttcttctccgatgaacagccgccgtcacttcattggtactctgcttcagatcattggacttga

SEQ ID NO: 763 - DNA, 714 bp, Arabidopsis thaliana
atggcggaacgttacgagtggctcacaacgtcaagtgtgatgtctctggttgcaaatgaggagtttcagcacattttgcgtgtgctcaacactaacgttgatggtaagcaaaagattatgtttgcccttacctctatcaaaggtattggaaggagattggccaacattgtctgcaagaaagccgatgtcgacatgaacaagagggctggtgagttatctgcagctgagattgacaacctcatgactattgttgcaaacccaagacagttcaagattccagactggtttttgaacagacagaaagattacaaggatgggaagtactctcaagttgtctccaatgcccttgacatgaagctcagggatgatcttgagcgtctcaagaaaatcagaaaccatcgtggtctgagacattactggggtctccgtgttcgtggacaacacaccaagacaactggtcgcagaggaaagactgttgcattggatcagaaacgatacgaagaactgcccaaacataatgcttctacttctgcattcatctactgttcgagagcctccataagatccatggatataagttgtgtatctgcttctctggtggagagtccttcagggagaagtatcacagctgatagaagtttgcaaatagggaacgccagttcacctctaggaggaattgggataggtgatagtgatcaagttaatcttgcataa

SEQ ID NO: 764 - DNA, 240 bp, Arabidopsis thaliana
atggcaggaaccggagttgtggcggtgtacggcgaaggagccatgacggagacgaaacagaaatctcccttctccgtgaaagttggtctcgctcagatgcttcgtggcggtgtaatcatggatgtcgtcaacgcagagcaagctcgaatcgctgaagaagctggcgcatgcgccgtgatggctcttgaacgtgttcccgccgatattcgagctcaaggcggtgttgcacgtttttgttag

SEQ ID NO: 765 - DNA, 621 bp, Arabidopsis thaliana
atgaagcacaacaatgttatccccaatggtcacttcaaaaagcactggcagaattatgtcaagacatggttcaaccagcctgccaggaaaaccagaagaagaattgcgaggcaaaagaaggctgtgaagatcttccctcgtccaacttctggacctctccgccctgttgtgcatggtcagactcttaagtacaacatgaaggtcagaaccggtaaaggattcactcttgaagagctcaaggctgctggtatcccaaagaagttggcgcctacaattggtattgctgttgaccatcgtcgcaagaaccgatctttggagggtcttcaaacaaatgtccagaggctgaaaacctacaagaccaagttagtcattttcccgcgtcgtgcccgcaaggtcaaggctggtgactctacaccagaagagttggctaatgctacccaagttcaaggagactacttgcctattgtacgtgagaagcctaccatggaactcgtcaagctgacttcagaaatgaagtctttcaaggcttttgacaagatacgccttgagcgcactaacaagaggcatgccggagctagagccaagagagccgcagaggctgagaaagaagagaagaagtga

SEQ ID NO: 766 - DNA, 597 bp, Arabidopsis thaliana
atggcaaccatgtctgctcttcagagctcttttacttctctttctctatctcccagctcttccttcctcggccagcgtttaatttccccgatttccctctccgtcacttctccggtcaagcccgctgagaacccatgtcttgttcttgcaaagctcaagcgttgggaacgaaaagaatgcaaaccaaacagtcttccgattctccacaaaatgcatgtcaagtttggagatacagtcaaagtaatatctggacgcgacaagggtaaaatcggagaggttactaagattttcactcacaacagtaccattgtgatcaaagatgtgaacctcaaaacaaaacacatgaagagccgagaagagggagagcctggtcaaattgtcaagatagaagcacctatccacagctcaaatgtgatgttgtattcaaaagaaaaagacgtagtaagccgggtgggtcacaaggtacttgaagatggacagaaggtaagatatctgatcaaaacaggggaactcatcgacaccattgagaagtggaagctacttaaggaggctaaggataaggaaaccacccaagttgcagttacctccgcatcttag

SEQ ID NO: 767 - DNA, 360 bp, Arabidopsis thaliana
atgtcggagaagaagggaaggaaagaggaggtggtgaccagagagtacaccatcaaccttcacagacgccttcatagctgtacctttaagaagaaggctccaaaggcgatcaaggagataaggaagtttgctgagaaggaaatggggacaaaggatgtgagagtggatgttaaattgaacaagcagatttggagcaaaggtatcagaggtcctccgaggagaatcagagtccgagttgctcgtaagagaaatgatgatgaagatgcaaaggaagagttcttctctcttgtcactgttgctgaaatccctgctgaaggactctctggcctcggcactaagatcattgaagaagaggattaa

SEQ ID NO: 768 - DNA, 885 bp, Arabidopsis thaliana
atggatcggcaaaattccgatgacatcatgagatttctcgatggaatggctagctccgacgacgttcttttcggttttcttgacgaaggaaaccagtcaccggaagatttctccgtaaacctcaacgccggcgaagatgacggtgacgaagacgacaataataacaattctgaagataacaaagctttttggcaggaacacgaacaacttcttcaggggacactgtataggacaagttccattgagacaaagattagacaagctacaaaagaagcgttgaaacaagttaaatctaagggtctttattgtgtttgccggcgaccagtggacggcggttgccggagttgcttacgtggcgaaatctctagacacctaagagatgtcgccggctacgattgcgtcatctctaaatctaaatggagaagttgtcaagacatccctgcaggggaacacgaatttatagagattgtggaccgatcgggttcaaagaaaagcgagatgcgagtggtgattgagttatcatttagggcagagtttgagattgcaaaaggcagtgaagagtacaaaagacttatcagtcgattgcctgaggtttacgtcgggaaaaccgagaggcttcgatctctgataaagatattgtgcatagcgggaaagaaatgcttgagagacaagaaaatgcatatggctccttggagaaaacacaagtacatgcaagccaagtggcttggcacatgtgatcgatctagctccttggaagcttcggtttccgaggccatggagccagaaaattgggtgccggtggcgaagcctagggtttctatgttgaactatgatggtctcttaggtggtttctctgccggtccggccactgtagcggtcgtgtga

SEQ ID NO: 769 - DNA, 1293 bp, Arabidopsis thaliana
atggctttggcgatgatgatccgaaacgcagcttcgaagcgaggaatgactccgatctccggtcatttcggtggtttgagatctatgtcttcatggtggaagagcgttgagcctgctcctaaagatccgatcctcggagttaccgaagcttttctcgctgatcctagtcctgaaaaagttaatgttggtgtgggagcatatcgtgatgataatgggaagcctgttgtcttggaatgtgtcagagaagctgagaaaaggcttgctgggagcactttcatggagtaccttcctatgggaggaagtgccaaaatggtggacctaacattgaagcttgcctatggggacaatagtgaatttatcaaagataaaagaattgctgcagttcagactctgtctggcactggagcctgccggctctttgcagacttccagaaacgtttttctcctggttcacagatctacattcctgttccaacctggtccaaccaccacaacatctggaaagatgcacaagtccctcaaaagacatatcattactatcatccagaaaccaagggcttggatttctcagcattgatggatgatgtgaagaatgctccggaagggtcattcttccttcttcatgcttgtgctcataatcctactggagtagaccctacagaggaacaatggagagagatatcacagctattcaaggctaaaaagcatttcgcattcttcgatatggcttaccaaggttttgctagtggagatccagcgagagatgccaagtccatcaggatctttcttgaagatggtcatcatattggaatttctcagtcctatgcaaaaaacatgggactctacggccagagggtgggatgtctcagtgtgctttgtgaagatccgaagcaagccgtggctgtgaaaagtcaattgcagcagctagctagaccaatgtacagcaacccacctttgcatggtgctcagctggtctcaaccattcttgaagacccagagttaaagagtctgtggctaaaagaagttaaggtcatggctgataggatcatcggcatgagaactactttgcgagaaagccttgagaagttaggatcgcctttgtcatgggagcacgttaccaaacagattggaatgttctgctacagtgggttaacaccagaacaggttgaccgcttaacaagcgaatatcacatctatatgacccgtaacggccgtatcagtatggctggtgttacaacaggaaacgtgggataccttgcgaatgctatacatgaagtcaccaagtcatcttaa

SEQ ID NO: 770 - DNA, 1989 bp, Arabidopsis thaliana
atgtctacgacgactactgaggcgagatcaccgttgccgttgttgttgagaagaggaaggtcttcgacggcgttatcggcgtcgacggcggaagcaagatcgccgttatcgatactgcagttcagaagaagatcgagcaaagatgtgaggaacataacgtcagtttcgagcagtctcttgcctgcttttgggactttcatcgaagatgataatccttcttccaaacctttcatcgttcttcactttgatcgtcgttacaggttgtgggaattgtttttggtgatattggttgggtattcggcgtgggcatctttgttcgagttggctttcgagaaagctgccgaaggagcgttattgaccattgatctcgtcgttgacttcttcttcgccgttgatatcatcctcaccttttttgtttcctacttggataatactacttacctcaatgtcaccgaccacaagctcatcgccaaacggtacttgaagagcgtggcttttgtgatggacgtagcatcaacgttacccattcaattcatttataaaactattaccggagatgtcggacgaggccaagctttcggcttccttaatttactccgcctctggcgtctccgtcgtgtagccgaactctttaaaagactagagaaagacgcacatttcaactatttcgtgatccgagtcatcaaacttctatgtgtaacgatattttggatacatttggcgggttgcattttatactggatagcctaccattatccaaggcctacggatacatggataggatcgcaagttgaggattttaaggaaagaagtgtatggttagggtacacttactcaatgtactggtccattgtcacactcactaccgtgggttacggtgatttgcatgcagttaatagccgtgagaagacattcaacatgttctacatgcttttcaacattggcctcacttcttatatcatcggtatcatgaccaatctagttgtccatggcgctcttcgtacattcgccatgaggagtgcgatcaatgatatattgcgatacacaagcaagaacaggttaccggatacaatgagggaacagatgcttgcacatatgcagctcaagttcaagaccgcggagttaaggcaagaagaggttcttcaagacttacctaaggccataagatcaagcattaaccaacatctattccgctccatcatcgaagaagcttatctttttaaaggattccccgaaggcctcctcgtccagctggtttcgcaaatacaagcagaatattttccgccgaaaatggagataatcttgcagaatgagattccaacggatttctacgtaattgtatctggaggagtggatataattgcttccaagggtgtgagtgaacaggtattagcgaagttaggtcccggaagtatggcaggagagataggagtagtgttcaacattcctcagcctttcacagtgaggacacgtcgactttcacaagttatcagaattggtcatcataagttcaaagaaatggtgcagtctgataatgacgtcgacgccaaaatgatcattgccaatttcatgacatatcttaagggattgaatgatgagttaaaaaaagaaattccttttcttagagatttattagatgacgcagatgctcaggttcaggaaacagttcagtcagaggaaacaccacaaagtaacgatgaggaaatagttacggtctcaagacatgaaaatggacagatagaagagagaagaagagagggagttccaaaaagagtgataattcatggacaagctcctcctaatcaagataacaaaaacaatggtgattccaacggtagacttatcattttacctgactctatccaacttctattcgacttagctgagaagaagttggggaaacgaggaagcacgattgcaatggcagatggtgcacatgttgaacaaattgatgctcttcgagaaaacgatcatttatatattttctaa

SEQ ID NO: 771 - DNA, 1365 bp, Arabidopsis thaliana
atgaacccaacccaaaaacccgaaccggtttacgatatggtcatactcggagcatccggatttaccggtaagtacgtcgtcagagaagctctcaagttccttcaaacaccgtcttcttctccgttaaagtctctagctttagcgggtcgtaacccgacccgtttaacccaatctctcgaatgggccgcccgcccgaacccaccaccttcctctgtcgctatcctcactgctgatacatctgaccctgattcacttcgtcgtctctgtactcaaaccaaactcatcctcaattgtgttggaccgtttcgtatccatggtgatcctgtcgtctctgcttgtgctgattcagggtgtgattatttggatataagtggtgaacctgagtttatggagagaatggaagctaactaccatgatagagcagaagagactggctctttaatcgtttctgcttgtggttttgattcaattcctgctgaattgggtcttctctttaatgctaaacaatgggtatctccatcggttcctaaccagattgaagcgtaccttagcttggagtctgacaaaaaaattgctgggaactttgggacttatgagtctgcggttttaggtgttgctaatgcagaaaagcttaaagaattaagacgttcaagaccaagaaggccaagaccaacgatttgtggtcctcctgctaaaggaccaacattagaaaaccagaagacgattggtctttgggctttaaagctaccttcagctgatgcagtagttgttcgtagaactctcacaactctaacagagaaaccacatgggcttcctgggattaatgaaagtcctgagcagatacaaaagagagaagcattctggtcatcgatcaagcctgctcattttggtgtaaagataacgtccaaatctctctttgggatattccgatatgttacacttggagtgtcacttggtttactttccaagttctccttcggaagatggcttcttttgaaattcccttcagttttcagccttggttggttccagaagaaaggtccaagtgaagaagaggtagaaagcgctacgtttaagatgtggttcataggtcgtgggtacagcgaagagagtctagcttcacaaggagaaacaaagcctgacttggaaatcattacaagaatttcaggacctgagattggatatataaccaccccgataacacttgttcaatgcggtttgatagtcttgggccagcgcgaaagcctagttaaaggaggagtctacacacccggcattgtgtttggttcaaccgatatccagcagcgacttgaggataatggtatatcttttgagctgatttcaaagatcaagactcaaggataa

SEQ ID NO: 772 - DNA, 954 bp, Arabidopsis thaliana
atgccggtgttcaaagctccgttcaatggctactctgtgaaattcagtccattctacgagtcacgcctcgccgtcgctacagctcagaacttcggaattctcggaaacggccgaatccatgtcctcgagctcgctcctggagctccaggcgtaactgaatccgtctcgtacgatacagccgacgctgtatacgacgtatgttggtcagaatctcatgactctgtgctcatcgccgcaattggtgacggctcagtgaagatttacgacacagctcttcctcctccttctaatccgattagatcattccaagagcacgcgcgtgaggttcaatctgtggattacaatcccacgcggcgcgattcgtttctcacttcttcgtgggatgatacggttaagctttgggctatggatcgtccggcgagtgtaaggacttttaaggaacatgcttattgcgtttatcaagcagtttggaatcctaaacatggtgatgtgtttgcttctgcttctggagattgtactttaaggatttgggatgttagagaacctggatcaactatgatcatccctgctcatgattttgagattttgtcttgtgattggaataagtatgatgattgtattttagctacttcttcagtggataagacagttaaggtttgggatgttaggagttatagagttcctttggctgtgcttaatggtcatggatatgcggtgaggaaggtgaaattctcgccgcataggaggagtttgatagcttcttgctcttatgatatgagtgtttgtctttgggactatatggtggaagatgctttggttggtaggtatgatcatcatacagagtttgctgttgggatcgatatgagtgttcttgttgaaggtttaatggcgagtactggttgggatgagcttgtttatgtttggcagcaagggatggatcctagagccagttga

SEQ ID NO: 773 - DNA, 444 bp, Arabidopsis thaliana
atggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagtaa

SEQ ID NO: 774 - DNA, 645 bp, Arabidopsis thaliana
atgtcagacgacgacgagagaggcgaagagtacctcttcaagattgttatcatcggtgattccgccgtcggcaaatccaatctcctcactcgctacgcccgtaacgagttcaatcccaattccaaagccactatcggcgtcgagtttcagactcagagcatgctcatcgacggcaaagaggtcaaagctcagatttgggataccgccggtcaggaacgcttccgcgccgttacatctgcttattaccgtggcgccgttggagccctcgtcgtctacgatatcactcgtagctccactttcgaaaacgtcggtcgctggctcgatgagctcaacactcattctgatacaacagtagcaaaaatgcttattgggaacaaatgtgatctcgagagcataagagcggtgagtgttgaggaaggcaagagtcttgctgagtctgaaggtttgtttttcatggagacctctgcgttggactcgaccaatgtaaagacggctttcgagatggttattcgggagatctatagcaacattagtcgaaagcaattgaactctgattcttacaaagaggagctgactgtgaatcgtgttagcttggttaagaacgagaacgaagggacaaagacattctcttgctgttcgaggtaa

SEQ ID NO: 775 - DNA, 2247 bp, Arabidopsis thaliana
atgggttctctttcttgttcaataatccatctggttcttattctgcaactacaaacatttttcgttttttctcaaaacatcagaaacggctctgttcctgtcggagaatctctcaccgcttcagagtcccaacaaatctctagttcatggcgttcaccttccggtgactttgctttcgggttccgcaagatccaaccaaacgacggtttcactctctccatttggttcgacaagatttctgacaagaccatcgtgtggcacgcacaagccgtcaacacaaccaccggtcttgtccctaatggttcgaaggttacattaactgcagatggcggtctggttatcgctgaccctcgaggtcaggagctgtggagagcgttgagtggtggctctgtttctcgagggcgatttactgacgacggaaacttcgttcttttcagagatgggtcagaagattctgacgaggttctatggtcgagctttgaaaatcccaccgacactctgttacctaatcagaatatagaagttggaaggaatctgtcatcacgtaggacagagacgagcttcaaaaaaggaagattcagcctacgtctagaggatgacggaaatcttcagcttcactctctcaacgccgagactgcctcagaatcagacatatactctcagtactacgaaagtaataccaacgatccaaacaaccccgggattcaattagttttcaaccagtcaggggaaatatatgttcttcaaaggaacaattcaagattcgtcgtcaaagatagagatccggatttttctatcgccgcgccgttctacatttcgacgggccccgatgatgcacttgggaatatggcttgtgggtataataatatatgtagtttaggaaacaacaagaggccaaaatgtgagtgtcctgagaggtttgtgttaaaggatccgagcaatgagtatggtgattgtttgccagattttgagatgcagacttgtagaccagagaaccaaaccgcaaactcagatgtgaatctttacgagttcattactttagagaagacgaattggccgtttggggattatgagagttatgccaactatgatgaagaaagatgtaaagcttcttgtcttagcgattgtttatgtgctgcggttatttttggaacaaatcgggatctaaaatgttggaagaagaagtttcccttgtctcacggtgaaagatctccacgtggtgatagtgatacattcattaaggttcgaaaccgctccatcgcggatgttccagttaccggaaacagagcgaaaaaacttgactgggtctttacatatggagagcttgcagaggctacaagagatttcacggaagagcttggaagaggagcctttggtatagtttacaaaggatatttagaagttgccggtggttctgaagttaccgtggctgtgaagaaactagatcgtcttgatttagataacgaaaaagagttcaagaatgaggttaaagtgataggtcagattcaccacaagaacctagtgaggctcattggcttctgcaacgaaggacagagccagatgatcgtctatgagtttttaccacaagggacgctagccaattttctcttcaggcgtccgaggccgagctgggaagatagaaagaatattgcggtggccattgctcgtggaatcttgtatctacatgaagagtgcagcgagcagatcatacactgtgacataaaaccgcagaacatactcctagatgagtattacactcctcggatctcggattttggtctagcaaagcttttgttgatgaaccaaacgtatacgctcactaacatccgtggaacaaaagggtatgtggcccctgaatggttcaggaatagccccattacatccaaagtagatgtttatagctatggagtaatgcttttagaaatcgtgtgctgcaagaaagccgtcgaccttgaggataacgtgattctcatcaattgggcttacgattgttttcgacaaggaaggttggaagatctgactgaggacgattcagaggcaatgaatgacatggaaactgtggagagatatgtgaaaatagcgatatggtgtatacaagaagagcatgggatgagacctaacatgagaaatgttacacagatgcttgaaggtgtgattcaagtttttgatcctccaaatccgtctccttatagcactttcacttggtctgatgaatctttgtctagtgatccagtgtcacttgtttga

SEQ ID NO: 776 - DNA, 732 bp, Arabidopsis thaliana
atggcttcaatcaacctcttcctcttcgctttccttcttcttctctctcacgcttcagcttcaacggtaatcttctacaacaaatgcaaacacccagtttggccaggtatccaacccagcgccggtcaaaacttactcgccggcggtggttttaagcttccagctaacaaagcccactctcttcaactcccaccactctggtccggccgtttctggggtcgccacggctgcaccttcgacagatctggccgtggtcactgcgccaccggagattgcggcggttctctctcctgcaacggtgccggcggtgaacctccggccactctcgccgaaatcactctcggccctgagctagacttctatgacgtcagcctcgtcgacggttataacctggccatgtcgattatgccggttaaaggttcaggtcaatgtagctacgccggttgtgttagcgatctaaaccagatgtgtccggttggtttacaagtccggtcacgtaacgggaaacgtgtagtagcctgtaaaagtgcttgctctgccttcaattcaccacagtactgttgcaccggcttgttcggtaacccacagtcttgcaaaccaacggcttactccaaaatcttcaaagtcgcttgcccaaaagcttactcttatgcttacgacgacccaaccagtatcgccacatgttccaaggctaactacatcgtcaccttttgccctcatcatcgccattaa

SEQ ID NO: 777 - DNA, 1068 bp, Arabidopsis thaliana
atgtccatgcaacaagaaacgtctcacatgacggcggctccacagaccaacggccatcaaatcttccctgagattgacatgtccgccggcgattcctcctccatcgtacgagctacagtcgtccaagcctctacagtcttctacgatactcccgccacgctagataaggcagagagactgctttctgaggcagcggagaatggatctcagctagtggtgttcccggaggctttcatcggtggatatccacgtggctctacctttgaattggctattggttctcgtaccgctaaaggacgagatgactttcgcaagtaccatgcttctgccattgatgttcctggccctgaagtggaacgattagcgttaatggccaagaagtacaaagtatacttggttatgggtgtgatagagagggaaggctacacgctatactgcaccgttcttttcttcgattcacaaggtctgttcttaggtaagcaccgcaaactcatgcctacagctcttgaacgttgcatttggggatttggagatggatcaaccatccctgtgttcgatactcctattgggaaaatcggtgctgctatttgttgggaaaataggatgccttctttgagaaccgcaatgtatgccaaaggcattgagatttattgtgcacctactgctgattcaagagaaacttggctagcatcaatgactcatattgcacttgagggtggatgttttgttttgtcagctaaccagttttgtcgtcggaaagactatccttctccgccggaatacatgttttccggttcagaagagagcctaacaccggactctgttgtctgcgctggtggaagctctatcatttcacctttgggaattgttttagctggaccaaactatagaggagaagctcttatcacagctgatctagatcttggggacatagcacgagccaagtttgattttgatgtggtcggacattactcgaggcctgaagtgtttagcttgaacataagggagcatccgagaaaagcggtcagcttcaagacgtcaaaggtaatggaagatgaatccgtctaa

SEQ ID NO: 778 - DNA, 843 bp, Arabidopsis thaliana
atggcgtcttcgtcgttctcagtcacatctccagctgctgctgcttccgtctatgcagtcactcaaacctcctcgcacttcccaatccaaaaccgctctcgcagagtttctttccgtctctctgctaagcccaagcttcgctttctctccaagcctagtcgcagtagctaccctgtggtgaaagcacaatctaacaaggttagtactggtgcatcatcaaatgctgccaaagttgatgggccatcatcagctgaaggaaaggagaaaaactcattgaaggagtcgtctgcttcttctcctgaattagctacagaagagtctatttctgagttccttacccaagtaacaactcttgtcaagcttgtggattcaagagacattgttgagttgcagttgaaacaactcgactgtgaactagtcattcgaaaaaaagaagccttacctcaacctcaagctcctgcatcttatgttatgatgcagcaaccaaatcaaccatcttatgcccagcaaatggctcctcctgctgcacctgctgctgccgcaccagccccttctacgccagcctctctgcctccaccatccccacctactccagccaaatcgtcacttcctactgttaaaagccccatggctggcacattctaccgtagtcctgcacctggtgaaccaccctttattaaggttggagacaaagtgcagaaggggcaagttctatgcattgttgaagccatgaagttaatgaatgaaatagagtctgaccataccggaaccgtagtcgatattgtcgcagaagacggcaagcctgtcagcctcgacactcctctgtttgtggttcaaccgtag

SEQ ID NO: 779 - DNA, 516 bp, Arabidopsis thaliana
atggcggccatgaactcgagtgttctcacttgcagctacgcaattgctggctctggctcggtagagcttaaccagaaagttggtttggtgaattcatcagttgggtttggtcagaagaaacagatgattatgcctgtgatcaaagctcaacgcgttgttggtgatgatgttgatggatctaatggaagacgatcagccatggttttcttagcagctacactcttctccactgctgctgtttctgcttctgctaatgctggcgtcattgacgaatacctcgagaggagcaaaaccaacaaagaacttaatgataagaagagattggcaacaagtggagcaaactttgcgagagcattcactgttcaattcggaagctgcaagttccctgagaatttcactggctgccaagatcttgccaagcaaaagaaagttccatttatctcagaagatattgctttggaatgcgaaggcaaggacaagtacaagtgtggttccaatgttttctggaaatggtga

SEQ ID NO: 780 - DNA, 1062 bp, Arabidopsis thaliana
atggcttacgagaaagagcttgatgctgctaagaaagctgcttcactcgctgctcgtctctgtcagaaagttcaaaaggctttgttgcaatcagatgtgcaatcaaaatctgataaaagtccagtgaccgttgctgattatggttcacaagcagttgttagtttagtcttagaaaaagagctcagttctgaacccttttcattggtggctgaagaggactcaggcgatctacgcaaggatggttctcaggatactctggagcgcatcacaaaactcgtgaacgacactttggctaccgaggaatcgtttaatggctctactttgtctactgatgatctacttagagccattgactgtggaacatctgaaggtggtccaaatggtcgacactgggtcttggatccaattgatggcactaaaggatttctgaggggagatcaatacgcagtagcactaggattgctcgaggaagggaaagtagttttaggtgtgcttgcttgtccaaacttgccgttagcatccatagcaggaaacaacaagaacaaatcttcgtcagacgaaattggatgcctcttctttgctacaattggttcagggacatatatgcagctcctagattcaaaatcttctcctgtaaaagtgcaagtctctagtgttgagaatcctgaagaggcatcgttcttcgagtcattcgaaggagctcactctctacatgacttatccagctccattgccaataaactcggtgtcaaagctccaccagtccgtattgatagccaagcaaagtatggagctttatcaagaggagatggagctatatacttacggtttcctcataaaggataccgcgaaaagatttgggaccatgtcgctggtgctatagttgttacagaggcgggtggaatagtgacagatgcagcaggaaagccactggatttctcgaaagggaagtatcttgatttggacacaggcattatcgttgctaacgagaagctaatgcctctgcttttgaaagcagttcgtgactccatagctgagcaagagaaagcttcagctctctga

SEQ ID NO: 781 - DNA, 1392 bp, Arabidopsis thaliana
atggcgggaatcgtgacagagccgtggtcagtagctgagaacggaaacccaagcataacggcgaaaggatcgagcagagaactaagacttggaagaaccgctcacaacatgtcttcttcttctttgaggaaaaaatcagacctccgagtgattcagaaggttccatacaaaggtcttaaagattttctctctaatctccaagaagtcattctcggaacaaagcttgccattctttttccggccattcctgccgccattatttgcacctattgtggcgtcagtcagccttggatatttggacttagcttgctaggactgacacctttggctgagcgagtcagctttttgacagagcaactagctttctacaccggtcctacattgggtggtctattgaacgcaacgtgtggaaacgcgactgaattgataatcgcgattcttgctttgaccaataacaaagtcgcagtggtgaaatattcgctgctaggttcgattttgtcgaaccttttattggttctagggacttcactcttctgtggaggaatcgctaatatccgaagggaacagcggttcgaccggaaacaagccgatgtgaacttcttcttacttctactgggtttcttgtgtcacttgctgccattgttggtgggatacttgaaaaacggagaggcttcggctgctgttttgtccgacatgcaactgagtatatcgcgaggcttcagtattgttatgttgatcagctacattgcatatcttgttttccaactgtggactcaccgccaattgttcgatgcacaagaacaggaagatgagtatgatgacgatgtggagcaagaaaccgcggtgattagtttttggagcggttttgcatggttggttgggatgacactcgttatcgcattgctatcggagtatgttgtagccacgattgaggaagcatcggataaatggaacttatcagtgagtttcataagcatcatattgcttcctattgttggaaatgcagctgaacatgctggagccgttatttttgcctttaagaacaagcttgacatatctttgggagttgcgttaggctctgcgactcagattggcttattcgttgtccccttgaccatcatcgtggcgtggattttgggaattaatatggatctcaattttggtcccctcgaaactggctgtcttgctgtttccataatcatcacagcgttcacattacaggatgggagttctcactacatgaagggactggtcctcttgctttgctatttcattattgccatctgtttcttcgtcgacaaacttccccagaaacaaaatgccattcacttgggacatcaagcgatgaacaatgtcgtcactgcaacaggaggaggagttttctcatcttaa

SEQ ID NO: 782 - DNA, 552 bp, Arabidopsis thaliana
atgactccaacatcagagatgatgatggattatagcagaattgagcagagtcatcatcatcatcaattcaataaaccttcttcacagagtcatcacattcagaagaaagagcagagaaggagatggtcacaggaacttcaccgtaaatttgttgatgctcttcataggcttggagggccacaagttgctacaccaaagcagattagagatttgatgaaagttgatggtttaaccaatgatgaagtcaagagccatttacaaaaatatagaatgcatatccgtaagcatccgctgcatccgacaaagactttgtcatcgtcggatcagccaggtgtgttagagagagaatcgcagagcttaataagtttgtcgaggtcggattcgccacaaagcccacttgttgcaagagggttgttcagtagtaatgttggtcatagctcagaggaagatgaggaggaggaggatgaagaggaggagaagtctgatggacgtagtagctgtagaaatgatgaaacaaagaagaagagacaagtgttggatcttgagctttga

SEQ ID NO: 783 - DNA, 981 bp, Arabidopsis thaliana
atgaattgcttgatagctatagctctttcagtctctttctttcttgtgggaattgttggaccgatccaagctcaattgcagatgaatttctatgccaattcttgtcctaatgctgaaaagattgttcaagattttgtttcaaaccacgtttctaatgctccttctcttgctgctgctctcattagaatgcatttccatgactgttttgtccgaggttgtgatggatcagtgcttataaactcaacgtcaggaaacgcagagagagacgcgactcctaacctaacggttcgagggtttggcttcatcgacgcaattaaatctgtgcttgaagctcaatgccctggaattgtctcttgcgctgatattatcgctctagcttctcgcgacgctgtcgttttcaccggaggaccgaattggagtgtaccgaccggaagaagagacgggaggatatcaaacgcagcggaggcattagccaacattcctcctccaaccagtaatatcaccaatcttcagacactctttgcaaaccaaggacttgatcttaaggacctcgttttactatccggggctcacactattggtgtatctcactgctcgtctttcacaaaccgtctctacaattttacgggtcgtggaggccaagatccggctttggacagcgagtacgcagccaatctcaagtctagaaaatgtcctagcctcaacgataacaagaccatcgtagagatggatccagggagccgcaaaacatttgatctaagttattaccagctcgtactcaagcgtagaggtctgtttcaatcagactctgctctcaccactaaccccacaacactttcaaacataaaccggatcttgacgggttcggtggggagtttcttctctgagtttgccaagtcaatggagaaaatgggtcggatcaatgtcaagactggttcagctggagtggttaggaggcaatgttccgttgcaaatagttaa

SEQ ID NO: 784 - DNA, 2766 bp, Arabidopsis thaliana
atgaaaatgagacgaggcaattcaagtaacgaccatgaacttgggattctacgaggagctaactcggacaccaactcggacacggagagcatcgctagcgaccgtggtgcctttagcggtccgcttggccggcctaaacgtgcgtccaagaaaaacgcaagattcgccgacgatcttcccaagagaagcaatagtgttgctggcggccgtggtgatgacgatgagtacgtggagatcacgctagacatcagggacgactcggtggccgtccatagtgtccaacaagcagctggaggtggaggccacctggaggacccggagctagcccttcttacgaagaagactctcgagagcagcctcaacaacaccacctccttatctttcttccgaagcacctcctcacgcatcaagaacgcctcccgcgagctccgccgcgtgttctctagacgtccctccccggccgtgcggcggtttgaccgcacgagctccgcggccatccacgcactcaaaggtctcaagttcattgccaccaagacggccgcatggccggccgtcgaccaacgtttcgataaactctccgctgattccaacggcctcttactctctgccaagttttgggaatgcttaggaatgaataaggaatctaaagacttcgctgaccagctctttagagcattagctcgccggaataacgtctccggcgatgcaatcacaaaggaacagcttaggatattctgggaacagatctcagacgaaagctttgatgccaaactccaagtcttttttgacatggtggacaaagatgaagatgggcgagtaacagaagaagaggtggctgagattattagtcttagtgcttctgcaaacaagctctcaaatattcaaaagcaagccaaagaatatgcggcactgataatggaagagttggacccagacaatgctgggtttattatgatcgaaaacttggaaatgttgctattacaagcaccaaaccagtcggtgcggatgggagacagcaggatacttagtcagatgttaagtcagaagcttagaccggcaaaagagagcaaccctttagtgagatggtcggagaaaatcaaatatttcatacttgacaattggcagagactatggataatgatgttatggcttggcatctgtggtggcctctttacttataaattcattcagtacaagaacaaagctgcctatggtgtcatgggttattgcgtttgtgtcgccaaaggaggcgccgagactctcaaattcaacatggctctcatattgttgcctgtttgtcgaaacaccatcacttggcttaggaacaagactaagcttggtactgtcgttccttttgatgatagtcttaacttccacaaggttattgcaagcgggatagtcgtcggtgttttactccatgcgggtgcccatttaacgtgtgattttccacgtttaattgccgcggatgaggacacctatgagccgatggaaaaatactttggggatcaaccgactagctactggtggtttgtgaaaggagtggaaggatggactggcattgtgatggttgtgctaatggctatagcctttacactcgcgacgccttggttccgacgtaacaagcttaacttacctaacttcctcaagaagcttaccggtttcaacgccttttggtacacccaccatttgttcatcattgtttatgctcttctcattgtccatggtatcaagctctacctcacaaagatttggtatcagaaaacgacatggatgtatcttgctgtacccatccttctatatgcatcggagaggctgctccgtgctttcagatcaagcatcaaaccggttaagatgatcaaggtggctgtttaccccgggaacgtgttgtctctacacatgacgaagccacaaggattcaaatacaaaagtggacagttcatgttggtgaactgccgagccgtatctccattcgaatggcatcctttctcaatcacatcagctcccggagacgattacctgagcgtacatatccgcactctcggtgactggacacgtaagctcaggaccgttttctccgaggtttgcaaacctcctaccgccggtaaaagcggtcttctccgagcagacggaggagatggaaacctcccgttcccgaaggtccttatcgacggtccatacggtgctcccgcacaagactacaagaaatacgacgtggtactcctcgtaggtctcggcattggagccacgcctatgatcagtatccttaaggacatcatcaacaacatgaaaggtcctgaccgcgacagcgacattgagaacaataacagtaacaacaatagtaaagggtttaagacaaggaaagcttatttctactgggtgactagggaacaaggatcattcgagtggttcaagggaataatggacgagatttcggagttagacgaggaaggaatcatcgagcttcacaattattgcacgagtgtgtacgaggaaggtgatgcaagagtggctctcattgccatgcttcagtcgttgcaacacgctaagaacggtgtggatgttgtgtcgggtacacgtgtcaagtcccacttcgctaaacctaactggagacaagtctacaagaagatcgctgttcaacatcccggcaaaagaataggagtcttctactgtggaatgccaggaatgataaaggaattaaaaaatctagctttggatttttctcgaaagacaactaccaagtttgacttccacaaagagaacttctag

SEQ ID NO: 785 - DNA, 1596 bp, Arabidopsis thaliana
atggcactcaaagcgattctctttttgggtttatttctcgtcgtgatagtttctccgatcaccgtctacggtggagctgtgtgtccggcgagttccacgtttggtcgtggaagctttcctgatggtttcttgttcggtgctacaacttctgctttccagcatgaaggtgcagcagaagaaggaggccgaggttccagcatttgggactcattcactcttaaacaacattcagaaagcaacaacaatcttgacggcaggctcggagttgatttctatcatcattacaaggaagatgttcaactattgaaaaaactgaatatggatgcctttaggttctctatatcttggtcaagaatatttccccatgggaaaaaagacaagggagtgagtgaaacaggagttaaattctacaatgatcttatcaacgagctcattgcaaatggtgtaacgcctcttgtcacattgtttcaatgggatgtacctcaggctcttgaagatgaatacggcggtttcttgagtgaccgtattttggaggatttccgtgattttgcacagtttgctttcaataaatatggtgatagagtgaagcattgggttactataaacgaaccttatgaatttagtcgtggtggatacgagactggagagaaagcaccaggaagatgttctaaatatgtcaatgagaaatgtgttgcaggcaagagtggccatgaagtttacactgttagtcacaatctgctgttggctcatgccgaagctgtggaagaattcaggaaatgtggaaagtgcacaggtggaaagatcggaattgttcaaagtccaatgtggtttgagccttatgataagaaatccacctcgagtccttcagaggagatagtgaagagagctatggatttcactctaggctggcatatggagccaataacacatggagattaccctcaggccatgaaagatgttgttggtagtcgattaccatcttttacgcccgagcagaaggagaaactgaagggttcttatgattttgtcggtatcaattacttcacttctacatttgttgctcatacggacaatgttaatccagagaaaccgagttgggaagctgattctcgcttgcagttacattcgaataacgttgatgggttcaagattggttctcagcctgctactgcgaagtatcctgtttgcgctgacgggttaagaaaagttttgaaatacatcaaagagaactacaatgacccagaaatcatagtcactggaaacgggtacaaggagacacttgaagagaaagatgtacttccagatgccctcagcgatagtaacaggaagtattatcatatgagacatctcatggcattacatggagcagtctgcgaggacaaggttaatgttaaaggttactttgtgtcgtcgcttatggatggactagagtgggaagatggatacaagacgaggtctggactgtactatgtagactatggacacaatatgggacggcatgagaaacaatctgccaagtggctctccaagctccttgagaaagtcccggacacgattcagtcgaaggtagattcggattcaaggaaagagttataa

SEQ ID NO: 786 - DNA, 1473 bp, Arabidopsis thaliana
atggcgaacaaaccaagaaccagatgggttcttccttacaagaccaaaaacgttgaagacaattactttcttggtcaagtccttggacaaggccaattcggaaccactttcctctgtacccataaacagacaggtcaaaagcttgcctgcaaatccatacccaaaaggaagctcctttgtcaagaagattacgacgacgttctgagagagatccagataatgcatcacttgtctgaataccccaacgttgtccgtatagagagtgcgtacgaggacaccaaaaacgtgcatcttgtgatggagctttgtgaaggaggtgagttgtttgatagaattgtgaagagaggtcattacagtgaaagagaagctgctaagcttatcaagaccattgttggggttgttgaggcgtgtcactctcttggtgttgttcatagagatcttaagcctgagaatttcttgttttcttcttctgatgaagatgcttctcttaaatctactgactttggcctctctgttttctgcacaccaggagaagcattttcggaactcgttggtagtgcttactatgtggcacctgaggttttacataagcattatggtcctgaatgtgacgtatggagtgctggagttatcctctacattctcttatgtggttttcctcctttttgggctgagagtgaaataggcatcttcaggaagattttacagggaaagttggagtttgagatcaatccttggcctagcatttcagagagtgccaaagatcttataaagaaaatgcttgaaagcaatcctaaaaagaggctaactgctcatcaagtgttgtgtcatccgtggattgtggatgataaggttgctccagataaacctttggactgcgcggtagtgtcccgcctgaagaagttctctgcaatgaacaaacttaagaagatggctttacgagttattgcagagagactatctgaggaagaaatcggtggtctcaaagaactgttcaaaatgatagacacagataaaagtgggactatcacgtttgaagagttaaaagatagtatgagacgtgttgggtcagagcttatggaatcagagatccaagaactcttgcgtgcggctgatgttgatgagagtggaacaattgactatggagagttcttagctgcaacaatccacttgaacaagctggagagagaggagaatctagtagctgcattctctttctttgataaggatgcaagtggttacatcactatcgaagagcttcaacaggcatggaaggagtttggtataaacgattctaatcttgatgaaatgatcaaagacattgatcaagataatgatggacaaatagactatggagaatttgtggcaatgatgaggaaaggaaatggcactggaggagggattggtcggagaactatgaggaactctctcaactttggaactactcttcctgatgagtctatgaatgtctga

SEQ ID NO: 787 - DNA, 1680 bp, Arabidopsis thaliana
atgaaagaatcattcaaagtgtgtttctgttgtgtaagaaacttcaaggtgaaatcaagtgagccacctgaagaaatcaagaaccttttccatgattactctcaagacgacaggatgtctgctgatgagatgctcagattcgtgatccaagttcaaggagaaacacacgctgatatcaactacgtgaaggatatcttccacagacttaaacatcacggcgtttttcatcctcgtggaattcatcttgaaggattctaccgttatcttcttagtgatttcaactctccattgcctctgacccgcgaggtttggcaagatatgaatcagccattatcgcattacttcttgtacacgggacataactcttacttgactgggaatcagttgaacagtaatagcagcatcgaaccgattgtgaaagctctgagaaatggagttcgtgtcattgagcttgatttatggcctaactcttcaggaaaagaagctgaagttcgtcatggagggacgttaacgagtcgtgaagatctgcagaaatgtcttaacgtggttaaggagaacgcgtttcaggtgtctgcttatcctgttgtgcttactttagaagaccatttaactccaattcttcagaagaaagtcgctaagacgtttgggggatcattgtttcaatgtacggacgaaactacagagtgttttccttcaccagaatcactcaagaataagatcttgatctcaacaaagccaccaaaagagtatcttcagacccaaatctcaaaaggttcaacaacggatgaatccactagagctaaaaaaatttcggatgcagaagaacaagttcaagaagaagatgaggagagtgtagcgattgaatacagagacttaatctcgattcacgctgggaaccgcaaaggagggttgaagaattgcttgaatggagatcctaaccgagtcatacggttaagcatgagtgagcagtggcttgagactctggcaaaaacccgtggacccgatttagtaaagttcacgcagcggaatcttttgaggatatttcccaagactacacggtttgactcatctaactatgatcctctcgttgggtggattcatggggctcaaatggttgccttcaatatgcaaagccatgggaggtatctgtggatgatgcaaggaatgtttaaagccaatggtggatgtggctatgtgaaaaagcctgatgttttgctctccaatggtcctgaaggtgaaatctttgacccttgtagtcaaaacctcccgatcaagacaactcttaaggtgaagatctacactggagaaggatggaatatggactttcctttagatcactttgaccgatactctcctcctgatttctacgcaaaggcaagtgtcggaatcgcaggggttccattggacacagcaagttacagaacagaaatagataaagacgaatggtttccaatttgggacaaggagtttgagttcccattacgtgttcctgagttatctcttctgtgtatcacagtcaaagattacgacagtaacactcagaacgatttcgctggccagacatgttttccgttgtcggaggtaaggccaggtattcgtgccgttcggctccacgatcgtgccggagaggtctacaagcacgtgagactgctcatgcggtttgtcttggagcctcgttag

SEQ ID NO: 788 - DNA, 2373 bp, Arabidopsis thaliana
atgccatgtactacttatcttcctcttcttcttctcctcttccttcttccaccaccatctgtacaaagcaaagttatcatcaaaggaaaccaaaccattctgagtttcaaagctattttccggcttggtttcttcagcaccaccaatggttcctccaattggtacttgggtatctcttacgcttctatgccaactcccacccacgtttgggtcgccaatcgaatccgacccgtttcggatcctgactcttccactctcgagctcacctccaccggatacctaatcgtcagtaacctccgtgacggcgtcgtttggcagacggataacaaacaacccggaaccgatttccggttctctgaaaccgggaatctgattttgatcaacgacgacggttctccggtttggcagagctttgacaatccgactgacacgtggcttccggggatgaatgtcaccggtctaacagctatgacttcgtggcggagtctcttcgatccttcgccggggttttactctctgagactgagtccaagcttcaacgagttccagcttgtttacaaaggaaccacaccgtattggtccaccggaaattggaccggagaagccttcgtcggcgttccggaaatgaccattccttacatctacaggttccatttcgttaacccttacactcccacggcgtcgttttggtacatcgtcccaccgttggactccgtttccgagccacggctgacgcggttcatggtcggcgccaacggccagctgaagcagtacacttgggatccacagacgcagagctggaacatgttctggttgcagccggaggatccttgccgcgtttacaatctctgtggtcaattagggttttgtagcagcgaattgctcaagccctgtgcttgcatccgcggtttccggcctaggaacgacgccgcgtggagatctgatgattacagcgacggatgccgccgtgaaaacggtgattccggcgaaaagagtgatacttttgaagccgttggtgatctacgctacgatggtgatgtgaagatgtcacggttgcaggtaagcaagagctcttgcgccaaaacttgcttaggaaactcttcttgtgttggtttttatcataaggagaagtctaatctctgcaaaattttactcgagtcgccgaataatctgaagaattcgagctcgtggactggagttagtgaagatgtattgtatatcagagaaccaaagaaagggaattcaaagggaaacatctctaagtctataattatattgtgcagcgttgttgggtcaatctcagttcttgggtttacattgttagtgccattgattctgttgaagaggagtcgaaagaggaagaagactaggaaacaagacgaagatgggtttgctgtgttgaatcttaaggtattttctttcaaggagcttcaatcagctaccaatgggttctcggataaggtcggacacggcggttttggggcggtgtttaagggaacattaccgggttcttctacattcgtggctgtgaaacgcttagaaagacctggaagcggggagagtgagttccgggcagaggtatgcaccattgggaacattcaacatgtcaatctcgttaggcttagaggtttctgttcagagaatcttcataggcttcttgtctatgattacatgccacaaggatccttgagttcctatctgtctagaacaagccccaaattgctaagctgggagacccgtttcaggatcgcgttaggtactgccaaagggatcgcgtacttgcatgaaggatgcagggactgtattatacactgtgatatcaaaccggagaacattcttttggacagtgattacaacgccaaagtgtctgattttggcttggctaagctccttggacgtgacttcagcagagttctagccacgatgagagggacatggggctacgtggctcccgaatggatatctggtttgcccatcacgacaaaagctgatgtgtatagctttggaatgacattgctcgagctgatcggtgcgcgtgagatcatacaaggcaatgtggactctgtggttgactctagactcaacggagaatataacactgaagaggtgacgaggatggcaacggtggcgatatggtgcatacaagacaatgaagagataaggccagcaatgggaacggtagtgaagatgcttgaaggagttgtggaggtgacggttcctccaccgcctaaattaatacaagctcttgtctccggcgattcataccgaggagtgagcggcacaagctgtagtgaaggccatggctgttcggatctcaatacaggtttgtctagccctggctcacggtcgtcttttggtagaccttctccttga

SEQ ID NO: 789 - DNA, 1338 bp, Arabidopsis thaliana
atggcgacgagagcaaacgtacctgaacaagtcagaggtgctcctctcgttgatggtttgaagattcagaacaaaaacggtgctgtgaagagtcggcgtgccctcggtgacatcggaaatcttgtttctgttcccggagttcaaggaggaaaggctcaacctccgattaatcgacccattactcgaagtttccgtgcccagttattagcgaatgcccaactcgaaagaaagccaatcaatggagacaacaaggttccagctcttggtccaaagagacaacctcttgctgcaagaaacccagaagctcaaagggcggttcagaagaagaatctagtggttaagcaacagacgaagcctgttgaagtgatcgagacgaagaaggaggtgactaaaaaggaagtagcgatgtcacctaagaataagaaagtgacgtactcgtctgtacttagtgctcggagcaaagctgcttgtggtatagtcaacaaaccaaagattatcgatattgatgaatctgacaaagataaccatttggctgcggtggagtatgttgatgatatgtactcgttctataaagaagttgagaaggagagtcagcctaagatgtacatgcacattcagactgaaatgaatgagaagatgagagcgatcttgattgattggttactagaagttcacatcaagtttgagctcaaccttgaaactctgtacctcaccgtcaacatcattgatcgattcctctctgtgaaagctgtccctaaaagagagttacagctagtgggaatcagtgccttgcttattgcttccaaatatgaagaaatctggccacctcaggttaacgatctggtgtatgtcacggacaatgcttacagtagcagacagattctggtgatggagaaggcaattcttggaaacctcgaatggtatttgacagtcccgactcaatacgtcttccttgtccgcttcatcaaagcttcgatgtctgatccagaaatggagaatatggttcacttccttgctgaattggggatgatgcattacgacaccttgacgttctgtccctccatgcttgctgcttcagctgtttacacggcaagatgctcattgaacaagtcccctgcttggactgatacattgcagttccacaccggctacacagagtctgagattatggactgctcaaagcttttagcttttcttcactcgagatgcggtgagagcaggctacgtgcagtgtacaagaagtactcgaaggcagagaatggaggtgttgctatggtttctccggccaagtctctcttgagtgctgctgctgattggaagaagcctgtttcttcttag

SEQ ID NO: 790 - DNA, 1686 bp, Arabidopsis thaliana
atgatcactgcagctctacacgaacctcagattcacaaaccaaccgatacatccgtcgtctccgatgatgtgcttcctcattctcctcctacgcctcgcattttccggtcaaagcttccggacattgacatccctaaccacctccctctccacacttactgcttcgaaaaactctcatctgtttccgacaagccttgtctcatcgttggctccaccgggaaaagctacacctacggcgaaacacacctaatctgtcggagagtcgcttccgggttatacaagttaggtatcagaaaaggtgacgtcatcatgatccttctccaaaactcagccgagttcgttttctccttcatgggtgcttccatgatcggagccgtctcaaccaccgcaaaccctttctacacttctcaagagctttataaacagcttaaatcttccggagccaaactcataatcactcactctcaatacgtcgataaacttaaaaacctcggagaaaacctcacgctgatcactaccgatgaaccaacaccggagaattgtctaccattctcgacactcatcaccgacgacgaaacaaacccatttcaagaaaccgtcgatatcggcggtgacgatgcggcggcgttaccattctcatcgggaacaacagggttaccaaaaggagttgttttgacacacaagagcttaatcacaagcgttgcacaacaagtagatggagataacccaaatctttacctcaaatcaaacgacgtcatactctgcgttttaccacttttccatatctactctctcaatagcgtcctcctcaattcactccgatccggcgccacggttcttttaatgcataagtttgagatcggtgcgttattggatcttattcaaagacatagagtgacaatagcggcgcttgtaccgccgctagtgatcgctctagctaaaaacccgacggttaattcttatgatctctcctccgttagattcgttctttccggtgcagctcctttaggtaaagaacttcaagatagtcttcgtcgccgtctccctcaagccatccttggccagggatatggtatgacggaggcaggaccagtgttgtcaatgagccttgggttcgctaaagaaccgataccgacaaaatcaggttcatgtgggactgtggtccgaaacgcagagcttaaagtggttcaccttgagacacgtctctctcttggatacaaccaacctggtgagatttgtatccgcggtcaacagatcatgaaagagtacttgaacgatccagaagccacttcagcaacaatagacgaagaaggttggcttcacacaggagacattggatatgttgatgaagatgatgagattttcattgttgatcgacttaaagaagtcatcaagttcaaaggctttcaggtccctccagctgagctagagagtttgctaatcaatcaccattcaattgccgatgcagctgttgttccgcaaaatgatgaagtcgctggggaagttccggtggctttcgtggtgcgatcaaatggaaatgatatcactgaagaagatgttaaagaatatgttgccaaacaggtggtgttctataagagattgcacaaggtcttctttgttgcttccattcctaaatctccttcgggaaaaatactaagaaaggacctcaaagctaagctttgttga

SEQ ID NO: 791 - DNA, 939 bp, Arabidopsis thaliana
atgtcggatgcgtattgtacggattgtaaaaaggagacggagttggttgtcgatcactcagccggagataccctttgctccgagtgtggtttggttttggaatctcactccattgatgagacctctgagtggcgtaccttcgctaatgaatcttccaacagcgatcccaatcgtgtcggtggtccaaccaacccgcttctcgctgatagtgctttaaccactgttatcgctaagcccaatggttcatctggtgatttcttgtcttcttctctcgggaggtggcagaatcgtaactccaattccgatcgtggtttgattcaagcttttaaaaccattgctaccatgtctgaaaggttgggacttgttgcaactatcaaggatcgggctaatgagttatataagaggctggaggatcagaagtcaagcaggggaagaaatcaggatgcactttatgcagcctgtctgtacattgcttgtcgccaagaggacaagccacgaactattaaggaaatatgcgttattgccaatggggcgacaaagaaggaaattggccgagcaaaagactacattgttaagacattgggactggagcctggtcagtctgtggatttaggaactatacacgctggtgatttcatgagaaggttctgctccaaccttgcaatgtctaaccatgcggtgaaagctgctcaggaagctgtgcaaaaatctgaggaatttgatataaggaggagtcctatatcaatagcagcagtagtcatctatatcataacccagctgtctgatgacaagaagactctcaaagatatatcgcatgcgacaggagtagcagaagggacaataaggaattcatacaaagacttgtatccacatctgtcaaagatagcaccaagttggtatgcaaaggaagaggatctgaaaaacctgtcaagtccttga

SEQ ID NO: 792 - DNA, 1251 bp, Arabidopsis thaliana
atgggttatggaaatcgagcttcttctaaaactcctgcgatctcaggtttgcgtgaaaagcatcaacaggatcttgaaaaactgacattgacctcacaaccattcaaaaccttgagattatttgttgttgctgtttttctctatgttagaagatggtcctcttaccttcttgcaaatgttggctggcttatacttttttgtagcatttttgttgcatttgcagctcttcttgtgaccctagatgggcctcacgtcaagcatgttgaagaactgtctgagtacaccaggtttggactatggtggatattcttaggtgttgcatcatcaattggtcttggatctggtttgcatacatttgttctttatttgggtccccatattgctttatttaccataaaagtaatgcagtgcgggcgagtcgatttaaagagtgctatatatgatacaattcagttgaagagaagcccttcatggcttgataaaccatgccacgagtttggctccccagttttttcttctggagttcctcttagcagtatactaccacaggttcagatagaagccatcctatggggtctaggaacagcgttgggagaacttcctccttactttatctccagagcagcaagtctttccggtggcaaaatgaaagaattggagacatgttctggtgacgataacggattcattgctaaacgcgtaaatcagatcaaaagctggttattgtcgcattcacaatatctcaacttcttcacaatcctgattcttgcttcggttcctaacccattattcgaccttgctggaatcatgtgtggacaattcgagaaaccgttttgggagtttttccttgcaaccttgattggaaaggcaatcatcaagacacatatacagacggttttcatcatatgcgtctgtaataatcagcttcttgactgggtagagaatgagctgatatatattctgagctttgtgcccggttttgcttctgcattgcctgagctcacagcgaaactccgcttaatgaaagagaagtacttgattgcttcgcctccagtatcttctgatatcaatgtcaagaaatgggatctttcttttgcatccgtgtggaacggagtcgtgtggctgatgcttttgaatttcttcggccagattgtgacttcaactgcacagagatacctaaagaagcaacaagaagaagaactagatgccttgaccaacaagtcgtcgctgacctcaaagaaatctaagtag

SEQ ID NO: 793 - DNA, 1197 bp, Arabidopsis thaliana
atggcgacggagcatataactcgtacgggagatgaatacaatgtcgagcttttacctagtgacgacgatgcgccgccgcttgaatcgtcttggcgtctcaacctcgacgcttttcaactcccttcttccaccggtggccgtcacgacggacgtactcgcttttctcgctattttcgtactccaagaaaggaacgtagagtctctgaatactacaagaagcaagagaggctcctcgagggtttcaatgagatggagactatccacgaaaatggttttgcatctggtgttccaactgaggaagaaatgaagaagcttgcaaagagtgagagacttgcggttcacatatcgaacgcaacaaatttggtgctttttgtagcaaaagtttatgcctctatggagagtagatccatggctgtgattgcttcaactttggactctcttttggatctcttgtctggttttatcctctggtttacagctaatgccatgagaaaaccaaaccagtttcactatcctatcggaaagcgccggatgcaacctgtgggtatcattgtgtttgcttccgtgatggcaactcttggactgcaagttttgctagagtcaggaaggcaactagttgccaagagtggtattcatatgaatagcacagaggagaaatggatgattggtatcatggtctctgtcaccatcgtgaagtttcttctaatgctttattgcagaggatttcagaacgaaatcgttagggcctatgctcaagatcacctctttgacgtcgtcactaattcaatcggcttagcaacagctgtcttggccgtcaaattctactggtggattgatcctaccggtgctatacttattgctttgtacaccatagcaacatgggcaagaaccgtactagagaacgtccattcactgatcggccgctctgcgccaccagatttcttggcgaaactgacattcttgatatggaaccatcacgaacaaattaagcatattgacacagtaagggcttacacttttgggtcacactactttgtggaagtggacattgttttgccagaggacatgagactacaagaggctcacaacatcggagagactcttcaggaaaagctcgagcagctcgctgaagtagaacgagcttttgtccacatagactttgagttcactcatcgtcctgaacacaagtgtaactag

SEQ ID NO: 794 - DNA, 699 bp, Arabidopsis thaliana
atggccgttcctcttcctgctcgtcctcaatctcccgaaggtttttacgcaatcaacaaccagtttcagacgaatgggccaaaagggttctctgagctcaagattctagcgaacggagacatgttcgtgaggatggatttgcctggagttcctgatgaaggcggcatgagtgtttatcataaccggtcggaggaatctgtagttgtttacgccaaagcacccaagattcacacacacgactccaccgaacgtcgttacctaacgatgactggaattggctgcagctgctgtgcgatctcaagcatgaccactcacatgtccgacggtgtttttagacttaccctctccaagactcgcatcgatccaaatcgctcttcttgcatcgatcatttttctgatatgaaaagtttatgcttttgtcaacagttcttggttgctcaggtttccgtgaagctcccaaacggcaaactattcgtgcgtgcagacatgcctggtgttcccaaagaaaacttcactgtctctgtcacgaatgggcgagtcaaggtgactggtgaagctcctgctctgagccatgactcaagtggccgtttctactctggtgacggcgctatgctctccactcctgttgacattcccagccgtaggatcaagaccatcgccaaggacggtgtcattcgtctccttatccctccattttga

SEQ ID NO: 795 - DNA, 1482 bp, Arabidopsis thaliana
atggccgatcaaatctccggcgagaagccggccggagttaatagattcgctcttcaatgtgctatcgtcgcctccatcgtctccatcatctttggttacgatactggtgttatgagtggagcgatggtgtttatagaagaagatttgaagacaaacgacgttcaaatagaagttctcactggaattctcaacctttgtgcccttgtcggatcattgctcgccggaagaacgtcggacataatcggacggcgttacacaatcgtcttggcctcaatactattcatgttaggctcaatattgatgggttggggtccgaattatccggttctcctatccggtagatgcaccgctggactcggagtcggttttgctctgatggttgctccggtttactctgccgagatcgcaactgcttcacatagaggactcttagcttctcttcctcacctttgtatcagtatagggattttactaggttatatcgtgaattacttcttctccaagttacctatgcatatcggttggagactcatgctcggtatagccgcggttccgtccctagtgctagcgttcgggatcttgaaaatgccggaatctccacggtggttgattatgcaaggccgtcttaaggaaggcaaggagatattggaattggtatctaattcccctgaagaagcagaactccgctttcaagacatcaaagctgctgcgggaatcgacccgaaatgcgtagacgatgttgtgaaaatggagggtaagaagactcatggtgaaggagtgtggaaagagctcattctaagaccaactcctgcagtgagacgtgttcttttaactgctcttgggattcatttcttccaacacgcctccggaatcgaagcagtgcttttatacggtccgaggatctttaagaaagcaggaatcacgactaaagacaagcttttcttggttactatcggtgtcggaatcatgaaaacgacgtttattttcactgcgactttattgttagacaaggtaggtcgaaggaagcttttgttgaccagcgttggaggaatggtcattgcgttgacaatgttgggatttgggcttacaatggcccaaaatgctggcgggaaattagcgtgggctttagtactgagcatagttgcggcttatagtttcgtggcgtttttctctattgggctcggcccaataacttgggtctacagttctgaggttttcccgttgaagcttagggcacaaggagcgagtctcggcgttgcggtgaacagagtaatgaacgccaccgtgtcgatgtcgtttttgtcgttgactagtgcgataaccaccggtggagctttctttatgttcgccggagttgcggcagtggcgtggaatttcttcttcttcctcttgccggagacgaaaggaaaatcacttgaagaaatcgaagcgctttttcaaagagacggtgataaagtacgcggcgaaaacggtgcagcttag

SEQ ID NO: 796 - DNA, 270 bp, Arabidopsis thaliana
atgaagtttgtttccgtcttcctcgttctgtttatcttcttcctcgtcgttcttgaggccccggagaagatagaagccaaagacgacaagttcatatgtgtggttgagtatggaggagacgtgggtccaacgttctgtaaccctaaattcttccccacgttgtgccgtcaaaactgccggagcttcaaaggtgccaaaggcggtaaatgcgtgaagcaacccaaacacaaacatatcaagtgcttctgcgactactgtaaagacgactag

SEQ ID NO: 797 - DNA, 1593 bp, Arabidopsis thaliana
atggatcttggagttcgtgtttctggtcatgaaaccgtttcttctccgggtcaaactgaactcggatctggtttcagtaacaagcaagaaagatccggtttcgatggtgaagattgctggagaagttcaaagctctcacgaacatcaactgatggattctcttcttcccctgcctctgctaaaacgctgtcgtttcatcaaggcatccctttactgagatctaccactattaatgatcctcgtaaaggacaagaacacatgcttagcttctcttctgcttcaggcaaatcagatgtctcaccttatcttcagtactgtagaaactcaggatatggtttaggaggaatgatgaacacaagcaacatgcatggaaacttgttgacaggagtaaaaggacctttttcattgactcagtgggcagagctagagcaacaggcgttgatctataagtatatcacagccaatgtccctgttccatctagtttacttctctctctcaagaaatcttttttcccttatggttccttgcctcctaattcttttggatggggctcttttcatctgggcttttccggtggtaacatggatcccgagccagggagatgtcgccggacagatggaaagaaatggcggtgctcgagggacgctgttcccgatcaaaagtactgtgaacgacatattaacagaggccgccatcgttcaagaaagcctgtggaaggccaaaatggccacaatactaatgctgccgccgctgcttctgctgctgccgcttctaccgctgctgctgtgtccaaagcggcagcggggacttcagctgttgcgatgcgtggatcagataataacaatagccttgccgctgctgttggaacacaacatcataccaataatcaatctacagattctttggctaacagagttcaaaattctcgaggggcttcggtttttcctgccacgatgaacttacagtcgaaggaaactcatccgaaacaaagcaataatccctttgaattcggactcatctcttctgattcgttacttaatccgtcgcataaacaagcctcgtatgcaacctcttccaaaggctttggatcgtatcttgacttcggcaaccaagccaagcacgcggggaatcacaacaatgtcgattcttggcccgaagagctgaaatcggattggactcagctctcaatgtcaatccctatggctccatcttcccctgttcaagataaacttgcactctcacctttaaggttatcgcgtgagtttgaccccgcgatccacatgggattaggcgtcaacaccgagtttcttgaccccgggaaaaagacgaataactggataccaatctcctggggtaataacaactccatgggaggtccactcggcgaggtactaaacagcacgaccaatagtcccaagtttggttcctctccaacaggcgtcttgcaaaagtcgacatttggttctctttctaacagcagctcggcaagcagcaccatcattggcgataacaacaataagaacggtgatggaaaagatccgcttggcccgaccacgctgatgaatacttctgctactgctccttctctgtga

SEQ ID NO: 798 - DNA, 1980 bp, Arabidopsis thaliana
atggcgaaagttcggattttgatcttcacccttgtcttattcttctccctcaatgtccatatccatggattttaccttcccggcgtcgctccacaagatttccaaatgatccaacgcaatcgatcaagtaatcttgttaaaattggatctatggctctgttttatgagatttggggagatgcattgatggtgaaagttaataaattgacatctacaaagactcagcttccatattcctattattctcttccttattgtcgtccagaacatattgttgatagtgctgagaatctcggtgaagttcttcgtggtgatcgaattgagaactctccttttgtgtttaaaatgagggaatcgcagatgtgtgctgcggtttgtcgtgtgaagcttgataagaaaaccgcaaaggcgtttaaggagaagattgctgatgaatatcgagttaacatgattttggacaaccttcccctagttgttccggtgcaaaggccagatcaggacaatgttgtagtgtatcagcatggtttccatgttggtctcaagggaatctttgctggcaaaaaggaggagaagtattttatccacaaccacttgaccttcactgttaggtatcacagagatatacagaccgattcttcaagaatcgttggctttgaagtcaagccgttcagtgtcaaacatgaatatgaaggtcaatggaatgaaaaggctcggttaacgacttgtgatccgcatacaaagcgtgcagtcactaactctgagtctcctcaggaggttgaagaagggaacgagattatcttcacatatgatgttgacttccaggaaagtgaggtgaaatgggcgtctaggtgggacacttaccttctaatggctgatgatcagattcattggttctcaatcgttaattctatgatgattgttcttttcctctctggtatggtcgctatgatcatgctaagaacactctaccgagatatttccaactacaatcagttagagagtcatgaagaggccctcgaagagacgggttggaaattggtacacggagatgttttcagaccgccaacaaacccggagttgctttgtgtttatgcaggcactggagttcaatgctttggaatgattcttgtcaccatgatctttgcttgtcttggctttttatctccttcaaaccgtggtggtcttatgacggctatgcttttgctttgggttttcatgggactattggcaggatacgcgtcttcacgcctctacaagacgttaagaggaaccgaatggaaaagaaacgctctgaaaaccgcattcatgtttcccgctaccgtctttgtcgccttctttgtccttaatgcgataatctggggacaaaaatcatccggtgcagtcccatttggtacaatgtttgctttggttgtcctctggtttggtatctctgttccacttgttttcatcggtggctacattggtttcagaaaacctgcaccggaagatccagtgaaaaccaacaagatcccgcggcagatcccaacacaggcctggtacatgaacccaatcttctccattttgattggaggcattctcccatttggcgcagtcttcatcgagctcttcttcatactcacctcaatatggctacatcagttctactacatattcggcttcctcttcatcgtcttcatcattttgatcatcacttgcgcagagatcacggtcgtcctctgttattttcagctgtgtagtgaagactatcaatggtggtggagatcttacttaacatcaggctcttccgcggtttacctctttctttacgcagtcttttacttctacaccaaacttgagatcacaaagctcgtctctgcagtgctctactttgggtacatgctcatagtttcatacgtattcttcgtctttactggtgcaattggtttctacgcatgcttttggttcaccaggcttatctactcttcggttaaaatcgattga

SEQ ID NO: 799 - DNA, 1899 bp, Arabidopsis thaliana
atggaaggtgtgagatttgtggtgtggagattaggatttctggtttttgtatggttctttgatatctcttctgctacactttctcctactggtgtaaactatgaagtgacagctttggttgctgtgaagaatgaattgaatgatccgtacaaagttcttgagaattgggatgtgaattcagttgatccttgtagctggagaatggtttcttgcactgatggctatgtctcttcactggatcttcctagccaaagcttgtctggtacattgtctcctagaatcggaaacctcacctatttacaatcagtggtgttgcaaaacaatgcaatcactggtccaattccggaaacgattgggaggttggagaagcttcagtcacttgatctttcgaacaattcattcaccggggagataccggcctcacttggagaactcaagaacttgaattacttgcggttaaacaataacagtcttataggaacttgccctgagtctctatccaagattgagggactcactctagtcgacatttcgtataacaatcttagtggttcgctgccaaaagtttctgccagaactttcaaggtaattggtaatgcgttaatctgtggcccaaaagctgtttcaaactgttctgctgttcccgagcctctcacgcttccacaagatggtccagatgaatcaggaactcgtaccaatggccatcacgttgctcttgcatttgccgcaagcttcagtgcagcattttttgttttctttacaagcggaatgtttctttggtggagatatcgccgtaacaagcaaatattttttgacgttaatgaacaatatgatccagaagtgagtttagggcacttgaagaggtatacattcaaagagcttagatctgccaccaatcatttcaactcgaagaacattctcggaagaggcggatacgggattgtgtacaaaggacacttaaacgatggaactttggtggctgtcaaacgtctcaaggactgtaacattgcgggtggagaagtccagtttcagacagaagtagagactataagtttggctcttcatcgcaatctcctccggctccgcggtttctgtagtagcaaccaggagagaattttagtctacccttacatgccaaatgggagtgtcgcatcacgcttaaaagataatatccgtggagagccagcattagactggtcgagaaggaagaagatagcggttgggacagcgagaggactagtttacctacacgagcaatgtgacccgaagattatacaccgcgatgtgaaagcagctaacattctgttagatgaggacttcgaagcagttgttggtgattttgggttagctaagcttctagaccatagagactctcatgtcacaactgcagtccgtggaactgttggccacattgcacctgagtacttatccacgggtcagtcctcagagaagactgatgtctttggctttggcatacttctccttgagctcattactggtcagaaagctcttgattttggcagatccgcacaccagaaaggtgtaatgcttgactgggtgaagaagctgcaccaagaagggaaactaaagcagttaatagacaaagatctaaatgacaagttcgatagagtagaactcgaagaaatcgttcaagttgcgctactctgcactcaattcaatccatctcatcgaccgaaaatgtcagaagttatgaagatgcttgaaggtgacggtttggctgagagatgggaagcgacgcagaacggtactggtgagcatcagccaccgccattgccaccggggatggtgagttcttcgccgcgtgtgaggtattactcggattatattcaggaatcgtctcttgtagtagaagccattgagctctcgggtcctcgatga

SEQ ID NO: 800 - DNA, 1509 bp, Arabidopsis thaliana
atgtcaggattcgaagatggattttcagctgaaaagctattctcacaaggatactcatacacctacgacgatgtgatatttctaccacacttcatcgacttttccactgacgccgtctcgctatccacgcgtctcagcaagcgcgtcccactctcgatcccatgcgtcgcttcgccgatggacactgtctcggaatcccacatggctgctgcaatggctgctcttggaggaatcggaatcgtgcactataactgcgacatcgatactcaagcttccgttatccgtcacgctaaatcgcttcaagttccgattgcgtctgatgctgtttttaaatgcccagagcaccagattggttctgttgatgattttggtccttcttccttcgtttttgtctcgcagacgggaacattgacaccgaaattgttgggttatgtttcaaaatcggagtggtcgagtatgaaagatgaccaaaaggaggtgaagatatatgattacatgaagagttgtgagaacaaagattactatgtgccatgggatattgatcttgacaagattgaggcggttttggaagataagcagaaagggtttgttgttctggagaaggaaggtgagactgtgaacgtagtaacaaaagacgatgtggagagggttaaaggatatcccaagttagggtcaggaactgttggtgcagacaagaaatggatggttggtgctgctatagggacaagggaatcagacaaggagaggctagagcacttagtgaaagctggagctaatgttgtggtgttggatagttcgcaagggaactcgatttaccagcttgagatgatcaagtatgtgaagaatacgtatccggagttggatgtggtcggtgggaatgtggtgactatgtaccaggctgagaacttgatcaaagcaggagttgatgggttaagagttggtatgggatctggatctatatgcacaacacaagaggtttgtgccgttggacgaggacaggctactgccgtgtacaaagtctcgacactagctgctcagcacggtgtacctgttatcgcagatggtggcatctcaaactcaggtcacattgtgaaggctctagttctgggagcatcaacggtgatgatgggaagcttcttggctggaagcaccgaggctcctggagcctatgaatatcgaaacggtaggagagtgaagaaatacagaggtatgggttcattagaagcaatgaccaaaggaagcgaccagagatacttgggagataccgcgaaactcaagattgcacaaggagtggttggagcggttgcagataaaggctcagtgttgaagtttataccatacacaatgcatgccgtgaagcaaggttttcaagatctcggtgcttcttctttgcagtctgctcacgagctattgagagataatacccttagactcgaggctcgtaccggtgcagcacagatagaaggtggaatccatggactggtgtcttacgaaaagaaatcgttttag

SEQ ID NO: 801 - DNA, 1512 bp, Arabidopsis thaliana
atgtcgacactcgaggatggatttccggcggataagctcttcgctcaaggatactcttacacctacgacgacgtcatctttcttcctcacttcatcgatttctccacagacgctgtttctctatccacgcgccttagccggcgcgtgcctctctccataccttgcgtttcgtctccgatggatactgtttcggaatctcacatggctgctgctatggcttctcttggtgggattggaatcgtccactataactgtggcatcgccgctcaagcatcgattattcgccaagctaagtcgcttaaacatccgattgcttccgacgccggtgtgaagttcccggagtatgagattacttctttagatgcttttggtccttcttccttcgtttttgtcgagcaaacaggaacaatgacgactcctaaattgttaggctatgtaacgaaatcgcagtggaagagaatgaattacgaacaaagggagatgaagatatacgattacatgaagagctgtgatagcagtgactattgtgtaccatgggaaattgattttgaaaagttggagtttgttttagaagataagcaaaagggctttgtggttcttgagagggatggtgagactgtgaacgtggtgacgaaagatgatatacagagggttaaaggatatcccaagtctggaccagggactgtgggcccagacggtgagtggatggttggtgcagcgataggtacgagggagtctgataaggagaggcttgagcatttggttaatgttggggtcaatgctgtagtgttggatagttcgcaagggaactctatttaccagcttgagatgatcaagtatgtgaaaaagacttaccctgaattggatgtgattggtggcaatgttgtgacaatgtaccaggcacagaatttgatccaagcaggagttgatgggttgagagttggtatgggatctggttcgatatgtaccacacaagaggtttgtgcagttggtcgtggacaggctactgctgtgtacaaggtttgttcgatcgctgctcagagcgggattccagttatagcggatggtggtatctcaaattcagggcacattgtaaaggctctcgtccttggagcatcaactgttatgatgggtagctttttagctggaagtactgaggctcccgggggttacgagtatacgaacggtaagaggatcaagaagtaccgtggaatgggatcgctagaagcaatgactaaaggaagtgaccaaagatacttaggagatcaaacaaaactcaagattgctcaaggagtggttggagcagtcgcggataaaggctcagtgttgaagctgataccttacacaatgcacgccgtgaaacaaggtttccaagaccttggtgcttcttccttgcaatctgctcatggtctgttgagatcaaacatccttaggcttgaggctcgaactggtgctgcacaggtcgaaggaggagttcacgggctggtttcttatgaaaagaaatcgttttaa

SEQ ID NO: 802 - DNA, 1446 bp, Arabidopsis thaliana
atggagaagaagaagagcatgttcgttgaacagagcttcccggagcatgaaattggcgatactaacaaaaactttgacgaggatggccgcgacaaaagaactgggacatggatgaccgggagtgcacacataataacggccgtgatagggtcgggagtgttgtctttggcgtgggcaatcgcacaacttggatgggtggcaggacccgccgtactaatggctttttctttcataacatattttacatcaaccatgcttgccgattgttaccgttcccctgaccctgttaccggcaaacgcaactacacctacatggaagttgtccgatcctatctaggaggaagaaaagtgcaattatgtggattggctcaatacgggaatctgattggaataacaatcggctacacaatcacagcttcaattagcatggtggcagtgaagaggtcgaattgtttccacaaaaatgggcataatgttaaatgtgccacttcaaacactcccttcatgatcatatttgcaatcatccaaattattcttagccaaatcccaaatttccataacctctcttggctctccattcttgcggccgtaatgtccttttgttatgcctccatcggtgttggtctctccatcgccaaagcggcgggtggcggtgagcacgtaagaacaacactgacaggagttacggtcgggattgatgtatcgggtgccgagaaaatatggagaacgttccaagcgattggggacattgcatttgcctacgcatactcaactgttctcattgaaatacaggacaccttgaaagcaggtcctccatcggagaacaaagccatgaaaagagcaagccttgtgggtgtctccacaacaaccttcttctacatgttatgcggttgtgttggttacgctgcctttggaaatgatgctcctggaaatttcctaactggttttggtttctatgagccattctggctaatcgactttgccaatgtctgcatcgccgtgcaccttatcggcgcctaccaagtcttttgtcaaccaatttttcagttcgtagagagccagagcgcgaaacgttggcctgataacaagtttattacaggagaatacaaaatccatgtcccttgctgtggtgattttagtatcaacttcctcagattggtatggaggacttcatatgttgtggtcaccgcggttgtagccatgatcttccctttcttcaacgatttcttgggtcttattggagcagcttccttctggcctttgactgtttactttcccattgagatgcatattgctcagaagaagataccgaaattctctttcacttggacttggttaaaaatcttgagttggacttgtttcattgtgtccctcgttgctgcagccggatcagtgcaaggactcatacaaagtctcaaggatttcaagcctttccaggctccttag

SEQ ID NO: 803 - DNA, 2136 bp, Arabidopsis thaliana
atgtcctcttcttcttcttcgtcaacctccatgatcgatctcatggcagcaatcatcaaaggagagcctgtaattgtctccgacccagctaatgcctccgcttacgagtccgtagctgctgaattatcctctatgcttatagagaatcgtcaattcgccatgattgttaccacttccattgctgttcttattggttgcatcgttatgctcgtttggaggagatccggttctgggaattcaaaacgtgtcgagcctcttaagcctttggttattaagcctcgtgaggaagagattgatgatgggcgtaagaaagttaccatctttttcggtacacaaactggtactgctgaaggttttgcaaaggctttaggagaagaagctaaagcaagatatgaaaagaccagattcaaaatcgttgatttggatgattacgcggctgatgatgatgagtatgaggagaaattgaagaaagaggatgtggctttcttcttcttagccacatatggagatggtgagcctaccgacaatgcagcgagattctacaaatggttcaccgaggggaatgacagaggagaatggcttaagaacttgaagtatggagtgtttggattaggaaacagacaatatgagcattttaataaggttgccaaagttgtagatgacattcttgtcgaacaaggtgcacagcgtcttgtacaagttggtcttggagatgatgaccagtgtattgaagatgactttaccgcttggcgagaagcattgtggcccgagcttgatacaatactgagggaagaaggggatacagctgttgccacaccatacactgcagctgtgttagaatacagagtttctattcacgactctgaagatgccaaattcaatgatataaacatggcaaatgggaatggttacactgtgtttgatgctcaacatccttacaaagcaaatgtcgctgttaaaagggagcttcatactcccgagtctgatcgttcttgtatccatttggaatttgacattgctggaagtggacttacgtatgaaactggagatcatgttggtgtactttgtgataacttaagtgaaactgtagatgaagctcttagattgctggatatgtcacctgatacttatttctcacttcacgctgaaaaagaagacggcacaccaatcagcagctcactgcctcctcccttcccaccttgcaacttgagaacagcgcttacacgatatgcatgtcttttgagttctccaaagaagtctgctttagttgcgttggctgctcatgcatctgatcctaccgaagcagaacgattaaaacaccttgcttcacctgctggaaaggatgaatattcaaagtgggtagtagagagtcaaagaagtctacttgaggtgatggccgagtttccttcagccaagccaccacttggtgtcttcttcgctggagttgctccaaggttgcagcctaggttctattcgatatcatcatcgcccaagattgctgaaactagaattcacgtcacatgtgcactggtttatgagaaaatgccaactggcaggattcataagggagtgtgttccacttggatgaagaatgctgtgccttacgagaagagtgaaaactgttcctcggcgccgatatttgttaggcaatccaacttcaagcttccttctgattctaaggtaccgatcatcatgatcggtccagggactggattagctccattcagaggattccttcaggaaagactagcgttggtagaatctggtgttgaacttgggccatcagttttgttctttggatgcagaaaccgtagaatggatttcatctacgaggaagagctccagcgatttgttgagagtggtgctctcgcagagctaagtgtcgccttctctcgtgaaggacccaccaaagaatacgtacagcacaagatgatggacaaggcttctgatatctggaatatgatctctcaaggagcttatttatatgtttgtggtgacgccaaaggcatggcaagagatgttcacagatctctccacacaatagctcaagaacaggggtcaatggattcaactaaagcagagggcttcgtgaagaatctgcaaacgagtggaagatatcttagagatgtatggtaa

SEQ ID NO: 804 - DNA, 1539 bp, Arabidopsis thaliana
atggacaatagcagaaccagacaaaacatgaatggttctgctaattggtcacaacaatccggaagaacatctacttcctctttggaagatcttgagataccaaagttcagatcttttgctccttcttcaatctctatctctccttctcttgtctctccttccacttgtttcagtccctctctttttctcgattcccctgcttttgtctcctcctctgctaacgttctagcttctccaaccacaggagctttaatcacaaacgtaactaaccagaaaggtataaatgaaggagacaagagcaacaacaacaactttaacttattcgatttctcattccacacacaatcatcaggagtttctgctccgaccacaactacaactacaactacaactacaacaacaacaaacagttctatctttcaatctcaggaacaacagaagaagaaccagtcagaacaatggagccaaaccgagactcgtccaaacaatcaagctgtatcttacaatggaagagagcaaaggaaaggagaggatggttacaattggagaaagtacggacaaaaacaggtgaaaggaagtgagaatcctcggagttactataagtgtactttccctaattgtccaacgaagaagaaagtggagagatctttggaaggtcagatcacagagattgtgtataaaggaagccacaaccatcctaaacctcagtctactagaagatcttcttcgtcttcttcgacttttcattcagctgtgtacaatgccagtttggatcataatcgtcaagcttcttctgatcagcctaattccaataatagctttcatcagtctgattcctttgggatgcaacaagaggataatactacttctgattctgttggtgacgatgagttcgaacaaggctcatcgattgtcagcagagacgaagaagattgtgggagtgaacctgaagcaaagagatggaaaggggacaatgaaacaaatggtgggaatggtggtggaagcaagacagtgagagagccgagaatcgtagtgcagacaacgagtgatattgacattcttgacgacggttacagatggagaaaatacggccagaaagtcgttaagggaaacccaaatccaagaagctactacaagtgcacaaccatcggttgtccagtgaggaaacatgtggagagagcatcacacgacatgagagcagtaatcacaacctacgaagggaaacacaaccacgatgttcctgcagctcgtggtagcggttacgccacaaacagagcaccacaggattcgtcttcagtcccgattagaccagctgctattgctggtcactccaactacactacttcttctcaagcaccatatacacttcagatgctgcacaacaacaacactaataccgggccttttggttacgccatgaacaacaataacaacaacagcaaccttcaaacgcaacaaaactttgttggtggtggattctctagagcaaaggaagaaccaaacgaggagacctcatttttcgattcgtttatgccctga

SEQ ID NO: 805 - DNA, 744 bp, Arabidopsis thaliana
atggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaaatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtgctgatgtcaatgccaaaaataacggtggtcgcactgctcttcactatgctgctagcaaaggccggttggagattgctcagcttttattaacacacggtgcaaagattaacatcacagacaaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacagttaaaagtttccatggatcaggttgcgttcctgcttataagacatggtgcagatgtggatgtagaagacaaggaaggctacactgttctaggccgagctaccaatgaattccgacctgcacttatcgatgctgctaaggccatgcttgaaggataa

SEQ ID NO: 806 - DNA, 1542 bp, Arabidopsis thaliana
atggcaggagggtcgtttggtccgaccggtgtggctaaggagagagcagaacaataccaagggaaagtcactagttatgttataatcgcttgccttgttgcagctattggtggatccatctttggatatgacattggaatctcaggaggagttacatcgatggatgagtttcttgaggagtttttccacacggtttatgagaagaagaagcaagctcatgaaagtaattactgcaaatatgataatcaaggcttagctgctttcacttcttcactctacttagctggtttggtttcgactctcgtggcttcacccatcactaggaactacggtaggcgtgcgagtattgtttgtggtggaatcagctttcttattggatctggtttgaatgctggagctgtgaacttagctatgcttcttgccggacggatcatgcttggtgttggtattggatttggaaatcaggcggttcctttgtatttatcagaagtggcaccaactcatctacgaggtggtttaaacatgatgtttcagctagctacaactatcgggatctttacagcgaacatggttaattacggtactcaacagcttaagccttggggatggagactctctcttggtttagctgcttttccagctctgcttatgacgcttggcgggtatttcttacccgagacaccaaacagtttggtcgaaagaggattaacagagagaggtcgacgagtcttagtgaagctaagaggaacagaaaacgtcaacgccgagcttcaagacatggtagatgcgagtgagcttgcgaattccatcaaacatccattcagaaacatcttgcagaaacgacacaggcctcagctagttatggctatttgcatgccaatgtttcagatactcacagggataaactccattctcttctacgcacctgttctgttccagacaatggggtttggaggaaacgcatctctctattcatcagctttaacaggagctgttcttgtcctatcaacatttatttccataggattagtagacagattgggacgaagagctcttctcataactggaggaatacaaatgataatctgtcaagtcatagtagcagtgatcttaggagtgaaatttggagacaaccaagagctatcaaaagggtactcagtgatcgtagtcatcttcatctgcctctttgttgtagcgttcggatggtcatggggtcctctaggttggaccatacctagcgaaatctttccgttagagactcgttcagcggggcagagtatcacagtagctgtaaatctcctcttcactttcatcatagctcaagctttccttggtctcctctgtgcattcaagtttggaatcttcctcttctttgctggttgggtgacagtaatgactatctttgtgtatttcctgttgcctgaaaccaaaggagttccaatagaagagatgacactcttatggagtaaacattggttctggaaaaaagtattacctgatgcaacaaatcttgaagatgagagcaagaatgtatctgtttaa

SEQ ID NO: 807 - DNA, 861 bp, Arabidopsis thaliana
atgacgaaggaagtggttggtgataagagatctttctccgggaaagactatcaagacccaccacctgaacctctattcgacgctactgagcttgggaagtggtctttctacagagctctcatcgctgagttcatagccactctccttttcctctatgtcactattatgactgtcatcggttacaagagccagaccgatccagccctgaatcctgaccagtgtacaggcgttggcgtccttggtatcgcatgggcctttggtggcatgatcttcatcctcgtctactgcaccgccggcatctctggtgggcatattaatccggcagtgacttttgggctgttgttggctcggaaagtgacgttggtgagagcagtgatgtacatggtggctcagtgcctcggtgccatttgtggtgtggctttggtcaaggccttccagtctgcttacttcacccgctacggtggtggcgcaaatggtctctctgacggttacagcatcggcaccggtgttgcagccgagatcattggtacattcgtcttagtctacaccgtcttctctgccactgatcccaagaggagtgcgcgtgactctcacgttcctgtattggctccattgccaattggatttgcagtgttcatcgttcacttagctacaatcccaatcacgggcactggtatcaaccctgcaagaagtctcggagctgcaatcatctacaacaaggacaaagcttgggaccatcattggatattctgggtgggtccgtttgctggtgcagccatcgcagctttctaccatcagtttgtgttgagggctggtgcgattaaggcgctcgggtctttcaggagccagcctcacgtttaa

SEQ ID NO: 808 - DNA, 1878 bp, Arabidopsis thaliana
atgcctaactcgattctctttcttcttctttcattcctgtatctcacaaactgcgttgctcaatctccatcacaaacttgtcctttagatttctctcatgtcctaacaatcccatggaacacaacagattgtcaaaagtccgacaaatcagccgatagcaagaacagttgttgccaatctcttttaactctaatcggaatccctctagctcatcgtctcaaacaaacttccaatttccgtctcccaaatctcgctacttcaatctcttgtctcaacaatctccaaacgaagcttagttcactctctctatcttcgaatctcacctctctctgtttcgatccgaatcagttcgtcatcaataacgaaacctgtgctggaatccaaacgactcaagattgggtatctcgtctcggtccatctacggcgcttgactccgcctgtagcagtggtctcactgatctaacgcgatgcgacgcttgcgtggcggctgggtttagggttcaaaaacagctcatcactttggacggtaatagctctcacggtgtttattgttaccattttgtggttacttacgctgctggtattgttaacaagaaaggacctgagagtgatgatgctttgtcttgtctcttctctttgagtttgagatctccattgaactcaaagaagaaaagacacacggtggctcttgctttagggataaccggagctattttcggggctctggttattgccggtttgatttgtttgtatttccggtttggtaaagctgttaaaggaggagaggttggttgggaggatcaagggtctagaccgaaatggagaccaaacactggctctatctggttcaaaatcgaggaactagagaaagctacgaataacttctcgcagaagaatttcatcggtcgaggcgggtttggttttgtttacaaaggggttttaccagatggatcggttatcgcggttaagaaggtgatagagtctgagtttcaaggggatgcagagtttcgtaatgaggttgagatcattagcaatttgaaacataggaatcttgttccgcttagaggttgtagtatggtggatgatgatagtgagagtcagagatatcttgtttatgattacatgtctaatggaaatctcgatgatcacttgtttcctcgaggtgagactacgaagatgccattgagctggcctcagagaaagagcatcattttggatgtggctaaagggttggcttatttgcattacggtgtgaaacccgctatttatcaccgggatattaaaggtacgaacatattgttagatgtcgatatgagagcgagagttgcggatttcggtttagctaaacagagtagagaaggagagtctcatctcactaccagagttgcgggaacacacggttacttggctccagagtatgccctctatggtcaattaaccgagaaaagcgatgtgtatagcttcggggttgttatattggagatcatgtgtggaaggaaagctcttgatctgtctacttctggatcaccaaacacttttctgatcacagattgggcttggtcattggtaaaagcagggaaaacagaggaagctcttgagcagtctttgttgagagaggaaggctcagggctctcgaatccgaaagggataatggagagattcttgcaagttgggatattgtgtgcccatgtattggttgctttaaggccaacaatattagatgcattgaaaatgcttgaaggagacatcgaggttcctcctattccggaccgaccagtcccgctcgcgcatccttcgtaccgtatggacggaaacggattcacaatatcgcctgcgcttagcggactacaaatacattccggagatatgctcagatga

SEQ ID NO: 809 - DNA, 1185 bp, Arabidopsis thaliana
atgactcttttcaccgtttcgtgcctcctcgtggtactattcttatgtcattccttggtccatgccgaaaataatggttattacgggtatacccccacggttgccaactacctccccgagaaaccgcagaacatcatgaatccggtggactcctgttggcggctcaagtctgactgggctgccaatcgtaaagacctagcggattgcgtggttggattcggttcatctaccttgggcggaaagaaaggtaatttatacgttgtcacaaacccttacgacaatgcacagaatcctcaaccaggttctttgcggtacggcgtgatccaagccaaaccattgtggatcactttcgctaaggatatggtcataaccctagaaaatgagctcatggtcaatagctataaaaccattgatgggagaggggcaaaagtagaaatcgcatacggaccatgcatcacgatacaagacgtgacgaacgtaatcgtgcacgggatcagcatccacgactgcaaaccggggaagtacggtatggtgaggagtagcccgacgcatgttggtcaccgtaagggatcggacggtgatgcgatcgctattttcggttcatcgaatatttggatcgatcattgttacctagcgagttgtacggacgggctcatcgatgtgatccatgcttccacgggaatcactatttccaacaactatttcactcagcatgacaaagtgatgttacttgggcacaacgatgattttgtgcaagatgtgaaaatgaaagtgaccgtggcattcaatcattttggaccaggacttgtggagagaatgccaagagtaagacgagggtacgctcatgtggcaaacaatagatacgataaatggataatgtatgcaattggtggtagcgccgatccaaccatttttagtgaaggcaactatttcattgcttctgataaatctaacagcaaagaggtgacgaagagagaagtaaaaggaggatggaacaattggagatggagaacctcaaaagatgttttcaagaacggagcttacttcgtaccttctggttatggcagcatttcgctaccttacagttctgctcagcgattcacagtagctccgggaaacttggttccttctttaactgcagacgctggccctctaaactgcaaccgcaacggcccttgttattag

SEQ ID NO: 810 - DNA, 531 bp, Arabidopsis thaliana
atggtgaagtactctcaagagcccgataatatcaccaaatcttgcaaggcgagaggagccgatctcagggtccacttcaagaacactagagaaacagcgcacgccataaggaagctaccattgaacaaggccaaaaggtacttggaagatgtcatagctcacaagcaagctatccccttcacccgtttctgtcgtggtgttggtcgtaccgctcaggcaaagaacaggcattcgaacggacaaggtcgctggcctgctaaatctgctcaattcgttcttgatcttctcaagaatgctgagagcaatgctgaggtcaaaggtttggatgtcgatgcccttttcatttctcacatccaagtgaaccaagcagcaaaacagaggagaaggacatatcgtgctcatggaagaatcaatccttacatgtcaaacccatgccacattgagttgattttgtcagagaaagaagagcctgtgaagaaagagccggagacacagttggcagcaaagtcaaagaaaggagcctcatcttaa

SEQ ID NO: 811 - DNA, 369 bp, Arabidopsis thaliana
atgcaaatgctaagaagcttgagcacgaggacaagaagccgtcgtggaggatacgagagagtgagtgatgattcaactttcagtttactcggagcaaagctaaggagatcgacgagtgttccttactacgcaccatctataaagcttggagctggtggtgttccgaccattcttgaggagcttcctcgtcagaaatcaaagaaagtcaaaccaacaggcaaatttagtcacccaatctttagtcttttctacggaaagaagaagaagtcgacgacgacgaagcctgagttttctaggtatcttgagtatttaaaggaaggtggtatgtgggatgccagagctaatgcgcctgttatctattacaagtag

SEQ ID NO: 812 - DNA, 768 bp, Arabidopsis thaliana
atggctaatcacaaaaatctcttctttctatgtttcttaataggtttagggttatgttctgctagacgagcactactctcctcctctgaatccgaggctgaagtcgctgcctatggcgtgaatagtggtttaagtgctggtcttggtgttggtattggtggtggtcctggaggaggatctggttacggaggtggaagcggtgaaggcggtggagctggtgggcatggcgagggacatattggtgggggcggaggtggtggacatggtggtggtgctggcggaggaggaggtggtggccctggaggaggctacggaggtggaagcggtgaaggtggtggagctggatacggaggcggagaagctggtgggcatggcggaggtggaggaggcggagcaggcggcggtggaggtggtggtggtggtgcacatggtggaggatacggtggtggacaaggtgctggtgctggaggaggatatggaggtggaggtgccgggggacatggaggtggtggaggcggtggaaatggtgggggtggaggaggaggttctggcgaaggaggagctcatggtggtggttacggagcaggaggtggagctggagagggatacggtggtggtgctggagctggtggacatggtggtggaggaggaggcggtggtggttccggaggtggaggaggaggaggtggaggttatgctgctgcttctggatacggtcacggtgggggtgctggtggtggagaaggaagcggtggctatgtaccatga

SEQ ID NO: 813 - DNA, 2154 bp, Arabidopsis thaliana
atggatcaaatcgaagcaatgttgtgcggcggaggagagaagacaaaagtggcggttactacgaagactttggcagatccattgaattggggtttagcagcggatcaaatgaaaggaagtcatttagatgaagtgaagaagatggtcgaagagtatcgtagaccagtcgtgaatcttggcggagaaacactgacgatcggacaagttgctgccatctccaccgtaggaggcagcgttaaggttgagttagcggagacttcaagagccggtgtgaaagctagcagtgattgggttatggagagcatgaacaaaggtactgacagttacggagtcaccaccggctttggtgctacttctcaccggagaaccaaaaacggcaccgcattacaaacagaactcattagatttttgaacgccggaatattcggaaacacgaaggagacatgtcacacactgccgcaatccgccacaagagccgccatgctcgtcagagtcaacactcttctccaaggatactccgggatccgattcgagatcctcgaagcgattacaagtctcctcaaccacaacatctctccgtcactacctctccgtggaaccattaccgcctccggcgatctcgttcctctctcttacatcgccggacttctcaccggccgtcctaattccaaagccaccggtcccgacggtgaatcgctaaccgcgaaagaagcttttgagaaagccggaatcagtactggattcttcgatttacaacctaaggaaggtttagctctcgttaatggcacggcggttggatctggaatggcgtcgatggttctattcgaagcgaatgtccaagcggtgttagcggaggttttatcagcgatcttcgcggaggttatgagcgggaaacctgagtttaccgatcatctgactcatcgtttaaaacatcatcccggacaaatcgaagcggcggcgataatggagcacatactcgacggaagctcatacatgaaattagctcaaaaggttcacgagatggatccattgcagaaaccaaaacaagatcgttacgctcttcgtacatctcctcaatggctaggtcctcaaattgaagtaatccgtcaagctacgaaatcgatagagcgtgaaatcaactccgttaacgataatccgttgatcgatgtttcgaggaacaaggcgattcacggtggtaacttccaaggaacaccaatcggagtttctatggataacacgagattggcgattgctgcgattgggaagctaatgtttgctcaattctctgagcttgttaatgatttctacaacaatggacttccttcgaatctaactgcttcgagtaatccaagtttggattatggattcaaaggagcagagattgctatggcttcttattgttctgagcttcaatacttggctaatccagtcacaagccatgttcaatcagctgagcaacataatcaagatgtgaactctcttggtttgatctcgtctcgtaaaacatctgaagctgtggatattcttaagctaatgtcaacaacgttccttgtggggatatgtcaagctgttgatttgagacatttggaggagaatctgagacaaactgtgaagaacacagtttctcaagttgctaagaaagtgttaaccactggaatcaacggtgagttacatccgtcaaggttttgcgagaaggacttgcttaaggttgttgatcgtgagcaagtgttcacgtatgtggatgatccttgtagcgctacgtacccgttgatgcagagactaagacaagttattgttgatcacgctttgtccaacggtgagactgagaagaatgcagtgacttcgatctttcaaaagattggagcttttgaagaggagcttaaggctgtgcttccaaaggaagttgaagcggctagagcggcttatgggaatggaactgcgccgattcctaaccggattaaggaatgtaggtcgtatccgttgtataggttcgtgagggaagagcttggaacgaagttgttgactggagaaaaggttgtgtctccgggagaggagtttgataaggtcttcactgctatgtgtgaaggtaaacttattgatccgttgatggattgtctcaaggaatggaacggagctccgattccgatttgctaa

SEQ ID NO: 814 - DNA, 1473 bp, Arabidopsis thaliana
atggcaatcatcctctgtttcctcattctcttaccccttatcttaatcttcttgaaaaaactcaaacattcgaaatggaagcttcctccggggccaccaaagcttccgttcattggaaacttacaccaactccaagaactacctcccaggaatctcaaccacaagtacgggccagtgatacttctccgtttcggattcgtccccttggtcgtgatctcatctaaagaagcagcagaggaagttctcaagattcacgatcttgaatgttgtagccgaccagagacggccgggactagaaagatctcttacaactttaaagacatcggattcgcgccttacggtgaggaatggaaggccatgcgaaagctctcggtggtcgaactcttcaccgccaaaaaacatcagtattttaggtctatcagagaggaagagaatgacttgttggtcaagaaactaacagaattggctctgacacgatccccggtgaatttgaagaagacccttttcactttagtcgggagtattgtgtgtcggatcggattcgggtttaatcttcatgagtgtgagttcatcgatgaaaatagcatctccgaccttgttgacaagtctgagatacttgagatgacttctatgttctctgatttctttccaggaggaatcggtagattcatcgattggatctccggtcaaaacaagcgattcgataatgttttctcggacctcgacactttctttcaaaacattcttgattatcatcttaagcctggaagaaaagtagcagatagctctgatataatcgacgtggtgatcaacatgataaagaagcaagagaaagatggagactctttcaagctcacaacggatcatcttaaagggatgatctcggacatatttctagctggagttagcacaagtgcctccacactgatatgggcgataacagagttagttaggaaccgtaaagtgatgaagaaagtgcaagaagagattaggacaacactcggagacaagaaggagagaatcacagagcaagatctcaccaatctccattacttcaagcttgtggtcaaagagatattcagattacacccagcagttccatttttgctaccaagagagacattatctcatgtcaagattcaaggctacgacattcccgccaaaacccagatcatgatcaacgtctatgcgattgctcgcgatccaaaactttggacaaacccagatgagtttaaccctgacaggttcctagacagttccatagattacaaaggactaaattttgaactgttaccgtttgggtctggtaggagaatctgtccaggaatgacgatgggaatcacacttgttgaatttgctttattgaatttgctttacttctttgattggggtttgccggagaaggaagaggcggacaagatcatcaccggcaatggagttgctgttggcctagttcaagttcttctccactga

SEQ ID NO: 815 - DNA, 1710 bp, Arabidopsis thaliana
cttgagcatgttggtctagagatggacttacctgttatcatgatgtctgcggatgattcaaagagtgtggttctaaagggagtaacgcacggtgcggttgattaccttatcaagcctgtacgtatggaggcacttaagaacatatggcagcatgtagttaggaagaggagaagtgaatggagtgtaccggaacattctgggagcattgaggagactggcgagagacagcagcagcaacatagaggaggtggtggtggtgcagctgtttctggtggagaggatgcggtggatgataactcatcctcggttaacgaaggtaacaattggaggagcagttcacggaagaggaaagacgaggaaggagaagagcaaggagatgataaggacgaagatgcgtcgaatttgaagaaaccgcgtgtcgtctggtctgttgaattgcatcagcagtttgttgctgctgttaatcagctcggcgttgagaaggcggttcctaaaaagatcttagagctgatgaatgttcctggtctaacccgagaaaacgtagcaagtcacctccagaaataccggatatatctaagacggcttggaggggtatcgcagcaccaaggcaatcttaacaactcgtttatgacgggtcaggatgcgagcttcggacctctttcgacattgaatgggtttgatcttcaagcactagccgtcacaggtcagttacctgcacagagtcttgcacagcttcaagccgctggtttaggccggcctgcgatggtctctaagtcaggtttgccggtttcctccattgtggatgagagaagcatcttcagctttgacaacacgaaaacaagatttggagaagggcttgggcatcacgggcaacaaccccaacagcaaccacagatgaacttacttcacggtgtccccacgggtttacaacagcagcttcctatgggtaatcgaatgagtattcaacaacagattgctgctgttcgagctggaaatagtgttcaaaacaacggaatgctgatgcctctagcgggtcagcagtctttgcctcggggaccaccgcctatgctaacctcttcgcaatcatccatcaggcagccgatgttatcaaaccgcatttccgagagaagtggtttctctggaaggaacaatatccccgagagcagcagagtgttaccgacaagttacactaatctcacaacacaacactcatcaagctcgatgccttataacaacttccaaccagaacttcccgtgaacagtttcccgctggcaagtgcaccagggatatcagtaccggttcggaaagccacttcttaccaggaagaggttaacagctccgaagcgggtttcactacgccgagctacgacatgttcaccaccagacagaatgattgggatctgaggaatattggaatagcctttgactcacatcaggactcagaatccgctgcgttttccgcttcagaagcctactcttcttcgtccatgtcaagacacaacacgacagttgcagccaccgagcatggccgaaaccaccagcagccaccatcgggaatggtacagcaccatcaggtttatgcagacggaaacggtggttcagtgagggtgaaatcagagagagtggctacggatacagcaacaatggcgtttcacgagcagtatagtaatcaagaagatcttatgagcgcacttcttaagcaggtttga

SEQ ID NO: 816 - DNA, 1989 bp, Arabidopsis thaliana
atgaatatgagtgatttaggttgggatgatgaagataaatcggtggttagtgctgttttagggcatttagcttctgattttcttcgagcaaactctaattcgaatcagaatctctttcttgttatgggaactgatgatactctgaataagaagctctctagtctcgttgattggccaaactcggagaatttcagctggaactacgctattttctggcaacaaaccatgtctagatccggacaacaagtcttaggttggggagatgggtgttgtcgagagcctaatgaggaagaggaatcaaaagttgttaggtcttataattttaacaacatgggggcagaggaagagacatggcaagatatgaggaagagagtgttgcagaagcttcataggttgtttggtggatctgatgaagacaattatgctttgagcttagagaaagttactgctactgagattttcttcttagcttccatgtatttcttcttcaatcacggtgaaggcggtcctgggaggtgttattcttcagggaaacatgtgtggctctctgatgcagttaactctgagtctgactattgtttcaggtcttttatggcgaaatctgcgggaatcagaacgatcgttatggttcctactgatgctggtgttcttgagcttggttctgtttggtctttgcctgaaaacattggcttggttaagtctgttcaagctttgttcatgaggagagttacgcaaccagtaatggtgacttcaaacactaacatgactggagggattcacaagcttttcgggcaggatttgagtggagctcacgcgtatcctaagaagctcgaagtgagaagaaacttggatgagagattcactcctcaaagttgggaaggctataataacaataaaggtccaacatttggttacacacctcagagggatgatgtgaaagtgctagagaatgtgaatatggttgtagataataacaattacaagacgcagattgagtttgcgggatcatcagttgctgcttcttcgaatccatctacaaacactcagcaagaaaaatcagaatcttgtacagagaaaagaccagtgagcttgttagcaggagcaggaatagtttctgttgttgatgagaagagaccgagaaagagagggagaaagcctgcaaacggaagagaagagccattgaaccatgtggaagctgagaggcagagacgcgagaagcttaaccaaagattctacgctttacgatcagttgttccaaacatttctaaaatggacaaggcttctctacttggagacgcaatttcttacatcaaagagcttcaagagaaagtcaagataatggaagatgaaagagtaggaacagataagagcttatcagaatcaaacacaataacagtagaagaaagtccagaagttgacattcaagctatgaatgaagaggttgttgtaagagtaatctcgcctttggattcacatccagcttcaagaatcatacaagcaatgagaaactcaaatgttagtctaatggaggctaagttatcattagctgaagacacaatgtttcacacttttgtgataaagtctaacaacgggtcggatccattgacgaaagagaagcttatagcagcgttttaccccgagaccagctcgacgcaaccgccattgccttcttctagttcacaggtctctgggtttgtttctccgatcagatccaatttcaatccttctccgtcagattatctcctcggccacgatgtctctccgccgcactatcctcgatctccaccgtcaaacccagagagccactctctcaaagtctctacctttctcgatgagtcacatctcctccgcatccgccaccgccgccgtgagaaacccactgggaagagacctctcttcaatccccttcgcacaagcccagaaactgaaaccagattcaaccaatctcgtcaccgatcgctcgatttcgtcttcaattgggcaatctga

SEQ ID NO: 817 - DNA, 1227 bp, Arabidopsis thaliana
atgagaggtgggagtctatggcagctagggcaatcaataacccgtcgtcttgctcaatctgacaagaaggttgtgtcacgtcgctactttgcctctgaagctgacctgaaaaagactgctctttacgacttccatgttgcccatggaggaaagatggttccttttgctggttggagtatgccaattcagtacaaagattcgattatggactcaacggttaactgcagggaaaatgggagtttgtttgatgttgcacatatgtgtggtttgagccttaagggtaaagattgtgttccttttcttgagacacttgtggttgctgatgtggctggtttggctcctggaactgggagcttaactgtgttcacaaacgagaaaggaggtgccattgatgactcggtgattaccaaagtgacagatgaacatatctatttggtggtcaatgctggctgtagggataaggatttggctcacattgaagaacacatgaaggctttcaaatccaaaggaggtgatgtctcgtggcatatccacgacgagagatctcttcttgcccttcagggtcctttggctgctccagtgcttcaacacctgactaaagaagacttgagcaagctttactttggcaatttccagattctggacattaatggttccacatgtttccttaccaggactgggtataccggggaagatgggtttgagatttcggttccagatgagcatgctgtggatctagcaaaagcaatcttggagaagtccgagggtaaggtaaggcttacgggtctaggagcaagagacagtctcaggttagaagcaggactttgtctatatggaaacgacatggagcaacacatttctcctgttgaagctgggctcacatgggccatagggaagcgtagaagagccgaaggtggatttcttggcgcggatgtgattctccagcagcttaaagatggacctacaatcagaagggtcggtttcttctcctcaggaccacccgcaaggtcgcatagcgaggttcatgatgagagtgggaacaagattggagagatcacaagtggagggtttagcccgaacctgaagaagaacatagccatgggatatgtgaagtcaggtcagcacaagactgggactaaagtcaagatcttggtccgtgggaaaccatatgaaggcagcatcacgaagatgccattcgtggccaccaaatactacaaaccaacatga

SEQ ID NO: 818 - DNA, 1410 bp, Arabidopsis thaliana
atgagttcaagatctgacctcaaaatcaaacgagtttctttgataatcttcttgctaagtgttcttgttgagttttgctatggagggttcacaagtgaatatgtcagaggaagtgatttaccagatgacatgccactagacagcgatgtttttgaagttcctcctggtcataattcacctcaacaggttcatgtaacgcaagggaaccatgaaggtaatggagtgatcatttcttgggtgactccggttaagcccggttctaagactgttcaatattggtgtgagaatgagaaatcgaggaaacaagcagaagcaacagttaatacttaccggttctttaattacacgtctggttatattcaccattgcctcatcgatgatttggaatttgatacgaaatactactacgaaattgggagtggcaagtggtccagacggttctggttctttatcccgcctaaatcaggccctgacgtaccttacacatttggattaattggggatctaggacaaacttatgactcaaatagtacgttaagccattatgagatgaatccgggaaaaggacaagcggttctgtttgtaggagacttgtcttacgcggatcgctaccctaaccacgacaacaatagatgggatacttggggaaggttcgttgagcgaagtgttgcttatcaaccttggatatggactgctggcaaccacgaaatcgacttcgttcctgacattggtgaaatagaaccattcaagccttttatgaatcggtatcatacgccacataaggcatcaggaagtatctctccattgtggtattccatcaaaagggcgtcagcttatattattgttatgtcatgttactcatcttatgggatatacacacctcaatacaaatggctggaaaaggagttacaaggagtgaatcgaacagagacgccatggcttatagtcttagtgcatagcccgttttacagtagctatgtgcatcattacatggaaggtgaaacattgagagtcatgtacgaacaatggtttgtcaaatacaaggttgatgttgtgtttgcaggtcatgttcatgcctatgagagatcggaacgtgtttctaatattgcttacaacattgtcaatggattgtgtgagccaatatcggatgagtcagctcctatatacatcacaatcggggatggcggaaactcggaaggcttgcttaccgacatgatgcagccacaaccaaaatactccgcgtttcgagaagctagctttgggcacgggttgctagagattaaaaacagaactcatgcttacttcagctggaatcggaaccaagatgggaacgccgtggcagcagattctgtgtggttgcttaatcggttttggcgagctcaaaagaagacatggcttgatgcattttaa

SEQ ID NO: 819 - DNA, 1005 bp, Arabidopsis thaliana
atggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatctcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttag

SEQ ID NO: 820 - DNA, 564 bp, Arabidopsis thaliana
atgtcttcgccaagcaaacgcagagaaatggatatgatgaagctgatgatgagcgattataaagtggaaacgatcaacgatggcatgcaagaattctatgttgaattcaatggtcccaaagacagtctctatcaaggaggtgtgtggaagataagagttgagcttccagatgcttatccttataaatctccatctgttggtttcattactaaaatttatcatcctaatgttgatgaactgtcgggttctgtttgtttagatgtgattaaccaaacttggagtcctatgttcgaccttgtgaatgtgtttgagacatttcttcctcagcttcttctgtatccaaacccatcagatccattgaatggagaagctgctgcgttaatgatgcgtgatcgtcctgcttatgagcaacgagttaaagaatactgtgagaagtatgcaaagccaggggaaggttcagaagataagtctagcgatgaagaactaagtgaagaggaatacggctcagataatgaggatgatgatgatgatgatgttgcaattgctggcaaaccagatccttga

SEQ ID NO: 821 - DNA, 342 bp, Arabidopsis thaliana
atgtctgaacttgattcccaggtccctactgccttcgacccgtttgctgatgcgaatgctgaggactcaggtgcaggaacaaaggagtacgttcatattcgtgtccagcagcggaatggtaggaaaagcttgacaacggtccaggggctgaagaaagagtacagctacaccaagatacttaaggacctcaagaaagaattttgctgcaacggaactgtggttcaagactcagaactcggacaggttattcagcttcaaggcgatcagaggaagaacgtctccacgttcctagtccaggctgggcttgtgaagaaagataacatcaagatccatggtttctga

SEQ ID NO: 822 - DNA, 720 bp, Arabidopsis thaliana
atgagtaacgagcttctcaccatcgatcctgtcgaccttcaattcccttttgaattgaagaagcagatctcttgttctctctatttgggtaacaagaccgataattatgtcgccttcaaggttaagacgacgaatccaaagaagtactgcgttaggcctaatactggtgttgttcatcccagatcctcttctgaagttttagtgaccatgcaagctcaaaaggaagctcctgctgatctgcagtgtaaagataagttcttgcttcaatgtgtagtcgctagtcccggagccacccccaaggatgttacacatgagatgtttagcaaagaggcagggcatcgagttgaagagactaaattgagagttgtctatgttgctccaccacgaccaccatcaccggttcgagaaggatctgaagagggctcttcaccgagggcttctgtctctgataatgggaatgcttctgattttactgctgctccaagatttagcgcagacagggttgatgctcaggataattcatctgaggcaagagctctggtcacaaaactcaccgaggaaaagaactctgcggttcaactgaacaacaggcttcaacaagaattggaccagttgaggcgcgaaagcaagagaagtaagagtggtggaatccctttcatgtacgttcttctggtcggcctaatcggtttaatcctgggatacattatgaagaggacatga

SEQ ID NO: 823 - DNA, 1023 bp, Arabidopsis thaliana
atgtcttcaacacaagaagcgtctgttactgatttgcccgtgaagagacctagagaagcagaggaggacaataacggcggcgccatggaaacagagaacggtggaggagagataaaggagccttcttgtatgtcctctattattcctggatggttctctgagattagtcctatgtggccaggagaagcacattctctcaaggtagagaagattctattccaagggaaatcagattaccaggatgttattgttttccagtctgcaacatatggaaaggttttggttttggatggagtgattcaactcactgagagagatgaatgtgcgtatcaagaaatgatcactcatcttcctttgtgctctatctccaaccccaaaaaggtactggtgattggaggaggagatggaggagtcctgagggaagtggcacgtcatagttctgttgagcagattgacatttgtgaaatagataaaatggtggttgatgtggctaagcagtatttccctaatgtagcagttggatacgaggatcctcgtgtcaacctcatcattggcgatggtgttgctttcttgaagaacgctgctgaaggaacctatgatgcagttattgttgattcatctgatccaatcggtccagcaaaagagctatttgagaaacctttctttgagtcagtgaatagagctcttcgtcctggtggagttgtgtgcacacaagctgaaagcttgtggcttcacatggatatcattgaagacattgtttctaattgccgtgacatctttaaaggatctgttaactacgcttggaccagtgttccaacttacccgagtggagtcattggattcatgctttgttcatctgaaggaccacaagtcgatttcaagaagccagtgagtctaatcgatactgatgaaagctctatcaaatcacactgtcccttgaagtattacaacgctgagattcactcagctgctttctgcttgccctcttttgctaagaaggtgattgattcgaaagccaactag

SEQ ID NO: 824 - DNA, 990 bp, Arabidopsis thaliana
atggctggaaaactcatgcacgctcttcagtacaactcttacggtggtggcgccgccggattagagcatgttcaagttccggttccaacaccaaagagtaatgaggtttgcctgaaattagaagctactagtctaaaccctgttgattggaaaattcagaaaggaatgatccgcccatttctgccccgcaagttcccctgcattccagctactgatgttgctggagaggtcgttgaggttggatcaggagtaaaaaattttaaggctggtgacaaagttgtagcggttcttagccatctaggtggaggtggacttgctgagttcgctgttgcaaccgagaagctgactgtcaaaagacctcaagaagtgggagcagctgaagcagcagctttacctgtggcgggtctaaccgctctccaagctcttactaatcctgcggggttgaagctggatggtacaggcaagaaggcgaacatcctggtcacagcagcatctggtggggttggtcactatgcagtccagctggcaaaacttgcaaatgctcacgtaaccgctacatgtggtgcccggaacatagagtttgtcaaatcgttgggagcggatgaggttctcgactacaagactcccgagggagccgccctcaagagtccgtcgggtaaaaaatatgacgctgtggtccattgtgcaaacgggattccattttcggtattcgaaccaaatttgtcggaaaacgggaaggtgatagacatcacaccggggcctaatgcaatgtggacttatgcggttaagaaaataaccatgtcaaagaagcagttagtgccactcttgttgatcccaaaagctgagaatttggagtttatggtgaatctagtgaaagaagggaaagtgaagacagtgattgactcaaagcatcctttgagcaaagcggaggatgcttgggccaaaagtatcgatggtcatgctactgggaagatcattgtcgagccataa

SEQ ID NO: 825 - DNA, 729 bp, Arabidopsis thaliana
atggcgggagaagatagccgtgaagctcaacgaggcgacgaatatgaggaatcgagtcctctcttgaaggtgaacgagaatgacggcaagatctgctcgaaaagagatgccaaggcggcgcctcttgtgcctcctcccgcggcggaggaatacggctggacggcggatggattgcctgtgagccatggtagcgtgattggcgagccgatcaggagaaaccagtggaattctggtctttttacctgtcttggtcgcaatgatgaattttgcagcagcgatctcgaagtttgtcttcttggaagtgtggctccttgtgtgttgtatggaactaatgcagagagacttgggtctgctccgggaacattttcaaaccattgcttgacgtatttgggattgtactttgttggtaattctttgtttggctggaactgtcttgctccatggttctcttattctagccgttctgctattcgccgaaagtttaaccttgagggaagctttgaggctatgaacaggtcttgtggttgctgcggtggctgcatagaggacgagatgcaaagggaacacttggagacgacttgtgactttgtgacacatgtcctttgccatacatgtgccctttgccaagaagggcgtgagctccgcaggaaggttcttcacccaggtttcaatgctcagtccaccgttgttgtgatgccacccatagaacaaaccatgggtcgtaagtga

SEQ ID NO: 826 - DNA, 1596 bp, Arabidopsis thaliana
atgtctctcagacctagcgcgaagacggaggtgcgacggaatcggtacaaagtagcggtcgatgcggaggaaggacggcggaggcgagaggataacttggttgagatcaggaagaacaagagagaggaaaatttgcagaagaagagatttacgtcttctatggcttttggctcagcaacgggacaaacggaacaggatctttcttcagcgaaccaattaaaagataatctacctgctatggttgctggaatctggtcagaggatagcaattcacaattggaggcaacaaatctcttgcggaaactgctttctattgaacaaaatcctcctatcaatgaagttgtacaatctggtgttgttcctcgtgttgtgaagtttctttccagggatgacttccccaaacttcagtttgaggcagcttgggcgctcaccaacattgcttcagggacatcagagaacacaaatgtcatcattgaaagtggagctgtcccgatattcatccaacttctcagctctgctagtgaagatgtccgcgaacaggctgtttgggcattgggaaatgttgctggagactcaccaaaatgccgggatttagtcctaagttacggtgccatgacacctcttctgtctcaattcaatgagaatacaaagctttcaatgctgagaaatgctacatggacattatcaaacttctgcagagggaagcccccacccgcatttgaacagacacaaccagctttaccagttcttgagcgccttgtgcaatcaatggatgaagaagttctcacagatgcatgctgggctctgtcatacctctcggataattcaaacgacaaaatacaagcagtcattgaagcaggagttgttcctcgcctcatccagctcttaggtcattcgtcgccatcagtgctgattcctgctcttcgtaccattggaaatattgtaaccggggatgatctacagactcagatggttctcgaccagcaagcgcttccttgtcttttgaaccttctaaaaaacaattacaagaagagtatcaagaaggaagcttgctggactatctccaacattacagctggaaatgcagatcagatacaagcagtgattgatgcaggtataatccagtctcttgtttgggtgcttcaaagtgcagagttcgaagtaaaaaaagaagctgcttggggaatatcaaatgctacttctggtggcactcatgatcaaatcaagtttatggtgagccaaggctgtatcaaacctctatgcgatctccttacttgcccagatctgaaagttgtaacggtttgcttagaagcactagagaacattctcgtggttggagaagcagagaagaacttaggtcacacaggagaagacaacctctacgctcaaatgattgacgaagcagaagggttagagaagattgagaatcttcagagtcacgacaacaatgatatctacgacaaagccgtgaagatcctcgaaacattttggactgaagacaatgaagaagaaggcaacgacgagaatcatgctccacaatctggtttccagttcggaagcaccaatgttcctcctggtcaattcaactttatttga

SEQ ID NO: 827 - DNA, 1269 bp, Arabidopsis thaliana
atggccttctcttctctcctcagatctgccgcctcctacacggttgccgctcctcgccctgactttttctcgtcgccggcgtctgatcattctaaggtgttgtcaagtcttggatttagtcgcaacctgaagccatcaagattttcttctgggatatcttcatctctacaaaatggcaatgcaagaagtgtgcaacccatcaaggccacggctacagaagtgccatctgcagttcgaaggtcaagtagcagtggaaagacaaaggttgggatcaacggttttggtcggattggaaggttggtcctccgcattgcaacatcaagggatgatattgaggttgtagcagtgaatgacccattcattgatgccaagtacatggcttacatgttgaagtatgattctactcatggaaatttcaagggaagcatcaatgtcattgatgattctactttggagatcaatgggaagaaggtcaatgttgtcagcaagagagatccatctgagatcccatgggctgatcttggagctgattatgttgttgagtcttccggtgtattcaccaccctgtcaaaggctgcatcccatttgaagggcggtgccaagaaagttataatttctgccccttctgctgacgcacctatgtttgttgttggagtaaacgagcacacataccaaccaaacatggatatagtctccaatgcaagttgtaccaccaattgtcttgcccctcttgccaaggtggtgcatgaggaatttggtattcttgaaggcttgatgacaactgtccacgcaactacagctactcagaaaactgttgatgggccatcaatgaaggactggagaggaggtcggggcgctagtcaaaacatcattcctagctcaaccggcgccgcgaaggctgtaggtaaagttcttccagaactgaatgggaaacttacgggaatggccttccgtgtaccaacatcgaatgtttctgtggtggatttaacttgtcgacttgagaagggtgcctcttacgaagatgttaaggcagccattaagcatgcctcagaaggacctcttaaaggcattctcgggtacacagatgaagatgtcgtctccaatgatttcgtcggtgattcaaggtccagtatctttgacgccaatgctggtattggattgagcaagtcctttgtgaaacttgtctcttggtacgacaacgaatggggttacagcaaccgagttcttgaccttatagagcacatggctttggtagctgccagccactaa

SEQ ID NO: 828 - DNA, 1989 bp, Arabidopsis thaliana
atggctcaggttcaagctccttcttcacattctcctcctcctcctgctgttgttaacgacggggctgcgacggcttctgctacccctggaatcggcgtcggcggcggtggagacggagtcactcacggtgctctttgttctctctatgtcggagatctggatttcaatgtcaccgattctcagctttatgactatttcaccgaggtgtgtcaggttgtatctgttcgtgtttgtcgtgatgctgctaccaatacttctcttggttatggttatgtcaactacagcaacaccgacgatgcggagaaggcaatgcagaagttgaactacagttatctcaatgggaagatgattcggattacttactcttctcgtgactcttctgcccgtagaagtggggttgggaatttgtttgtaaagaatttggataagtcagttgacaacaaaactctgcacgaggcgttttccgggtgtgggactattgtgtcctgtaaggttgctactgatcacatgggtcagtctagaggatatgggtttgtgcagtttgacactgaggattcagctaagaatgctattgagaagctgaatgggaaagtgttgaatgacaaacagatttttgttggaccttttcttcgtaaggaggaaagagagtctgctgctgataagatgaagtttactaatgtttatgtgaagaatctttcggaggcgactactgacgatgagttgaagactacttttggtcagtatggtagtatctcgagcgctgtagttatgagggatggagatgggaaatccaggtgttttggatttgtcaactttgagaatcctgaagatgcagctcgtgctgttgaagctctcaatggaaagaagtttgatgataaggagtggtatgtgggtaaagctcagaagaaatctgagagggaacttgagttgagccggagatatgaacaaggctcaagtgatggtggaaacaaatttgatgggttgaatttatatgttaagaaccttgatgataccgtcaccgatgagaagttgcgcgagttgtttgccgaatttggtacaatcacctcttgcaaggttatgcgggaccctagtggtactagcaaaggatcaggatttgttgccttctctgctgccagtgaagcttcaagagtgctgaatgaaatgaatggtaaaatggttggtggcaaaccgttgtatgttgctcttgcacagaggaaagaagaaaggagggctaagctgcaggcacagttttctcaaatgagacctgcttttatccccggtgtgggtcctcgaatgccaatatttacaggtggtgctccaggtcttggacaacagattttttacggtcaaggacctccaccaatcatccctcaccagcctggatttggatatcagcctcagctggttcctggaatgaggccggccttttttggtggaccgatgatgcagccaggtcagcaaggtccacgaccaggtggcagacggtcaggtgatggacccatgcgccatcagcatcagcagccaatgccttacatgcagccacagatgatgccaagaggacgagggtaccggtacccttctggtggtagaaacatgcctgacggtccaatgccaggaggaatggttccagttgcttatgacatgaatgtaatgccgtatagtcagcctatgtccgctggtcaattggctacttcccttgctaatgctacacctgctcaacagagaacacttcttggtgagagtctatatccattagtggaccagatagagagtgagcacgctgcgaaagtgactggtatgcttctggaaatggatcagaccgaggttttgcatctgctcgagtcaccagaggctctaaatgccaaagtttcagaggcattagatgtgttgagaaacgtgaatcagccatcttcacagggaagtgaaggcaacaaaagtggaagtccaagtgatctcttggcttcactttccatcaatgatcatttatga

SEQ ID NO: 829 - DNA, 1353 bp, Arabidopsis thaliana
atgagggagatcattagcattcatatcggacaagctggtattcaggtcggaaattcttgttgggagctttattgtctcgaacatggtatccaacccgatggcaccatgcccagtgatagtactgttggtgcatgtcatgatgcattcaacacattctttagcgagacaagctcaggccaacatgtgcctcgagctgtgtttcttgatctcgaaccaaccgtcattgacgaagtaagaaccggcacttacagacagcttttccatcccgagcaacttatctctggcaaagaagatgcagccaataactttgctagaggccattacactgttggaagggaaattgttgacacctgccttgaaaggctgaggaaattggcagacaattgcacagggttacaaggatttttggtattcaatgctgttgggggtggaacaggttctggtttgggttctttactgttggagcgcttgtccgtagattttggaaaaaaatcaaaactcggtttcaccatctacccttctcctcaggtttctacagcagttgtggagccgtataacagtgttctctcgactcattctcttctcgaacacacagatgttgttgttcttttggacaatgaagccatatacgatatctgcaggagatctttagacattgagaggcctacatactccaatttgaaccgcttgatctcccaaaccatctcttcgcttacaacttctctaagatttgacggtgccatcaatgtggacatcaccgagttccagaccaaccttgtaccttaccctcggatccacttcatgctctcctcttatgcacctgtgatttcatctgcaaaggcctaccatgagcagttttcggtccctgagatcacgacttccgtctttgaaccctccaatatgatggctaaatgtgaccctaggcatggcaagtacatggcttgctgtttgatgtatcgtggtgacgttgtgcccaaggatgtcaatacagccgttgctgccatcaaagccaaacgaacaattcagtttgttgactggtgcccaactggattcaagtgcgggataaactaccagccgccttccgttgttccaggtggtgacctggctaaggttcaacgagcggtttgcatgatcagcaataatactgcagttgctgaagtgttctcacgtatagaccataagtttgatctcatgtactccaaaagagcctttgtccattggtatgtaggagagggtatggaagaaggagagttctctgaggctcgtgaggatcttgctgccctcgagaaagattatgaggaagttggtggagaaggagcggaggacgacgacgaagaaggcgatgagtattag

SEQ ID NO: 830 - DNA, 1497 bp, Arabidopsis thaliana
atgatggcttcaaaaactccagaaggatcacttaccaattccagtcaaagtatgtcaatcaacactttagcagatcaagtatcttcgagtttgtctttcgctgatccaagtagtgatggcaaaaccggtaatagtaagatcaacgagcaaggtgagagtggaaagagtagcacttgtagaccaagtacaagcagtgatataagcgatgagagcacttgtagcagctttagtagcagtatcaacaaacctcacaaggctaatgatgtgagatgggaagctattcaagctgttagaactaaacatggtggtttgggtttgaatcattttaggctcttgaagaggttaggatgtggagatattggaactgttcatcttgctgagttgaatggaactaggtgttattttgcgatgaaggttatggataaaactgctttggctagccggaaaaagcttcttagggctcaaactgaaagagagatattgcagtgtcttgatcacccgtttcttccgactttgtatagtcattttgagacagagaagttctcttgtttggtgatggagttttgtcctggtggtgatttgcatacactaaggcagagacaacccgggaaacgcttcaccgagcaagcagctaagttttatgtcgcggaagtgcttcttgcaatggaatatttacacatgcttgggatcatttaccgtgatctgaaacccgagaacgttcttgtgagagatgatgggcacgtgatgctttcggattttgatctctccctgagatgtactgtgagcctctctatagtcagatcagctaatgttggatccgaaggcttgtcgaagaattcggtttcttgctcgcaacaacctgcatgcatccagcaaccatcttgcatctcaatggctccaacatcttgcttcggtcctcggttcttctcatcgaaatccaagaaagacaagaaaccgaaaaccgaaaacgggaaccaccaagtaactccgttaccagaactcgttgcagagcccacaggcgcccgttctatgtcttttgttggcacacacgagtacttagctccagagatcatcaaaggtgaaggacatggaagtgcagttgattggtggacctttgggatctttctttatgaactattgtttggtaaaacaccgtttaaagggtcaggaaatcgagcaacgctcttcaacgtggttggtcagcctcttagattccctgaatctccggttgttagcttcgcagctagggatttgataaggagtttgcttgtgaaggagccacaacatagattagcttataagcgtggagcaacagagataaagcaacatcctttctttgaaggagtgaattgggctctggttcgatgtgccagtccaccggagattcctaaaccggttgatcttgaagctttgaatcctactcctactgtgccagcagccgcatcttcgagtgtaagatctgatcagagtaattatcttgagtttgatttcttctga

SEQ ID NO: 831 - DNA, 1515 bp, Arabidopsis thaliana
atggtgggatcagaggttttggaggaatgtggagaaaaaataagcaagaaagagtcaaagaagcgagccgctaaactggagaagttgctccgtaaacaggaacgagaagaagccacatcatcatctctttctctggaggaggaggatgaatcgtgttccagcaactacggtgacgtgactactaacgagttgcagtcggctgttgagggaaaagagctcactgatgtgagcaacttggttgaagagattgtggggtcagaggtttcgatcagaggtcgactgcacaagaatcgcttagtcggtaccaaattgtttgtgatcttgagggaaagtggattcacggttcaatgcgtggtggaggagaccagagttggtgcaaacatgattaaatttgtcaagcagctgagtcgtgaatctgttgttgagcttatcggtgtcgtctctcaccctaagaagcctctcacaggaaccacccagcaggttgaaatacatgtcagaaaaatgtactgcctcagcagatccttgccaaatttaccacttgttgtggaggatgctgctcgtagtgaatcagatattgaaaaatctggcaaggacacacgtttgaataatagggttcttgacatcagaacaccggctaatcaagccatcttccgtattcagtgccaagtccaaattgcgttcagagaatacttacaatccaaggggtttcttgaaatccacacaccgaaattgatcgctggcagtagtgaaggaggttctgctgtgtttaggttggactacaaagggcagcctgcttgtctggctcagtctcctcagcttcataagcagatggcgatatgtggtgacatgcgacgcgtctttgaggttggtcctgttttcagagctgaagactccttcactcatagacacctgtgtgaattcgttggtcttgatgtggagatggagattcgaatgcactactctgagataatggatcttgtgggggagttgtttccgttcatattcacaaaaatagaagaaaggtgcccaaaggaacttgaatctgtcagaaagcaatacccttttcaatctttgaaggaagctggcgaggaggttgatcctcttggtgatctaaatacagaatctgagaggaaacttggccagcttgttctggaaaagtacaagacggagttctacatgctgcatcgctatccatcggctgtcagaccgttctacactatgccctatgaaaatgattctaactacagcaactctttcgatgtcttcatcagaggagaggagatcatgtcaggagctcaacgtatccatgacccagaactcttggagaagcgcgcaagagaatgcggcattgatgtcaagacaatatccacgtacattgatgcattcaggtacggtgcaccacctcacggtggattcggagtggggctggagcgtgtggtaatgctcttatgtgccctcaataacatccgcaaaacttcgctattccctcgtgactctcaaaggctcactccctaa

SEQ ID NO: 832 - DNA, 609 bp, Arabidopsis thaliana
atgaatcctgaatatgactatttgttcaagcttttgctcattggtgattctggtgttggaaagtcgtgcttgcttctaaggtttgctgatgattcctacctggatagctacatcagcaccattggtgtcgactttaaaatccgaacagtcgaacaagatggaaagaccatcaaactccagatttgggatacggcaggccaggaacgtttcagaacgattactagcagttactacagaggagctcatggaattattgtgacttatgatgtaacagatctagaaagcttcaacaacgtcaagcaatggctaaatgaaatcgaccgctatgcaagtgagaatgttaacaagctactggttgggaacaagtgtgatctcacatcacagaaagttgtatccactgagacagctaaggctttcgctgatgaacttgggatcccattcttggaaacaagtgctaagaatgctaccaatgtcgaagaagctttcatggccatgactgctgcaatcaagaccagaatggcgagccaacctgcaggaggatctaagccaccaacggtccagatccgaggacaacctgttaaccagcaatcaggctgctgctcctcttaa

SEQ ID NO: 833 - DNA, 2280 bp, Arabidopsis thaliana
atgtggaaactgaagatcgcggaaggaggtagtccatggcttagaaccaccaataatcacgtcggaagacagttttgggagttcgatccgaatctcggtactcctgaggatctcgccgccgtcgaagaagctaggaagtctttttcggataatcgattcgtgcagaaacatagcgccgatctgcttatgcgccttcagttttcaagagaaaatttgattagcccagttttacctcaagtcaaaatcgaagacactgatgatgttacagaggagatggtggaaaccacgttaaagaggggtctagatttctattcaactatacaggcacacgacgggcactggccaggtgattatggtggtcctatgtttcttctcccaggactgataattacactctccataactggagcactgaatacagtattgtcggaacaacataaacaagaaatgcgccgttatctctataatcaccagaatgaggacggaggttggggtttacatattgagggccctagcaccatgtttgggtctgtgttgaactatgttactctaaggttgcttggagaaggacctaacgatggagatggagatatggagaaaggacgagactggatactaaatcatggtggtgctaccaatattacatcttgggggaaaatgtggctatcggtacttggagcttttgaatggtccggaaataacccactgccacctgagatatggcttctcccatatttcctgccaatacatccaggaaggatgtggtgccattgtcgaatggtgtacttgccgatgtcgtatttgtatggaaaaaggtttgtgggtcccataacgtccactgttttatcactgagaaaggagcttttcacagtaccatatcatgaagtcaactggaatgaagcacgcaacctttgcgcaaaggaggatttatactacccacatccacttgtgcaagatattctttgggcatcacttcataagattgttgagcctgttctgatgcgatggcctggtgcaaatttgagagaaaaggctataagaaccgcaatagaacatattcattatgaagatgagaatactaggtacatctgcataggtcccgtgaacaaggtattaaatatgctttgctgttgggtagaagacccaaactcagaggctttcaagttgcacctaccaagaatccatgactttctctggttagctgaagatggaatgaagatgcagggttataacggaagccagctatgggatacaggttttgctattcaagcgattttggcaactaacctcgtcgaagaatatgggcccgttttggaaaaagcacattcatttgtcaagaattcccaggtgttagaagactgccctggagatctgaattactggtatcgccacatttctaaaggggcttggcctttctcaactgcagatcacggttggcccatctctgactgcaccgcagaaggactgaaagctgctcttttgctatccaaagttcccaaggcgattgttggtgaaccaatagatgcaaaacggttatatgaagctgttaatgttatcatttctttacagaatgcagatggaggcctcgcaacatatgagctcaccaggtcatacccttggttagagctaatcaacccagcagaaacctttggcgatattgttattgattatccttacgtggaatgtacatcagctgctatccaagctttgatatcatttcgaaagctgtatcctggtcatcgaaagaaggaagtagatgagtgcattgagaaggcggttaagttcattgaatccattcaagcagcagatggctcatggtatggatcatgggctgtttgcttcacgtatggtacgtggtttggagtgaaagggctggtagctgttggaaaaacattgaaaaactctccacatgttgctaaagcttgtgaatttctattgtcgaaacaacaaccttcgggcggctggggagaaagctatctttcatgtcaagacaaggtctattcaaaccttgatggcaacagatctcacgtcgtgaatacagcatgggctatgctcgcactcattggtgctgggcaagctgaggtagaccggaaaccactacaccgggctgcaagatacttgattaatgctcaaatggagaatggtgattttccacaacaggaaataatgggagtcttcaataggaactgcatgataacatatgccgcgtatcgaaacatttttccgatatgggctttgggggagtaccgttgtcaggtattattgcaacaaggagaatga

SEQ ID NO: 834 - DNA, 3066 bp, Arabidopsis thaliana
atgatatctctgtatcaaatattggccgagaagaagaagaagaagaaaaatgatcttaacatctttgcattttctgtttttgccatcatttgcttcaaattttatagtgtaaatgctatcaaattaccgcagcaagaagtcgatgctctgcagcaaatcgctaccacattgggctcgaaattctggaaattcgatgctgaaaattgtaagattgaaatggtggggttaactgaaactcctcctccaacagctaagcaagaaatagaatgtgaatgcagtcccactaacgacactgattgtcatgttgtcaaatttgcattcaaggaccataatcttccaggaactcttcctcaaatagtcaagcttccctaccttcgggagatagacttggcctacaactacatcaatgggaccttacctcgtgaatgggcttcttcaaatttaacttttatttctcttcttgtgaatcggttgtctggagaaattccgaaggagtttggaaactcttctctaacatacttggatctcgagtcaaatgcgttttctggaactattcctcaggagcttgggaacttagtccacttgaaaaaactgttgctttcctctaacaaattgaccggaactttgccagcttcactagctagactacagaatatgacagatttcaggattaacgatcttcaactcagtggaacgatacctagttacatacaaaattggaagcaactcgagagacttgaaatgattgcatctggtctcactggtccaatcccatcggtcatctcagttctgagcaatcttgttaatctgaggatcagtgatatacgtggaccagtccaaccattcccttcgttgaagaacgtgacaggtctaactaaaattatattgaagaactgtaacatttctggacaaattcctacttatctttcacatttgaaggagttggagacactggatttgagttttaacaagttggttgggggaattccgtcgtttgcacaagcagaaaatttacggtttataattttggctggaaatatgctcgagggagatgctccagatgaattactaagagatggaatcacagtagatctttcatataacaatctcaagtggcagagtcctgaaagtcgtgcttgtcgcccaaatatgaatctgaatctaaacttgtttcagagcacttcgacaaaaaaatcgagcaaatttctgccgtgtatcaaagatttcaaatgtcctcgatattctagctgcttgcatgtgaactgcggtggaagcgatatgtatgttaaggagaaaaaaacaaaagaattatatgaaggagatggaaatgttgaaggtggtgctgctaagtattttttgaagcctgacgctaattggggatttagcagcacaggggacttcatggacgataacaatttccaaaacactagattcaccatgtttgtcccggcatctaaccagtctgatctctacaaatcggcacgaattgctccagtatctctaacttacttccatgcctgcttggaaaatggaaattacactataaatctagacttcgctgagatacggttcaccaatgatgaaaactataaccggcttggaaggcgtctgtttgacatttacattcaggagaaattagtggcaaaggactttaacatcatggatgaagcaaagggagctcaaacacctataatcaaaccacttactgcctatgtgacaaaccactttttaaccatccggttgagttgggccggtaaaggaactaccaggattcccactagaggggtttatggtcctatcatatcggctatttccatagtttcagattccaagccgtgcgaacgtccgaaaactggaatgagccctggagcatatattgcaattggaattggagcaccatgtcttattatctttatactgggatttctgtggatatgtggctgcctcccaagatgtggtcgacaacgaaaagatccgtatgaagaagagttgccttctggaacttttacattgaggcaaatcaaattcgctacggatgacttcaatccaactaacaagattggagaaggtggtttcggtgctgtctttaagggtgtgttagcagatggaagagttgtagcagttaagcaactctcatctaaatcgagacaagggaaccgagaatttctaaacgagataggcgcaatttcttgtcttcaacatccaaatctcgtcaagcttcatggtttctgcgtcgagcgggctcagctattactggcgtacgaatacatggaaaataacagtttatctagcgcgttattcagtccaaagcataaacagataccaatggactggcctactaggtttaagatttgctgcgggatcgcaaagggtctcgcgtttctccatgaggaatcaccgttgaagtttgtacatagagacatcaaggccacaaatattttattggacaaggacttaactcccaagatatctgatttcggattggctaggcttgacgaagaggagaaaacacacatcagcaccaaagttgctgggactataggatatatggcaccagaatacgcactgtggggctacctaactttcaaagcagatgtctacagcttcggtgttttggttctagaaatcgtcgccggcataaccaacagtaatttcatgggggcaggagattccgtttgcctcttagaatttgctaacgagtgcgtagaatcggggcacttgatgcaagtagtggatgagaggttgaggcctgaagtggatagaaaagaagcagaggcggttataaaagtggctctcgtgtgctcgagcgcttctccaacagatcgtcctttaatgtcagaggtcgttgctatgctagaaggtctatatccagtgccagaatcaacaccaggagtaagcaggaacgcaggggatataaggtttaaggcatttaaagatttaaggagaggcatggagaacaatagtaagacgcagtgttctgttaaaagctatccgtcttcttcttcgacttcttctggggcaggacaagcagttcaagaaagaaagaaagaagagtcaaggccttga

SEQ ID NO: 835 - DNA, 1509 bp, Arabidopsis thaliana
atggaagaaaccaacattagagttgttctctactccattttctctctcatcttcttgataatctctttcaagttcttaaaaccaaagaaacagaatcttccaccgtctccgccgggatggttgccaataataggccatctccgccttctgaagccacccatccaccgcaccctccgctccttctccgagaccctcgaccacaacgatggtggcggcgtgatgtccctccgacttggatcccgtctagtctacgtggtgtcgtcacataaggttgcggcagaggagtgctttggcaagaacgacgtcgttctagctaaccggccacaggtgatcatcggaaaacatgttggttataacaatacaaacatgatcgctgcaccttacggtgatcactggcgtaacctccgtcgcctctgcactatcgagatcttttcaacacaccgccttaactgctttctttatgtccgtaccgacgaagtacgtcgccttataagccgcctctctcgtctcgcaggaaccaaaaaaactgttgtggaattgaaaccaatgcttatggacttgacattcaacaacataatgagaatgatgaccggaaaacgatactacggtgaagaaacaaccgatgaggaagaagcaaagcgtgtccgtaagttggtagcagatgttggggctaacacgagttcaggcaacgccgttgactacgtccccatcctcagactgttttcaagttatgaaaatagggttaaaaagttaggagaggagacagataagtttttacaaggtctcattgacgataaacgtgggcaacaagaaaccggtactacaatgatcgatcatttgcttgtcctccaaaaatctgatattgagtattacactgatcaaatcatcaaaggcatcatactgataatggtaatagcagggactaacacatcagcagtcactctagaatgggcactttccaatttgcttaaccatcctgacgtaatatctaaagcgagagacgaaatcgataaccgggttggtttagaccggcttatcgaagaagcagatcttagcgagctaccatatctaaagaacattgtccttgagacccttaggctacacccagctacaccattgctagtcccacacatggcatcagaagattgcaagataggatcctacgatatgccacgtggtacaacgttgttggtgaatgcatgggccatacatagggatccaaacacgtgggatgatccggatagctttaaaccagagcggtttgagaaagaagaggaagcacaaaagcttctggcgtttggattaggtagaagagcgtgtcctggatcgggtctggcccaacgaatcgtgggactagctctcgggtcattgatacaatgctttgaatgggagagagttgggaatgtggaagtggatatgaaggaaggagttgggaatactgtacccaaagcgattcctttgaaagctatttgcaaagctcgtccatttctacataagattatttcctaa

SEQ ID NO: 836 - DNA, 651 bp, Arabidopsis thaliana
atggctgctcctcctgctagagctcgtgctgattacgattacctcattaaacttctgctgatcggagacagcggtgttggtaagagttgccttctcttacgtttctcagatggctcgtttaccaccagtttcattacaactattgggattgattttaagatacggactattgagctcgatgggaagagaattaagctgcaaatctgggatactgccggacaggagcggttccgcacaatcacaactgcgtactaccgtggagccatggggattttgcttgtgtatgatgtgactgatgaatcatctttcaacaacatcaggaattggatccgtaacattgagcagcatgcttctgatagtgtcaacaagattctagttgggaacaaagcagatatggatgaaagcaaaagagctgtgccaaaatctaagggccaagctcttgcagatgaatatggaatgaagtttttcgagactagtgccaagactaacttaaacgttgaggaagttttcttctctattgctaaagacattaagcaaagacttgcagataccgatgcacgagctgagccgcaaacaatcaaaatcaaccaatccgaccaaggtgcgggaacatctcaagctactcagaaatcagcatgttgcggcacataa

SEQ ID NO: 837 - DNA, 888 bp, Arabidopsis thaliana
atggaagcattaactacttcaagggttgtgccagttcaggtcccctgtagaaagctctcttcactttttgctaatttttcttgccttgagttaaggagatatccttgtagaggtcttgtctccattatgaaccatcccaaattgcttcgtccagtgactgcttctgtgcagcctcacgagttgtcgactttggggcatgaaggcaacattgttccttctaaagaaattcttgatctttggagaagtgttgaagcggtatgtttcgatgtggacagcacggtttgtgtggatgaaggtattgatgaacttgctgagttttgtggagctggaaaggctgttgctgaatggactgccagagctatgggtggatctgttccatttgaagaagctctagctgcaagactttctttattcaagccttctctttcaaaagtagaggaatatctcgacaagagacccccaaggctatctcctggcattgaagagttggtcaagaaactcagagccaataacattgatgtctatttgatatctggaggttttcgacagatgatcaatcctgtagcatcgattcttggcatccctcgggagaatatctttgccaacaatcttctatttggaaactccggcgagtttctgggatttgatgagaacgaacctacgtcaagaagtggaggcaaagccaaggcagtgcaacaaatacgaaagggtcgtctctacaagactatggccatgattggagatggtgctactgatctcgaagcacgtaaacctggtggcgcagatttgttcatatgctacgctggagttcagcttcgtgaagccgttgcagcaaatgcagactggcttatctttaagtttgaatctctcataaactcattggactaa

SEQ ID NO: 838 - DNA, 546 bp, Arabidopsis thaliana
atgaacctagaagagaaaccaaccatgacggcttcaagggcttcccctcaagccgaacatctctactacgtccggtgtagcatctgcaacaccatcctcgcggttgggataccattgaagagaatgcttgacacggtaacggtgaaatgcggccattgtggtaacctctcgtttctcaccacaactcctcctcttcaaggccatgttagcctcacccttcagatgcagagctttggtggaagtgactataagaagggaagctcttcttcttcctcttcctccacctccagcgaccagcccccatctccctcacctccctttgtcgtcaaacctcctgagaagaagcagaggctcccatctgcatacaaccgcttcatgagggatgagatccaacgcatcaaaagtgccaatccggaaataccacaccgtgaagctttcagtgctgctgccaaaaattgggctaagtacatacccaactctcctacttccattacttccggaggccacaacatgatccatggcttgggattcggtgagaagaagtga

SEQ ID NO: 839 - DNA, 774 bp, Arabidopsis thaliana
atggcttctttgttcaaggagcaagcaaagctatcagcttatcgtgatagaagattttcaggaacacaagaggagtttgatgaagcgctaagagcatctacaacggtttacattggcaatgtgtctttttacactactgaagaacagctttacgagcttttctctagagctggagaaatcaaaaagatcatcatgggtttggataagaacactaaaacaccttgtggcttttgtttcgtcctgttctactctagagaggatactgaagatgcagtcaagtatataagtgggactattctcgatgaccggcctattcgtgtggattttgattggggattccaagaaggaagacaatggggccgtggtagaagcggtggccaggttcgtgatgaataccgtacagattacgatcctgctagaggtggttatgggaaattagttcagaaggaactcgaagcacaaaggcagctcgtggattacggtactggctcattgggagcttatcctcaagctgcgccaacgaattatggaaatggaaggcgtggtggtggaaactatggtcaaggaggacaaaatcgccatggaagaggagactaccatcggaaacgacaaagagacgatgatcgctatggccgcgataactcaagaagaaacacagatcatgagtctaggagagacactgatagtgacatgagaccggagaagaacccacgattccgtgagagcggtgactccgatgacgatggtgaagatgatcggaagagaagatcttaa

SEQ ID NO: 840 - DNA, 1389 bp, Arabidopsis thaliana
atggcgagagttctagtctcgtctccatcttcattcttcggttcaccgttgattaaaccgtcgtcatctctccgtcacagtggagtaggaggaggaggaaccgctcaatttcttccataccggagtaataataacaaactcttcactacttcaaccaccgtacgattcagcttaaacgagattcctcctttccatggcttggattcatctgtagacatcggagcgattttcaccagagctgaatctcttctctatacaatagctgacgccgccgttgttggtgctgattccgtcgtaactactgattcatccgccgtgcagaagagtggtggttggtttggttttatctccgatgctatggaattggttcttaagattttgaaggatggattatcagcggttcatgtaccttatgcttatggatttgcgattatcttgcttacgattatcgtcaaagcagcgacgtatcctttgactaagcaacaggttgaatcaacactagcgatgcaaaatcttcaaccgaaaatcaaagcgattcaacaacgttacgcaggaaatcaggagaggatacaactagagacatcgcgattgtataaacaagctggtgttaatccgttggcaggttgcttaccaactttagcaaccataccagtttggattggtttataccaagctctctctaacgtggccaacgagggattgtttacagaaggtttcttttggattccatctctgggtggaccaacatctatagctgctcggcagagtggatccggcatttcgtggctttttccgtttgtggacgggcatccaccattgggatggtatgacactgtagcttatcttgttctacctgttctacttattgcctcccagtatgtgtcaatggaaattatgaagcctcctcaaactgatgatcctgcacagaagaatacgcttcttgttttcaagtttcttccactcatgatcggttactttgcattgtctgtcccatcaggactatctatttactggctcacaaataatgtacttagtaccgcccaacaagtatatctgcgtaaactaggtggtgcaaagccaaatatggatgaaaacgcaagcaaaataataagtgcgggacgagcaaagagatctattgctcagcctgacgatgctggcgaaagatttagacaattaaaagagcaagagaagcgcagcaagaagaacaaggcggttgcgaaagatacagttgaattggtagaagaatctcagtctgaatcagaagaagggtctgatgatgaggaagaagaggctcgtgaaggagcgttagcttcgagcacaacaagcaagccgcttcctgaggttggccaacgaagaagcaaaagatcgaagcggaaacgcactgtatag

SEQ ID NO: 841 - DNA, 1068 bp, Arabidopsis thaliana
atggaagcagttcgttcaacaacaaccttatctaattttcatctactgaatattttagtcctgcgttctctcaagcctctgcatcgtctatctttctctttctctgcctcagcaatggagagtgatgcatcttgtagcttagttttgtgtgggaaatcctctgtggaaactgaggtagcaaagggtttgaagaacaagaactctcttaaactcccagataataccaaagtttcactcattttagaatctgaggctaagaatttggttaaagatgatgataattccttcaatctttcactctttatgaactcgattataactcatcggtttggacggtttctcatttggtctccgcgtttgtcttccactcacgatgttgtttctcataacttctctgagcttccagttggttcagtttgtgtcactgatatccagtttaagggtcgaggcagaacaaagaatgtatgggaatctccaaagggttgtcttatgtattcttttactctagaaatggaagatggtcgagtcgtgcctttgatacagtatgtggtatctcttgctgtaactgaggcagtgaaagatgtttgtgacaagaagggtttgccgtacattgatgttaaaataaagtggccaaatgatctgtacgtgaatggtcttaaggttggaggcattttgtgtacctctacgtatagatcaaagaagttcaatgtcagtgttggtgtggggttgaatgtggacaacgggcaaccgaccacgtgcttaaatgcagtactaaaaggcatggctcctgaatcaaacctacttaaaagagaggaaatccttggtgccttctttcataaatttgaaaaattcttcgatctattcatggaccaaggttttaaatctctcgaagagctttactacaggacatggctacacagcgagcaaagagtgattgttgaagacaaagtagaggaccaagttgttcaaaatgttgtgactatccagggtttgacttcttctggatatttgctggctgttggagatgacaatcaaatgtatgagcttcaccctgatggcaataggtaa

SEQ ID NO: 842 - DNA, 774 bp, Arabidopsis thaliana
atggcaatgttgggcttggttttatctgttcttactacaattcttgcattgtctgaagcaagaatcccaggagtttacaatggtggtggttgggaaactgctcacgccactttctacggtggctctgatgcttctggaacaatgggaggagcttgtggttatggtaacttatacagccaaggctatggtgtgaacacggcggctttaagcacggctctgttcaacaatggttttagctgtggtgcttgttttgagctcaaatgtgctagtgatccaaaatggtgccattctggtagtccttcaatcttcatcactgcgactaatttctgtcctccgaactttgctcagcctagtgacaatggtggttggtgtaaccctcctagacctcactttgatcttgctatgcctatgtttctcaagatcgctgagtatcgtgccggaatcgtccccgtctctttccgccgagtgccatgccggaagagaggaggaataaggttcacaatcaacggtttccgttattttaacttggttctagtcactaacgtcgctggcgccggaaacatagtgcggctaggtgtgaaaggaacacatacttcgtggatgaccatgagtcgtaactggggacaaaactggcaatctaactcagttttggttggtcagtcactttcttttagagtcacaagcagtgaccgtagaagctcgacgtcgtggaacattgctccggcgaattggaagtttggtcagactttcatgggaaagaacttcagagtctga

SEQ ID NO: 843 - DNA, 438 bp, Arabidopsis thaliana
atggagagtatctggcgaatcgcgacgggacaagatccgagccgtgaagattacgaagggatcgagttctggtcaaaccctgagcgttctggttggctcacaaagcaaggcgattacatcaaaacctggcgtcgtcgttggttcgttctcaaacgagggaagcttctctggttcaaagatcaagccgctgctggaattcgtggatctacgccgcgtggtgtgatctccgttggtgattgtctcaccgtgaaaggagctgaggatgttgtgaataagccttttgcttttgagctatctagtggtagctataccatgttcttcattgctgataatgagaaggagaaagaagagtggattaattcgattggaagatcgattgtgcaacactcgaggtctgtgacggattctgaggttctcgattatgatcacaggcggtga

SEQ ID NO: 844 - DNA, 969 bp, Arabidopsis thaliana
atggcttctactggagttgagacaaaagccggttactccacatcatccgtatcaaccagtgaacctgttgtttctgttgattggcttcatgctaatcttagagagcctgatttgaagattttggatgcttcatggtatatgccggatgagcagagaaatccgatccaagaatatcaggttgctcatattccccgcgctctcttctttgatttggatggaatatcagatcgaaaaactagtttgccacatatgttgcccactgaggaagcttttgctgctggttgttctgctcttggaattgataacaaagatgaagtggttgtctatgatggaaaggggatctttagtgcagcccgtgtatggtggatgttccgagtttttggacatgaaaaagtttgggtgctcgatggaggtctaccaagatggcgtgcatcaggttatgatgttgaatctagtgcatcaggtgatgctattctgaaagccagtgccgcaagtgaggctatagagaaaatttatcaaggacaaaccgtcagtccgataacctttcagactaagttccagccacatctagtgtggacacttgatcaggtcaagaacaatatggaggatccgacttatcaacacatagacgctcgttccaaagccaggtttgatggtactgctccagaaccccgtaagggaataagaagcggtcatatacctggaagcaaatgtatcccttttcctcagatgtttgattcttgtaacacattgttaccagcagaggagctgaagaaacgatttgaccaagaagatatctcactggacaagcctattatggcctcgtgtgggactggtgtaacagcttgcatcttggcaatggggcttcaccggctggggaaaaccgacgtgccgatctatgatgggtcgtggactgaatgggcgacacaaccagacttgcccatagagagtgttgaatcttcttcatga

SEQ ID NO: 845 - DNA, 957 bp, Arabidopsis thaliana
atggcttcttctggatctgaggcaaaagctaattacgcacccatatctaccaatgaacctgttgtgtctgttgattggctccactctaatcttggagatgctgatataaaggttttggatgcctcatggtacatggcacatgagcaaagaaatccaatccaagagtatcaagttgctcatattccaggtgctctcttctttgatttgaatggaatagcagatcgaaaaacaaatttacgacacatgctaccatctgaggaagcttttgctgctggttgttctgctcttggaatcgagaacaacgatggagtggttgtgtatgatggaatggggctctttagtgcagctcgtgtatggtggatgtttagagtctttggacatgacaaagtatgggtacttgatggaggcttgccgaaatggcgtgcttcaggctatgacgttgaatccagtgtttcaaatgatgccattttgaaagccagtgcagcaactgaggctatagagaagatctatcaaggacaaacaattagcccaataacttttcagacgaagttccggccacatcttgtattggcacttgatcaggtgaaggaaaacatcgaggataagacttatcagcacatcgatgcgcgttcaaaggctagatttgacggtattgctccagaaccttggaagggtttaccgagtggtcatatacccggtagcaagtgtgtcccttttcccctaatgtttgattcctctcaaacactgttaccagcagaggagctgaagaagcagtttgaacaggaagacatatctctggacagtccgattgcggcctcatgtggaaccggtgtaacagcttgtattttggcattgggactttatcgtctgggaaaaactaatgtggcaatctatgatgggtcttggactgaatgggcaactgcaccaaacttgcccatagtgggttcttcttcataa

SEQ ID NO: 846 - DNA, 1443 bp, Arabidopsis thaliana
atggcggtttcttcttcttcgtttctatcgacagcttcactaaccaattccaaatccaacatttcattcgcttcctcagtatccccatccctccgcagcgtcgttttccgctccacgactccggcgacttctcaccgtcgttcaatgacggtccgatctaagattcgtgaaattttcatgccggcgttatcatcaaccatgacggaaggcaaaatcgtgtcatggatcaaaacagaaggcgagaaactcgccaagggagagagtgttgtggttgttgaatctgataaagccgatatggatgtagaaacgttttacgatggttatcttgctgcgattgtcgtcggagaaggtgaaacagctccggttggtgctgcgattggattgttagctgagactgaagctgagatcgaagaagctaagagtaaagccgcttcgaaatcttcttcttctgtggctgaggctgtcgttccatctcctcctccggttacttcttctcctgctccggcgattgctcaaccggctccggtgacggcagtatcagatggtccgaggaagactgttgcgacgccgtatgctaagaagcttgctaaacaacacaaggttgatattgaatccgttgctggaactggaccattcggtaggattacggcttctgatgtggagacggcggctggaattgctccgtccaaatcctccatcgcaccaccgcctcctcctccacctccggtgacggctaaagcaaccaccactaatttgcctcctctgttacctgattcaagcattgttcctttcacagcaatgcaatctgcagtatctaagaacatgattgagagtctctctgttcctacattccgtgttggttatcctgtgaacactgacgctcttgatgcactttacgagaaggtgaagccaaagggtgtaacaatgacagctttattagctaaagctgcagggatggccttggctcagcatcctgtggtgaacgctagctgcaaagacgggaagagttttagttacaatagtagcattaacattgcagtggcggttgctatcaatggtggcctgattacgcctgttctacaagatgcagataagttggatttgtacttgttatctcaaaaatggaaagagctggtggggaaagctagaagcaagcaacttcaaccccatgaatacaactctggaacttttactttatcgaatctcggtatgtttggagtggatagatttgacgctattcttccgccaggacagggtgctattatggctgttggagcgtcaaagccaactgtagttgctgataaggatggattcttcagtgtaaaaaacacaatgctggtgaatgtgactgcagatcatcgcattgtgtatggagctgacttggctgcttttctccaaacctttgcaaagatcattgagaatccagatagtttgaccttataa

SEQ ID NO: 847 - DNA, 1923 bp, Arabidopsis thaliana
atgatctcatggcacgacctctacacggtcctcaccgccgtgattcctctctacgtggccatgatcctcgcttacggctctgtccggtggtggaaaatcttctcacccgaccaatgctccggaatcaaccgttttgtcgccatcttcgccgtccctctcctctcttttcacttcatctccaccaacaatccttacgcaatgaatctccggttcatcgccgccgacactctccaaaaaatcatcatgttgtcacttttagtcctatgggctaatttcactcgctccggtagcctcgagtggagcatcacaatcttttccctctccacacttcccaacactcttgttatggggattcctctcttgatcgccatgtatggcgaatactctggttccctcatggtccaaatcgtcgtcctccagtgtatcatctggtacacgcttctcctttttctcttcgagtttcgtggcgccaagatgctcatcatggagcagttccctgagacggctgcttccattgtttctttcaaagtcgaatccgacgtcgtttcgctcgacggccatgattttcttgagaccgatgcagagataggtgacgacgggaagcttcacgtcaccgtgagaaaatccaacgcttcacgtcgttcgttctgcggcccgaacatgactccacggccgtcaaatctcaccggagctgagatttatagtctcagcaccactcctagaggctctaatttcaaccactctgatttttacaacatgatgggtttccccggtggtcgtctctccaatttcggtccggcggatatgtactccgttcaatcatctagaggtccaactcctcgaccttcaaacttcgaggagaattgcgccatggcatcctccccgagattcgggtattaccctggaggaggagccgggtcttatccggctccgaatccagagttctcttcaaccaccacatctaccgccaataaaagcgtcaataaaaacccgaaagacgttaatacgaatcagcagacgactcttccaacgggcggcaagtcaaacagccatgacgccaaggagcttcacatgttcgtctggagctcaaacgggtcacccgtttcagaccgggcgggtcttaacgttttcggcggagcacctgacaacgatcaaggcggaagatctgaccaaggtgctaaagagatccgtatgttagtcccagatcaatctcacaacggcgagaccaaagctgtagctcatccagcaagtggagatttcggaggagaacaacaatttagtttcgccggaaaagaagaagaagcagagagaccaaaagacgccgagaatggtctaaacaaacttgctccaaattccacggcggcgctacaatccaagacaggtctaggaggagccgaagcaagtcaacgaaaaaatatgcctccggcgagtgtgatgacaaggctgatactgataatggtttggaggaaactcatcagaaacccaaacacttactctagtctcattggacttatttgggctctcgtcgctttccggtggcacgtggcaatgcccaaaatcattcaacaatctatctccattctatctgatgctggtcttggaatggcaatgtttagtttggggttgttcatggcgttgcaacccaaattaatcgcttgtgggaattcagtggcaacgtttgccatggcggttaggttccttacgggtccggccgtgatggcggttgctgctatagccatcggattacgtggtgatttactgcgtgtcgctatagttcaggccgcattacctcaaggaattgtgccctttgtgtttgcgaaggagtacaatgttcatcctgctattttaagtacaggggtaatatttggaatgcttatagcgcttccgatcacgctggtttactacattctactcgggttataa

SEQ ID NO: 848 - DNA, 1860 bp, Arabidopsis thaliana
atgatcacatggcacgacctctacaccgtcctcacggcggtgataccactctacgtagccatgatcctcgcttacggctcagtccggtggtggaaaatcttctcaccagaccaatgttccggcataaaccgcttcgtcgctattttcgccgtccctcttctctctttccacttcatctcctcaaacaatccttacgcaatgaatctccgattcatcgcagccgatacactccaaaaactaatcatgctcactctcctaatcatctgggctaacttcactcgctccggtagtcttgaatggagcatcacaatcttctctctttcaacacttcccaacactctcgttatgggaatacctctcttgatcgccatgtacggagaatattccggctcactcatggttcagatcgttgttcttcagtgtataatctggtacacgcttcttctctttcttttcgaatacagaggagctaagatcttgatcatggaacagtttccagagactggtgcttcgattgtatcgttcaaagttgagtccgatgttgtttctttagatggacatgattttcttgaaactgatgctcaaatcggtgacgatggtaagcttcatgttacggtgagaaaatcaaacgcttctcggagatctttttacggtggtggtggtactaatatgactcctcgtccgtctaatctcaccggagctgagatttatagtcttaacactactccaagaggatctaacttcaatcattctgatttttactctatgatggggtttcccggtggccggctttcgaactttggtccggcggatatgtactctgttcagtcctcgagaggacctactcctagaccttcgaattttgaggagagttgtgctatggcttcttcgccaagattcgggtattacccgggaggagctcccgggtcgtacccagctcctaatccggagttttctaccggtaataaaaccggtagtaaagctccaaaagagaatcatcatcatgtaggaaaatcaaatagtaatgatgctaaggagcttcatatgtttgtttggggatccaacggatcacccgtttcggaccgagctggtcttcaagttgataatggagccaatgaacaagtcggaaaatccgatcaaggcggtgcaaaagagattcgaatgttgatctctgatcatactcaaaatggtgaaaacaaagctggtccgatgaacggggactatggcggggaagaagagtcggagagggtaaaggaagtgcctaacggactacacaagcttcggtgtaactccacagcagagctaaaccctaaagaagctatagaaacgggtgaaactgtaccggtaaaacatatgccaccagcgagtgtgatgactcggctgatattgataatggtgtggaggaaactcataagaaacccaaacacttactctagtctcattggtctcatttgggctcttgttgctttcaggtgggatgtggcaatgcctaaaattattcaacaatcaatctcaattctttctgatgctggtcttggtatggcaatgttcagtttggggttgttcatggcattgcaaccgaaattaattgcttgcggaaattcgacggcgacttttgcgatggcggtgagattctttactggaccagcggtaatggccgtggcagcaatggctattggattacgtggagacctattgcgtgtggccattgttcaagctgcattgcctcaagggatcgtgccgtttgtgtttgcaaaagagtataatgttcatcccgcaatcttgagtacaggggtaatatttggaatgcttatcgcactaccgattacacttgtttactacattttactcgggctataa

SEQ ID NO: 849 - DNA, 1416 bp, Arabidopsis thaliana
atgacggcgaagcgagcgatcggacggcacgaatcccttgctgacaaggtccatcgacatcgtggtcttctacttgtgatttcgatccccattgtgttgatagctcttgtgcttctgttaatgccggggacgtcgacgtccgtctctgtcatcgagtacacgatgaaaaaccacgagggaggttccaattcgaggggtccgaagaattacgctgtgatttttgatgctggaagttctggaagccgtgtgcatgtttactgtttcgatcagaatttggatcttgttcctttggagaatgagctcgagctcttcttacagctaaaaccgggtttaagtgcatatcctaatgatcctcggcaatcagcaaactctttagtaactcttctggacaaagcagaagcttccgttccccgtgagttgcgtccaaagactcctgtcagagttggggcaactgcaggtttgagagctttgggtcaccaagcctctgaaaacattttgcaagcggttagggagctcctcaaaggtagaagtaggctgaagactgaggcaaatgcagtgactgttctggatggtactcaggaaggatcttatcagtgggtgacaattaattacttgctaaggactttgggaaagccgtactcggacacagttggagtggttgatcttggaggggggtcggttcaaatggcatatgctataccagaggaagatgctgcaactgcaccaaaaccagtagaaggcgaggattcttatgtcagagaaatgtatttgaagggacgaaagtatttcctctatgttcatagctacctacattacgggttactggctgctcgggctgagattttgaaagtttctgaggactctaacaacccctgtatcgcgactggatatgctggtacctacaaatatggaggaaaagcgtttaaagctgcagcttctccatccggtgcaagtctagatgagtgccggcgagtagctattaacgcactcaaagtcaataattcattgtgtacacacatgaaatgcacttttggtggagtatggaatggtggaggcggtggtggccagaagaaaatgtttgttgcatcatttttcttcgatcgagccgcagaggctggttttgttgacccaaaccaacctgtggctgaggttcgaccacttgactttgagaaagcggccaacaaagcttgtaacatgagaatggaagaagggaaatcgaagttcccacgtgtggaggaagataatcttccttacttgtgcttggatcttgtttaccaatatactcttctcgtcgatggattcggattgaagccatcacagacaataacgttagtgaagaaggtgaaatacggagattacgccgtggaagctgcgtggccactaggaagcgccatagaagcagtatcctcaccatga

SEQ ID NO: 850 - DNA, 1044 bp, Arabidopsis thaliana
atggaaggtaaagccatcgcgacgtctctcggtggtgatcgtgtattgatattcccgtgttctcctcgctcttccttcgtttttacatcccggctctctagcctgcctctaaagcgtgcgtctatcggtggtgctgtctcttgttccggcgtcaatggcttgactcggtggaattccattgtttcgactcgccgactcgttcctgttcgttcaattaactcggaatcggactcggactccgacttccctcacgagaatcagcagggaaatccaggtttggggaaatttaaggaataccaagaatgggactcatggacggccaagttctccggtggagcaaacattccgtttctcatgctccaattgcctcagatcatcctcaatacccagaatcttttggcgggaaacaataccgctctttcggctgtcccatggctgggaatgttgactggtttgttaggaaacctttcgttgctttcttattttgctaagaagagagaaaaagaagcagctgtggtgcaaacactgggagtggtctctactcacattgtgcttgcacagctcacaatggctgaagcaatgcctattcagtattttgttgctacttcagctgttgtcaccatcggtctcattgtgaactgtttgtactatttcggtaagcttagcaaaactgtgtggcaactgtgggaagacgttatcactattggtggactctccgttcttcctcaaatcatgtggtcaacatttgtccctcttgtaccaaacagtatcttgcctgggacaactgcttttggtattgctgtggcagctataatcatggctcgaactgggaaactttcagagaaaggtgttaggtttgtagggtctttatctggatggacagcaactcttatgttcatgtggatgccagtttcccaaatgtggacaaattttctaaacccggacaacataaaaggcttatcgtcaatcacaatgttgctctcgatgatgggaaacgggcttatgatccctcgagcactatttatccgtgatttgatgtggtaa

SEQ ID NO: 851 - DNA, 4371 bp, Arabidopsis thaliana
atgactccttctaattctttatctagcagtgaacgctctctctctggtgagtgttctgttgatggaaactcttgtgataggggtattgaagatgaatgttcaagtcatagtagtcaagaagatgtggaattaacgaaggaggttaaggtagatcggttagagcgtaagtcgaagagcatgccgagtgatattctcgacattttggatgagaaatcgaaagaaaacagtgttgagaatgtgcagtttttatctgatcgtgaagatgatagtgatgatgttccagtttgggagccacctgaaccggaaaatccagaagatgaggtggatggtgtttttgctgatgatgatgatgattgttgtgatggttctaagtggaacaaagcaagtttgttaggggagttgagtgatgaaagtagtgaaaagagaaaggtttatgaagaaaatcgaagagtgatgcttgaggaggctgattcaaagtttaagttcattgttagtcagcttattaagtcggctgggttttctattgaagaaagtggatattggtttgagatagttgctaggttatgctgggaggctgcttctatgttgaagccagctattgacggcaaatcagttgatcccactgagtatatcaaagtgaaatgcatagcaactggttcttgcgttgacagtgaagttttcaaaggcctggttttcaaaaaacatgctgctcttaaacacatggcaactaagtatgagcatcctagaataatgttagtcgaaggagtactgggtcatccgataagtggattttcgtctctccaatcagtgaatcaggacaatgagtatctactgaagtatgtgaagcctgttgttgatatcatagaagcttccaagcctgacgtgatgctggtggaaaagtctgtttcacgtgatatccaaaagactattcttgataaaggggtcactctggtgtttgacatgaagctccaccgtctacagaggatttctcgatgcattggttcaccaattctttcagttgactctctgtctagtcagaagttaaagcattgtgattcctttcgtatcgagaaaattgtcgaggagcataatgccgcgggtgaatccgacaagaagccaactaaaacactgatgtttttagagggttgccctacccgccttggctgcacgattttacttaaaggatgccacagcgagaggttgaaaaaggtcaaagaagtagtacaatattcatttatcctggcatatcatctaatgctggaggcttctttcctcgctgaccggcatacaatgttctcaaccatctttgcaaaagaagctacatcatgtgttgtggaaatagaaaatttttcaccatctccttctcctcgtgaatctccctctgaagcagttgatattcctgtgtctaatggattcgatgaacaaactattcagattaatggggaagcagatggtgagaaagttggaacttgggaatcagatggagatcatgtgttctctcacgagccatataatccagttatttttactgggttctcatctttatctgccagattaagtaaatatttaggctttgttcaaaatccggagtcagttccagtttctgtggatacagatgtatcgactaccagcaatcttgattcgattagggaatctgaggaagatactgcagaaaagaatgaggataaacaacctcttttacttgatcctgagctcccagtaaactcgagttcagatgatggagacaacaagtcgcaaacggaaaatgatattgagagcaccttggagtctcagagtatattggttttagtgtcaaagaggaatgccctcagggggataatgtgtgatcaaaggcatttttcacacatcaagttttacaagcactttgatgttcccttggaaaaattcctgcgcgatatgtttaatcagagaaatctatgccaaacgtgtgttgaatttccagaagcacatctttactattatgctcatcaaaataagcaactaacaatccaaatcaagcgaattccagtagcaaaaggtttggctggtgaggcaaaaggaaaaatctggatgtggagtcgttgtggaaagtgtaaaacaaagaatgcgtcccggaaatccacaaaacgagtgctgatatcaactgctgctcgtagcttgtcatttggaaagtttttggagctcagcttttctcagcaaacttttctgaacagatcgtctagctgtgggcactctttcgacagtgacttccttcacttctttggattaggctccatggttgctatgctcagttactcccaagtcgcatcctacacagtgtctctaccacccatgaagctggaatctagcattttaataaaagcaggttggcttgagaaagaatttcaaacagtattcactaaagggatctccttgttcgaggacgctgctggttttcttaagagactaagatcacaattcacaaattcagatctcagatatcagcgtgcacgcaaactcctttctaacattgaggagttgctgaagcacgagcgttgcatatttgaggaaaacatcaagaactcgttcgacaaggctaaaaccatagatgatgtttcacacagactgctccgcttaaaccgcatgaggtgggaacttctgcttcaagctctcatctggaactaccggttgcagtcgctggttttatctgatcgtttgctaccttcaagtgatgagacgaagatatatgaacaaggtttgaagactgtttccgaggctggaatgaccagatatgaaaatgataacaaagtttctgattctggtagcaatggaggcatagacactccacttgttgaacacaaggatataccaatcgctggagcgtctgttggggacaatgatcagatggcagaatcctatgtgcctgaagataatgaatcgcaaactttgtgcagctccagtcccgatacaacctctcccatcaacaatcattttgacactcatttggctgttaatgtacattcaaccaatggacaagaagcggacaaatcaattccagttactggagagtctttggatgatgaggtttctacctctaatgggccacacatcttaggttgggatgaatggttttggctgccatttgaggaactacgctcgaagcggattgttgatattgagaaggaatacttgttgaaattcgagtatgttaacaactttacccaagaaaacctacagacggtgaaccagataatcaccgaggaaagttctcgtctgcgcatctcgttgagggatgatgattttattgtgtcagactatgaagacgagctgtccagcctaattgcttgtgcacttgcccatctgaacaatgaagagagcaaaaagcctctttcaaggtgtatacatggatctcttcaagggttcttagataataatcaggattctaagcaaactgaccgagacgtttcccgtttctcgagtgagagtacaaatcggttggaaacactaccccctccagaggtcctcgttacttttgggtcagtcaaatcagttggaaaacccaagtactctatcgtgtccctgtatgcagatgatttccgtgacctcagaaaacgctgttgttcatcagagcttgactatatagcttcactaagccgctgtaagccatgggatgccaaaggtgggaagagcaaatccgtgttcgctaagactttggatgataggttcatcgtaaaagagatcaagaagacagagtacgaatcatttgtgacttttgctacggagtatttcaaatacatgaaggactcgtatgatttaggcaaccagacttgtcttgccaaagttcttgggatccatcaggtaactgtaaggcagccaaagggtggcgggaaagagatacggcacgacctgatggtcatggagaatctgagttttagcagaaaagttactcgccagtatgatctcaaaggcgctctacatgctcgtttcacagccacttctgctaatggcgaagacgatgttctattggatcagaactttgtcaacgacatgaacaaatccccgctttacgttagcaaaacatcaaaacaaaatctccaaagagcggtttataacgacaccagcttcctaaccagtataaacgtgatggactactcgctgctggttggagttgatgatgagaatcatgagctagtgtgtgggatcatcgattatctgagacaatacacatgggacaagcagttagagacatgggtgaaatcgtctttggtggtaccaaagaatgtgcagccgacagtgatcagcccgattgattacaagacaaggttcaggaaattcatgaaaacgcatttcttgtgcgtccctgaccagtggtgcgaccaaggagactcgtaa

SEQ ID NO: 852 - DNA, 1731 bp, Arabidopsis thaliana
atggccatggatgatatggttagccaggtggctatggattactgcgttcgctatcatcgcttccattcttgtagatggttaagtctccgctcttcaccttcatgttctcgcaggttaaacagttttagttcgaggtgttcgattacaaacactgatgtatgtcacgaatttgtgactactgatgatgaaatccacgaggatttgcttactccaattgaggatcattcaattcctattgttcatcttgataccaatatctccgttactgaatctctgaccttactcaccgagtgtacttacgtagatactgttttaacagcattgcctgtattgtctgaggaagagcagactgtaattgcagccactcctgctcaccctgaaggattatatgtcttatatgcaagttgtttggttggaaatttggttgagcaactttggaattttgcttggccgtccgccattgcaatgctatatccgagcttactacctgtggcagtcatggggtttgtcactaaattggcgataattgctggaggccctgtggttggaaagtttatggattatagtccgagagttcctacatatatctcgttgaatgtcattcaggcagccgctcaagtgctatctgcaggaatgataattcatgcatacacggttccttccacatcggcgtcatcaattcttctgcagccttggttttttgcattgttattcgcaggggccattgacagtctatgtggaatagcatctggagtcgccattgaacgtgattgggttgtattgttggccggcataaacagaccaatcgctcttgctcaagcaaatgctgttctccacagaatagatctgctttgcgagatagctgggacgatgttatttggcattctcctatccaaatatgaccctgtgacctgcttaaagtttgctgccacactaatggtgggttctttgccaaccatgacagctcttatatggctgaccaacaagttctcctctggagttctggaccgtcctaaatgctccttgaacagctgttctgctgaaggatctcgtactaataccgacattgatattggcatggaaactatcaagctcggatggaaagaatatattcaacagccagttcttcctgctagcctcgcatatgtccttctctactttaacatcgtcctcaccccaggcagcttgatgactgcatttctaacacaacgatgtgtgaatccatcagttattggtggtttcagtggattatgcgctgttatgggcgtcgccgcaaccttcttatcagcaaacttggtcaaacgagttggcattttaaaggcgggtgcagtaggattgtttttccaagcttcactccttgccgttgctgttgctgtgtattgtagctcttctctatcccataaaagcccactcttcttcttcttgtccatgatcgtattatcaaggctaggtcacatgtcttacggcgttgtgggagctcaaatacttcaaaccggcattccatcatccaaggctaatctcatcggcgcaacggagatctcagtggcaagtctagctgaatcgcttatgctcggagtagccatagcggcgaatgacgcttcccatttcgggtttctcgcggttctgtctcttttatcagttgttgcggcctcattgatattctgcagattgctgagaaatcccactgatgaacaaagacgactcttctccttcgaccctctctcaaattga

SEQ ID NO: 853 - DNA, 1098 bp, Arabidopsis thaliana
atgggttactgcgatggtaaatggacaccggtgattattatggttatgatcaattcagcgctgggtttagctaatgctttggttaaaaaagtactcgatggtggtgttaaccatatggttatcgcaacatatcgtcttgctatttcaaccctatttttggcaccaatcgcatttttttgggaacggaaaacgagaccgacactaacgctcaacatcttggttcagcttttcttcagtgctcttgttggggcaagtttgactcagtatttcttcctattggggctatcatacacatcggctacgttggcatgtgcttttattagcatgacgcctgcgattacattcgttatggctctaatattcagggtagagaagctaaacatgaaaagcaaagcaggtatggggatggtgatgggcgcgttgatatgcataggaggagctttattattaacaatgtacaaaggtgttcccttgacaaaacttcggaaactagaaacccatcagttgataaacaataaccacgctatgaaaccagagaattggataataggatgcgtacttctctttgcgggtagtagctgtttcgggtcgtggatgctgatacaagccaaagtgaacgagaaatacccttgtcaatactcgagtactgtcgtattatccttctttggcaccatccaatgcgcccttctaagcctcatcaaatctcgagatatcacggcttggatcctcacagataaacttgatatcgttaccattgtttacgcgggagcagtagcacaaggaatatgtacggttggaacgtcttggtgcatcagaaagagaggacctatctttacttctatatttaccccggtggggcttatatttgcaacactatttgatttcttgatccttcatcgtcaaattttcctaggaagtgttgtcggatctggggttgtaatcttcggactatacatattcttgttgggaaaagtcaggctaatgaaagaagagtgtgaaaagaagttaccttgtcgttttaatgaagatgatcaagaagaagatgatgatgaacaatacaaaaagggtcatcttatggttgttccaatgactccttga

SEQ ID NO: 854 - DNA, 2124 bp, Arabidopsis thaliana
atgacaagatataataacaaagccccaccatcacctgctgtcctgcgcggcgtctccgtcgtctctgtcgccgcatctccgtcatcattttcgctaccgcataatctctgtctccgccgtcactgccgcagcctagaatatgatttctcgtttctgaaacccttgtataaggtagaaagagagagaaatcatccaaagcaaggaccttccagcgactttcagggtttaaggtttagcttctcgactatggcgattctagggcttatcaagagggttacacgaataaccgtaaacaattcgagggtcagagtgtacccagtgaggtacttccaaaggaaggacctttcaagcacaaatctattcaatggtgaagatgctgctaagcttcctgttctgatcgtcggcgctggaccgatcttccgtgaattggatggattagctgaggagattgaaagatcacagcctcctgtagatttgtggagaaaatttatttactgtacatctctctccggctcaacactaggcacagttgatcacatgcagcctcaagattttgagaaagttgtcagcccggcttctgttgctcacttctcccagtacaaattgacaaatttattgcttaagcggttggaagacctcggctttcatgttcgtggttccaaagagtcggatggtcttgaggctgactctgtggttgcgaggcaaattcttatgggtcatgagtgtgtggggattgatgctaacaaggacagtattactgcaactgtttcttttctcaaaggaggcaagcatatgaaaagaaacattcaatgtagtctactggttggtgctgatggtgctgggagtgcagtaagaaagctcacagtaatagaaatgcgaggggaaagagatctacagaagcttgttagtgtccatttcatgagtagagagctcggtgagtacctgatcagtaacagaccagggatgctattttttatttttaacaccgatggtataggagttcttgttgcccatgatcttctacaaggagaatttgttttgcagatgtgcaagatgctgatattcaatttggtgggacatgagctttcagacttggatgtagctgatattaagccatgggtcatgcatgctgaagtcgccgagaaattcatgtgttgtgagaacagagtgatacttgctggtgatgctgctcaccggttcccgcctgctggaggttttggaatgaacactggaattcaggatgctcataatcttgcatggaaaatagcagctcttgttcagggttctgcaaactcttcaattcttaaaacttatgaaacagaacgtaggccgattgccctttccaatacttcactcagtgttcaaaacttcagagcagctatgtcagttccttcagcgctaggccttgacccaacagttgcaaactcaggtcgtgcacagctttcagaatctctgttgaatgagagcaatccactgggaaatcagagacttagcagactaaagagtatcttcgaaggaggaaaaagccttcaactacagtttcctgcagaagatcttggtttcaggtatttagagggagccattgttcctgataacgagtctgaagctggtgatcccgaagtaccgagtggtcgtagaagagactatgtcccttgtgctgaaccaggttcaagactgcctcatatgtatgtgaaaatactgtcagattccacaagagaggttattgtttctacactggatcttgtttcgacagagaaagtggagtttctacttataatatcgccattacaagagtcctatgagctagctcatgctacattcaaagtcgcaaaagagtttatggctagtgtaaaagtatgcgtggtctggcctagtagtgatgatggtcttgaaaggaagagcaattcagcattagctccatgggaaaattatgtcgatgttatggaagttaaaaaacaaaatggtgaaggaacttcgtggtggagtatttgtaaaatgtcagagagaggatctattttagtccgtcccgaccaacacattgcttggcgagcaaagtctggtattactttggatcctactctgcacatgagagatgtcttcaccatcatactagggaaacaatga

SEQ ID NO: 855 - DNA, 2406 bp, Arabidopsis thaliana
atggttggatttcccgctaatcaagcaaaaaccgttgaagaagagctacctttgcaagtcgtagccgatcaagaccccaaggtaaaaactttcaaggactcttttgatttcccttccatcgattcctttccggatttcgattctatcacttggtctgagagtaatcggaacgttgaggattttagcatagaagatacggactttgatttctttgagtaccacatggagatacctcaagaagatgttgttactgttagcgatgtaatgtgtccggagaatcagactactgttaattctgagtcgattgagggaaagcttgaggtctttaatgatgacatgtctggggaagttggtgtgagttcggttaggtctgagtcgatggttgaagtaaagcctgtgctttgtgatgtcatgtctgaggaagttggagtgagctcggttgaggtagagcccaatgtttgtgttgagatgtctgcaaacggtggggatgaaccagcagtaaaagattcagaaccggttgtttctgaaaactcgaggtcaatggaaggtgagactgagccagttgttgtgtctgatgcgtctgttgcttgtcccaccatggatttggatgaatcagggttgaagaaaactgatgagggtttggcttgttctattgaagtagggttggagaaggtaagtttggccgtggatgatgatgagaagagtgatgaggctaagggggaaatggattctgctgagtctgagagcgaaacctcgagctcttctgcaagcagtagtgatagtagtagcagtgaagaagaggagagtgatgaggacgagagcgacaaagaggaaaataagaaggaagaaaagtttgaacacatggttgtggggaaagaggatgatctagcaggggaacttgaagagggtgagatagagaatttagatgaggagaatggggatgacgatattgaggatgaggatgatgatgatgatgatgatgatgatgacgatgatgatgtgaatgagatggttgcttggagcaatgatgaggatgatgaccttggtttgcaaacaaaagaacctatcaggtcaaagaatgagctcaaggagcttcctccagttcctcctgtggatgtcactctggaaccacaccatgccacacttcctgttggagttgttctttcggtaatgagcgcacaagtaatagttgagggaatggaaaagcatagtcctttgactgaaggttctatcctttggataactgaaaaaagaacgccattgggactggtggatgagatctttggacccgtgaagtgcccttattatattgtgaggttcaattcagagagtgaagtgccagaaggggtttgtcaagggacacctgtctcatttgtcgccgatttcgctcaacatattctcaatatcaaggaactgcagaagaaaggttacgatgcatctggggataacgacgaggagataccagacgagctagagttctcagatgatgaaaaagaagccgaatacagaagaatgcagaagttggaaaagagaggaatgatgagtgaccagaaaaccggtaacaccaggaacaagaagaagaaaaaccgagatcccggaaggcctacaagcagttactcaggggaatggacgaagaaccagggatctagttctctatcgtcaaaccgttctgatcctcaaatgggtggtccgcgtcctcaaatggacggttttcctccaaacaatgcagcatggagaccccagagtaatcagcagaacccatatcagcttcctcctatacctaatcagatgggaatgcagatacctttcatggcaatgcaaaatcaaaatcaaatgatgttccaaccgcagttcaatggtggccagatgccaatgccaggtggaccgggaggcttaaacttctttccaggacaggcttcagcgccatggcctgcaatggtaggtcagaattgtttcaaccaacagtttgggatgggtcgtggtattcagcagcagccattaccaaatgagctgagttttaatatgttttctcaaggtcttcaaatgcacccaccacagtcccaaatgcaccggccacagtctcaaatgaatccacagttccaaatgccaccacagttccagccccaccagcaatctccaatgaacccgcagtaccaaatgatgcaccgaccacagtctccagcgaacccgcagttccaaatgcaagcacaatctgatgtgcgaccactacagtcacaaatcccgcagtcaccaagtgatttgcagtccccaatggaaccacaatctcaagggtttagcagcgggcagtcttctgaacggggaaggggcttccatggtcgtggtagaggtagagggcggggtcgcttcggacgtgggcgaggtagaggccggcaacagtctggatga

SEQ ID NO: 856 - DNA, 2019 bp, Arabidopsis thaliana
atgggttctcatggtaagggtaagagagatagaagtggaaggcagaagaagcggagagatgaatccgagtctgggtctgagtccgagtcttacacttctgactctgatggctcagatgatttgtcgccgcccaggagttccaggaggaagaaaggtagcagcagtcgtcggactcgacgccgtagctcaagtgatgattccagtgacagtgatggtggacggaagagtaagaagagatcttcatctaaggattactcggaggaaaaagttacggagtatatgtctaaaaaagctcagaagaaggcattacgtgcagcaaagaaactgaagacgcagtcagtgtcagggtactccaatgattcaaacccatttggtgattcaaatctcactgagacatttgtgtggcggaagaagattgaaaaagatgttcatcgaggagtaccgctggaagaattttccgttaaagctgagaagagaagacaccgggaaaggatgacagaggttgaaaaggttaagaagaggagagaagagagagcagtggagaaagctcgacatgaagaagaaatggcattgttagctagagaacgtgctcgggctgagttccatgattgggagaagaaagaggaagagttccatttcgatcaaagcaaggtgaggtcagagattagattacgtgaaggtcgactgaagccaatcgacgtcctctgcaagcacttggatggttcagatgatttggatatcgagctcagtgaaccgtacatggttttcaagggacttactgttaaagatatggaagagcttcgcgatgatatcaagatgtatctggatttggatcgggcaactccaacacgtgtacaatattgggaggcgcttattgtggtatgcgattgggagttagctgaagctcgtaagagggatgcccttgatcgagctagagttagaggggaggagcctcctgcagaattgcttgctcaagagaggggactacacgctggtgttgaagctgatgtgagaaaacttctcgatgggaagacccacgcggagcttgtagaactgcagttggacatcgaatcgcagctgcgttctgggtctgcgaaagtagtagagtattgggaagcagttcttaaacgcctcgaaatatacaaggcaaaggcttgcttgaaggaaatacacgctgagatgctgagacgtcatctacatcgcctcgagcaactttcagagggtgaagatgatgtagaagttaatcctggcttaacacgtgtggtggaagaaaatgaggaggagataaatgatacgaatctttcagatgctgaagaagcattttctccagagcctgttgcggaggaagaagaagctgatgaggcagcagaagcggctggttcgttttcgccagagctcatgcacggtgatgatcgtgaagaagcaatcgatcccgaggaagacaagaagctactgcaaatgaaacggatgattgtgctggagaaacagaagaaacggcttaaagaagctatggactcaaaaccagcacctgtagaagataacttggagcttaaagcaatgaaagcaatgggagcaatggaagaaggtgatgccatatttggctctaatgctgaagtgaacctcgattccgaggtatactggtggcatgacaagtaccggccaagaaaaccgaagtatttcaatcgggttcacacaggttacgaatggaataagtataaccaaactcactatgaccacgataatccgcctccaaaaatcgttcaaggatacaagtttaacatcttctacccggatttagtagacaaaattaaggctcccatttacactatcgaaaaagatgggacaagtgctgaaacgtgtatgatccggttccatgctggtccaccttatgaagacattgcgttccggattgtgaataaagaatgggagtattctcacaagaaaggtttcaaatgcacgtttgagcgtgggattctgcatttgtacttcaactttaaacgacataggtacaggcgataa

SEQ ID NO: 857 - DNA, 1602 bp, Arabidopsis thaliana
atgacgaagcttctagagattaatcatattcaaaccctttgttttgccaagggtttttctcctgccagattaaatgttgcaacttcaccttttcggatatctcgtcgtggtggtggtggatattgcagcaatgcttgtatcccttatcggttgaaatttacttgttatgcaacactatctgctgtggtaaaggagcaagcatcagactttagtggaaaagaagcagctttgcttgtagatgagctcagaagcaacttcaactctggcagaacgaagagctacgagtggagaatttctcagcttcaaaacattgctaggatgattgatgagaaggagaaatgcatcaccgaagctttgtatcaagatctttctaagcctgagcttgaagcttttctagctgaggttttttatataatttcaatgtcccgtttcttcactgcattccacttatccactgttgaatctctttggtatttttctcgttttttagatttcgaatacaaaatcatcctgtatgcttgcaatcaaagagttaaagaactggatggctccagaaacgtattgtctgtcgagccagtcattggagctattgcagctggtaatgcggttgtgctaaaaccttctgaaattgctccagcagcatcttctcttttagcaaagttgtttagtgaatacttggacaatacaacaatcagagttatcgagggaggagtccctgaaacaacggcactactggatcaaaaatgggacaagatctttttcactgatctttctctgcttctaaagcataaaatagttaaattcaggtctcatactctaattgtggtgttgtggttgaaggtggctgctaggaggatcattgcagggaaatgggcttgtaacagtggacaggcttgcattggtgttgattacgtgatcacaacaaaggattttgcatcaaaattgatagatgctctgaagactgaactggagacattttttgggcaaaacgcattagaatcaaaggacctgtcgcggattgtgaactctttccacttcaaaaggttggaaagtatgttaaaagagaatggagtagccaacaaaattgttcatggtggccgaataaccgaagataaacttaaaatatcaccaacaatactactggatgtgcctgaagcatcttccatgatgcaggaagagatatttggacctttacttcccataattacggtacaaaagattgaagatggctttcaggttatacgttcaaagccaaagcctttagcagcgtatctcttcacaaacaacaaagagttggagaaacaattcgtgcaggacgtatcagcaggaggaattaccatcaatgacactgtcttacacgtgactgtaaaagatctgccatttggtggggttggggagagtgggatcggtgcttaccatgggaaattctcgtatgagacgtttagccataagaaaggagttctttaccggagcttttcaggggacgcggatcttagatatcctccttacacaccaaaaaagaagatggtgcttaaggctttgctctcttcaaacatatttgctgccattttggctttctttgggttctctaaagactcatga

SEQ ID NO: 858 - DNA, 1041 bp, Arabidopsis thaliana
atgcatgtcatatctctttcgttatcctcaatattctttttcctcttcctcacatcaaccattttgatttctccggtacaacccacaacctctaagcctccggcaccacggccccacagagagctctccgccgattactactccaagaaatgtcctcagcttgaaactctcgtcggttccgtcacttctcagcggttcaaagaagtccccatctcagctccagccaccattcgcctcttctttcacgactgcttcgttgagggttgtgatgggtcgatattgatagaaacaaagaaaggaagcaagaaattagcagagagagaagcatatgagaataaggaattgagagaggaaggatttgatagtatcatcaaggcgaaggccttggttgagtctcattgcccttctctcgtctcttgctctgatattctcgctattgccgctcgagatttcattcatctggcaggtgggccttactatcaagtgaaaaaaggaaggtgggacggaaaaagatcaacggcaaagaacgtccctccaaacatacctcgatcaaactccaccgttgatcaactcatcaagctcttcgcgtccaaaggactaaccgtagaggaactcgtcgtcctttctggttcccacaccatcggcttcgcccattgtaaaaatttccttggtcgtctctacgactacaaaggcacaaaacgacccgacccgagtcttgaccaaagattactaaaagagctccggatgtcttgtcctttttccggcggaagctctggagtcgtccttccgctcgacgctacaactccgtttgtgtttgataatggatatttcacaggtctaggaaccaacatgggccttctcgggtcggaccaagctttgttccttgacccgaggacgaagcccattgcacttgagatggcaagagataagcagaagtttctcaaggcgtttggagacgctatggataaaatgggttccattggtgtaaagagagggaagagacatggggaaatacgtacggattgtcgagtctttttatag

SEQ ID NO: 859 - DNA, 1140 bp, Arabidopsis thaliana
atgggcaagattatcttggttgtttctcttactgctttatgcatttttatgctcaagcacgcaccgagtttcacatcaccaaccgcgttctctcgtagcgaggaaggtgtgactcatgtgttagtcactggtggtgctggatatatcggatcacatgctgcgttgaggctcttaaaagattcataccgtgtaaccattgtggacaatctttctcggggaaatcttggtgccgtcaaggttttacaaggattgttcccagaacccgggaggcttcaatttatttatgctgacttaggagatgccaaagctgttgataaaatcttctcagagaacgcgtttgatgctgttatgcattttgctgcagtagcatatgttggagagagcactctagatcctctaaagtattaccacaacattacatcaaacacattagtagttcttgaagctgtggctagacataaagtgaagaagttgatatattcaagcacatgtgccacttatggagaacctgacaagatgcctattgttgaagttactccacaggtccccattaacccttatggaaaagctaagaagatggctgaagatatgatcctggatttctctaaaaactctgacatggcagtcatgatcctaagatactttaacgtgataggttcagatccagaaggtagactaggagaagctccaaagcccgagctacgtgaacacggacggatttcgggtgcctgtttcgatgcagctcgtggcgtgattccaggccttcaggtcaaaggaacagactacaaaacaggagatggaacttgtgttcgtgactacatagatgttactgaccttgtagatgctcacgtaaaagctctcgagaaagctaagcctagaaatgtgggaatatacaatgtaggtacaggaaaaggaagatcggtgaaagagtttgtggaagcatgtaagaaagcgacaggagtagatatcaaagtagattttttgcctcgaagacctggagattacgcagaggtttacagtgatccagcaaagattctgagagatcttaattggtctgctcgttacactaatcttcaagaaagtcttgaggttgcttggaagtggcaaaagactcatccccatggatatgcttcttcttaa

SEQ ID NO: 860 - DNA, 1455 bp, Arabidopsis thaliana
atggtgttcgaaacttgtccatctccaaacccaattcatgtaatgctcgtctcgtttcaaggacaaggccacgtcaaccctcttcttcgtctcggcaagttaattgcttcaaagggtttactcgttaccttcgttacaacggagctttggggcaagaaaatgagacaagccaacaaaatcgttgacggtgaacttaaaccggttggttccggttcaatccggtttgagttctttgatgaagaatgggcagaggatgatgaccggagagctgatttctctttgtacattgctcacctagagagcgttgggatacgagaagtgtctaagcttgtgagaagatacgaggaagcgaacgagcctgtctcgtgtcttatcaataacccgtttatcccatgggtctgccacgtggcggaagagttcaacattccttgtgcggttctctgggttcagtcttgtgcttgtttctctgcttattaccattaccaagatggctctgtttcattccctacggaaacagagcctgagctcgatgtgaagcttccttgtgttcctgtcttgaagaacgacgagattcctagctttctccatccttcttctaggttcacgggttttcgacaagcgattcttgggcaattcaagaatctgagcaagtccttctgtgttctaatcgattcttttgactcattggaacaagaagttatcgattacatgtcaagtctttgtccggttaaaaccgttggaccgcttttcaaagttgctaggacagttacttctgacgtaagcggtgacatttgcaaatcaacagataaatgcctcgagtggttagactcgaggcctaaatcgtcagttgtctacatttcgttcgggacagttgcatatttgaagcaagaacagatcgaagagatcgctcacggagttttgaagtcgggtttatcgttcttgtgggtgattagacctccaccacacgatctgaaggtcgagacacatgtcttgcctcaagaacttaaagagagtagtgctaaaggtaaagggatgattgtggattggtgcccacaagagcaagtcttgtctcatccttcagtggcatgcttcgtgactcattgtggatggaactcgacaatggaatctttgtcttcaggtgttccggtggtttgttgtccgcaatggggagatcaagtgactgatgcagtgtatttgatcgatgttttcaagaccggggttagactaggccgtggagcgaccgaggagagggtagtgccaagggaggaagtggcggagaagcttttggaagcgacagttggggagaaggcagaggagttgagaaagaacgctttgaaatggaaggcggaggcggaagcagcggtggctccaggaggttcgtcggataagaattttagggagtttgtggagaagttaggtgcgggagtaacgaagactaaagataatggatactag

SEQ ID NO: 861 - DNA, 1422 bp, Arabidopsis thaliana
atggatctcctcacaccactcatcttcctcctcctcctcctctcaccattttcactctcagatgctggttccatcggagtaaactacggccgaatctccgacgaactcccctccgcattcaaagtagtccaactactaaaatcccaaggaatcacgcgagtcaaaatcttcgacgcagacccatcagttctcaaagcattatccggatctggaatcaaagtcaccgtagatctccccaacgagttactcttctccgccgccaaaagaacttccttcgccgtctcatgggtcaaacgcaacgtagcagcttatcatccttcaacacagatcgaatcaatagctgttggtaacgaagtcttcgttgatacacacaacactacaagcttcttgatccctgcaatgagaaacattcacaaagctcttatgagtttcaatctccactccgacattaaaatctcttctcctcttgctttaagcgctcttcaaaactcttacccttcttcctccggttctttccgaccagaacttattgactctgttatcaaaccaatgcttgacttcttacgtgaaactggttcaagacttatgatcaatgtctatcctttctttgcttatgaaggaaactctgacgtcattcctttagattatgctttgcttagagagaatccaggaatggttgattctggtaatggtttgagatactttaatctcttcgacgctcaaatcgacgccgttttcgcagcaatgtcggctttaaagtacgatgatatcgaaatcattgtcacggaaactggttggccgtcgaaaggagatgagaatgaagtcggagctactctagctaacgcagcttcttacaacggaaacttaatccgtcggatcttgacacgtggaggtacaccgttacgtcctaaagcagatctaacggtctatcttttcgctctgttcaacgagaacaagaagttaggtccaacgtcggagagaaactatggtctcttcttccctgatgagaagaaagtctacgacattcctttcacaacagaggggttgaaacattaccgtgacggtggtcatactccggtcactggaggagatcaggttacaaagcctccgatgagtggaggcgtgtcgaagagtttgaatggttatacttggtgtgtagctaatggtgatgctggtgaagaaaggttacaaggtggtttagattatgcttgtggtgaaggtggtgctgattgtcgtcctattcaacctggtgctaactgttatagtcctgatacacttgaggctcacgcttcgtttgctttcaatagttattaccagaagaagggtcgtgccggtgggagttgttacttcggcggcgccgcttacgtcgttagccaaccaccgagtaagtataactttttttttgtgtgtggcgcatgttaa

SEQ ID NO: 862 - DNA, 3513 bp, Arabidopsis thaliana
atggcagcatcttccgaaatactcccggagtcgtggcaagtgttcatcaatttccgaggagcagatttgcgcaacggtttcatcagccatctggcgggagctttgacctcagctggaatcacatactacatcgacacggaagaagtcccgagcgaagatctcactgtccttttcaagaggatagaggaatcggaaatcgcactgtccatcttctcgagcaattatgctgagtcaaaatggtgtttggacgagctcgtgaagatcatggaacaagtaaagaaaggaaagctcagaatcatgcccgtcttcttcaacgtgaagccagaggaggtgagagagcagaacggagagttcggacttaagctttacggagaaggtaaaagcaaacgacccaacatacctaattgggagaacgctttgcggtctgtcccaagcaagataggcttgaatttggcgaattttagaaacgagaaggaactccttgacaagatcattgactccatcaaaaaagtacttgcccgaattacacgagcaagcagagtagcagaatctctaaacgggatctcaaaagactcagaggcaaagaatgtagacacattttcgccaaactccagtgattttccatctacttccattgacgacgacctcagtatcaactcgcctcagtaccaagccacaattccccccgcaagcagggaaggtgaacgtctcaacacgatctctactgtaagttcaactggtagtattgaacatcctccacccaactacggaatagaaccacgccttaaggagatggaagaaaagttagattttgatagcctcgaaactaaaactgttggaattgttgggatgcctgggattggtaaaaccactcttgcagaaacgttgtatagaaagtgggaacacaagtttgagaggagtatgtttttcccagatgccagtaagatggcgaatgaacacggaatgtgttggctgcagaagagattattggaagagctgttgaaggatactaatctcaacataggatatacaacgaatgaacatgagttttgtaaggatgttcttctcctaaagaaagtttttcttgtcatagataatgttagtagcgaggaacagatcgaaactctttttggtaaatggaattggattaaaaatggaagcaagattgttattacgtcaagtgatgagtcaatgctcaagggtttcgttaaagatacttatgtagtcccaagtttgaacagcagagacagtctactgtggtttactaatcatgcatttggtttggatgatgcccagggaaacttggtaaagttgtccaaacactttctgaattatgccaaaggcaacccactagccctcggagcttttggtgtagaactttgtgggaaagacaaggctgattgggaaaagagaataaaaacattgacactaatttccaataagatgatccaagatgtcttgagaagaaggtatgatgaactcacagagaggcagaaagatatttttcttgacgtcgcatgtttcttcaaatcagagaatgaaagttatgtacgacacgtggtgaattcatgtgattctgagtctactaagagttgggatgaaataacagatctcaaaggaaagtttcttgtcaatatttctggtggtcgagttgagatgcatgatatactatgcacattcgccaaggaacttgcttcacaagcattgactgaagatacaagggttcatctcaggctgtggaactatcaagatatcatgtggtttctcaacaatgaattggaaatggaaaatgtcagaggtattttcttagacatgtctaaagttccggaggaaatgacatttgatggtaacatctttagcaatatgtgcaatcttcgatatctcaaaatatacagttctgtttgccataaggaaggcgaaggtatcttcaaatttgacacagttagggaaattcagttaccattagacaaggtacgctatctccactggatgaaatatccatgggagaaacttccatcagacttcaacccggagaatctcgttgatcttgaactgccttatagctccattaagaaagtttgggagggtgttaaggataccccgatactaaagtgggccaatctaagctattcaagtaagttgactaaccttttagggttgtcaaatgctaaaaatcttgaaagattgaatcttgaaggttgcacaagtttgcttaaactgccccaagagatggagaacatgaaaagtcttgtcttcctgaacatgagacgttgcactagtctcacatgtcttcaaagtattaaagtgagctctctgaaaattctcatactcagtgactgctcaaaacttgaggaatttgaggtgatttcggaaaatctggaagaattatatttagatggaactgcaataaagggacttcctccagcggccggggatctgacgagacttgtcgtcttaaatatggaaggctgtacagaactggagagtcttcccaaacgtcttggaaaacagaaagctcttcaagaactggtactctctggatgttcaaagctcgagagcgttccaacggacgtaaaagacatgaaacatctacggctcttattgcttgacggcacaagaatcagaaagatcccgaagataaagtcgctaaagtgtttgtgcttaagtagaaatattgcaatggtcaatctacaagataatctcaaagatttctctaatctgaaatgtcttgtcatgaagaactgcgagaatctcagatatcttccttcgcttccaaaatgtcttgagtacctaaacgtatatggttgtgaaagactagaatcagttgagaatccactggttgctgataggttaacgttattccttgatagatctgaggaattacgttccactttcttgttcactaattgccacaatctgtttcaagatgcaaaggactcaatctcaacctacgcgaaatggaaatgccaccgacttgcagttgaatgctacgaacaggacatagtttctggagcttttttcaacacttgctatcctggatatatagtcccttcgtggttcgatcaccaagcagttggatcagtcttagagccaaggctggaaccacattggtataacactatgctttctgggatagctctatgtgcagttgtatcattccatgagaaccaagatccgatcatcggcagtttctcagtaaaatgcacattgcaatttgaaaacgaagatgggtctcttcgctttgattgtgatatcggatgtttgaacgaaccaggaatgattgaggcagaccatgtttttatcggctatgtcacttgctcacgtttgaaagatcaccactctatacctattcatcaccctacaactgtaaaaatgcagttccacttgactgatgcttgtaaaagtaaagtggtggattgtgggttccgtttgatgtacacccagagccgtggctgtttgttagaggaagaagtcaacgccaacttcactaaattatacttgggtttattgtaa

SEQ ID NO: 863 - DNA, 2517 bp, Arabidopsis thaliana
atggaatcttcgtcagaaggtgagacaaacaagatttcccgatgcaaagccactggttcagacaatcctgatgaggactacgtcgagatcacactcgaagtgcgagacgaaaccatcaacacaatgaaggccaaggcgacacttcgttcggttctttccgggaggctgaaaacgatggttaagtcgctatcgtttgcttcacgccggctcgaccgtagtaagtcgttcggtgctatgtttgctcttcgagggttgaggttcattgccaaaaacgacgccgttggtagaggctgggatgaggttgcaatgaggtttgataagttggccgttgaagggaaactccctaaatccaaatttggacattgcataggaatggttgaatctagcgaatttgtgaacgagctttttgaggcgttggtccgaaggagagggactacgtcatcgtcaatcaccaaaactgaattgtttgaattctgggagcagatcacaggcaatagttttgatgataggctgcaaatcttttttgatatggtggacaaaaatttggacggacgtattacaggagatgaggttaaggagataattgctttaagtgcttcggctaacaagctatcaaagattaaagaaaatgtagatgaatatgctgccttgatcatggaagaactagatcgcgacaacctcggatatattgagttacataacttggaaacattgcttctccaagttcctagccaatcaaataacagtccatcttccgcgaacaaacgtgcactcaacaagatgttgagccagaagctcataccaacaaaagatcgaaacccggtgaaaagatttgctatgaatatatcatacttcttcttggaaaattggaaaaggatttgggtgttaacattgtggatatccatttgcatcactctcttcacttggaaatttctccagtataaacgcaaaaccgtgttcgaggtgatgggctactgtgttaccgtggccaaaggcagtgcagagaccttgaaattcaacatggctctcattctcttgcccgtttgtaggaacactatcacttggctaaggaccaagtccaagcttattgggtctgttgttccatttgatgacaatatcaatttccacaaggttgttgcatttgggatcgcggttggaataggcttgcacgctatatctcacctggcatgtgatttcccgcgtttgctgcatgcaaaaaatgtagagtttgagccaatgaaaaagtttttcggagacgagaggcctgaaaattatggatggttcatgaaagggacagacgggtggaccggtgttaccatggtggttcttatgttagtggcctacgtcttggcgcagtcgtggttcagacgaaaccgggcaaacctaccaaaatcgttgaaacgattgactggtttcaacgcattttggtactcacaccatttgtttgtcatcgtttatgttcttctcatcgtgcatggctattttgtttatctctcaaaggaatggtaccacaagacgacgtggatgtatctggcagttcccgtactactatatgcatttgaacgattgattcgtgcatttagaccaggtgccaaggctgtcaaggttttgaaggtggcagtatatccaggaaatgtactttcactttacatgtcgaagcctaaaggtttcaagtacacaagtggacagtacatatatattaactgttctgacgtctcaccattacaatggcatccgttttcaattacttcggcttccggggatgattacctcagcgttcatatccgcacactcggagactggacatcgcaactcaaatccttatattccaaggtttgtcaacttccctcaacaagtcaaagtgggctcttcatagctgacataggtcaagccaacaatataaccaggtttccgaggctgttaatcgatggtccatatggtgcacccgcacaagattaccggaactacgatgtattgcttctagtaggtctagggatcggagcgacgccattaatcagcataatcagggacgtccttaacaacatcaagaaccagaattccatcgaacgaggcactaaccaacacataaaaaactatgttgccacaaaacgagcttatttttattgggtaacaagagagcaaggatcattggaatggttcagtgaggtcatgaacgaggtagctgagtatgatagtgaggggatgattgaactacataattactgcactagcgtgtatgaggaaggagatgcgaggtcagcactaatcaccatgttgcagtcattgcaccacgccaagagcggcattgacatcgtatcgggcactcgggtccgaacccatttcgctcgacccaattggcgtagtgtcttcaagcacgtcgcagtcaaccacgtcaatcaacgagttggggttttctactgtggtaatacatgcatcataggagagttaaagagactggctcaagatttctctaggaaaactacgaccaagtttgagttccacaaggaaaatttctag

SEQ ID NO: 864 - DNA, 504 bp, Arabidopsis thaliana
atggctaataaccaagcaagccttcttctgcagaaacagcttaaagatctgtgtaagaaacctgttgatggtttctctgctggcctcgttgatgagaagaacgttttccaatggagcgtctctattatgggtcctcctgatactttgtatgaaggtggcttttttaatgcaattatgtcgtttccggagaattatccagtttcaccaccaactgtgacgtttacctcggagatgtggcatcctaatgtttattctgatggaaaagtttgcatttctattcttcatcctcctggtgatgatcctcatggatacgagcttgcctctgaacgttggacccctgtccatacggtagaaagcattgtgttgagtatcatatcgatgctctcaggtcccaacgatgagtcaccagcgaatgtggaagctgcaaaggaatggagagacaacagagcagagtttaggaagaaagtgagtcgctgtgtgagaagatcgcaagagatgctatga

SEQ ID NO: 865 - DNA, 2697 bp, Arabidopsis thaliana
atggcgtcagagcatccgtttaaagggatcttcactacacttcctaagcctggtggtggtgaattcggaaagttctatagcttacctgctcttaacgatccacgagttgataaacttccttactctattaggattctgcttgaatctgcgattcgtaattgtgataactttcaagttactaaggaagatgttgagaagattattgactgggaaaagacatctcctaaacaagtagagattccttttaaaccagctcgtgttcttcttcaggactttacgggagtcccagctgttgttgaccttgcttgtatgcgtgatgcgatgaataagctgggaagtgattccaacaaaatcaatcccttggttccggtggatcttgtgattgatcactcggttcaagtagatgtagctcgatcagagaatgcagtgcaagcaaacatggagcttgagttccagaggaacaaggagaggtttgctttccttaaatggggttctactgcgttccagaacatgcttgttgtgcctcctggctctggtattgtgcatcaggtcaatttggaatatcttggaagagttgtgttcaataccaaaggccttctctacccagacagcgtggttggaactgattcacatacaactatgattgatggtttgggagttgctggatggggtgttgggggtattgaagctgaggcaacaatgcttggccagcccatgagtatggtattgcctggtgttgttggattcaaacttgccggaaaaatgcgtaatggtgtaacagctactgatttggttctaacagtgactcaaatgctgaggaagcatggcgttgttggaaagtttgttgagttttatggtaatggcatgagtgggctgtccctagctgacagggcgacaattgccaatatgtctcccgagtatggtgcaaccatgggcttcttccctgtggatcatgttactctacaatatctcaaattgactggaagaagcgatgagacagtggctatgattgaagcatatcttcgggctaacaatatgtttgttgactacaatgagcctcagcaagaccgggtttactcgtcatatctagaactgaatctggatgatgttgaaccttgcatttctggaccaaagcggccacatgatcgtgttactttgaaggaaatgaaagctgactggcattcatgtcttgacagtaaagttgggttcaagggttttgctatacctaaagaggcacaagaaaaagtggtaaatttttcgttcgatggacaaccagcagagcttaaacatggaagtgtggtgattgctgcaatcacaagctgtactaatacatcaaatcccagcgtcatgcttggtgctggtcttgttgcaaagaaggcttgtgaccttgggctacaggttaagccttggataaagacaagtcttgctccaggctcaggagttgttacaaaatacttattaaagagtggattgcaagaatatctgaatgaacagggtttcaatattgtcggctacgggtgcactacatgcatcgggaattctggggaaattaatgaatcagtgggagctgctattaccgaaaatgacattgtggcggctgctgtgctatccggtaacaggaactttgaggggcgtgttcatccactaacaagagccaattaccttgcatctcctccgttggtggttgcctatgctcttgctggcacggttaacattgactttgaaacggagcctattggcaaaggaaagaatggcaaggacgtcttcttaagagatatctggccaaccacggaagaaattgctgaggttgttcaatccagtgttttgcctgacatgttccgagcaacgtacgagtcaatcaccaagggtaaccccatgtggaataagctgtctgttcctgagaataccctctactcatgggatcccaactcaacttacattcacgagcctccatacttcaaggacatgaccatggatcctcctggtccacacaatgtgaaggatgcttactgtttactcaattttggggacagtatcaccactgatcacatctcaccagctggaaacatccaaaaggacagtcctgctgcaaagtttctcatggagcgtggcgttgaccgtaaggacttcaactcatatggaagtcgccgtgggaatgatgaaataatggccagaggtacttttgctaatatccgtatcgttaacaagctcatgaatggtgaagttggccctaagactgttcacattccatctggagagaagctctcagtctttgacgctgccatgaggtacaagtcatctggtgaagacacaattattctggctggagctgagtatggaagtggtagctcacgtgattgggctgccaagggacccatgctacagggtgttaaagcggtgattgcaaagagttttgagaggattcaccgaagcaacttggtgggaatgggaatcatcccattgtgctttaagtccggtgaagacgcagatactcttggattgactggtcacgaacgctacacgatccatctcccaaccgatatctcagagataagacctggccaagatgttaccgtcactaccgacaacggaaaatctttcacttgcacagtccgcttcgacacagaggtggaattggcatactttaaccatggaggcatacttccatatgttatcagaaacttgagcaagcaatag

SEQ ID NO: 866 - DNA, 945 bp, Arabidopsis thaliana
atggcgacggagaaaagcaagattctggtgatcggaggaactggttacatcgggaaattcctagtagaagcgagcgccaaagctggccactccacattcgctctcgttagagaagcaactctatccgatcctgtcaagggcaaaaccgtccagagtttcaaagatctcggcgtcacaatactacacggagatttgaatgatcacgagagcttagtgaaggctattaaacaggttgatgtggtgatatctaccgttgggagcatgcaaatcttggatcaaaccaagatcatttccgccatcaaagaagccggtaatgtcaagagattcttgccgtctgagtttggggtggatgtggataggacgagtgcggttgagccagctaaatcggcttttgcagggaagatacagatcaggagaaccatcgaagcggaaggaataccatacacttacgctgttaccggttgctttggtggttactacttgccaacattggttcagttcgagcctggtctcacttctcctcctagagacaaagtcaccattcttggcgatggaaatgccaaagaatatttcgcagctgtgatcaacaaagaggaagatattgctgcttacacgatcaaggcggtggatgatcctaggactctgaacaaaatcctatacattaagccttctaacaacactttatcgatgaacgaaatagtcaccttgtgggagaaaaagattggcaagtctcttgagaagactcacctcccagaggaacaactacttaaaagcatccaagagtctccgattcccatcaatgttgttctgtcgataaaccacgcggtgtttgtgaatggagataccaatatcagtatagagccttcctttggtgtggaagcctctgagctttaccctgatgtcaagtacacaagtgttgacgagtatctcagttatttcgcttga

SEQ ID NO: 867 - DNA, 210 bp, Arabidopsis thaliana
atggacgccattgattccgtcgtggatcctcttagagactttgccaaggacagcattcgcctcgttaagcgttgtcataagccagatcgcaaagaattcacgaaagttgcagtccgtacagcaatcgggttcgtagtaatgggattcgtgggattctttgtgaagctcatctttattccaatcaacaacatcatcgtcggtgctacttag

SEQ ID NO: 868 - DNA, 2364 bp, Arabidopsis thaliana
atggacaaggaaaaggagcaaactttggagtggaacgaagcacagaagatagatataagcgttgaccttttggctgcagccaagaaacaccttctcttcctcggagctgttgatcggaaccgttgtctctacgatggccctgcactccaaagagccatctacagatacaatgcttattggcttcccttgcttgctcaatacaccgagtcttcttctatctgtcaaggaccattagtccctcctcttgactgtgaatgggtttggcattgccacaggcttaatccggtgaggtataagactgattgtgagcaattctatgggagagttctggacaattctggcgttgtatcttccgtaaatggaaactgcaaatcacaaactgaaactctatggaaaagattgtatcctacggagccttatgaccttgattttgccaatgcaatctcagagccagcagatgtctcagctcttgagaaatgtaccacttatgatcttgttttagctgtcaagagacaaagcccatttttctaccaggtttcaagagctcatgtagataatgacgtctttctgcaagaagctgtggctagatacaaagcatttctctacttgatcaagggtaaccgagaaagatcgatcaaacttttctgtgttccgacttacgatattgatcttatctggcacacacatcagcttcatgctatctcttattgcaatgatttgactaagatgattggtaaggtcttggagcatgatgatacagactctgaccgtagcaaaggtaagaagcttgatactggtttctctggaactactgctcaatgggaagaaacatttggtcgaaggtattggaaagccggtgctatgaaccgtggtaataccccaaagccagtcacaacttctccttatgtttgttctggaaagaaatcaattgcgaaagaggaagagtcccagaatgtaatccaatatccagaggtgaaagtcattgaagttatcttggagattgttggggttaagaacttaccagatgctcacaaaggaaaggtctttgttctgttcagcaaaactcaaccagattctctgtttaacgctgagcgtaggcttaccgttttatctgagtcttgtggggaaaagcaagttgctttgttccagtgtgagcctacaggagagcttagtttccaactaatgtcttccaagtctaagagcttaggtttcacttctttatcgttttcggagtttctttctccagtaactaaactctctgttgagaagtggttggagttaacaccaactaaaaggggaaaggcagatgatccgaatcccatctctttgagagtcgctgtctcgttcaccccgccaactcgaagtccaactgttctacatttggttcaagcaagaccatcactgaaaggctcttgtttccttcctatgctccgaaaggtacgtcttgctaagagttttacacgcgttgttgatgaaaccgaaacagaggtgatcaacctccaaatgaggaactccaatgacgcagcaccaaaaggtgatagaagacaagttattggtgtaaaagagtgtggtgaaacttatgttttggcagagtatgatggcactttctggtctctgctcgactcaaaatggtcacttaagcagacatgcaatcctgccacagatggtcctctgtttgagctttccggtactcgaatggtgaaagtttactccgggagaaagctggagtatgagccaaaacattgctcaaagctaagaagcgagcaagatttcatgactgctgttgaattctcaaagcaacatccttatggtaaagctgtggggttactcgatttgaagttcggttctattgaggcaaatgagaaatggctggttttgcctggaatggtatcttctttcatactcagtgatcttcttaagaaggaaggctttagtgcagccgcaaaagacacggtgaaagctaatggaataacagaggaaagtacggagattgatgttttgagtcaagaaaagctagaagaagaaacaatgatggatgtggatacgactacaccagttgctgtagcggccgagaagatcaacggtggtgctaggtgcttttcgaaggagctaagtgggaacatgattgaagaagaaggtggtcactgtggtggttgtggaggttgtggtggatgtggaggtggaggtggatgtggtggtggtggtaggtgcggtgggatgacaaagatagaaggctgcggcggcggatcctgcactggcggttccactggctgcggtaattgcggtggaggatgtggtaatatgatgaagaacaatgctaatggaaatgctccatcagtagaaaacgacgcagttacagcttga

SEQ ID NO: 869 - DNA, 975 bp, Arabidopsis thaliana
atggagtgtagatcattggatctgacgattatatctgcggaggatctcaaagacgttcaattgatcggtaaacaagacttgtacgccgtcgtttccatcaacggcgacgctaggacgaagcagaagacaaaggttgataaagattgcggcaccaaacctaaatggaagcatcaaatgaagctcaccgtcgatgacgcagcggcgcgtgacaatcgtcttactcttgttttcgagatcgtggcggatcgtcccatcgctggtgataaacctgtcggtgaggttagcgttccggtgaaggagcttttggatcagaataaaggtgacgaggagaaaacggttacttacgccgtgaggttgcctaacgggaaggcgaaaggatctctcaaattctcgttcaaatttggggaaaagtatacttatggatcttcgagtggtcctcacgcgccggtcccttcggctatggatcataagactatggatcagcccgtcaccgcttacccgcccggacacggtgcaccgtctgcataccctgctcctcccgcgggtccttcttccggatatccaccacaaggacatgacgataagcacgatggtgtttatggatacccgcagcaggctggatatccagctggaaccggtggttatccgccacctggtgcatacccacaacagggaggttaccctggatatccgcctcagcaacagggtggatacccgggttatccgccacagggtccatatggttacccgcaacaaggttatccaccacagggtccatacggttacccgcaacagcaagctcatggtaaaccgcagaaaccgaagaagcatggtaaggctggagctggaatgggactaggacttgggcttggagctggtttattgggtgggttgttggttggtgaagcggtttctgacatcgctgatatgggtgacatgggtgacatgggtgacatgggtggtttcgatttctga

SEQ ID NO: 870 - DNA, 348 bp, Arabidopsis thaliana
atgaaggttgttgccgcatacttgctcgctgttttgagcggaaaagcttcaccaaccagtgccgatatcaagactatccttggatcagttggtgctgagacagaggattctcagattgagcttttgttgaaggaagtgaaaggaaaagatttggctgagttgattgctgctggaagggagaagttagcttcagtgccgtctggtggcggaggtggtgttgcggttgcttctgctacatctggaggtggaggaggtggtggtgcttctgctgctgagtccaagaaagaagagaagaaggaagaaaaggaagaatccgatgatgacatgggtttcagtctattcgagtaa

SEQ ID NO: 871 - DNA, 111 bp, Arabidopsis thaliana
atgcctcgctatgatgatcgctatgggaacactcgtctttacgttggccgattatcatcgagaactaggacccgagaccttgaacgtctttttagcagatacggaaggtaa

SEQ ID NO: 872 - DNA, 2418 bp, Arabidopsis thaliana
atggtggtgattcacggagtgtctcttactccacgcttcactcttccttctcgacctctcaacactggctttaatgccggcaattccaccctctctttcttcttcaaaaagcaccctctctctcggaagatctttgctgggaaacaatctgcggagtttgattcttcgtcacaagctatctctgcttctgagaaagtcttagtacctgataatcttgatgatgatcccagaggtttttcacagatatttgatctagaaagtcaaacaatggaatatactgaggcagtaagaacagaagaccaaacaatgaacgttgtcaaggagagaggggtgaaaccaagaatagttcccccaccgggtgatggcaagaaaatttatgagatagaccccatgttacgaacttacaacaatcatcttgattaccgttatggacagtataaaagattgcgtgaggaaatagacaagtatgagggtggtcttgaggcattctctcgtggctatgaaaagttaggattttcgcgcagtgatgccggtataacttatagagagtgggcgcctggagctaaggctgcatcacttatcggagatttcaacaactggaattctaatgcagatatcatgactcggaatgaatttggtgtttgggagatctttttgcccaacaacactgatggttcgcctgcaattcctcatggctcacgtgtaaagattcgtatggatactccatctggcattaaagactcaattcctgcttggatcaagttctcggtgcaagctccaggtgaaatcccattcaatggcatatactatgatcctccagaagaggagaagtatgtattcaaacatcctcaaccaaagagacctaagtcgctaaggatttatgaagcacatgttggcatgagtagcacggaaccaatggtcaatacgtatgctaactttagagatgatgttcttccccgcatcaaaaagcttggatataatgctgttcaaattatggccatacaagaacattcatattatgccagctttgggtaccatgtcacaaacttttttgccccaagcagtcgctgtgggaccccagaggaactaaaatcactgatagatagagctcacgagttaggcctggtagttctgatggatatcgttcatagccatgcttcaaaaaacacattggatggactgaacatgtttgatggaactgatgctcactattttcactctggacctcggggataccattggatgtgggattcacgacttttcaattatgggagctgggaagtattacgatatctcctttcaaatgcacggtggtggctagaagaatacaagtttgatggatttagatttgatggtgtaacctcaatgatgtatactcatcatggactctcggttggatttactgggaactacaccgaatactttggattggaaactgatgtggatgctgtgaattatctcatgctggttaatgatatgattcatgggctctaccctgaagcgattaccgttggtgaagatgttagtggtatgccaacattctgtattcctgtccaagatggtggcgttggatttgactaccgtttacacatggccatagctgataagtggatagaaatgctcaagaagagagatgaagactggcaaatgggcgacatcatttacacacttaccaacagaaggtggtcagagaagtgtatctcttatgctgaaagtcacgatcaagctcttgttggtgataaaacaattgccttctggttaatggacaaggatatgtatgatttcatggcagtagacagaccatcaactcctcttatcgatagaggaatagctttgcacaaaatgattaggcttataactatgggattaggcggtgaaggttacttaaattttatgggaaacgaattcggacatccagaatggattgattttcccagaggcgagcagcgtctttctgatggtagcgtgattcctggcaacaatttcagttatgacaaatgccgccgcagatttgatcttggggatgcagattatctcagataccgcggactacaagaatttgatcaggcaatgcaacatcttgaagagaattacggttttatgacttcggagcaccaattcatatcacgaaaagacgaagcagatagagtaatcgtattcgaaagaggtgatctcgtctttgtctttaactttcactggaccagcagctactttgattaccgcattggttgctccaagcctggaaaatataagatcgtattggactcggacgatcctctctttggtggattcaataggctcgatcgcaaggcagagtacttcacttatgatggcttatacgacgaacgaccctgctccttcatggtctatgcaccgtgtagaaccgccgtggtttatgctttagcaaaccacgattag

SEQ ID NO: 873 - DNA, 576 bp, Arabidopsis thaliana
atggcgaataagttcactagacaacagatttcagagtttagggaacagttcagcgtatacgacaagaatggtgatggtcacattaccacagaggagttcggtgccgtgatgcgttccctcggtttaaacctgacccaagctgagcttcaggaggagatcaacgattcggatttagatggtgacggaaccatcaatttcactgagttcttgtgcgcaatggctaaggacacttactctgagaaagacctcaagaaagatttcagactctttgacatagacaagaatggtttcatctcagctgctgaaatgagatatgtgaggactatcctccggtggaagcaaactgatgaagaaatcgatgagattatcaaggcagctgatgttgatggtgatggtcagatcaactacagagagtttgccaggcttatgatggccaagaatcaaggtcatgatactaaatatgacacaactggtggcactttggagagggacttggcggccggggttgccaaaaatatcatcgcagcgccaatgaccgacttcatcaaaaatttgttcgaagcgttgttttcttga

SEQ ID NO: 874 - DNA, 1752 bp, Arabidopsis thaliana
atggttttcaaggtttctaccgtatccacatctcctattgatggccagaaaccaggaacttctggtcttcgtaagaaggtgaaagtgttcaagcaacccaattatctagagaattttgtccaagcaacattcaatgctcttacggcggagaaagttaaaggtgccacacttgtggtctctggtgatggtcgttattactcaaaggatgctgttcagatcataattaagatggcagcagctaatggtgtacgacgtgtgtgggttggtaaaaacactctgttatcaactcctgctgtatcagctgtgattcgtgaaagatcaggggctgatggatcgaaagcaactggagcatttatcttaacagcaagccacaatcctggtggccctactgaggattttggaatcaaatacaatatggaaaatggaggacctgctcctgaatcaatcactgataaaatttacgagaacactaagacaatcaaggagtacccaatagcacaagatctacccaatgttgatatttctgctgttggtgtaaccagttttgaaggacctgaaggaaaatttgatgttgaagtttttgatcccgcagatgactacgttaaattaatgaagtcaatcttcgattttgaagccatccggaaattgctatcatctccaaagtttacattctgctatgatgcattgcatggagttgctggagcctatgcacatcgcatctttgtcgaagaactcggtgcgcaagaaagcgcattattgaactgcactcccaaggaggactttggaggagggcatccggatcccaatttgacctatgctaaggagcttgtggcacgaatgggattaggtaaatccgacactggaggtgaacctccagagtttggcgccgctgctgatggtgatgcagaccgtaacatgatccttggtaaaaggttctttgtaactccttcggattcagttgccataattgctgcaaatgctattggtgccatcccgtacttcagctctggtttgaaaggtgttgcaaggagcatgccaacctcagctgctcttgatgtcgttgcaaaaagcttgaatttgaagttctttgaggttccaacaggctggaagttttttggtaatctgatggatgctgggatgtgttctgtttgtggagaagaaagttttggaactggctcggatcatatccgtgagaaagacggaatatgggcagttcttgcatggatgtctatacttgctcacaagaacaagggaaatattgacggtaacgctaaactggtgtcagttgaagacattgtccgccagcattgggctacctacggtcgtcactattacactcgttacgactatgagaatgtagacgcaggtaaagctaaggaactgatggagcatttggtcaaattgcaatcttcaattcctgaagttaacaagattgtgaaaggaattcgttcggacgtggcaagcgtcgccagtgctgatgaattcgagtacaaagatccagttgatggatccatttcgaagcaccagggaatccgttacttgtttgaagacggatcacgacttgttttccgtctctctggaactggctcagaaggagcaaccatccggctttacatcgaacagtacgaaaaggatgcttcaaaaaccggccgagaatcccaggaagctttgtctcctctggttgacttagctctaaagctgtcgaagatggaagagttcacaggccgatcagcccccaccgtcataacataa

SEQ ID NO: 875 - DNA, 1143 bp, Arabidopsis thaliana
atggctgatgataaggagatgcctgctgctgtagttgatggacatgatcaagtcactggtcatattatttccaccacaatcggtggcaaaaatggtgaaccaaaacagacaattagttacatggcggagcgagttgttggtacaggctcgttcgggatcgttttccaagcaaaatgtttggagactggagaaaccgtggcgataaagaaggttttgcaagatagaagatacaagaaccgagaacttcagttgatgcgtgtgatggatcatccgaatgtggtttgtttgaagcattgcttcttttcgactacaagtaaagacgagcttttcttgaacttggttatggagtatgtccctgagagcttgtatcgagttctgaaacattatagtagtgcaaaccaaagaatgcctcttgtctatgttaaactttacatgtatcagatcttccggggacttgcttacattcacaatgttgctggagtttgtcacagagatctaaagcctcaaaatcttctggttgatcctcttactcatcaagtcaaaatctgtgactttggcagtgcgaaacagctcgttaaaggtgaagccaacatttcttacatctgctcacgattctaccgtgcacccgagctcatatttggtgccactgagtacacaacttctattgatatctggtctgctggttgtgttcttgctgagcttcttcttggtcagccattatttcccggagaaaatgctgtggatcagctcgttgaaattataaaagttcttggtacaccaactcgagaagaaatccgttgtatgaatccacattacacagatttcaggtttccacagataaaggcacatccctggcacaagatcttccacaaaaggatgcccccagaagcgattgattttgcatcaaggctgcttcaatactctccaagtctaagatgcacagcgctcgaagcttgtgcacatccgttctttgatgaactcagagaaccaaacgctcgtttaccaaatggacggcctttcccgcctctcttcaacttcaaacaagaagtagctggatcatcacctgaactggtcaacaagttgattccagaccatatcaagagacaattgggtctaagcttcttgaatcaatctggaacttaa

SEQ ID NO: 876 - DNA, 1824 bp, Arabidopsis thaliana
atggacactaagatcggatctatcgacgcgtgtaacccgaccaaccacgatatcggcggtcctccaaacggcggagtctccaccgttcaaaacacaagtccacttcactccaccaccgtcagcccctgcgacgcgactcttggccgttacctagcaagacggttagtcgaaatcggcgtcaccgatgtcttctccgttcctggtgatttcaacctgacgcttctcgatcacctaatcgccgaaccaaacctcaagctgatcggttgctgcaacgagcttaacgccggatacgctgctgacggttacgctagatctcgcggtgttggtgcgtgcgtcgttacgttcaccgtcggtggattgagtgttctgaatgcgatcgccggtgcttacagtgagaatctgcctctgatttgcatcgtcggtggtccaaactccaacgattacggtaccaataggattcttcatcatacaattggtttacctgatttcactcaagagcttaggtgttttcaagctgttacttgttttcaagctgtgattaataacttagaagaggctcatgaacttatcgatactgcgatttcaactgctttgaaagaaagcaaacctgtttatatcagtatcagctgtaatttaccggcgattcctcttccgacgtttagtcgtcatcctgttccgttcatgcttccgatgaaggttagcaatcagattggtttagatgcggcggtggaggcagctgctgagttcttgaacaaagctgtgaagccagttcttgttggtgggccgaaaatgcgggttgcgaaagccgcggatgcttttgttgagcttgctgatgcttctggctatggtcttgctgtgatgccttctgctaaaggacaagtacctgagcatcacaagcattttatagggacgtattggggagctgtgagtacagctttttgtgctgaaatcgttgaatctgcggatgcttatctgtttgcaggtccgattttcaacgattacagttctgttgggtattctctgcttctcaagaaggagaaggcaatcatcgttcagcctgatcgggttactatcggtaacggacctgcgtttggatgtgttcttatgaaggattttctaagcgagttggctaaacgaattaagcacaacaacacttcttatgagaattatcacaggatctatgtcccagaaggaaagcctttgagagataacccgaatgagtctttgagggttaatgtactgttccaacacattcagaatatgctctcttctgagtctgctgtgcttgctgagacaggagattcctggttcaactgtcagaagctgaagctccctgaaggatgcggttacgaattccaaatgcagtacggatcaattggctggtcagtgggtgctactctaggctatgctcaagccatgccaaacaggcgtgtcattgcttgtattggagatggtagtttccaggtaaccgcacaggatgtatctacgatgatacggtgtgggcaaaagaccataatcttcctcatcaacaacggaggctacaccattgaggtggaaattcacgatggtccttacaatgtcataaagaactggaactacacagcttttgttgaggccatacacaatggagaaggaaaatgctggactgccaaggtgagatgcgaggaggagttagtgaaagcaatcaacacggcaaccaatgaggaaaaagagagcttttgtttcattgaagtgatagtgcacaaagacgatacaagcaaggaacttttggagtggggctctagagtctctgctgctaatagtcgtcccccaaatccgcagtag

SEQ ID NO: 877 - DNA, 1440 bp, Arabidopsis thaliana
atggtgttggcggagctcggcggccggataacccgcgccatacagcagatgaacaatgtgacaataatcgatgaaaaggttttgaatgatttcttaaacgagattactcgcgctttgctccagtccgatgtttcttttggccttgtggaaaagatgcagaccaatattaagaagatcgttaacctcgacgatctagcagctggccacaacaaacgcctgatcatcgagcaggctatcttcaaggaactctgtaggatgctggatccaggaaagcctgcctttgcccccaaaaaggccaaacctagtgtagtgatgttcgtcggtttacaaggtgctggaaaaaccacaacatgtaccaagtatgcttactatcatcagaagaaagggtacaaagcagctctagtgtgtgcggatactttcagggccggtgcttttgatcagctgaaacagaatgccaccaaggctaagatccccttttatggaagctacacagaatccgatcctgtgaaaattgctgttgagggagttgataggttcaagaaagaaaagtgtgatcttattattgttgacaccagtggtcgccataaacaagcagcttctctctttgaagaaatgcgtcaagttgctgaagcaacggaaccagatcttgttatatttgttatggatagcagtattggtcaagctgcatttgaacaagctgaagcttttaaggaaactgtatctgttggagctgtaattattactaagatggacggccatgccaagggaggtggtgctcttagcgctgttgcagctacaaaaagtcctgtgatattcattggaacaggagagcatatggatgagtttgaagtgtttgacgttaaaccatttgtcagccgtctcttaggaaagggtgattggtctggactcgtggataaactacaagaggtggtacctaaagatctacagaatgaacttgtagaaaatctctctcagggtaactttacgttgagaagtatgtacgaccagttccagtgctctctgcggattccacttaatcagcttttctcgatgctgcctggaattagtgctgaaatgatgccgaaaggacatggtgaagaaagccgagtgaagatgaagcgatacatgacaatgatggattctatgacaaataaagaacttgacagcccaaacccaaagatttttaacgagtcaaggataatgaggatagcgagagggtcagggaggttagtaagagaagtgatggagatgttggaagagtacaagaggatagcaaagacaatgaaagggatcaagatcccaaagaacggagacatgagcaaggtcataccgcctcagatgctaaaacagatgggcggcatgagcggtctgcagagtctcatgaagcagatgggttcggctaaggacatgatgggaatgtttggtggcggaggcaagtag

SEQ ID NO: 878 - DNA, 1104 bp, Arabidopsis thaliana
atgcgtaggtggttgtgctgttcttgtcgtgtacaagaatcttacccatcagctgaaaataaccgattgaaaacccctcctactcgccattacgactatggacgtaacaacaagaaaacaccagctcctgtgaagcctcctgttttgaaggagcctccgcctattgatgtccccgcaatgtcattggttgagctcaaagaaaagactcagaattttggatcaaaggcattgattggagaaggatcctatggaagagtgtactacgcaaactttaatgatgggaaggccgtggctgtgaaaaagcttgataatgcatctgaacccgaaacaaatgtcgagttcttgactcaggtctctaaagtttcgaggctgaaaagtgacaattttgttcagcttcttggttattgtgtagaagggaaccttcgtgtccttgcttatgagtttgccacaatgagatcattgcacgacatcttacacgggagaaagggagtgcaaggagcacaacctggtccaacacttgagtggatgcaacgagtccgagttgcggttgatgcagctaaaggattagaatacttacacgagaaagttcaacctgcggttatacacagagatattcgatctagcaatgtgcttattttcgaagatttcaaagccaagattgctgactttaatctttccaatcaagctcctgatatggctgctcgtcttcattccactagagttttggggaccttcggttatcatgcaccagaatatgcgatgacaggacagttgacacagaagagtgatgtttacagttttggagttgtgcttttggaacttcttaccgggagaaaaccggttgatcatactatgcctcgtggtcaacagagtcttgtcacttgggctactccaaggctgagtgaagacaaagtgaaacaatgtgttgatccaaaactcaaaggagagtatcctcctaaagcagtggcaaagcttgcagcggttgcagcgttgtgtgtgcaatacgaagcagagtttaggccaaacatgagcattgtagtaaaagctcttcaaccgctcttgaggtcagcaacagctgctgctcctccaacacctcaaccttga

SEQ ID NO: 879 - DNA, 1101 bp, Arabidopsis thaliana
atgcgtaggtggatctgttgtggggataaaaaaggagattcagatttatcaaatgaagaggtgcatttgaaaagtccatggcaaaattctgaggcaaatcaaaagaatcaaaaaccacaagctgttgtaaagcctgaggcgcagaaagaagctcttcccatcgaagttcctcccttgtctgtggatgaggttaaagaaaagactgacaattttggatctaagtctctgattggtgagggttcttatggaagggtatattatgcaactctaaatgatgggaaagcagttgctttgaagaaactcgatgttgcacctgaagctgaaacaaacaccgagttcctgaatcaggtttccatggtttcaagactaaaacatgagaatctcattcaactggttggttattgtgttgatgaaaacctccgtgttcttgcttatgagtttgcaacaatgggatcactgcacgacattctacatggtaggaagggagttcaaggagcacagccaggtccaacacttgactggttaacgagggtgaagatagctgttgaggcagctaggggtttagaataccttcatgagaaggttcagcctcctgtaatacatagagacataagatctagcaatgttctcctttttgaagactatcaagcaaaagttgcagattttaatctctcaaatcaagctcctgataatgctgctcgtcttcactctacgagagttttaggcacctttggctatcacgctccagaatatgctatgacaggacagttaacgcagaagagtgacgtgtatagctttggggttgttcttctagagcttttgacaggaaggaaacctgtagatcatacaatgccacgcggccaacagagtcttgtaacttgggctacaccgagactcagtgaagataaagtgaagcaatgtgttgatccaaagttaaaaggagaatatcctcctaaatcagtagccaagctagcagcggtggcagcattatgtgtgcaatacgaatctgagtttagaccaaatatgagtatagttgtaaaagctttgcagccacttctcaaaccaccagcaccagccccagccccagtaccggaatcctga

SEQ ID NO: 880 - DNA, 1563 bp, Arabidopsis thaliana
atggctcacactctcggtctcactcaacccaactccactgagcctcacaagatctcgttcactgcgaaggagatcgatgtaattgaatggaaaggagacatactcgtagttggtgtgacagagaaggacttagccaaagacggtaactcaaagtttgagaatccgatcttgagcaaggtcgatgctcacttaagtggacttttagctcaagtctcttccgaggaagatttcactgggaaacctggtcaatcgactgttctcaggcttccgggtttaggatcaaagagaatcgctttgatcggtcttggacagtctgtttcgtctccggtggcttttcatagccttggtgaagctgtagctacagtttcaaaagcttctcaatctactagtgctgctattgtgcttgcttcaagtgtttctgatgaatctaagcttagttctgtatcagctttagcttcaggcatagtacttggtttatttgaagatggtaggtataagtctgaatcaaagaaaccatctttgaaagctgttgatattattggatttggaactggggctgaggtagaaaagaagctgaagtatgctgaagatgtttcttacggtgtaattttcgggagagagctcattaattctcctgccaatgtgcttactcctgctgtactagctgaggaagcagcaaaggtggcttctacgtacagtgatgtcttcactgcaaacatcttgaacgaagagcaatgcaaagagttgaagatgggttcttacctagctgttgctgctgcgtcggctaatcctcctcacttcatccaccttgtctataaacctccgaatggctctgttaagaccaaacttgctcttgttggaaaaggattgacctttgacagtggtggctacaacattaagactggacctggctgctcaattgagctcatgaaattcgacatgggcggttcagctgctgttcttggcgctgcgaaagctattggtgagattaagcctcctggtgttgaggttcatttcatcgttgcagcctgtgaaaatatgattagtggaaccggaatgagacctggagatgtcatcactgcctcaaacggaaagaccattgaggtcaacaacacagatgctgaaggtcgtctaacactcgcagatgctctagtgtatgcttgtaaccaaggcgtcgacaagattgttgacctcgctactttgaccggggcctgtgttattgctcttggaacttcaatggcaggaatctatacacctagcgacgagcttgcaaaggaagtgattgctgcatcagaaaggagtggagagaagctgtggaggatgccactggaagagagctattgggagatgatgaagtctggagtggctgatatggtcaacacaggcgggcgggcaggaggatccatcaccgcggctctcttcttgaaacagtttgtgagtgagaaggtgcaatggatgcatatcgacatggctggaccggtgtggaacgagaagaagaagtctgggaccgggtttggtgttgctacgcttgttgaatgggtacagaagaattcatcttcgtga

SEQ ID NO: 881 - DNA, 1662 bp, Arabidopsis thaliana
atggatgtctccaacacgatgctccttgtagctgttgttgcagcttactggctatggttccagcggatctcaaggtggctaaagggtccacgtgtttggccagttttgggcagtcttccgggtctgatcgagcagcgtgaccgtatgcacgactggatcactgagaacctccgtgcgtgtggcggcacttatcagacatgtatctgcgccgtacctttcttggcaaaaaagcaaggtctcgtgaccgtcacgtgcgatcccaagaacatcgaacacatgctcaagaccaggttcgacaactaccctaaaggtcctacgtggcaagccgtgttccatgacttcctcggccaaggtatcttcaactccgacggtgacacttggctcttccagcgtaaaaccgccgctcttgaattcaccaccaggacgttgaggcaagcgatgggtcggtgggtgaaccggggaatcaagctccggttttgtccaattctcgaaacggctcagaacaattacgagccggttgatctccaagacttaatactacggctcacattcgacaacatttgcggtttagcattcggtaaagacactcgaacctgcgcaccgggacttcccgagaacggtttcgcctcggctttcgaccgagccaccgaagcttctctccagcggtttattctaccagagtttctatggaggctgaagaaatggcttggactcggcttagaagtcagcttgagccggagcctaggagagatcgatgggtatttagatgctgtcattaatacacgtaagcaagaattgctgagtcagcgagagagtggggtccagcgtcacgacgatctcctctctcgtttcatgaagaagaaagaccagtcgtacagcgagacgttcttacgacacgtggcgcttaacttcatcctagctggacgtgacacgtcatcagtagcgttgagctggtttttctggctcatcacgacgcatccgacggttgaggataagatcgtccgcgagatatgctccgttctgattgagacacgtggaaccgatgtatcgtcgtggacggcggagccgttggaattcgatgaggtcgaccggttggtttacctgaaggccgcgctctctgagacgttgaggctttacccgtcggtgccggaagattcaaagcacgtcgtgaacgacgatatcttaccggacggaactttcgtaccggcgggatcgtcggtgacttattcgatctacgcggcggggaggatgaagagcacgtggggagaggattgcttggaattcaaaccggagaggtggatctcgccggacgatggaaaattcgtgaatcacgatcagtaccgattcgtggcgtttaacgccggacctaggatctgtctaggaaaagatctagcgtatctgcagatgaagacgatcgcggcggcggttttactcaggcatagactaacggtggcgccgggacacaaggtggagcagaagatgtcgttgactttgttcatgaagaacggacttttggtcaacgtgcacaagagggatttggaagtgatgatgaagagtctcgtacccaaagagagaaacgacgtcgttgttcttaacggaaaatgcaacggcggtatcggtgaaggcgtcgccgttaatgcggctgtggcggttgccgtgtaa

SEQ ID NO: 882 - DNA, 1428 bp, Arabidopsis thaliana
atggatggagaggttacttcttggattaggagagcaaatttctctcatactgtttgttatcgtatgattacgccgagtttagaatctatgccttttactgtaaaccaagagaagatgcagaggaatccagttactaataagaagagatctgtttctccgttgcctcatatggctctttctgatgcttttatcgaagcaaagtctgatattaagaggttttctactccacatcctagaagagtggaaccagagaagggaatgaaggccaagtcgtcgtcccgcaaagattcttctgagaaaaaatcagttaatctacggtccctgtctcactcgggtcctattagggatcttagtacgcagaaagttaaagagaggggaaagagcaagatagataagaagtcttcaaagtctgttgactatagaggttctaaagtaagttctgcaggagtgcttgaagaatgcctcattgatgtgtctaagttgtcttatggggataggtttgctcacgggaaatatagccagatttatcatggtgaatatgaaggcaaagctgttgctctgaagattatcacagcgcctgaggatagtgacgacatattcttgggagctcgtttagaaaaagagtttatcgtggaagccactcttttatctcgactaagccatccaaatgtcgttaagtttgttggagtgaatactggaaactgtatcatcacagagtatgtacctcgagggtctttaagatcatatctgcacaagctcgagcagaaatcccttcctttggaacagctaatcgattttggtctggatattgctaaaggaatggaatatattcactcaagagagatagttcatcaggatctgaagccagaaaacgtgttgatcgacaatgactttcacttgaagattgctgactttggcatagcgtgcgaggaggagtactgtgatgttttgggggataacataggaacttataggtggatggcacctgaagttttaaaacggataccacatggacggaagtgcgatgtttatagttttggacttcttttatgggaaatggtagctggagcacttccatatgaggagatgaaatttgctgaacaaattgcctacgcagttatatacaagaaaattaggccagttataccgacggattgtccagcggccatgaaagagctgatcgagcgatgttggtcatcgcaaacagacaagagaccggaattctggcagattgtcaaagtgttggaacatttcaagaagtctctaacaagcgaaggaaaacttaatcttttacctagccagatctgtccagaactaaagaaatgtcctaaattctggattcatatattcggatcattccaccaccacagcagcggtggcggcagcagcagcaacaactcagccttacctaagcctaaattcgcttga

SEQ ID NO: 883 - DNA, 1173 bp, Arabidopsis thaliana
atgactaagaacagtaaccacgacgagaatgagttcatcagctttgaaccaaatcagaacacgaagatacgctttgaagatgctgatgaagacgaagttgctgaagggtctggtgttgccggcgaggaaactccccaagatgagtccatgttcgacgccggagagagcgccgacaccgctgaagtaactgatgataccaccagtgccgattactacttcgattcttactctcactttggaatccatgaagagatgttgaaggatgttgtgagaacaaagacttatcagaatgttatttatcagaacaagtttcttatcaaggacaaaattgttcttgatgttggagctggaaccggaattttgtctctgttctgtgccaaggcaggagctgctcatgtctacgctgttgagtgttctcaaatggctgacatggcaaaggagattgttaaagctaatggattttctgatgttattacggtattgaaagggaagattgaggagatagagcttcccactcctaaagtggatgtgattatatcggaatggatgggttactttttgttgtttgaaaatatgttggacagtgtcttgtatgctcgtgataaatggcttgttgaaggtggagttgtgctaccagacaaagcctctctgcatcttacagccatagaggattcagagtacaaagaagacaaaatcgaattttggaacagtgtgtatggttttgacatgtcatgtattaagaaaaaagctatgatggaaccacttgttgacacagtcgaccaaaaccaaatcgtcaccgatagtaggcttctaaagacgatggatatctcaaagatgtcctctggtgatgcttccttcacagctccctttaagcttgttgcacaacgcaatgactacatccacgcccttgtagcctactttgatgtatcgtttaccatgtgccacaagctgctgggcttctcaacaggaccgaaatcccgagctacacactggaaacaaacagttctgtatctagaagatgtgttaaccatatgtgagggtgagacaatcactggaactatgtccgtttctcctaacaagaagaatcctcgagacattgacataaagctaagctattctttgaatggccagcattgcaagatctcaaggacccaacactacaaaatgcgttaa

SEQ ID NO: 884 - DNA, 1056 bp, Arabidopsis thaliana
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 885 - DNA, 960 bp, Arabidopsis thaliana
atgtcttcggatcctgacaaaatgatgtccaaagccgacaaaatgacaaagctcacgcttactagatggagtgctgattggagaggtgctactgagttgtatgagcaagcagcaaatgggtttagagcatcaaacaaatatgagaaagctaaagtggctctcgagaaagcttcaaaaggacaagagatgcaagcttctccttgggatgctgcaaagcatatggagtctgctgctgccttagcacagaagctaagtatttggaatgaagttgctgatttttatagaaaggcgtcggagctgtatgttgagtgtggaagggcacaacccgcatcagatgctcttggaaaggctgcccgtgctttggaagatgtcaaaccagatgacgccatccaactatacactgatgcttgtgaaattcttgaagaggatgggagggaccaaatggcctttgatctgtaccgtgcttgtgctaatgtctacattaagcttgagaagttcacagatgctgcaacctttttcttaagattgggtgtagctgctgataagtgtgatgcgacaaatagccagtgtaaggcctatctcagtgcaatcatcttatatctgtatgctcacgacctgcagcaggcagaaaaatgctacaatgactgttctcagattgatgcctttctgaagagtgatcagagccgaagtgctagtagacttctcaccgcctataatgaaggtgacattgaagaaatcaagaaggtggcgagtgcaagcactgtctcgaatttggatcatatggtaattcacttaaatgatctgtcgaatcctaatcctaattatgtctttctgtgtttccgaatgtatttgttctgcattatgctgattatcaagttggctaggaagctacccactggagatgttactgcaattcagatgaacactaatgacgatctagacgaggatgatctcacttaa

SEQ ID NO: 886 - DNA, 1599 bp, Arabidopsis thaliana
atggcggctacaggatctggacggtctcaattcatttccagttccggcggtaaccgaagcttctccaattctccactcatcgagaactctgattctaatcagattattgtctctgagaagaagagctggaagaatttctttgcttacttaggccctggttttcttgtttcaatcgcatatattgatcctggaaactttgagactgatctgcaagctggagcacactacaagtatgaattactttggatcatattggtggcctcatgtgcggctttggtgattcaatctctggctgctaatcttggtgttgtcacaggaaaacatttggctgagcaatgtagagccgagtactccaaagttccaaactttatgttatgggtcgttgctgaaattgcagtagttgcttgtgacataccggaagttatcggaacagcttttgctctgaacatgctctttagcataccggtgtggatcggtgttcttctgacaggcttaagtacgctgattcttctcgcacttcaaaaatacggggtgagaaagctggagttcttgatagcgtttcttgtgttcacaattgcaatatgcttctttgttgagcttcattactcaaagccagacccaggagaagtcctacatggtctctttgttcctcaacttaaaggaaatggtgcaactggtctcgcaatctctttgctcggagccatggttatgccgcataatctcttcctccactcggccttggttctctcgaggaaaatccctcgttccgcttctggtatcaaggaagcttgcaggttttacttgatagaaagtggattggctctaatggtggcctttctcataaacgtctctgtaatatcagtaagcggggctgtttgtaatgcccccaacttaagccctgaagatcgagctaattgtgaggatttggacttaaacaaggcttcgtttctgctacggaacgttgtgggaaaatggagctcaaagctatttgcaatcgcgcttcttgcttctggtcagagctcgacgataaccggaacttatgctggacaatatgtaatgcagggctttcttgatctcagactcgagccatggctcagaaacttactaacaagatgtttagctataatcccgagtctaattgttgctctcatcggtggttcagctggagctggaaagttaatcatcattgcctcgatgatcttatcctttgagctcccgtttgcgttggttcctcttctcaaattcacaagttgcaaaaccaagatgggttcacatgtcaacccaatggcgattacagctttgacttgggtcattggtggtttaatcatgggaataaacatatactatctagtaagcagtttcatcaaactgcttatccacagtcatatgaagcttatcctcgtcgtcttctgtggaattcttgggttcgcaggcattgctctctatttagccgccatagcttaccttgtcttccggaaaaacagagtagccacttctcttcttatttcaagagactcacaaaatgtggagacacttccaagacaggacattgtcaacatgcagttaccatgtagagtatctacctccgatgttgactga

SEQ ID NO: 887 - DNA, 5815 bp, Arabidopsis thaliana
tatagaattatggtaatggaggatgagcctagagaagccacaataaagccttcttattggctagatgcttgcgaggacatctcttgtgatcttatcgatgatctcgtgtctgaatttgatccttcctctgttgctgtcaatgaatccactgatgaaaacggcgtcatcaatgattttttcggtgggattgatcacattttagatagtatcaagaacggtggaggcttaccaaacaatggcgtttctgataccaattctcaaatcaacgaggttactgtaactcctcaggttattgctaaggagacagtgaaggagaatgggttgcaaaagaatggcggtaagagagacgaattctcgaaagaggaaggagacaaggataggaagagagctagggtttgtagttatcagagtgaaaggagtaacctttcaggtagagggcatgttaataattttagggagggagataggtttatgaataggaaacgtactcgtaattgggacgaggcgggtaacaataagaagaaaagggaatgtaacaattacagaagagatggtagagatagagaagttaggggttattgggagagggataaagttggttccaatgagttggtttataggtcagggacttgggaagctgatcatgaaagagatgttaagaaagtgagtggtggaaaccgcgaatgcgatgtcaaggcagaggagaacaagagtaagcctgaagaacgtaaagagaaggttgtggaagagcaagcaaggcgataccagttggatgttcttgaacaagctaaagcgaaaaacacgattgctttccttgagaccggtgctggaaagacacttatcgcgattcttcttattaaaagtgttcataaggatctgatgagccagaacagaaaaatgctctcggtgttcttggttcccaaagtgcctttggtttatcagcaagcagaagtgatccgtaatcaaacttgttttcaagttggacattattgtggtgagatgggacaggacttttgggattctcgaaggtggcaacgagagtttgagtctaagcaggttctagttatgacagcacaaattctgttgaatatactgagacacagtatcattagaatggaaacaattgatcttcttattctcgacgagtgtcaccacgctgtcaagaaacatccatactctttagtgatgtcagagttttaccatacaactcctaaagataaaagacctgccatctttggaatgactgcttcgcctgttaatttaaagggtgtttcaagccaagtagattgtgcgataaagatacgtaacctcgagaccaagttggattctacggtttgtactataaaagatcgaaaagaattagagaaacatgtgcctatgccttcagagatagtcgtcgagtatgacaaagctgctactatgtggtctcttcatgagacaataaagcaaatgattgcagctgttgaagaagcggcacaagcaagttcaaggaaaagcaagtggcaatttatgggggctagggatgctggagcaaaggatgaattgagacaggtttatggcgtctctgaaagaacggagagcgatggtgctgccaatttgattcataaacttagagctatcaattatactcttgctgaattgggtcaatggtgtgcttacaaggtgggacaatcattcttgtctgctttgcaaagtgatgagagggtgaatttccaagtcgacgtgaagtttcaagaatcatacctcagtgaggtggtgtcactcttgcaatgtgagcttctggaaggcgctgctgctgaaaaagtcgcggcggaagttggcaaaccagaaaatggtaatgcacatgacgagatggaggagggagagctccctgatgatcctgtggtctcgggaggggagcacgttgatgaagtaataggcgccgcagtggctgatgggaaagttactccaaaagtacaatcattgatcaaactactcctcaaatatcagcacacagctgattttcgagctattgttttcgttgagagggtggttgctgctttggttcttcctaaggtttttgcggagctgccttcgcttagttttatacggtgtgccagcatgattggacacaataacagccaggagatgaaatcatctcaaatgcaggatacaatttccaaattccgagatgggcatgtgacactgttagttgccacaagcgttgctgaggaaggacttgatattaggcaatgtaacgttgttatgcgtttcgaccttgcaaagacggtgctggcatacattcagtctcgtggccgggcaagaaagcctggatcagactacatactcatggttgagagaggaaatgtatctcacgcagcgttcctaaggaatgctaggaacagtgaggagacacttcgaaaagaagcaatagaaaggactgatcttagtcatctcaaagatacatcgagattaatctcaattgatgctgtgcctggtacagtttataaggtggaggcaactggtgccatggttagcttgaattccgcggttggtcttgtacatttctactgctctcagcttcctggtgacaggtatgcaatccttcgtcctgagtttagcatggagaagcatgaaaagcctgggggccacacggaatattcatgtaggcttcagcttccttgcaatgcaccgtttgaaatacttgagggtcctgtttgcagttcaatgcgtcttgcacaacaggctgtatgtttagctgcttgcaagaaactgcatgagatgggtgcatttaccgatatgctattaccggacaaaggaagtggtcaagacgctgagaaggctgaccaagatgatgaaggtgagcctgttcctggaactgctagacatagagagttctatcctgaaggtgtggcggatgtacttaagggagaatgggtttcatctggaaaggaagtttgtgagagctcaaagctattccatttatacatgcataatgtcagatgtgtagattttggctcttcaaaagatccattcctaagcgaagtttcagagttcgcgattctttttggcaatgagctggatgcagaggtattatcgatgtctatggatctttatgttgctcgggccatgatcactaaagcatctcttgctttcaagggatcacttgatattacagaaaaccagctatcatctctaaaaaagtttcatgtgaggttaatgagtatcgtgttggatgttgatgttgaaccctccacgacaccatgggatcctgcaaaggcctacctgtttgtccctgttactgacaatacgtctatggaacccataaaagggatcaactgggaattggttgaaaagattacgaaaaccacagcgtgggacaaccctcttcagagagctcgtcccgatgtatatctcgggactaatgagagaactcttggtggggacagaagggaatatgggtttggtaaacttcgtcacaacattgtatttgggcagaaatctcacccaacttatggtattagaggagctgttgcatccttcgatgttgtgagagcttctggattgttacctgtgagagatgcttttgagaaggaagtagaagaggatttatcaaaaggaaaattgatgatggctgatgggtgcatggttgcagaagatcttattgggaaaatagtgacagccgcacattccgggaagcggttttacgtagattcaatttgttatgacatgagtgcagaaacatctttccctaggaaagagggatatcttggtcccctagagtacaacacgtacgctgactattacaagcaaaagtatggagttgatttgaactgtaagcaacaacctttgattaaaggacgtggtgtttcgtattgcaagaaccttctttctcctcggtttgaacagtcaggtgaatctgagacagtccttgataagacatattacgtgtttcttccacctgaactatgcgttgtgcatccgctttcgggttcacttatccgaggtgctcagaggttaccctctataatgagaagagttgagagcatgttactcgctgttcaactcaaaaatttgattagttatcctattcccacatcaaagattcttgaagccttgactgccgcctcgtgccaggaaacgttctgctacgagagagctgagcttttaggagatgcgtatctaaaatgggttgttagtcgttttctgtttctcaagtatcctcaaaagcacgagggtcagcttacaaggatgaggcaacaaatggttagtaatatggttctttatcagtttgctctggttaaagggcttcagtcatatatccaggcggatcgattcgccccgtctaggtggtctgctcctggtgtgcctccggttttcgacgaggacacaaaagatggaggatcttcgtttttcgatgaagagcaaaaacctgtttccgaggaaaacagcgatgtgtttgaagatggggagatggaggatggtgaactagagggtgatttgagttcgtaccgagttttatctagcaaaacgttagctgatgttgttgaggctttgattggtgtttattacgtcgaagggggtaagattgcagctaatcatttgatgaaatggattgggattcacgtggaggatgatcctgatgaagtcgatggaacattgaaaaatgttaatgttccagagagtgtgctcaagagcatcgactttgttggtcttgagagagctcttaaatatgagtttaaagagaaaggtcttcttgttgaagctataacacatgcttcaagaccatcttcaggtgtttcgtgttaccagagattggaatttgttggtgacgcggtcttggatcatctcatcacaagacatctatttttcacatacacaagccttcctcctggtcggttaacagatcttcgagctgcagcggttaacaacgagaattttgctcgcgttgcggttaaacataaactccacttgtaccttcgtcacggttcaagcgccctcgaaaaacagattcgggaatttgtgaaggaggttcaaaccgagtcatcgaaaccggggtttaactcttttggtttgggagactgcaaagcaccaaaagttcttggagacattgttgaatctattgcaggtgctatttttcttgatagtggaaaagatacaactgctgcttggaaggtttttcaacctttgcttcagcccatggtgacaccagagacacttccaatgcatccggtgcgagagctacaagagcggtgccagcaacaagcagaagggttagaatacaaagcgagtaggagtggtaacacagcgactgtggaagttttcatcgacggtgttcaagttggagtagcgcaaaacccgcagaagaaaatggctcaaaagctagctgcgaggaacgcacttgcagctttgaaagagaaagaaatagcagaatcaaaggagaagcatatcaacaacggtaatgcgggagaggatcaaggcgagaatgagaatgggaacaagaagaatgggcatcagccgtttacgagacaaacgttgaatgatatttgtttgaggaagaattggccaatgccttcttacagatgtgtgaaagaaggaggaccggctcatgcaaagagatttacgtttggggtaagagttaatacgagcgatagaggatggaccgatgagtgtattggcgagccaatgccgagtgttaagaaagctaaggattcagctgcggttcttctacttgagcttttaaataaaactttttcttgattcttttactctcttcaacgagatgtagtcattacattttaaaccttaaaaccatagtggttgtagtgttttaatt

SEQ ID NO: 888 - DNA, 531 bp, Arabidopsis thaliana
atgtcttctcatactgcaactaagtatgatgttttcctaagtttcagagggcatgacactcgccacaacttcatcagttttctctacaaagaactggttcgaaggagcattcgaaccttcaaagacgacaaagagctggagaatggccagaggttttcgccggagctcaaaagccccatcgaggtgtcaagattcgccgtcgttgttgtctcagagaactatgctgcgtcttcttggtgtctcgatgagctcgtaacgatcatggatttcgaaaaaaagggttccatcaccgtgatgcccatcttctacggcgtggaaccgaatcatgtgaggtggcagaccggagtactcgctgaacagtttaagaaacatgcgagtagagaagatcctgagaaagttcttaaatggaggcaagcattgaccaattttgcgcaactctccggcgattgttcaggtgatgatgactcgaagctggtggacaaaattgctaacgagatatcaaacaagaagacgatttatgcaacaatatga

SEQ ID NO: 889 - DNA, 2235 bp, Arabidopsis thaliana
atggggtcaggtgcatcgaagaatactgaggaagatgacgatggttccaatggcggaggtggtcagctctacgtttcactcaaaatggaaaactctaaggttgaaggagagctcactcctcatgtctatggctctcttcctctcatcggttcctgggatccttccaaagctcttccgatgcaacgtgaatctgcgttaatgtcggagctaagcttcgttgttcctcctgatcacgagactttggacttcaagtttttgttgaagccaaagaacagaaatacgccctgcatagtggaggagggtgaaaataggcttcttactggtggttcgttgcaaggagatgctagattagctctgtttaggctggaaggtgatgtgattgttgaattccgagtcttcatcaacgctgacagagtttctccaattgatcttgctactagttggagagcttatagggagaacctccagccttctactgtacgtggaattcctgatgtcagcattaatcctgatccaaaatctgctgagtgtcctttagaaagtttggagctcgatcttgcacattatgaagttcctgctcctgcgccttctgcaaactcgtaccttgtttatgcggcggacaatgcagagaatccacgatctctttcagcttctggttcatttcgtaatgacagtactccaaaagcagcacagagaaattctgaagattctggtgttacggttgatggatccccatctgcaaaggaaatgacgatcgttgttcctgattcctcgaatatctattcggcttttggagaggctgagtcaaagtctgtggagacactctcaccgtttcagcagaaagatggtcaaaagggactctttgttgatcgtggtgttggctcccctaggctagtgaagtctcttagtgcaagctcttttttgattgataccaagcaaatcaagaattcaatgccagccgctgcaggagctgttgccgcagcagcggtagctgatcaaatgcttggaccgaaagaagatagacatctagcaattgtcctggttggcttgcctgctcgaggaaagacttttactgcagcaaagttgacaagatatctacgctggttgggacatgatactaaacattttaatgttggaaagtaccgacggcttaaacatggagttaacatgagtgctgatttcttccgagctgataatcctgaaggtgtagaggcacggactgaggtagcagcacttgctatggaggacatgatagcttggatgcaagaaggtggtcaagttggaatctttgatgcaactaatagcacacgagttcgacggaatatgttgatgaaaatggctgaaggaaagtgtaagatcatttttctggaaacactatgcaatgatgagcgcattattgaaagaaacatacgtctaaaaatccagcaaagtcctgactattcagaagaaatggattttgaagctggagtacgagactttagagaccgtttagccaattatgaaaaggtttatgagcctgtagaagaaggttcgtacatcaaaatgattgatatggtcagtgggaacggtggacagatacaagtgaacaatattagtggttaccttcctgggagaattgtatttttcttggtgaatacgcatctcaccccacgaccaatactactcactcggcatggagaaagcatggataatgttagaggcagaattggaggagatagcgtaataagtgactctggtaaactttacgcaaagaaacttgccagctttgttgaaaagcgacttaaatctgaaaaagctgcttcgatttggaccagtacacttcagagaacaaacctaacagcaagttccattgtcggattccccaaggtgcaatggcgtgccctggacgagatcaatgctggagtttgtgatgggatgacatatgaagaggtaaagaagaacatgccagaagaatacgaatctcgaaaaaaggacaaattacgataccgataccctcgtggagagtcctaccttgatgtaatccaacggcttgaacctgtgatcattgagttagaacgacaaagagctcctgtcgtcgtgatatctcaccaggctgttctgagagccttgtatgcatattttgcggatcgtcccctcaaagaaataccccaaatcgagatgccacttcacactataatagagatacagatgggagtttctggtgtgcaagagaaacgctacaaactcatggactga

SEQ ID NO: 890 - DNA, 726 bp, Arabidopsis thaliana
atggagtacgtaaaccctgaaggtcttcgattagatggtcgccgattcaacgagatgaggcaaatcgtagctgaagttggagttgtttctaaggctgacggttctgctgtcttcgagatgggtaataccaaagtaattgcagctgtttatggtccaagagagattcaaaacaagagccagcaaaagaagaacgaccatgcagtggtgttgtgtgagtatagtatggctcagtttagtactggtgatcgtagaagacagaaattcgacaggcgatcaacagagctatctcttgtcatccgtcagacaatggaagcttgcatattaaccgaattgatgcctcactctcagatcgatattttccttcaggttctacaagctgatggaggaacaagatcagcttgtatcaatgccgcgactctagctctagcagatgctggaattccaatgcgtgatctcgctgtttcctgtagtgctggatatttaaacagtactcctcttcttgatctgaactatgttgaagacagtgctggaggagctgatgtaaccgtcggtattctacctaaattagacaaagtgtcactccttcagatggatgccaagttaccgatggaaacatttgagacagtgtttgcattggcttctgaaggttgcaaggcaattgcagagagaatacgcgaggtacttcaagaaaacaccaaacagctagagtatcgccgagctgcataa

SEQ ID NO: 891 - DNA, 1260 bp, Arabidopsis thaliana
atggagtgtaatgcaaagccaccgtttcaatgggaattggaaaacttgatatcttttggcacttctacagctgaagttcctagaaagctaaaaccaatggagtgggaaattgatggatttgattgcacctctctgtattcttcaagctttgcctatgctggtagttcaggttctgatatagctcatgctttctctaaaagctcaaagtcaacttccattagctcttcatcagctgaagtaagaacacacaattttacatccgaaactggtgaaagtcttcctggagaatttgcaaaggggattgatacttctccaagtcttgaactttcttttggctctggtgatccggttctcggtttaaagcttggtaaacgaacgtactttgaagacttttgggaagtggagaatgctaaaggtttgggacttccagtgactctggcttcatcttctgtttctcccgtgaagaaatcgaaatccattcctcagaggttacaaactcctcactgtcaagttgaaggctgtaatcttgatctttcatcagctaaagactatcatcggaaacataggatttgtgaaaatcattcaaagtttcctaaagtcgttgtgagtggcgtagagcgtcggttctgccaacaatgtagcaggttccactgtctctctgagtttgatgagaagaaacgtagctgtcgccgacgtctctcagatcacaatgcaagacgtcgcaagccaaatcctggaaggacatatgatgggaaaccacaggtggattttgtatggaacagatttgcacttatccatccaagaagtgaggaaaagtttatatggccaagttcgaagcacgtaccatcaagagtgttaatgccgcaacctgcaaagactgagatttccgataccgagcacaatagatttggattgttggaccccaaaaccaaaaccgcaagagccgagttattcagtaaagaaaaggtcacaatctcttcacacatgggtgcttctcaagatcttgatggtgctctctctcttctgtcaaattcaacaacatgggtttcttcctctgaccaaccaaggcgttttacccttgatcaccatccctcaagcaacctccaacccgtagctcaccggtctgcggctcaactcaattcagtttccggctattggcagccggacccacccgcagttgaaggcccgaccgctctgcatagaaatggggtaggccagtttaatgaaaactacttcagcttgaaccagttttataactga

SEQ ID NO: 892 - DNA, 1128 bp, Arabidopsis thaliana
atggagatgggttccaactcgggtccgggtcatggtccgggtcaggcagagtcgggtggttcctccactgagtcatcctctttcagtggagggctcatgtttggccagaagatctacttcgaggacggtggtggtggatccgggtcttcttcctcaggtggtcgttcaaacagacgtgtccgtggaggcgggtcgggtcagtcgggtcagataccaaggtgccaagtggaaggttgtgggatggatctaaccaatgcaaaaggttattactcgagacaccgagtttgtggagtgcactctaaaacacctaaagtcactgtggctggtatcgaacagaggttttgtcaacagtgcagcaggtttcatcagcttccggaatttgacctagagaaaaggagttgccgcaggagactcgctggtcataatgagcgacgaaggaagccacagcctgcgtctctctctgtgttagcttctcgttacgggaggatcgcaccttcgctttacgaaaatggtgatgctggaatgaatggaagctttcttgggaaccaagagataggatggccaagttcaagaacattggatacaagagtgatgaggcggccagtgtcgtcaccgtcatggcagatcaatccaatgaatgtatttagtcaaggttcagttggtggaggagggacaagcttctcatctccagagattatggacactaaactagagagctacaagggaattggcgactcaaactgtgctctctctcttctgtcaaatccacatcaaccacatgacaacaacaacaacaacaacaacaacaacaacaacaacaacaatacatggcgagcttcttcaggttttggcccgatgacggttacaatggctcaaccaccacctgcacctagccagcatcagtatctgaacccgccttgggtattcaaggacaatgataatgatatgtctcctgttttgaatttaggtcgatacaccgagccagataattgtcagataagtagtggcacggcaatgggtgagttcgagttatctgatcaccatcatcaaagtaggagacagtacatggaagatgagaacacaagggcttatgactcttcttctcaccataccaactggtctctctga

SEQ ID NO: 893 - DNA, 966 bp, Arabidopsis thaliana
atggcttcagtggctcctaaaatcgctaaagatgtaactgaactaatagggaacactccattagtgtatctaaacaaagtagctaaagattgtgttggtcatgttgctgctaagcttgagatgatggaaccatgttctagcgtcaaagacaggattggttatagtatgattgctgatgcagaagctaaaggacttattaaaccgggagagagtgtgttgattgagccaacaagtgggaacactggagttggtttagcatttactgcagctgcaaagggctataagcttgttataacaatgccagcttcaatgagtatagagagaagaatcattctcttagcttttggagctgagttgattcttactgatccggctaaaggtatgaaaggtgctgttgcaaaggcggaggagattttggcgaaaacacctaatggttatatgcttcaacagtttgagaatcctgctaatccaaagatccattatgagactactggacctgagatatggaaaggttctggtggaaaagtggatggctttgtttctggtattggtactggtggtgctgggaagtatctcaaggaacagaacacaaacataaagctgtatggtgtcgagcctgttgaaagccctattctgtccggtggaaagccaggtccccacaaaattcaaggtataggtgctggttttattccaggcattttggatgttgatcttatagatgaagttgttcaggtttcaagtgaagaatccattgacatggcaaggcttcttgctagggaagagggtctgttagtgggaatctcatctggagcagcagctactgcagcaatcaaacttgcaaagaggccagaaaatgctgggaagcttatagtggcggtgtttccgagtttcggggaaagatatctatcgactgtactgtttgatgcagcaaggaaagaggcagagactatgacctttgagccctga

SEQ ID NO: 894 - DNA, 95 bp, Arabidopsis thaliana
tggagaaatatgatgataataatcagtaaatatcttaggacaccttctgacacagtttactgtgtatgagaatgacttgttaatctgattctcca

SEQ ID NO: 895 - DNA, 103 bp, Arabidopsis thaliana
ttttgtgtagaatatgatgaaagttgtatatcggtgatggtcttttgattcatatgatcgacaaaaatttcaactcgctacgttctttctgattcttacaaaa

SEQ ID NO: 896 - DNA, 1083 bp, Arabidopsis thaliana
atggctgctgctataagtgctgcagtctctttaccttcctccaagtcatcctctctcctcaccaaaatctcctctgtatcccctcaaaggattttcctcaagaagagcacagtgtgttacagaagagttgtgtcagtgaaggctcaggtgacaacagatactaccgaggcaccaccagttaaagtagtcaaggagtctaagaaacaggaagaagggattgttgtcaacaaattcaaacctaagaacccttacactggtcgctgccttttgaacaccaagatcaccggtgatgacgctcccggtgagacttggcacattgtcttcaccaccgaaggtgaggttccgtatagagaaggacaatcgataggagtgattccagagggaatagacaagaacgggaagccgcacaagctcaggctttactctatcgcgagtagtgccattggtgactttggagactccaagaccgtttctctctgtgtcaagagactagtttacacaaatgatggcggagagattgttaagggggtctgctccaacttcttgtgtgacttgaagccgggtgatgaagctaagatcactggacctgttggcaaggaaatgcttatgccaaaagaccccaatgccaccatcatcatgcttggaacaggaactggaatagctccattcagatcatttttgtggaaaatgttctttgaggagcacgaggactacaagttcaatggtttggcgtggcttttcttgggtgtacccacaagcagctcactgctatacaaggaggagtttgagaagatgaaggagaagaacccagacaacttcaggctggactttgcggtgagcagagagcagacgaacgagaagggagagaaaatgtacattcagacaagaatggcagagtatgcagaagagctgtgggagttgctgaagaaagacaacacctttgtttacatgtgtggtcttaagggtatggagaagggtatcgatgacattatggtctcgcttgctgctaaagatgggatcgattggttggagtacaagaagcaattgaagaggagtgaacagtggaatgttgaagtctactaa

SEQ ID NO: 897 - DNA, 660 bp, Arabidopsis thaliana
atggctgctaattcgataatggcttcctccaaacccctaatctccctgtcatccaaccaacaaccaaaccgagtccaaattcccaaattcgccaaacttccccaaattcccaaatccctcacttcctccaccgatctccgtagcaaagcactatcactctcctccgccaccgccaaatccttagctttaatcgccgctttcgctcctccgtcgatggcggaggcgatggagaaagcacagctcttcgatttcaatctcacgcttccgatcatcgttgttgagtttctcttcttgatgttcgctctcgacaaggtctattactctccgcttggtaacttcatggatcaaagagacgcttccatcaaagagaagctcgcgagtgttaaggacacttcgactgaagtaaaggagctcgatgagcaagccgccgccgtgatgagagcagctagggctgagatcgccgccgcgcttaacaagatgaagaaggagactcaggttgaagtcgaggagaagctagcggagggaaggaagaaggtggaggaagagctaaaagaagctttggcgagcttggagagtcagaaagaagaaaccattaaagctttggattctcagattgctgctcttagtgaagacattgtcaagaaggttcttccttcttaa

SEQ ID NO: 898 - DNA, 666 bp, Arabidopsis thaliana
atgtcgctcactatcccggcgaatctcgttctcaacccgagatctaacaaatctctcactcaatccgtacctaaatcctccgcaagattcgtctgctccgatgacaaatcctcctcctccacacctcaatccatgaaagctttctccgccgccgtcgccctctcttccatcctcctctctgctcctatgccagctgtcgctgatatctcaggtttgactccttgcaaggactcaaaacagttcgctaaaagagagaagcaacagatcaagaagcttgaatcttctcttaagctctacgctcctgaatctgcccctgctcttgctctcaatgctcagatcgagaaaaccaaacgcaggttcgacaactacgggaagtacggattgttatgcgggtcagacggtttaccgcacttgatagtgaacggagaccagcggcattggggagagttcattactccagggattcttttcctctacattgctggatggatcgggtgggttggaagaagctacttaatagctattagtggtgagaagaaacccgcgatgaaagagatcatcatcgatgttcctttggctagtcggatcatcttccgtggtttcatttggcccgttgctgcctacagagagtttctcaatggtgatctcattgctaaggatgtttaa

SEQ ID NO: 899 - DNA, 438 bp, Arabidopsis thaliana
atggcgtcttttgcaaccatcgccgccgtacaaccttctgccgccgtgaaaggacttggaggtagctctcttgccggagctaagctcttcatcaaaccttctcgccaaagcttcaaaaccaaatccaccagagctggtgctgtggtggctaagtatggagacaaaagtgtatactttgatttagaagatttgggtaacacaacaggacaatgggatgtgtatggatctgatgctccttctccttataacccacttcagagcaagttctttgagacatttgctgctcctttcacaaagagaggtttgcttctcaaatttttgattcttggaggaggctctttgcttacatatgttagtgcgaactctaccggcgatgttcttccgattaagagaggtcctcaagagccacctaagctcggtcctcgcggcaagctttaa

SEQ ID NO: 900 - DNA, 597 bp, Arabidopsis thaliana
atgatcgtactttctgttggttccgcttcttcatctccgatcgtcgtcgtcttttccgtcgcgcttcttctgttctacttctctgaaacttctctaggagctccttgtcccatcaatggcttgccaatcgtgaggaatattagtgaccttcctcaggataactatggaagaccaggtctttcccacatgactgttgctggctccgtattgcatggaatgaaagaggttgaaatatggcttcagacatttgctccaggttcagagacaccaattcacaggcactcctgtgaagaggtttttgttgtcctaaagggcagtggtactctgtatctcgctgaaacacatggaaatttccctgggaaaccaatcgaatttccaatctttgccaacagtacaattcatattccgatcaatgatgctcatcaggtcaaaaacaccggtcatgaggacctgcaggtgttggttatcatatctcggccgcctattaaaatcttcatctacgaagactggtttatgccacacactgctgcaaggctgaagttcccttactattgggatgagcaatgcattcaagaatcacaaaaagacgagctttaa

SEQ ID NO: 901 - DNA, 660 bp, Arabidopsis thaliana
atgtcgtccgatgacgaaggaggagaagagtatctattcaagatagtgataatcggcgactctgccgtcgggaaatcgaaccttctctctcgctatgctcgtaacgagttcaacgctcattccaaggccacgatcggcgtcgagttccagacgcagaatatggaaatcgaaggtaaagaagttaaagctcagatttgggatactgctggtcaagaacggtttcgtgccgtcacttccgcttattatcgcggcgccgtcggagctctcgtcgtttacgatattagtcgtcgatccacgtttgagagtgttggtcgttggcttgatgagctcaagacacattcggatacaacggttgcgaggatgctggtgggaaacaaatgcgatctagaaagcataagagcggtgagcgtggaagaaggcaaagcactagctgaaaccgaaggactatttttcatggaaacatcagctctcgattcaacaaatgttaaaacagctttcgaaatggtaatccgtgacatctataccaatataagccggaaacaactcaactccgacacttataaaaccgaactaagcatgaaaaacagagtcagtctcgttaaggacgataataaaagctccacacaaggctttggtttctcttgctgttcttcctcgtga

SEQ ID NO: 902 - DNA, 3654 bp, Arabidopsis thaliana
atggagacatcatctatttccactgtggaagacaagccaccgcagcatcaggtgttcatcaatttccgtggggcagatttgcgccggagattcgtcagccatctcgtaacggccttgaaattgaacaacatcaacgtctttatcgacgactatgaagacagaggtcaacctctagatgtactgctgaagaggatagaggagtccaaaatcgttttggctatcttctccggcaactacaccgagtcagtctggtgcgtgagagagctggagaagatcaaagattgtacggatgaaggaacactcgttgcgattccaatcttctacaagctggagccatccaccgttagagatttgaaaggaaagttcggtgatagatttaggagtatggctaagggtgatgagaggaaaaagaaatggaaggaagcttttaacttgattcctaacattatgggcatcatcattgacaagaaaagtgtggagagtgagaaagtcaatgaaattgtgaaggcggtgaagacagcgttgaccggaataccaccggagggaagtcacaacgccgtcgtgggtgctttaggtaatagcaacgctggaacttcctcaggagacaaaaagcatgagacttttggaaacgaacaacggttaaaagatttggaagagaagttggatcgtgataaatacaagggaactcgtatcattggagttgttgggatgcccggaattggtaaaaccacactcctgaaagagctatataagacgtggcagggcaagttttcgaggcatgcgctaatcgatcaaatccgtgtaaagtccaagcacttggagttggatcgcttgcctcaaatgctcttaggcgagttgtccaagttaaaccatcctcacgtagacaatctcaaagatccatacagtcaactgcatgaacgcaaagtgcttgttgtacttgatgatgttagtaaaagggaacaaatagatgctcttcgtgagatactagactggattaaggagggtaaggagggaagcagggttgtcattgcaacaagcgacatgtccttaacaaatggtttggttgatgatacttacatggttcaaaatttgaaccacagagatagcttacaactatttcactatcatgcctttattgatgatcaagccaatcctcaaaagaaagatttcatgaagctgtcagaagggtttgtacattacgccagaggccatccactagccctcaaagtattgggtggagagcttaataagaaaagtatggatcattggaattcgaaaatgaagaaacttgcacagagccccagccctaatattgtcagtgtcttccaagtgagttatgatgaattgactacagcgcagaaagatgcatttctcgacatagcctgtttcagatcacaggacaaggattatgtagaaagtctactggcttcatctgaccttggttcggctgaagcaatgagtgcagtcaaatctctcacggataagttcctgattaatacttgtgatggccgagtggagatgcatgatctattatataaattttcaagggaagttgatctgaaggcatctaatcaggatggtagcagacaacggaggctgtggctccatcaacacataatcaagggaggcataatcaatgtattgcaaaataaaatgaaagctgccaatgttagaggtattttcctagacttgtctgaagtggaagacgaaacgagcttagaccgcgaccacttcataaatatgggaaatctccggtatctcaagttctacaattcccattgtccacaggaatgtaaaaccaacaataaaatcaacatccctgataaacttaagctaccattgaaagaagttcgatgcctccactggctgaaattcccattggagacacttccaaacgatttcaacccaattaatcttgtcgaccttaagctgccctacagtgaaatggaacaactttgggagggtgacaaggacacaccatgcttaaggtgggtcgatctcaatcactcaagtaagttgtgcagcttgtcagggttatcaaaagctgaaaagcttcaaaggttgaaccttgaaggttgcacaacactgaaagcgtttccacatgatatgaaaaaaatgaaaatgcttgctttcttgaatctgaaggggtgtacaagtctcgaatctcttccagagatgaatttgatttctctgaaaacacttactctcagcggctgctcaacttttaaggaatttccgttgatttcagataatatagaaactctatacttagatggcacagcaataagtcagcttcctatgaacatggagaagcttcagagacttgttgtattgaatatgaaagactgcaaaatgctagaggaaattccaggccgtgttggtgagctgaaagctcttcaagaactgatactctctgattgtttaaatctcaagattttcccagaaatcgacattagctttttaaacattttacttttggatgggacagccattgaagtgatgccacaattaccctcagtgcagtatttgtgcttaagcagaaatgctaagatcagctgccttcctgttggaatcagtcagctttctcaacttaaatggctggacctgaagtattgtacgagtcttacatcagttccagagtttccaccaaatcttcagtgcttagatgcacacggctgtagttcgctgaagacagtttcaaagcctttggcccgtatcatgccaactgaacagaatcattccacattcattttcaccaactgtgagaacctggaacaagctgcaaaggaggaaatcacatcgtatgctcaaaggaaatgccagctgttatcatatgctcggaaacgctacaatgggggtcttgtttcagaatctttgttcagcacttgctttcctggatgtgaagtgccttcttggttttgtcatgaaacagttggatctgagttagaagtaaaactcctcccacattggcatgacaagaagcttgccgggattgctctatgtgctgtagtctcatgtcttgacccccaagatcaagtcagccgcttgtcagtgacctgcacctttaaagtaaaagatgaagacaagtcttgggtcgcatatacttgtccagtaggaagttggaccagacatggaggcgggaaagataagattgagctagaccatgtcttcattggatacaccagttgcccacatactataaaatgtcatgaagaaggtaactcagatgaatgcaatcctaccgaagcctctcttaaatttactgtgacaggaggtacaagtgagaatggaaaatacaaggtgttgaagtgtggtttaagtttggtgtatgctaaggataaagacaaaaatagtgctcttgaaacaaagtacgatatgcttattggaaagagctttcaagaaacttcagaaggggttgatggaagggtaaagaaaacgaaaggaaagtacgttatgcctgttgaaaagaactttcaagaaactacagaaggggttgatggaagagtaaataaaaagaaaaaaacaagaatggataatggacggccaaagaagaagcagagatcaggaagagatgataatcaaactaggatgcaagtggaactccaagaaggaaatataaattcagtgatcatgcacacggttaagaatttctga

SEQ ID NO: 903 - DNA, 1638 bp, Arabidopsis thaliana
atggtgatggaggacaacgagagttgcgctagtagagttattttcgacgccttacctacctcccaggccactatggaccgccgtgagcgcatcaaaatggaggtcttcgatgaggttctccgccgtctccgtcaatcggacattgaagacgcccatctccctggtttcgaagacgacctctggaatcacttcaatcgcctccctgccaggtatgctttggatgtgaatgtggagagggctgaagacgtcttgatgcacaagcgattgctgcattctgcttacgatccccagaatcggcctgctatcgaagttcatctcgtccagcctgatctttcatcttttatgttttgcctcttttgtcaacttttggattcctgggctcacaggttctttcgtcactcctcttttcttaaggttcaacctgccgggatctctgctgacttggactctacttctaatgatgctggtcattcttctcctacccgaaaaagcattcatccgccgcctgcctttggttcatcccctaatcttgaagcacttgcacttgcagctagtttatcccaagacgaggatgcagacaactctgttcataacaattcactctattcacggcccttgcatgagataaccttttccacagaagacaagcctaaactcctttttcagttaactgccttgcttgctgagcttgggctgaacattcaagaggcacatgctttctctacaactgatggctactcactagatgtttttgttgttgatggctggccgtacgaggaaacagagagacttaggatatcattggagaaagaagcagcaaagatcgagatgttaatctctctccttccttctgtttacctcttgttttatttcaggtataaaggtacatactgtagccaggaagttgctatcaaagtcctaaagccagagcgtctagactcagatctagagaaagagtttgcccaagaagtctttattatgaggaaagttagacacaaaaatgttgttcagttcattggtgcttgcaccaagcctccacatctgtgtatcgttacagaattcatgcccggtggaagtgtatatgactatctacacaagcaaaagggcgtctttaagcttccaactttgtttaaagtagctatagatatttgcaaagggatgagctacttacaccaaaataacataattcacagagatttgaaggctgccaacctcttaatggacgaaaatgaggtggttaaggttgcagactttggggtggctagagtgaaagcacaaactggagttatgacagctgaaactggaacatatcgctggatggctccagaggtgatagaacacaagccatatgatcacaaggctgacgtattcagctacgggattgtgctatgggagttgttgactgggaagggattaaggccaacaataccaaagaacacgcatccgaaattggcagagctattggagagattgtgggagcatgattcgacgcagagaccagacttctcagagatcatagagcagcttcaagagatagccaaggaggtaggagaagagggagaggagaagaaaaagtcgtcaacaggactaggagggggtatatttgcagccctgaggagaagcaccacacatcattga

SEQ ID NO: 904 - DNA, 1359 bp, Arabidopsis thaliana
atggagaaaagggtagagaagagaaggattgtgttagttccggttgctgcacaaggacatgtaaccccaatgatgcagcttgggaaagcccttcaatcaaagggcttcttaattactgttgctcagagacagttcaatcaaataggctcatcattgcaacactttcctggttttgactttgtcaccataccagaaagcttacctcagtctgaatctaagaaactaggaccagctgagtatcttatgaatctcaacaaaacaagcgaggcaagcttcaaggagtgtataagtcagttatcgatgcaacaaggcaatgatatagcatgtatcatctatgacaagcttatgtacttctgtgaagcagcagctaaggagtttaagattcctagtgttatcttcagcactagcagtgctacaattcaagtttgctactgtgttttaagtgaactcagtgccgagaagttcttgatcgacatgaaagatcctgaaaagcaagataaggtgttggaaggtttgcatcctttaaggtacaaagacctaccaacttcaggatttggaccattagagccacttttggagatgtgtagggaagtagttaacaaaagaacagcttccgctgttatcatcaacacggcgagctgtctagagagcttgtctctgtcatggctgcaacaagaacttggaattccagtgtatccattaggccctcttcacattacagcttcatcgccgggacctagtttactgcaagaggacatgagctgcattgaatggctgaacaagcagaaaccaaggtcagtcatatacataagcttgggaaccaaagctcacatggagaccaaggagatgttagagatggcctggggattgttgaatagcaaccaacctttcttatgggtcatccgacctggctctgttgcaggcttcgagtggatagagttattaccagaggaagtcattaagatggtaacagaaagaggatacatagcgaaatgggcaccgcagatagaagtacttggacatcctgcagtgggaggattctggagccactgtggatggaactcaacactcgagagtattgtggaaggagtcccaatgatttgcaggcctttacaaggcgaacaaaagttaaatgcgatgtatatagaaagtgtttggaaaatagggattcaacttgaaggtgaagtggaaagggaaggtgtagagagagctgtgaagaggttgatcatagatgaagaaggtgcagccatgagggagagggctcttgatttaaaagagaagctcaatgcctcggtaagaagtggaggctcctcatacaacgcactggatgagcttgtcaagttcttgaatacagagtga

SEQ ID NO: 905 - DNA, 1884 bp, Arabidopsis thaliana
atgggtttagctactacaacttcttctatgtcacaagattatcatcatcaccaaggaatcttttccttctctaatggattccaccgatcatcatcaaccactcatcaagaggaagtagatgaatccgccgtcgtctccggtgctcaaattccggtttatgaaaccgccggaatgttgtctgaaatgtttgcttaccctggcggaggtggcggcggttccggtggagagattcttgatcagtctactaaacagttgctagagcaacaaaaccgtcacaacaacaacaataactcaactcttcatatgttattaccaaatcatcatcaaggttttgctttcaccgacgaaaacactatgcagccgcagcaacaacaacactttacatggccatcttcctcctccgatcatcatcaaaaccgagatatgatcggaaccgtccacgtggaaggaggaaagggtttgtctttatctctctcatcttcattagccgcagctaaagccgaggaatatagaagcatttattgtgcagccgttgatggaacttcttcttcttctaacgcatccgctcatcatcatcaattcaatcagttcaagaatcttcttcttgagaattcttcttctcaacatcatcaccatcaagttgttggacattttggttcatcatcatcatctcccatggcggcttcttcatccattggagggatctacacgttgaggaattcgaaatatacgaaaccggctcaagagttgttggaagagttttgtagtgttggaagaggacatttcaagaagaacaaacttagtaggaacaactcaaaccctaatactaccggtggaggaggaggcggagggtcctcgtcatcggccggaacagctaatgatagtcctcctttgtctccggctgatcggattgaacatcaaagaagaaaagtcaagctactatctatgcttgaagaggtggaccgacggtacaaccactactgcgaacaaatgcaaatggtagtgaactcattcgaccaagtaatgggttacggcgcggcggttccgtacacgacattagctcaaaaggcaatgtctaggcatttccggtgtttgaaagacgcggtagcggttcagcttaaacgcagctgtgagcttctaggggataaagaggcggcaggggctgcatcctcggggttaaccaaaggggaaacgccgcgattgcgtttgctagagcagagtttgcgtcagcaacgagcgtttcatcatatgggtatgatggagcaagaggcatggagaccgcaacgtggtttgcctgaacgctccgttaatatccttagagcttggctattcgagcattttcttaatccgtacccaagcgatgctgataagcacctcttagcacgacagactggtttatccagaaatcaggtgtcaaattggttcataaatgctagggttcgcctatggaaaccaatggtggaagagatgtatcaacaagaagcaaaagaaagagaagaagcagaagaagaaaatgaaaatcaacaacaacaaagaagacagcaacaaacaaacaacaacgacacgaaacccaacaacaatgaaaacaacttcactgtcataaccgcacaaactccaacgacgatgacatcgacacatcacgaaaacgactcttcattcctctcttccgtcgccgccgcttctcacggcggttcagacgcgttcaccgtcgccacgtgtcagcaagacgtcagtgacttccacgtcgacggagatggtgtgaacgtcataagattcgggaccaaacagactggtgacgtgtctcttacgcttggtctacgccactctggcaatattcctgataagaacacttctttctccgttagagactttggagatttttag

SEQ ID NO: 906 - DNA, 1095 bp, Arabidopsis thaliana
atggtgagagaagaacaagaagaagatgacaacaacaacaacaacaacggaggaggagagagaaagctgcttgtggctgatgaaacggtgccgtctttgttggacgaaacggggttggtttgtgtaacgggaggttctggtttcgttgcttcttggctcatcatgcgtctccttcaacgtggctactccgttcgggccacggttcgaaccaactcagaagggaataagaaagatataagctacctaaccgagctaccatttgcatcggagaggcttcaaatattcaccgccgatctcaacgaaccggagagcttcaaaccggcaatcgaaggatgcaaagccgtattccacgtggcacatcctatggacccaaacagcaacgaaacagaagagaccgttacgaaacgtactgtgcaaggtctcatggggatactaaagtcgtgtttggacgctaaaaccgtgaaacgttttttctacacgtcaagcgccgtgactgttttctatagcggtggaaacggcggtggaggaggcgaagtagacgagagcgtttggagcgacgtcgaggtgtttaggaatcaaaaggagaagagggtgagtagctcttacgtcgtgtcgaaaatggcggcggagacggcggcgcttgagttcggtgggaagaatgggttagaggttgtgacgctcgttattcctctcgtcgtcggaccttttatatcttcgtcgttgccttcctccgtcttcatatctctcgccatgctctttggaaattacaaggagaagtatttgtttgatacttacaatatggtgcatattgatgatgtggcaagggcgatgatatttctattagaaaagccagttgcaaaaggtagatatatttgttcgtcggtggagatgaagatcgatgaggtctttgagtttttgtctacgaaatttcctcagtttcagctaccttcaatagatttgaataaatataaagtagagaagaggatgggtctttcatcgaagaagctgaaaagtgccgggttcgaattcaagtatggagccgaggaaatattcagtggagctataaggagctgtcaagcaaggggatttctttaa

SEQ ID NO: 907 - DNA, 1377 bp, Arabidopsis thaliana
atggttacatatttttgtgttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgaggctcaggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaataa

SEQ ID NO: 908 - DNA, 747 bp, Arabidopsis thaliana
atgaagatacagtgtgatgtgtgtgagaaagctccggcgacggtgatttgttgcgccgacgaagctgctctctgtcctcaatgcgacatcgagattcacgccgctaacaaactcgctagcaagcaccaacgtcttcatcttaattccctctccaccaaattccctcgttgcgatatctgccaagagaaggcagctttcattttctgtgtagaggatagagctctgctttgcagggactgcgatgaatccatccacgtggctaattctcgatctgctaatcaccagaggttcttagccactgggatcaaagtagctctgacctcaactatatgtagtaaagaaattgagaagaatcaacctgagccttccaacaaccaacagaaggctaatcagattcctgctaaatccacaagccagcagcaacaacaaccttcttctgctactccacttccctgggctgttgacgatttctttcacttctctgatattgaatccaccgacaagaaaggacagcttgatcttggggcaggggagttggattggttttcagacatgggattcttcggtgatcagattaatgacaaggctcttcctgcagctgaagttcctgagctttctgtttcgcatttaggtcatgttcattcatacaaacctatgaagtcaaatgtttcacacaagaagccgaggtttgagaccagatatgatgatgatgatgaggaacacttcattgtccctgatcttggctaa

SEQ ID NO: 909 - DNA, 207 bp, Arabidopsis thaliana
atgattgtaatcaatctcgcaggaaaggtccacggttcattggctcgtgccggtaaggtgagaggtcagacacctaaagtggctaagcaggacaagaagaagaagcctcgtggtcgtgctcataagcgtctgcaacacaaccgccgtttcgtcaccgccgttgttggttttggcaagaagagaggaccaaactcatcagagaagtag

SEQ ID NO: 910 - DNA, 516 bp, Arabidopsis thaliana
atggcgtcatctagcagcacataccggagctcaagctcttccgacggtggtaataataacccgtcggactccgtcgtcaccgtcgacgaacgaaaacgtaaaagaatgttatcgaacagagaatctgcacgtaggtcaaggatgcgtaaacagaaacacgttgatgatctaacggctcagatcaatcagctatcaaacgacaaccgtcagatcttgaacagcctcaccgtaacatctcagctttacatgaagatccaagccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattga

SEQ ID NO: 911 - DNA, 2880 bp, Arabidopsis thaliana
atgtgcgagcccgatgataattccgctagaaacggcgtcactactcaaccttcgaggtcaagggagcttctaatggatgttgacgacttagatcttgacggttcatggccactagatcaaatcccttacttatcctcatcgaatcgcatgatttctccgatttttgtctcctcttcctctgagcagccttgctcgcctctctgggctttctccgacggtggaggaaatggttttcaccacgcaacctccggtggcgatgatgagaagatcagctctgtctccggtgttccttctttccgtctcgccgagtatcctctcttcctcccttactcttctccatcagcagctgagaacacaacagagaagcataacagtttccagtttccgtctccattgatgagcctagtcccaccagagaacacagacaactactgtgtgatcaaagagaggatgactcaggcgcttcgatacttcaaagaatcaaccgaacaacacgttttggctcaggtctgggctcctgtgagaaagaatggtcgtgatttgctgacgactttgggtcaaccttttgttcttaatcctaatggtaatgggcttaatcaatacaggatgatctctctcacatatatgttttctgtggatagtgaaagtgacgtagagctcggactcccgggtcgagttttccgtcagaaattgcctgaatggactccaaatgttcagtactattccagcaaagaattctcgcggcttgatcacgccttgcactacaacgtgcgtggtacactggccttgcctgtctttaatccctctggtcagtcctgcataggtgttgtggaacttataatgacctcagagaagattcactatgcacccgaagtggacaaagtttgcaaagcccttgaggcggtaaatctgaaaagctcggaaatacttgatcaccaaacaacacagatatgcaatgagagtcgccaaaacgcgcttgctgagattctcgaagtgctgacagttgtatgtgagacccataacttgcctctcgctcagacttgggttccatgtcagcatgggagcgttcttgccaatggtggcggtctaaagaaaaactgcaccagctttgacggtagctgcatgggtcaaatctgcatgtctacaaccgacatggcctgctatgtcgtggatgctcatgtctggggctttagagatgcctgtcttgaacaccatctccagaaaggccagggagtcgctggacgagcttttctcaatggtggctcatgtttctgcagagacatcaccaagttctgcaaaacgcagtacccactagtccattatgcgctcatgttcaagttgaccacttgttttgcaatatctctccagagctcttacacgggcgacgacagttacattcttgaattttttcttccttcgagtataacagacgaccaagagcaagatttgctgttgggttctattttggtgacaatgaaagaacattttcagagtctgagggttgcatctggggttgactttggtgaagatgacgacaaattgtctttcgagatcatccaagcattaccggacaagaaggttcattcaaaaatagaatccattcgagttcccttttctggttttaagtcaaatgcaacagagacgatgttgattcctcagcctgtggttcagtcttctgatccagtaaatgagaaaatcaacgtggccactgttaacggtgtggttaaggagaagaagaaaacagagaaaaagcgtgggaagactgagaaaacaatcagtctagatgtacttcagcagtatttcactggaagtctcaaagacgctgcaaagagcctaggagtttgcccgacgacaatgaagcgaatttgcaggcaacacggaatctcgcggtggccatcgaggaagatcaagaaagtgaatcgttcaatcacaaagctgaaacgagtcatcgaatctgttcaaggtactgatggaggcctcgacctgacttccatggccgttagttccatcccttggacacacggtcaaacatcagcacagccactaaactcacccaatggttccaaaccacctgagctaccaaacaccaataattcacctaaccattggtcaagtgatcacagtccgaacgagccaaatggttcgcctgagttaccaccaagcaatggtcacaagcgatcacgaacggtggatgagagcgctgggactccaacctctcatggctcatgtgacggtaaccaattagatgaaccgaaagtcccaaatcaagatccgctcttcacggttggtggatcacccgggctcctttttccaccttattctagagatcatgatgtatctgcagcttccttcgcaatgccgaacaggcttcttggttctatagaccatttccgaggaatgctcattgaagacgctggaagttcaaaagatctgagaaatctctgccccactgcagcatttgacgataagtttcaagacacaaactggatgaacaatgataataatagcaacaacaacttatacgctcccccaaaggaagaggccattgcaaatgttgcatgcgaaccatcaggctcagaaatgagaacggtaacaatcaaagcaagttacaaagacgacataatacggttcagaatatcctcgggttcaggtataatggaattgaaggatgaagtggctaagaggctgaaagttgatgcaggaacgttcgatatcaagtatcttgacgatgataacgaatgggttttaatagcttgtgatgctgatcttcaagaatgtctcgagatccctagatcctcccgcacgaaaatcgtaaggctcttagttcatgatgtaacgacaaatctagggagctcctgcgagagcactggagaattgtga

SEQ ID NO: 912 - DNA, 912 bp, Arabidopsis thaliana
atgaatcaagaaaagaccatttcttgttgttgtgttcttgatgcttccacttatgttggtttctggattctcaagagattgctcactagaggttactctgttcacgcagctatccgtaaaaacggggagagtgtgcttgaagagaaaatcagagacatggaagctaacgaagagagattagaggtttatgatgtggatgtgttagattaccaaagtatcctcatttctctcaacaattgtaatgctgtcttctgttgtttggataatcctgaagggtacgatgagaaggaagtggatttggaggtgagaggagctattaatgtggtggaagcatgtgcaagaacagagagtatagagaagattgtgttctcatcttcgttaactgctgcaatttggagagataacattggaactcagaaagatgttgatgagaagtgttggagtgatcttgacttctgtctcaaaaaaaagttgtggcatgctcttgcgaagacacagtccgagaaggcagcttgggcattagccatggatcgtatggtcaacatggtttcggttaacccgggcctcatcgttggaccatcagtggctcaacacaacccaagaccgaccatgtcttacctcaaaggagctgcacaaatgtatgagaacggtgtgttagcgtacgtagatgttgaatttgtagcggatgttcacattcgagcattcgaggatacttcggcttgtggtagatacttttgcttcaaccaaattgtgaacacggaagaagaagctctcaagcttgtacaaactctatctcctttaatacctatgccaccaaggcatgagaaagaaatgcaaggaagtgaagtttatgaagagagattgagaaacaagaaactaaacaagctggtggaagctggatttgcttgttaa

SEQ ID NO: 913 - DNA, 1410 bp, Arabidopsis thaliana
atggtggtggtgttcggtggtctcgtcgataagaaattcctcagcgatataattgtttatgatattgaaaacaaactctggtttgagccagaatgtactggcagcgagtctgaaggacaagtgggtcctacacctcgtgcgtttcatgttgctattacaatcgattgtcatatgttcatctttggtggacgttctggtggcaagaggttgggtgacttctgggttctagatacaggtacgtatatgctaacatttgctgcagatatatggcagtggtctgaattgactagcttcggcgacttacctacacctcgtgattttgctgccgctgctgctattgggagccaaaaaattgtgttcttgcctgcctgcattactaaacctagatcgttggcaggtgcggcggctgggacggtaaaaagtggctgtcagatgtttatgttatggacacaatgtcccttgaatggctggagctatcggtttcagggtcattgccacctcctagatgtggtcatacggccacaatggtggagaaacgattacttgttttcggtggccgagaaagagcgtgaaacacctggatggacccaactcaagcttcctggacaagcaccatcatctcgatgtggtcatacagttacatctggaggacattatcttctgttatttgggggacatggaactggtggatggctgagtcgttatgatgtttactataatgatactataattttggacagagtaactgctcagtggaagcgcttaccaataggcaatgagcctcctcctcctcgagcttaccataccatgacttgtattggagctcgtcatcttttaattggtggttttgatggaaaattgaccttcggtgatctctggtggttagttcccgaagatgatccgatagccaagaggtcttctgtgcctcaagttgtaaaccctcctgaaattaaagagtcagagagagagttggacaaggaaaggggacaagatggattcagtattgttgacttgcaacagaaaatgggaatatctgtttcatcagggttgcgccttcaaattcccgaggagtcagaagatcaagagtttgttgaattaggaacaagattaattgagggagatgtagttgatgaacgggcctctatgattcagatggccgctcaagcacttcgtcagcattggaaacagtccactccgagaactttacaactaaaagagcttggttccttacttcgagattatcagcgacttgttacacgaattttcactacacagagcagcttaacatctgctgattttggcctccctggaacgaagacctttacgttttatcatatcaaaagttcttccgagttgcggattaatgacatctcgaagttgctggaagaatacaaaactcttgtaatctga

SEQ ID NO: 914 - DNA, 2412 bp, Arabidopsis thaliana
atggagctagaacccaataaatcactatctgctgatatgccatctttgctgagtagatcatctgaagcttttaatggaggcactggatatcgttcttcaagtgatctcagcatgttctcaagctcattgcccacactttttcatgaaaagctgaatatgactgattcagatagttggctctcctttgatgaaagctcacccaatctgaacaaacttgtcataggaaactcagagaaagattctttggaagatgttgaacccgatgctttagaaatattgctgcctgaggatgaaaatgagctccttcctggcctcattgatgagcttaattttaccgggttgcctgatgaacttgacgatctcgaagagtgtgatgtcttttgcacgggagggggtatggagttggatgttgaatcccaagataatcatgctgttgatgcgtcagggatgcagatttctgatcgcggtgctgcaaatgcatttgttcctcgtaaacgtcccaatacggctggtagagtttcagtggaacatccaaacggtgaacatccttcaaggacattatttgttaggaatatcaacagcagtgtcgaggattctgagttaagcgccctttttgagccgtttggggagatcagaagtttgtacactgcatgtaaaagcagggggtttgttatgatatcctactacgatattcgagctgctcatgccgcaatgcgtgcactacagaacacacttttaagaaaaaggacactggacattcacttttccattcctaaagaaaatccatcagagaaggatatgaatcaaggaactcttgtgatttttaatgtggacacaacagtatcgaatgatgagctccttcagctgtttggtgcctatggtgaaataagagagattagagaaaccccaaacaggcgattccacaggttcattgagtactatgatgttagagatgcagagacagccttgaaagcactgaatagaagcgagataggtggaaaatgtataaagctcgaacttagtcgtcctggaggggctcgtcgactgtcggtcccgtcacaaagtcaagatttggagagaaccgaagttacaaatttctacaatcaagtaggttcacatgttgctaattctccaccaggtaactggccaattggtagcccagtgaagggctctccttcgcatgcctttacgaggccacatggtctaggaatggtcaggccagttaactcagacaatatgccaggactggcttcaattcttcctgctcatccttctagctttcatggattttcaccagtcagtaatgaccaagggctattgaatcattcaaaccaaactattctgaataagggattgatgcacaacatttcctatgggcaacctcattctttgccagagcatataacagggggaatttccaactccatgaggtttatagctccacactcctcaggattcgggacttcatctgatcaccgctatcgctggggaagccctcctcagcatatgaattatcctggttacactggagtgtcgtcgtcatcgtcatctactgaacgtcctttcactgtcaggcatggttttccatttgctgagaggcaggcttcattgcttggaaaataccagcatcatgtgggctctgctccctcaagcattcattttaatacacaaatgaattgctacacgggatcaccagagataccccttggatttagtgatatgggaatcaacagaaactataacagtgctcatggaaaagcaaaccttggtgttagtctaccggggaacagtagtgaacaggatttcactggctttggcatgtcttcaatgcctacagttcctttcggtgggagtagaggattacaatcagtaaggcctgaaccttttgctgagcagggtaggatacataaccacgagagtcacaatcagaatcagttcatagatggtgggagatatcatatcgacttggataggattgctagtggagatgaaatccgaactacattaatcatcaaaaacatcccaaacaagtacacttacaagatgctggtggctgaaatcgacgaaaagcacaagggagactatgactttctatgcttgccgacagactttaagaataaatgcaacatgggtcacgcttttatcaacatggtctctccattgcacatcgttcccttccaacagactttcaatggtaaaatatgggagaaattcaacagtgggaaagttgcttcattggcatatgcagagatccaaggaaagtctgcccttgcgtcatacatgcagactccaagttctatgaaggaacaaaagcaattgtttccagaagtctcctaccatgatgatggtcaagacgccaatgatcacgtatgtttatccgatacaaaatctcatttttgtttttgtttttga

SEQ ID NO: 915 - DNA, 684 bp, Arabidopsis thaliana
atggctaaaaaggagagacctagacctgagaagttgtctgtgtatctttatatacctaatattgttgggtatatgagagttctcttgaactgtgttgcttttgctgtgtgtttctccaacaagccacttttctctgtcctttatttcttcagcttttgttgtgatgctgtggatggctgggtggctcgtagattcaaccaagtttcaacatttggagctgttcttgacatggtcacagatagagttagcacggcttgtcttctcgtgattctctctcaaatctacaggcctagtttggtcttcctctcattgctggctttagatattgctagtcattggctgcagatgtacagtacgtttctagcagggaagagcagccataaggatgtgaaagacagcacaagctggctttttagactctactatggaaaccggatatttatgtgttactgctgtgtttcttgcgaggttctgtatatcatccttcttctcattgcaaagaaccaatctgaaaatctcctgaatgtcgtagttgctacattaacacagatttcaccactctcttttctcctggctttgacattgttcggttggtcgatgaagcagaccattaatgtcattcagatgaaaactgctgcagacgtttgtgtactgtatgatatagagaagcagcagaagccttga

SEQ ID NO: 916 - DNA, 375 bp, Arabidopsis thaliana
atgcaaatgctaagaaacttaagcacgaggacgaggagtcgtcgcggcggatatgagcgtgtaagcgatgattccaccttcagcctacttggagcaaagctaaggaggtcaacgagcgttccatactatgctccatcgataaggcttggtggagattttcctgtgattttggaaaagcttccacgccaaaaaccaactaaaacagtggtgacaagcaaattaagccatccaatcttcagtttatttgatggttatcgccgccataacaagaagaaagcgacggctaaaccggagttctctagataccatgaataccttaaagaaagtggaatgtgggatttgagatctaatagtccggtcatctactttaagtag

SEQ ID NO: 917 - DNA, 1524 bp, Arabidopsis thaliana
atggagtcttctcccgatccaggagagttgattaagtcgtctcagccgagtttctttgagtttcagaagcaggcgtctctaatgacgagctgcaatcttctatggaaagagctctctgagcatttcacttccatggagcaaaacctgatgaagaaatctgaagctctgagacagatgattgaaaccctagataatcaaacgcagagctcgattgagttactcaagcatcgtgaggtgactatagaccacagcgtcgagatcgcggaggggaaagttgaggaacgcgttagagcggcgttggattcgctggagaaagctagagactgtggtgatgaagataccggagaagtcgacgacggcgacgggcttttatcggcgctgaagtcgctttgtttgaagatggacgcaagaggattttgggggtttgtgattgcgaggaagaaggaattggagaatctccggtcacagattcctgtggcgttggtagattgtgtggatccgccgaagttagtacttgaagctgtatctgaggtttttccggtggataaaagaggtggtggagagaaagtgagcaatgattttggatgggcttgtgttgtgattctggagagtttgattccagttatggttgatccagtgatggggaagtctcggctacttgtaactcctagcgttaaggagaaagctaaagagattgctgagacgtggaaggctagcttggaagagagaggagggattgagaatgtgaaaacacctgatgttcatacgtttctgcaacatcttgtgacttttgggattgtgaagaaggatgatctagctctttataggaaacttgtggttggttcagcttggcgtaaacagatgccaaagcttgctgtttcagttggtttgggcgaccaaatgcctgatatgattgaagagttgataatcaggggacaacagcttgatgcggttcatttcacttttgaagttggtcttgtacacttgttccctcctgttcctttgctcaaagcttatctgagggatgcaaagaaagctacagctttaatcactgatgattccaacaattctggccgatctgcgggatctgtttcttctgcactcgcttaccaatgtatgtgtctagagaagaccaaaaccgagaagagaaaaccagccgtgattcccgccaacaagagaacccgagcaagctacagcggtccaatgccaccagccaaagcagggcgtatcacaaacgcttacgtctcctctttcccaccgcctccaccaacattcatcagatcccaaagtcactcacctcaatacggtgtaccagcatacaccacatccccacctaccatctacagcaacaggagccctccataccaatactcacccgaggcggttcatggttcttaccaaacctctccggtcagttatccgacagcatatggtacctactgcagtccggtggctgctccaccccctccagtttaccatcctcacccgcaccaccaccaccatattcagcatgcttactactga

SEQ ID NO: 918 - DNA, 834 bp, Arabidopsis thaliana
atggctactccactctcaatctcatcaaatcctctcacctcccgccattgttaccgtctccacttatcttctacttcattcaagggaaatgtaagtgttttgggggcaaacccaagtcagattctatctctgaaactcaaccaaacccttaaaacgagaaaccaacagcaatttgcgagaccccttgttgtggttagccaaacggcggctacgtcgtcggcagttgtagctccggagagattccgtttggataatcttggaccacagccaggttcgaggaagaagcagaagagaaaaggtagaggtatctctgcaggacaaggagcaagttgtggttttggtatgagaggtcagaaatcaagatcgggtcctgggattatgagaggctttgaaggtggtcaaactgctctttatcgtcgtcttcccaaacttagaggaatcgctggaggtatgcgttcaggattacctaaatacttaccggttaatatcaaagacatagaaacagctgggtttcaagagggagatgaagtgtcattggagacattgaagcaaaagggtttgattaatccttcagggagagaaaggaaactccctcttaagattctgggtacaggagaactaagcatgaagctcaccttcaaagctcgtgccttctcaacacaagcaaaagagaagcttgaagcttcaggttgtacactcactgtgttgccgggaagaaagaaatgggttaagccatctgttgcaaagaaccaagcacgagcagatgaatactttgccaagaagagagctgcagcagcagaagcagcaacttcagagccagcagcctctgcttaa

SEQ ID NO: 919 - DNA, 1263 bp, Arabidopsis thaliana
atggccgccactgcttcctccgaagcttctgaaggaccagtgatgggtctcatcaacaagcgtctccgtgctctccgtaagaaatacaaccgaatcactcaaatggaagaatcgatttctcaaggcaaaaccctaaacaaggagcaagaagaagtcctccgctctaaacctgccgtcgtcatcctaatcgacgagcttgaaaagatccgtgctcctctctccgccgctgtgacagaggaaatcagcctcgctactcagcttaaccgtgcttcatccgatcaaaccaccgcatctgagcaaaaggaagtcactgatatcccgcaggaagttagcggcggcgatgatggcgctaagttggaggatctggtgaatttcctctactttggttcactcttcgacgtcaagtcacagaacgagttcacttcgataatgttgaccaggactcatgagagaagttgctgcttgtcttacgattacgttaccgatgatgccactgatctcctcggcgatcgggatttggattctatttctcagctttggagcctgatggtttctcgtccggtggattcaagcttatctcacaagaacgctttggagcgttgtgttgagcacgctaagctatggttagctaattccgagcagccaatcgaatcaaactgcaatacttcatatgctgcattgagagagaagttgaagaagattatggcgtctgactatttcaccactactccggaaatgaaagctccggttgatgtggcggctgcagctggtaactatacttcttaccaggtgcctgtggacgtggaggcttcagggcattaccagcaaaaggaagaagatgcatcaaattccaaagaagtagaatcagttgttaatgatcaatctcaacaagatgagcatcaaaaggttgagttagtgaccgaaggagaggtggtccatggacagcaagaacagggctatactcaggtgggaggagcagagaatgctaaaagagactatgtgccacgtgggtcttaccagaaccaaagaggtcgtcgaggtgctcgaagaggtggtggtggctatcagaatgggcgaggaggacgaggtggtggtggtggctaccagaatgggcggtacgaatcttatgatcaatctggtggaaacggttatcaaaggaactactacaacaacagaggaaggggacgtggtggtggtggtggtggaggaaatggccattcatacaacaactaccaagaccccaatgttgctgttgcgtcttag

SEQ ID NO: 920 - DNA, 1884 bp, Arabidopsis thaliana
atgtttgaaagccaaccttctttgcatgcgaatgcctctgcgttatcggaatacattaaggcattggttaaagttgataggctcgatcaaagtgagctggttcgaacattgcaaagaggtattgctggtgttgcaagggaggaagagacttttggaggtcttggggcatttagaaacgtaggaaaaccaacaaaagatggtgtccttggaactgctagtgcaccgatccatacgatatccacagaaaggactcactttaaagaacagctatggagtacaatccgaactattggagttggttttttactcatttctggtattggagctcttatcgaggacagaggaattggcaaaggacttggtttgcacgaagaagtgcaacctagtatggattcgagcaccaaattttctgatgtaaagggtgttgatgaagcaaaggctgagctagaggaaattgtgcattatcttcgcgaccccaaaaggttcactcgtctgggaggaaagcttcctaagggtgtgttgcttgtcggtcctcctgggacaggaaaaactatgcttgctagagctattgctggagaagctggagtgcctttcttctcctgcagtggtagtgagtttgaagagatgtttgttggagttggagccagaagagtgagagatctttttagtgctgcaaagaagtgctccccgtgtattatatttatcgatgaaatagatgctattggaggaagtcgcaatcccaaggaccagcaatacatgaagatgacattgaaccagatgctcgttgagttggatgggtttaaacagaatgaaggaattattgtggtcgcagcaacaaatttcccagagtctttggataaggccctggttagacctgggaggtttgatcgtcatattgttgtacctaacccagacgtggaaggtcgacgccagattttggagtctcacatgtcaaaggtacttaaggctgaagatgtcgatttaatgatcatcgctagaggaacgcctggattttctggcgctgatttggctaatctggtcaatgttgctgctttaaaagctgcaatggacggttctaaagatgtgacaatgtctgatcttgagtttgccaaagacagaatcatgatgggaagtgagaggaaatctgcagttatatctgacgagtcaagaaagctaactgctttccatgaaggtggtcatgcccttgttgccattcacaccgaaggtgctcttccagtccacaaagcaaccattgtgcctcgtggtatggctcttggcatggtttctcaactaccagataaagatgagacgagcatttctaggaaacagatgcttgctaggcttgatgtttgtatgggaggccgggtagccgaagagttgatttttggggaaagtgaagtaacttcgggtgcatcttctgatcttgagcaggcaaccaaactcgcgagagcaatggtcacgaaattcggtatgagcaaagaggtgggtcttgtggcacataactacgacgacaatgggaaaagcatgagcaccgagacaaggcttctcattgagagtgaagtgaaacaacttctggaaaaggcttataacaatgcaaaaacaatcctcacggtttacaacaaagagcttcatgcccttgcaaatgctttgcttcagcacgaaactctgtccggtaagcagattaaagaattgcttaccgatctcaactctccactgctgcaaaagcgtcaagaagtggttacaaagcaaagcaacccggttcctccatcaacccctagctcagcatcatcagcagccgcagcagctgccgcagctgcagccgccgccgccgcagcagctgcaacagccgcaaccaaaggtaaagacatggcgccagtatcgtaa

SEQ ID NO: 921 - DNA, 624 bp, Arabidopsis thaliana
atggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaa

SEQ ID NO: 922 - DNA, 432 bp, Arabidopsis thaliana
atggcgacagttccaggacaattgatctgggagatcgtgaagaacaacaactgtttcttggtgaagcagttcggtagaggaaactctaaggttcaattcagcaaggagactaacaacctcaccaacgttcactcttacaagcactctggtcttgcaaacaaaaagactgtgaccatccaggccgctgacaaggaccaagctgttgtgctcgccaccaccaagaccaagaagcagaacaagcctaagctctctgtcaacaagtctatcctcaagaaggaattccccaggatgtcaaaggctgttgctaaccaggtggtggacaactactacaggccggacttgaagaaagctgcacttgctagactcagcgccatcagcaaaggtctcagggttgccaagtccggtgccaagcaaagaaacagacaagcttaa

SEQ ID NO: 923 - DNA, 192 bp, Arabidopsis thaliana
atggtgactctaaaaatggagatttgcatcgagttgttgaaattgaccgtagatttcgtcgccgccgttgcagaatcaatcgaagtagctttccgccatcgtcctccaccggtgattcaatattcttcagtgatgtatggtcgccggagtaattacaccgccgttcccattcctctcgtggggtttctgtag

SEQ ID NO: 924 - DNA, 456 bp, Arabidopsis thaliana
atgaagcgcagtactaccgactctgatttggccggtgatgctcacaacgagacaaacaagaagatgaagagtacagaggaagaagaaatcggattctccaatttagacgagaatctagtgtacgaggtgttgaaacacgtcgacgcaaagaccttagctatgtcatcttgcgtgagcaagatctggcacaaaacggcacaagacgagcggctttgggagctgatctgtactcgtcactggactaacatcggctgcgggcagaaccagctcagatctgttgtgttggcgcttggtggcttccgaagactccactctctttacctctggcctctctctaaacccaatccgcgtgctaggttcggtaaggacgagcttaaactcactctttctcttctctcaattcgatactacgagaagatgagtttcactaagagacctcttccagaatccaaataa

SEQ ID NO: 925 - DNA, 1275 bp, Arabidopsis thaliana
atggcgtctcttcttggaacatcttcttctgcaatctgggcttctccttcactctcttctccttcctcaaaaccttcctcctcccccatttgcttcaggccaggaaaattgtttggaagcaagttaaatgcaggaatccaaataaggccaaagaagaacaggtctcgttaccatgtttcggttatgaatgtagccactgaaatcaactctactgaacaagtagtagggaagtttgattcaaagaagagtgcgagaccggtttatccatttgcagctatagtagggcaagatgagatgaagttatgtcttttgttgaatgttattgatccaaagattggtggtgttatgattatgggagatagaggaactggaaaatctacaactgttagatcattagttgatctgttacctgagattaatgtagttgcaggtgacccgtataactcggatccgatagatcctgagtttatgggtgttgaagtaagagagagagttgagaaaggagagcaagttcctgttattgcgactaagattaatatggttgatcttcctttgggtgcaacagaagatagagtttgtggaaccatcgatatcgaaaaggctttgacagaaggtgtaaaagcctttgagcctggtttgttggctaaagctaatagagggattctttatgttgatgaagttaatctcttggatgatcatttggttgatgttcttttggattcagctgcttctggttggaatacggttgagagagaagggatttcgatttctcacccggcgaggtttatcttgatcggttcaggaaatccggaagaaggagagcttaggccacagcttcttgatcggtttggtatgcatgcacaagtagggacggttagagatgctgatttacgggtcaagattgttgaagagagagctcgtttcgatagtaacccaaaggatttccgtgacacttacaaaaccgagcaggacaagcttcaagaccagatttcaactgctagggcaaacctttcctcggttcagattgatagggaattgaaggtgaagatctctagagtttgttcagagctcaatgttgatgggttgagaggagacatagtgactaacagagcagcaaaagcacttgcagctctcaaaggaaaagatcgagtaactccagatgatgttgcaaccgttatccctaactgcttaaggcaccgtctgaggaaagatccactggaatctattgattcaggagttctagtttccgagaagttcgccgagattttcagctga

SEQ ID NO: 926 - DNA, 1419 bp, Arabidopsis thaliana
atgtcggtgtacgacgctgctttccttaatacagagctttcgaaaccgacatcgatttttggtctccggctatgggtcgtgatcggaatcttacttggatctctaattgtcatcgcactctttcttctctccctctgcttaacttctcgccggaaaaatcgaaagccgagagccgatttcgcctccgccgccatcgctacaccgccgatttcaaaggagattaaagagatcgttccggcgcagaatcagtctgttccggcggagatccaggtcgatatcgggaagatcgagcatcgagtggtgttttcagatcgagtgtcgagtggtgagagtagaggaacagcgagtgcaagtgaaacggcgtcgtattccggtagcgggaattgtgggccggaggtgtcgcatcttggatggggccgatggtatactctgagagagcttgaagcggccacgaatgggctttgtgaagagaatgtaatcggagaaggtggttacgggattgtgtatcgtggcattttaactgatggaaccaaagtcgccgtcaagaacttgcttaacaataggggtcaagcagagaaggaattcaaagtagaagtggaagtcattgggcgagtacgacacaagaatcttgttaggcttttagggtattgcgtggaaggtgcatacaggatgctcgtgtatgactttgtcgacaatggtaatttggagcaatggattcacggtgatgttggcgatgtcagcccgctaacttgggatatacgtatgaatattatactggggatggccaaaggattggcgtatctacacgagggtcttgagccaaaagttgttcatcgggatattaaatcaagcaatatcttacttgatcgccaatggaatgctaaggtttcggattttggacttgctaagctcttggggtctgagagcagttatgtgactactcgtgtgatgggaactttcggttatgtagcaccagaatacgcttgcaccggaatgttaaacgagaagagtgatatctatagcttcggaatactaatcatggagataatcactggaagaaacccggttgattatagtcggcctcaaggagagacaaatctagtggattggcttaaatcaatggtgggaaaccgaagatcagaagaagttgttgatccgaaaatacccgaaccaccatcctcaaaggctcttaaacgagtgttgcttgtagctttgcgttgtgtggatcctgatgcgaacaagagacctaaaatgggtcatatcatacatatgcttgaagccgaagatctactctatcgcgatgaacgccgaacaacaagggaccatggaagccgcgagagacaagagacagctgtggttgctgccggtagtgaaagtggtgagagcggttcacggcatcatcagcaaaagcaaagatga

SEQ ID NO: 927 - DNA, 1461 bp, Arabidopsis thaliana
atggctaagtcttgctatttcagaccagctcttcttcttctgttagttcttttggttcatgccgagtcacgcggtcggttcgagccaaagattcttatgccgacagaggaagctaacccggctgaccaagacgaagatggtgtcggtacaagatgggcggttctcgtcgctggttcttctggatatggaaactacagacaccaggctgacgtgtgtcacgcatatcaaatactaagaaaaggaggtttaaaggaagaaaacatagtcgttttgatgtatgatgatatcgcaaaccacccacttaatcctcgtccgggtactctcatcaaccatcctgacggtgacgatgtttacgccggagtccctaaggactatactggtagtagcgttacggctgcaaacttctacgctgtactcctaggcgaccagaaggctgttaaaggtggaagcggtaaggtcatcgctagcaagcccaacgatcacattttcgtatattatgcggatcatggtggtcccggagttcttgggatgccaaatacgcctcacatatatgcagctgattttattgaaacgcttaagaagaagcatgcttccggaacatacaaagagatggttatatacgtagaagcgtgtgaaagtgggagtattttcgaagggataatgccaaaggacttgaacatttacgtaacaacggcttcaaatgcacaagagagtagttatggaacatattgtcctggcatgaatccgtcacccccatctgaatatatcacttgcttaggggatttatatagtgttgcttggatggaagatagtgagactcacaatttaaagaaagagaccataaagcaacaataccacacggtgaagatgaggacatcaaactacaatacctactcaggtggctctcatgtgatggaatacggtaacaatagtattaagtcggagaagctttatctttaccaagggtttgatccagccaccgttaatctcccactaaacgaattaccggtcaagtcaaaaataggagtcgttaaccaacgcgacgcggaccttctcttcctttggcatatgtatcggacatcggaagatgggtcaaggaagaaggatgacacattgaaggaattaactgagacaacaaggcataggaaacatttagatgcaagcgtcgaattgatagccacaattttgtttggtccgacgatgaatgttcttaacttggttagagaacccggtttgcctttggttgacgattgggaatgtcttaaatcgatggtacgtgtatttgaagagcattgtggatcactaacgcaatatgggatgaaacatatgcgagcgtttgcaaacgtttgtaacaacggtgtgtccaaagagctgatggaggaagcttctactgcggcatgcggtggttatagtgaggctcgctacacggtgcatccatcaatcttaggctatagcgcctga

SEQ ID NO: 928 - DNA, 1887 bp, Arabidopsis thaliana
atgaagcagcttctgtgttaccttccatggctgcttctcctcactcttctggtttcccctttaaacgacgctcgattcgtggtggagaagaacagtttgtccgtgacgtcgccggagagtataaaaggaactcatgatagtgcaattggtaacttcgggattcctcaatacggtggaagtatggctggtacggtggtttatccgaaagagaatcagaaatcgtgtaaggaatttagcgatttctcgatttcgttcaagtctcagcctggtgctttacctactttcctcttagttgatcgtggagattgtttcttcgctttgaaggtatggaacgcacagaaagcaggtgcttctgctgttcttgtagctgataatgttgatgaacctttgattacaatggatacacctgaagaagatgtttcttctgcaaagtatattgagaatattactataccttctgctcttgttactaaaggttttggtgaaaagctgaagaaagctattagtggaggagatatggttaacttgaatcttgactggagagaggctgttccgcatcctgatgaccgtgttgagtatgagttgtggactaatagtaatgatgaatgtggggttaagtgtgatatgttgatggagtttgtgaaagattttaagggagcggcgcagattcttgagaaaggcgggtttacgcagtttagacctcattatattacttggtattgtcctcatgctttcacgttgagtcgacagtgtaagtctcagtgtatcaataaaggaaggtactgtgctcctgatccagagcaggactttagctcgggatacgatggaaaagatgtggtcgtggaaaacttgagacagctttgtgtttacaaggtggcgaatgaaaccggcaaaccttgggtctggtgggattatgttactgatttccagatcagatgtcccatgaaggagaagaaatacaataaggagtgtgctgattccgttatcaaatctcttggaattgatagtaaaaaacttgacaagtgtatgggagaccctgatgctgacttggacaatccagttcttaaggaagaacaagatgctcaagttggcaagggttcaaggggtgatgttaccatattgcctaccttggttgtcaacaacagacagtaccgaggaaagttggagaagagtgcagtactcaaggctttatgctctggttttgaggagaccactgaaccagcgatatgcctcagcacagatgtggagtcaaacgagtgcttagataacaatggtggttgttggcaagataaatcagccaacataactgcttgcaaggatacttttcgtggaagagtatgcgagtgtcctacagttgatggtgtgcaattcaaaggggatggttacagtcactgtgaaccaagcgggccagggagatgcacaatcaacaatggaggttgttggcatgaagagcgagatggacatgcgttctctgcttgtgtggacaaggacagtgttaagtgcgagtgtcctccaggatttaaaggagatggtactaagaagtgtgaagacattaatgagtgcaaagagaagaaagcatgccagtgcccagagtgtagctgcaagaacacatggggaagctatgagtgctcttgtagcggggaccttctctacatcagagatcatgacacttgcatcagcaagacgggtgcacaagtgagatcagcatgggcggccgtttggcttataatgttatcattgggacttgcagctgctggtgcatacctcgtttacaaatataggctaaggcaatacatggactcagagatcagagccataatggcacagtacatgccattggacagccaacccgagatcccgaaccacgtgaatgatgaacgcgcctga

SEQ ID NO: 929 - DNA, 1812 bp, Arabidopsis thaliana
atgacactacttgagctctccaagcgtactggtgagtctgtggcggttttgcagagcattctcattaatgttggggaaacttttagttcagaattcgacacaatcagtgttgatgtcgccgagcttcttgctatggaaatcgggatcaacgtaaggaggcaacattctacagaaggatctgagattcttccacggcctccagttgtaaccgtaatgggccatgtcgatcatggaaaaacctcgttgctggatgctttaagaaacacctctgttgcagcaagagaagctggtggaatcactcagcacgtgggtgctttcgtggtaggcatgccggattctggcacttcaatcacattcctcgacacacctggccatgccgctttcagcgagatgcgagctcggggagctgctgtgactgatatagtcgtcttggtggttgctgctgatgatggggtaatgccgcagacactcgaggctattgcgcacgctagatcagcgaatgttccggttgtggttgcgatcaataaatgcgataaacctggagctaatccggaaaaagttaagtaccagctcacgtctgaggggatagagcttgaggatattggaggaaatgttcaggtgaaagataatccgggttggttcggtttaatatggtttttgttgcaatttggacttgcgaagagtacagggctagacaaattagaagaagctctgcttctccaagctgtggatatggacctgaaagcacgtgtggatggaccagctcaagcatatgtggtggaggctcggcttgacaaaggccgtggaccgttagccaccattattgtaaaagccggaactttggttaggggtcagcatgtagtcattgggtgtcagtggggaagactcagggctattcgggacatgatcggtaagacaacagaccgagcaacaccagcgatgcccgtcgagattgaagggcttaaaggtcttccaatggctggcgacgatgtgattgtggtggaatcagaggaacgcgcaagaatgctgagcgaagggaggaaaagaaaatatgagaaagatcggttgttgaaagcagaggaagcgagattagaggaagcagcagcgagattggaaacagagtctgaagaagggtttgttcgggttgaattaccgatagtagtgaaatcagatgtgcaagggactgcacaggctgttgctgatgcgttaagaacattaaatagcccacaggtgtctgtgaacattgttcatagcggagtgggagcaatatctcactctgatttggacttggcacaagcttgcggtgcgtgtattgttgggtttaacgttaagggtggaagtactggtaatctttctgcggctcaaggcagcgtcaaggtattccatcaccgtgtgatataccatttactcgaagacatcgggaacttgatcgtagaaaaagcaccaggagtttcggagatggaggtgtctggtgaagccgaggtacttagcatattcaagatcttaggaaagagaagaaccgaagaagatggagtaaacatcgcaggttgcaaagtgatggatggtcgggtatgtagaagcggactcatgaggctgttacgaagcggagaagtggtcttcgaaggctcgtgtgcgtcgctgaaacgggagaaacaagacgtggaacaggtcgggaaagggaacgagtgtgggcttgtgtttggagattggaatgattttagagtgggagatgtgattcaatgcatggaaccagtcattagaaaacctaaattcatatcctctgagagtggagctgtgagaattgaatgctga

SEQ ID NO: 930 - DNA, 1086 bp, Arabidopsis thaliana
atgggttttatcgatggaaagtgggcaccaatgatagtcttaattgtttctaacatgattgcgggaatggttaatgctttagttaagaaagttcttgatggaggcatcaatcatatggttattgctacttatcgtttgggtatatctactcttttccttcttccagtcgcttatttttgggaacggaaaacaagaccaaagctaactctaagcatctcatgtcagcttttcgtcagtgccctttttggggcgagcttgatgcaatatttctacttgcttggactgtcctacacgtctgcaacgctgggatctgctttctgggccataatgccttccctcactttcgttatggctttaatatttgggttcgaaaagctaagtttgaaaacaaaaataggatacggtgtcgttcttggaactttgataagcttagtaggaggtttacttcttactatgtatcaagggattccattaacaaactctccagaacaagcagcaaattcaaataaccacacaggacatgagaattggatcaaaggttgtttctttttattgaccggagttgttcttttcagttcttggatgcttatacaagccaagatcaacgtgaaatacccttgtccatactcgagtaccgttattttgtcggtctttggtacgcttcaatgcgcccttcttagtttaattaagactagacatttggaagattggatccttagagatgagcttaccatcatcaccgtcgttatagcgggagtggttgcacaaggtatgtgtacggtgggcatgtcgtggtgtatcaaacaacaaggacctgtcgtttcctcatcatttagtcctgtcgtgcttatgtctgcaaccgtgttcgatttcttgattcttcatcgtgagatttatttgggaagcgttattggatctgtggtggttgtgatcggtttatatatatttctatggagtaggagtaagcaaatagtagagtgtaagatcatgaagttgcctaccaatacggtggaagaagaaaaggaagaggaaggccgtacaaatgttaacaacggtcaacttttggttattccgatgactccttga

SEQ ID NO: 931 - DNA, 1356 bp, Arabidopsis thaliana
atgtctcggtgttttccgttcccgccacctggttatgtactaaacggaatccgcgatgaggctgtgatcgtatcatcgatcaagggggtggaggagaaagctaagaaagaacaaaggaggaaggatagaagaagtgataagaaggataaaaaagataagaaggagaggaaggagaagaaggagaagaaggagaaaaagaggaaggagagggaaggaaaggaagttggaagcgaaaagcgcagtcataagagacggcgtaaagaagacggtgctaaagttgatctttttcacaaactaaaagaaagtgaagtcaattgtttggagaagagcagccttactgtagaacgtgagctgcttcagtcgacgtcccaaaactcttgtgatagcactcttaacagcaatgagatgttaccgaagcagaaggaggtccagcagcctctcgatggtagacataacaacaacaacaacgagaagcgtgtggagaagcagcagcctctcgatggtagacataacaacaacaacgagaagcgtgtggagaagcagcagcctctcgatggtagacataacaacaacaacgagaagcggattgagaagcagcagcctctcaatggtagacataacaacaacaacgaaaagctgatggagaagcagcagcctctcaatggtagacataacaacaacaacgagaagcggattgagaagcagcagcctctcaatggtagacataacaacaaggagaagcagaaagagaaacagcagcctctcgatgttagacataacaacaacgactctgaaagcatcattcggattcgattgcctattcgaaggcagaaagatcccgaggtgatgatgaccaataaggatcaagaaaaaccaggtccttctcggggaataaagttagactcgtcccaacttcctactagagagccggttaatcaacatccttgttccacttctgcagcagaacatgcttcgaagccacgagaagagaaaaggaaagatcccatttttagagggaaacacggtaaagagaagatatcctcatcctctactcgagaaacttatcaacctcctaaaagcctatgcaattgccctccatccatggtgttgcaattcttggacgtagttgagaattgggtccctaacacgatcgagagaagagtagacctcattaactctgaagatgaagaatgttggtggtccatgaagaagccgccaagtagcaccacagaaatatgcaaacaacttaatagagagaatgagatcaagcaagtaggcaatacaatggggtggccatgtgctcgccttttaccagaagctgatgtctacgccttaccttacacagtcccgttctga

SEQ ID NO: 932 - DNA, 1479 bp, Arabidopsis thaliana
atgggggaagccagaccaagaagagcgaccacattcgcatgtctctcgataaggagaaggagaaacaacaatggtgtgtctgaatttgaagaaacggcgaggtttgaacaagtgggtggtaaaggaatctcggttttgtgcgggttaggttattgggtacaaggatcaagatgtttcccatggcttgcacttaacttccatatggttcatagcctcgcactccaaccatcgacgcttcagcttgtgcaatactcttgcagtcttcccatggtggctaaacctctctacggtgtgctctcagatgttctttacattggaagtggtcgtagagttccttacatcgccattggagcatggggttcaatggggatatttcaaggagctagagaagttcttccttctcttgtggcatgtgtcctgcttagtaaccttggagcatccatcactgaggttgcaaaagacgctcttgttgcggaatacggtctgagataccgaataaacggtctccagtcttatgcgctcatggcttcagcagctggtggagtccttggaaacttacttggaggatatctcttactcacaacacctcctaagatctcctttcttgtattctctgctttgttgtctctgcagctcgttgtttctttatcttccaaagaagaatctttcggcttaccacggatagcagagacaagctcggttttggagagcgtcaagaaacagatatcgaatcttaaggaagcaattcaggcagatgaaatctcccagcctctgatttgggcagtagtatccattgcaatggtccctcttctctcaggatcagtcttctgttaccaaactcaagttctgaatcttgatccttcggttattggaatgtcgaaagtgattggacagttgatgcttctttgtctaaccgtggtctatgatcgatacttgaagacacttcccatgagaccactgatccatatcatccaactcttgtacggtttatcgattctcctcgattacatcttggtgaagcaaataaatctcggatttggaatctccaacgaggtttatgtgctgtgtttttccagcctagcagaaatcctagcacagtttaagatccttccatttgcagtcagattagcaagtatgtgtccacaggggtgtgaaggatcagtcacatcttttcttgcttcaactctgtgtctatcacaaatagttagtgcattcttaggcgtcggattggctaatctgatcggtataacatcaagtaactattcaaacttgtcttcagggattctcatacagtctctagcagctctggcacctttgtgcttcatgcaccttgtgccaatgtcagaacctgtgattgagaaagaaggcaagagaggtattagtaagagaagcaggagaaacagacgagtcgggagagtagtcgataaagaaagtgttacttaccgacgggaaagagagtcagaagaagcacaaaggtag

SEQ ID NO: 933 - DNA, 1896 bp, Arabidopsis thaliana
atggcaaagccggaaaatgacgtcaccttaaccgagaaacaaacatggagcacatgggaagagcttcttctcgcctgcgccgtacaccgtcacggtaccgaatcatggaactctgtttccgccgaaatccagaaactgagtcccaacctctgttccctcaccgcctccgcttgccgccacaagtacttcgacctcaaaagccggttcacccaagagctgcccgtaccggaatccgtcgctgagatctcaaccgctccttggctagaggagttaaggaagctccgcgtcgatgagctccgtcgcgaagttgaacagtacgatttatctatctccacgttgcagtcgaaggtgaagcaattggaagaagagagagagatgagtttcattaaaccggacacggaaaccgagaatttagatctagagaggaagaaagagcgtagcgattccggtgaaccagtcccaaacccgccggttcagctaatgaacgaaaccatttctccagatcccaaagaaatcggatcggaaaacacggagagggaggaggaaatggccggaagcggcggcggagaatcgaagcttgccggagaggattcttgtagaggaagctgtgaaagtgtggagaaggaaccgacgacgaactcggagagagttgaaccggtgagtgtgaccgagttgatagagtcggaggacggagcgagtcgtggagaggagattactagtgatgtgcagagctcggcgagcttgccaagaaagggaacgtcggagccggataaggaagatcaatctccgacgagcgccaaagatttcaccgttgaatcacagccgttgattagttttgtcgagattcttctgtctcatccctgtggttcccacttttcgcgccgactcgaacgtcaggaaacaattgagtacggtacaataattagagagcacgtagattttgagataattcggaagcgagtcgaaggaggcttgtacaaaagttggaggatcaacttctttcgtgatttgctgctacttgttaataatgcaagagtgttttatcacagaggatcttcagagtttaaatttgctgagcagcttcaccaactcgtcaagaaacagatgactactactctcaagggacttagtaatagagatgagatctcaatctcaccaccaaaagaagaagttgttgcaatcccttcatcaaagcctgtttcttctaaaccaagaatgtctgttcctaatattgtagcttgtcggaaacgtagtgccttggctgctaaacctttgctattattgcctcctggaccagataaaaaggccaagaaaacagatcatgttgtggactatgatgagaagccggtttcagacaaggatggtgaagcctctgggaaagacgatgatgactctctgattgtgaagataatgactagaggaagaacctcctcgacgggaaaagtagctaacaggaacgacaagaaccgtgactccagtttgaatgttgatgatagcaaagataaggttaagaaaactgatgaagagaagaaaggtggctcgaaaaagaaaagggctgcgagttttctcaggagaatgaaagtgggctcttcggatgacacattgaagcgtagctctgctgctgattcttctactacgggaaaaggaggaggagcggaacagaggaagaataacagcaacaaagctgataataagaaaacaccgataccaaagataagacaaacaaataagaaagcaagtcctgtgaagagaagcaataatggtcgaaactcagaaagagaagctgctccatcttcttcatcttatcctattctagcaaagcgaagcagagatgctggtgaaaaagaggaggcgtcttcttattcaccacgcttgaagaaacgtgcaaggaggtga

SEQ ID NO: 934 - DNA, 1764 bp, Arabidopsis thaliana
atgactcttccttatcgtttctcttccgttagaaaccactcacttctacttaagacttctcatctctgcacacccagatcagctcttggttgttgtttctctcccaaggaatcccctttcttcaggaagaacactgcccaattcctttctcctcagaaacacacttctcttcctctgaaacttgtctgccctttagctagtttctcttcttatgcggattctgagggagaagagcaacaccatgctgatcaaccgatacagaaccctcacgaatcttctaccgtttcaaacgaatcagatgggaaaggtaatgcagaagctactggagacttttctggaatggctcaagcctttcacatttcttccacaacagcaagggcaatctctatagtcatcgccttctctgctctcacccttccaatcttcatgaagtccctgggacaaggactggctctcaagaccaagcttctctcttacgcaacactactctttggtttctacatggcctggaacatcggagctaatgatgtcgcaaatgccatggggacttctgttggatctggagccttgacaatccggcaagctgtgatgacagctgcagttctcgaattctcaggtgctcttttgatgggaactcacgtgactagcacgatgcagaaaggaattctcatggctaatgtgttccaagggaaagatatgttgctctttgctggtctcctctcttccttagctgcagctggaacttggttacaggtagcttcttactatggatggccagtatcaacaactcactgtatcgtcggatcaatggttgggtttgggcttgtatatggaggagctggtgccgttttctggagttccctagctaaagtagcttcatcttgggtcatctctcctatactgggagctcttgtctccttcctagtctacaaatgcatcaggagatttgtttacagtgcaccaaacccaggacaagcagcggctgctgccgctcccgtcgctgtatttgtaggtgtggccagtatctcctcagccgcattgcctctaagtaagatctttccaatagctctatcacaagccttagcctgtggagtagcaggagccatagtattcgacagaatcatccgcaaacagctcggtcacctcctagctaaaacaaaatcaccagaaacatctcaaaaccaacccaaaaccattggtttcctctccgatatcgcaggaccaacaggtacacaactcgaaatagtctacggaatctttggctatatgcaagtcctctccgcttgcttcatgtcattcgctcacggaggcaacgacgtctccaacgcaatcggaccattagccgccgcattaagcattctccaaaacggagcagctgcaggaggagccgagatcgttatcccaatggatgttctcgcttggggaggattcggaatcgttgctggtctcacaatgtggggatacagagtcatcgcaacgatagggaagaagatcactgagctaacaccaacaagaggattcgctgcggaattcgccgccgcgtcggttgttttgtttgcttcgaaattagggcttccgatttctgcgactcatacacttgttggtgctgtgatgggtgttggtttcgctagagggcttaatagtgtgagagctgagactgtgagagagatcgttgcttcgtggcttgtcaccattcccgttggtgctacactcgccgttatctacacttggattttcaccaagatcttatcttttgtattgtga

SEQ ID NO: 935 - DNA, 5273 bp, Arabidopsis thaliana
aagaggagccgtacaatatcattcccgttaacaatctcctcgccgaccatccttcactccgttttcccgaggttcgtgccgccgctgctgctcttaaaaccgttggagaccttcgtcgtccgccgtatgttcaatggcgttctcactacgatctcctcgactggctcgccttgttcttcggtttccagaaagataacgttcgtaaccagcgtgagcatatggtgcttcatctcgcaaatgctcagatgcgtctctctccgccgccggataatattgattctctcgattccgcggttgttcgtcggtttcgtcggaaacttctcgctaactactctagctggtgttcgtatttggggaaaaaatcaaatatctggatctcagatcggaaccctgattcgagacgagagcttctctatgttggactctatcttctcatttggggagaggctgcgaatcttcggttcatgcctgaatgtatctgttacatcttccataacatggcctctgagctcaacaaaatcttagaggattgcctcgatgagaacaccggccaaccttacttgccttctctctcaggcgaaaacgctttcttaaccggcgtcgttaaacctatttacgatactatccaagctgagattgatgagagcaagaacggtacagttgcgcattgtaagtggaggaactacgacgatatcaatgagtacttctggactgatcggtgtttcagcaaattgaaatggccgcttgatttgggaagcaatttctttaagagtagaggcaaaagtgtagggaaaactggtttcgtggagcgcaggacgttcttctacctttacaggagttttgatcgactttgggtgatgctagctttgttccttcaagccgccattatagtagcttgggaggaaaagccagatacctcgtcggtaacaaggcagctgtggaatgctctgaaggcaagagatgttcaggtgagactattgaccgtgttcttgacatggagtggtatgcgactcttgcaggctgtgctggacgcggcttcacaatatcccctcgtttccagagagaccaaaaggcattttttcagaatgctgatgaaggttatagctgccgcagtttggattgtagctttcactgtcctctacactaacatctggaagcagaagaggcaagacaggcagtggtccaatgccgcgacgactaagatataccaattcctttacgctgtgggggccttcttggtgcccgaaatcctggctttggctttgtttattatcccatggatgagaaacttcctggaagagaccaattggaaaatattctttgctctaacttggtggtttcaaggcaaaagctttgtgggtcgaggtttgagagagggtttagtggacaacatcaagtactcgactttctggatctttgtcctagctacaaagtttacatttagttacttcctgcaggttaagccaatgattaaaccctcaaagctgctatggaacttaaaggatgtcgattatgagtggcatcagttttatggagacagcaataggttttctgtcgcattgttatggttgccagttgtgttgatatatctgatggatatccaaatttggtacgcaatctattcttcgattgttggtgctgttgttgggctgtttgatcatctgggggagatcagggacatgggacagctgaggctaaggtttcaattctttgctagtgctattcaattcaacctaatgcctgaggaacaactcctgaatgctagaggctttggtaacaagttcaaggacggcattcatagattgaagctaaggtatggatttgggaggccgtttaagaaacttgagtcgaatcaggtcgaggccaacaagtttgcgttgatctggaacgaaatcatcttagctttcagagaagaggatatagtttctgatcgtgaagtagagctactggagctgccaaagaattcctgggatgtgacggttattcgctggccgtgtttcttgttgtgcaatgagcttttgcttgcactgagccaggccagagagctgatagacgcacctgataaatggctgtggcacaaaatatgcaagaatgaatacaggcgttgtgctgtagttgaggcatatgacagcatcaaacatctattgctctcaatcatcaaagttgacactgaagaacattcgataattacggtcttctttcagataattaatcagtccattcagtcagagcagttcaccaagacctttagagtggacctgctgccaaaaatttatgaaacactgcagaaattggttgggctggtaaatgatgaggaaacagatagtgggcgggtggtgaatgttctgcagtctctttatgagattgcaactcgacagttctttatagagaagaagacaactgaacagctatctaatgaaggtttaactcctcgagacccagcctcaaagttgctgtttcaaaatgctattaggcttcctgatgcaagcaatgaagacttctaccggcaggttaggcgtttacacacgattctcacctctagggactctatgcacagcgtccctgtgaatctagaggcgagacggcggattgctttcttcagtaattcgcttttcatgaacatgcctcatgcccctcaggttgagaaaatgatggcgttcagtgttctgactccatattacagtgaggaagttgtatacagcaaagaacagctccgaaatgagactgaggatgggatttccaccctatactacctgcagacaatttatgctgatgaatggaaaaatttcaaggaacggatgcatagggaaggaatcaagacagatagtgagttgtggacaaccaagctgagagacctcaggctttgggcttcctacagaggtcagacattggcacgtacagttcgtgggatgatgtactactaccgggctcttaagatgctcgcttttcttgactctgcgtctgaaatggacattcgggagggtgctcaggagcttggttcagtgaggaatttgcagggagaactgggtggtcaatctgatgggtttgtctctgaaaacgaccgatcttccttaagcagagcaagtagttccgtgagtacgctgtataaaggccatgagtatgggactgcattgatgaaattcacatatgttgtggcgtgtcagatctacgggtctcaaaaagcaaagaaagagcctcaggcagaggaaattctgtatctgatgaagcagaacgaagctctccgtattgcatatgtggatgaggtgcctgcgggaagaggagagactgattattactccgttctggtgaaatacgatcaccagttggagaaggaagtggaaatattccgtgtgaagctacctggtccagtgaagctgggcgagggaaagccagagaaccagaatcatgcaatgatctttacccgtggtgatgctgttcagaccattgatatgaaccaagacagttattttgaggaagctctcaagatgagaaatttgctccaggagtacaaccattatcatggtatcagaaaaccaactattcttggtgtcagggagcatatcttcacgggatcagtctcgtcactggcgtggttcatgtctgctcaggagacaagttttgtcactcttggtcagcgtgttcttgcaaacccactgaaggtcagaatgcattatggccaccctgatgtatttgacagattctggttcttgagtcgaggcggcatcagtaaggcttccagagttataaatatcagtgaggacatctttgccgggtttaactgcacgttaagggggggaaacgtcacccaccacgagtacattcaggtcgggaagggacgggatgttggattgaatcagatatcaatgtttgaggctaaggtagccagtgggaacggagagcaggttctcagccgagatgtgtaccggctcgggcacaggcttgatttcttcagaatgttatcatttttctacacaactgtagggtttttcttcaacacaatgatggtcattcttactgtttacgctttcctctggggacgggtttatctggctctcagcggggttgagaagtccgctctagcagacagtacggacaccaacgccgcgcttggggtgatcctgaaccagcagttcatcattcagctcggtctgttcactgccctgccaatgattgttgaatggtctctcgaggagggtttccttctagcgatatggaatttcattcgaatgcagattcagctttcagctgtcttctacacattctcaatggggaccagagctcactatttcggtcgaactattctccatggtggggccaagtatagagccactggacgtggatttgttgtcgagcacaagggattcactgagaactaccgactgtatgcacgcagtcactttgtgaaggccatcgagcttgggctgatcctcatagtctacgcttcgcacagtccgattgccaaagactcgttgatttacatagccatgactatcaccagctggtttcttgtgatttcatggataatggccccatttgtgtttaacccatcaggattcgactggcttaagacagtctatgactttgaagacttcatgaactggatctggtaccaaggcagaatctcaacgaaatctgaacaaagctgggaaaaatggtggtacgaggaacaggaccacctgagaaacaccgggaaggcaggattatttgtggagatcatcttggtcctccggtttttcttcttccagtatgggattgtataccagcttaaaattgcaaacggatccaccagcctttttgtctacttgttctcatggatatacatctttgctatatttgtgctcttcctagtcatccaatacgcccgtgacaagtactcggcaaaagctcacatacggtacaggcttgtccaattcctcctgatcgtgcttgctatactggtgattgttgctttgctcgagttcacgcatttcagcttcatcgatatcttcacaagccttcttgcattcatcccaactggctggggaattctgctgatcgcacagactcaaaggaagtggctgaagaattacactattttctggaatgctgttgtctctgttgctcgcatgtatgacatattgtttgggatactcataatggttccagtagcgttcttgtcatggatgcctggattccagtcaatgcaaacgaggatattattcaatgaagcttttagcagaggacttcgcatcatgcagattgtcactgggaagaaatcaaaaggcgatgtctaa

SEQ ID NO: 936 - DNA, 1449 bp, Arabidopsis thaliana
atgccagtagtaacccgcttgattcgtttgaagtgtgtagggctcagacttgaccggagtggactcaatcggcgaatctgtcacggaggacacggggaatcaacgcggcggagagtgatggaagagctttcaagcctaaccgtgagtcagcgcgagcaatttctggtggagaacgatgtgttcgggatctataattacttcgacgccagcgacgtttctactcaaaaatacatgatggagattcagcgagataagcaattggattatctgatgaaaggcttaaggcagcttggtccgcagttttcttccttagatgctaatcgaccttggctttgttactggattcttcattcaatagctttgcttggggagactgtggatgatgaattagaaagcaatgccattgacttccttggacgctgccagggctctgaaggtggatacggtggtggtcctggccaacttccacatcttgcaactacttatgctgcagtgaatgcacttgttactttaggaggtgacaaagccctttcttcaattaatagagaaaaaatgtcttgttttttaagacggatgaaggatacaagtggaggtttcaggatgcatgatatgggagaaatggatgttcgtgcatgctacactgcaatttcggttgcaagcatcctaaatattatggatgatgaactcacccagggcctaggagattacatcttgagttgccaaacttatgaaggtggcattggaggggaacctggctccgaagctcacggtgggtatacctactgtggtttggctgctatgattttaatcaatgaggtcgaccgtttgaatttggattcattaatgaattgggctgtacatcgacaaggagtagaaatgggatttcaaggtaggacgaacaaattggtcgatggttgctacacattttggcaggcagccccttgtgttctactacaaagattatattcaaccaatgatcatgacgttcatggatcatcacatatatcagaagggacaaatgaagaacatcatgctcatgatgaagatgaccttgaagacagtgatgatgatgatgattctgatgaggacaacgatgaagattcagtgaatggtcacagaatccatcatacatccacctacattaacaggagaatgcaactggtttttgatagcctcggcttgcagagatatgtactcttgtgctctaagatccctgacggtggattcagagacaagccgaggaaaccccgtgacttctaccacacatgttactgcctgagcggcttgtctgtggctcagcacgcttggttaaaagacgaggacactcctcctttgactcgcgacattatgggtggctactcgaatctccttgaacctgttcaacttcttcacaacattgtcatggatcagtataatgaagctatcgagttcttctttaaagcagcatga

SEQ ID NO: 937 - DNA, 1482 bp, Arabidopsis thaliana
atggttttgtctaagacagtttccgaatctgatgtctcaatccattcaacttttgcttctcgttacgtccgcaactctcttccacgattcgaaatgcctgagaactcaatcccaaaagaagcagcttaccaaatcatcaacgacgagctaatgctcgatggtaacccaaggctgaacctagcttccttcgtgaccacatggatggagccagaatgtgacaagctcatgatggagtccatcaacaagaactacgtcgacatggacgagtaccctgtcaccactgagcttcagaaccgatgtgttaacatgatagcacgtctcttcaacgcgccgcttggtgacggtgaagctgccgttggtgttggcaccgtcggatcgtcggaggcgattatgttggccggtttggcttttaagagacaatggcagaataagcgtaaggcccaagggcttccttatgataagcccaatatcgtaaccggtgctaatgtccaggtttgctgggagaaattcgcaaggtatttcgaagtggagcttaaggaagtgaacctaagagaagactattacgtgatggaccctgtaaaggcggtcgaaatggtagacgaaaacacaatttgtgtcgctgccatcctcggttcaacgttaaccggtgaattcgaagacgttaagctcctcaacgacctccttgtcgagaaaaacaagcaaaccggatgggacacgccaatacacgtggacgcagcgagtggtgggtttattgctccgttcttgtatccggagctggagtgggatttccggctaccgttggttaagagtattaatgtgagtggtcacaaatacggtttggtttacgccggtattggttgggttgtatggagaaccaaaaccgatttgcctgatgaacttatcttccatatcaattatcttggcgctgatcaaccaacctttacactcaacttctccaaaggttcaagtcaagtgattgctcagtactaccagctgattcgtcttggattcgagggttatcgcaatgtgatggataattgtcgggaaaacatgatggtactaagacaaggattagagaaaacgggacgttttaaaatcgtctccaaagaaaacggtgttccgttagtggcgttttctctcaaagatagtagccgccacaacgagttcgaggtggcccatacactccgtcgcttcggctggatcgttccggcctacacgatgcctgcggatgcgcagcatgtcactgtccttcgagttgttatccgagaagatttctctcgaaccttagccgagagattggtagctgatttcgagaaggttctacacgagctcgatacgcttccggcgagggttcacgccaagatggctaatggaaaagttaacggtgttaagaagacgccagaggagacgcagagagaagtcacggcctactggaagaagttgttggagactaagaagaccaacaagaacacaatttgctaa

SEQ ID NO: 938 - DNA, 1383 bp, Arabidopsis thaliana
atggcggaaacaactcccaaagtgaaaggccacgtcgtaatcttaccatacccagttcaaggccacctaaacccaatggttcaattcgctaaacgtctagtctccaaaaacgtcaaagtcacaatcgccaccactacctacaccgcctcctcaatcacaacaccatcactctccgtcgaaccaatctccgatggattcgatttcatccccataggtatccccggtttcagcgtcgatacttactcagaatccttcaagctcaacggatccgaaaccctaactctcctaatcgagaaattcaaatccacagattcaccaatcgattgcttaatctacgattcgtttcttccttggggacttgaagttgctagatctatggaactttcagctgcttctttcttcactaataatctcactgtttgttctgtgttgcgtaaattctctaacggtgactttcctcttcccgctgatcctaattcggcgccgtttcgtatccgtggcttaccgtctttgagctacgatgagttaccttcgtttgtgggacgtcattggttgactcatcctgagcatggcagagttcttctgaatcagtttcctaaccatgaaaatgctgattggttattcgttaatggctttgaagggttagaagaaacacaagattgtgaaaatggtgagtctgatgcaatgaaggcgacgttgatcggaccgatgattccatcggcttatcttgatgatcggatggaagatgataaagactatggtgcgagtctgttgaaaccgatatcgaaggagtgtatggagtggcttgagactaagcaggctcagtcagtagcatttgtttcgtttggttcgtttgggattctctttgagaagcaacttgcagaggtagctattgcgctacaagaatcggatttgaacttcttgtgggtgattaaagaagctcatatagcgaaattgcctgaagggtttgtggaatcgactaaagatagagccttgttggtttcttggtgtaaccagcttgaggttttagctcatgaatcgataggttgctttttgactcattgtggttggaactctacgttggaagggttgagtttgggagttccgatggttggtgtgcctcagtggagtgatcagatgaatgatgctaagtttgtggaggaagtttggaaagttgggtatagagcgaaagaggaagctggggaagtaatcgtgaagagtgaagaattggtgaggtgtttgaaaggagtgatggaaggagagagtagtgtgaagattagagagagttcgaagaagtggaaagatttggctgtgaaggcaatgagtgaaggaggaagctctgatcgaagcattaacgagtttatagagagtttagggaagtaa

SEQ ID NO: 939 - DNA, 2019 bp, Arabidopsis thaliana
atggctgctaaacctcttcttcttcctcttctcctccttcttcatctctcaatcaccttagctcaaaacgacacaaatgctctcacactcttccgtctccaaaccgacacacacggcaacctcgccggaaactggaccggctccgacgcttgtacctcctcatggcaaggcgtttcttgctcaccatcttcacaccgcgtcactgaactatctctcccttccctctccttacgaggaccattaacctctctctcctccttagaccaacttcgtcttcttgacctccacgataacagactcaacggcaccgtttcaccactcacaaactgtaaaaacctcagactcgtttatctcgccggtaacgatctctccggtgagattcctaaagagatatcctttcttaaacggatgatacgtcttgatctctctgataacaatatccgtggagttataccaagagagattctcgggtttacccgggttttaacgatccggatccagaacaatgagttaacgggtcggatcccggatttttctcagatgaagtcacttcttgaattgaatgtttccttcaatgagttgcacggaaacgtctccgacggcgtggtgaagaaatttggagacttgagcttttccggtaacgaaggattatgcgggtcggatcctttaccggtttgtactatcacaaacgacccggaatcttctaacactgatcagattgttccgtcgaatcctacttcgattccgcattctccggttagcgttagagaaccggaaattcacagtcatagagggattaaaccgggaataatcgctgcggttatcggtggttgcgtggcggttattgttttagtatcttttggttttgctttctgttgtggaagattagaccgtaacggcgaaagatcaaaatccggaagtgtagagactggtttcgtcggaggaggagaagggaagagacgaagcagttacggagaaggaggagagagtgatgcgacgtcggcgacagataggagcagacttgtgtttttcgagaggaggaaacagtttgagcttgatgatttgttgaaagcatctgcggagatgcttgggaaagggagtttagggacggtgtacaaggcggtgttagacgacggctcaacgactgtggcggtgaagcggcttaaagacgcgaatccatgtccgaggaaagagtttgagcagtatatggagattattggtaggcttaaacaccaaaacgttgttaagctaagagcttattactatgctaaagaagagaagctcttggtttatgagtatcttcctaatggaagcttgcactctcttcttcatgggaatcgaggaccaggacggattccattggattggacgacgaggattagtctaatgttaggagcagcgagaggattagcgaagattcacgacgagtatagcatctcaaagataccacacggcaatatcaaatcctctaatgttctattggacagaaacggcgtcgcgctaatagctgatttcggtttatcacttttgctaaacccggttcacgctatcgctcggttaggaggataccgtgcgccggaacagtcggagatcaaacgtctctctcagaaagctgacgtgtacagttttggtgtgttgcttctcgaggttttaacaggaaaagcaccctcgatattcccgtctccgtctagacctagatcagcggcgtcggtggctgtggaggaagaggaagaagcggtggttgatttaccgaagtgggttagatcggtggtgaaggaggaatggacggcagaggtttttgatccggagcttttgaggtataagaacatagaggaggagatggtggcaatgcttcatatcggtttagcttgcgttgtgcctcagccggagaagaggccgacgatggcggaagttgttaagatggttgaggagattagagttgagcaatctccggtcggtgaggattttgatgagtcacgaaactcaatgtctccgtcgttggctaccaccgacggctaa

SEQ ID NO: 940 - DNA, 1239 bp, Arabidopsis thaliana
atgcaaatgttaacagatcttagtgattttgggaatgtaggactggattatgcagaccccaagaagaaaaacaattacttgggaaagattcttttgacagcttctcttacagccttgtgcattttcatgctcaagcaatctccaacattcaatactcctagcgtgttttctcgacatgagccaggggttacacatgttttggtcactggtggtgctgggtatattggttcacatgcagctctaaggcttctaaaggaatcatatcgagtaaccattgtggacaatctatcacggggcaatctcgctgcagtcaggattttgcaagaactatttccggaacctggaaggcttcaatttatttatgctgatcttggagatgccaaagctgtcaacaagatattcacagagaatgcctttgacgctgtgatgcatttcgctgctgttgcatatgttggggaaagcacacaattccctcttaagtattatcacaatattacatcgaacactttggtagtattagagacaatggctgctcatggagtaaagactttgatatattcaagcacttgtgcaacgtatggggagcctgatattatgccaattacagaggaaactcctcaggtgccaatcaacccatatggtaaggccaagaagatggcagaagatatcattttggatttctcgaaaaactcagatatggcagttatgatcctaagatatttcaatgtgattgggtccgatccagagggcagattgggtgaagccccaagacctgagctgcgagagcatggacgcatctccggtgcttgttttgatgcagcacgtggcatcatgcctggcctacagatcaaaggaacagactacaaaaccgctgatggaacttgcgtacgggattacattgatgtcactgatttggttgatgctcatgttaaagctcttcaaaaggcaaaaccacgcaaagttggaatctacaatgttggcaccgggaaaggtagctcggtgaaagagtttgttgaggcgtgcaagaaagcaactggtgttgagatcaagatcgactatttgcctagacgtgcaggtgattacgctgaggtttacagtgatccaagcaagattaggaaggaacttaactggacagctaagcacactaatctcaaagagagtcttgagactgcatggagatggcagaagctgcaccgtaatggctatggcttaacaacctcatcggtctcggtttactga

SEQ ID NO: 941 - DNA, 795 bp, Arabidopsis thaliana
atgttggagcttcgtttagttcaaggttctctactgaagaaggttctagaagcggtcaaagatctggtgaacgatgcgaacttcgactgttcgaccacagggttctcgcttcaagctatggattcgagccatgtcgcgttggtgtctcttttgcttagatctgaaggtttcgagcactatagatgcgataggaacctctctatgggaatgaatcttggtaatatgtctaagatgctgaaatgtgctggaaatgatgatatcatcaccatcaaagctgatgatggtagcgacactgttactttcatgtttgagagtcccacacaagacaagattgcagattttgagatgaagctgatggatatcgacagtgagcatttaggaattcctgatgctgagtaccactcgattgtgagaatgccttctggtgaattttccaggatatgcaaagatctcagtagcattggtgacacagttgtgatctcggtaacaaaagaaggggtgaagttttcaacagcaggtgatatcgggacagcaaacattgtgctcaggcagaatactaccgtcgacaaacctgaagatgctattgtgatagagatgaacgagcctgtttcgctttcatttgcattgaggtacatgaactccttcacaaaggctactccattgtcggaaactgtgaccatcagtttgtcctctgagttaccggtcgtggtggagtacaaggtggctgagatgggttacattcgatactatctggcgcctaagattgaagaagaagaagacaccaaaccagaataa

SEQ ID NO: 942 - DNA, 501 bp, Arabidopsis thaliana
atgaactcacaagcttgtcttcttcttcagaaacagcttaaagatctttgtaagcatcctgtagatggattctctgctggtttagttgatgagaagaatatattcgaatggagcgtaactattattggacctcctgatactctctatgaaggaggatttttctatgccattatgtcattcccacaaaactatcctaatagcccacctacggtgcggtttacttcagatatttggcatcctaacgtttatcccgatggccgcgtttgtatatctattctacatcctcctggtgatgatccaagtggatatgagcttgcaagtgagcgttggacgcctgttcacacagttgagagtatcatgttgagtattatatcaatgctctctggtcccaacgacgaatctccagcaaacgttgaggctgctaaagaatggagagagaagagagatgagttcaagaagaaagtgagccgttgtgtcagaaagtctcaagaaatgttttga

SEQ ID NO: 943 - DNA, 525 bp, Arabidopsis thaliana
atggcgtcgcatcctaaagttttcttcgacatgaccatcggcggtgcaccagcggggaagatcgtgatggagctttacaccgacaagacaccaaagacggcggagaatttcagagctctatgcaccggagagaaaggcgtcggacgtagcggaaagccacttcacttcaaaggatcttcgtttcaccgcgtgatcccaaatttcatgtgccaaggaggagatttcaccaaaggtaacggaactggtggcgaatcgatctacggagccaaatttgaggatgagaatttcgagaggaagcacacaggacctgggattttgtcgatggctaacgctggtgctaacactaatggatctcagtttttcatctgtacggtgaagactgattggcttgatggtaagcatgtggtgtttggtcaggtggttgaaggcttggacgttgttaaggctattgagaagatcggatcttcttctggaaagccgacgaagcctgttgtgatcgctgattgtggtgagatctcttcttag

SEQ ID NO: 944 - DNA, 306 bp, Arabidopsis thaliana
atggcggatcaacaagcaggaacaatcgtcggaggagttcgcgatattgatgcaaatgctaatgatcttcaagtcgagagtctcgctcgtttcgctgtcgatgagcataacaagaacgagaacttgactctggagtacaagaggctccttggtgcgaaaacacaggttgtggcaggaacaatgcaccatctaactgtggaggtggctgatggtgagaccaataaggtctatgaggccaaggttttggagaaagcttgggagaatctcaagcagttggagagtttcaaccaccttcacgatgtttaa

SEQ ID NO: 945 - DNA, 774 bp, Arabidopsis thaliana
atgtcgggactcagattggatggcaaaatcgcaataataacaggcggagctagcgggattggagccgaagcggttaggctgttcacggaccacggagctaaggtggtcatcgttgactttcaagaagaacttggtcaaaacgttgccgtttctgtcgggaaagacaaagcaagtttttaccgttgcgatgttacaaacgaaaaggaggtagaaaacgccgttaagttcaccgtcgaaaagtacgggaagcttgacgttctctttagtaacgccggcgttatggaacagccgggaagctttctcgacttgaatctggaacagtttgaccgaaccatggcggtcaacgttcgtggtgcggctgcgtttatcaaacacgctgcacgagccatggtggagaaaggcacgcgtgggtcaatcgtatgtacgaccagcgtcgcgtcggagatcggtggtccaggacctcacgcgtacacggcgtctaagcacgctcttctcgggctggttaaatcggcttgtggcgggctagggaagtacgggattagagtcaacggcgttgcaccatacgcggtggcgacggcgataaatagccgtgacgaggaaacggtgaggatggtggaggaatatagcgcagccacggggattctcaaaggtgtggtgcttaaggctcgccatgtggcagaggcggctttgtttctggcttcggatgattcggcttacgttagcggtcagaatctggctgttgacgggggttatagcgtcgttaagcccatttga

SEQ ID NO: 946 - DNA, 333 bp, Arabidopsis thaliana
atgtcgacagtcggagaacttgcttgcagctacgctgttatgatccttgaagacgagggcattgccatcactattgcgactttggtcaaagcggctggtgttgagattgagtcttactggccaatgttattcgccaagatggctgagaagagaaatgtcacagaccttatcatgaatgttggtgctggtggtggtggaggcggtgccccagtgtctgctgccgcacctgctgctgctggaggagctgctgctgctgcccctgctaaggaggagaagaaggacgaacccgcagaagagagtgatggagatcttggtttcggcttgttcgattag

SEQ ID NO: 947 - DNA, 738 bp, Arabidopsis thaliana
atgatgaagctcaaagtgtatgcagatcgaatgtcacagccatcacgtgctgttatcatattctgcaaggttaatggaatccaattcgatgaggtcttgatttccttggcgaagcgtcaacaattatctcctgaattcaaagatattaacccattggggaaagttccagctattgttgatggcaggcttaagctctttgagagtcacgcaatcctgatatatctatcctcggcgtttccaagtgttgctgatcattggtatccaaatgatctatccaaaagagccaagattcactcagttttggattggcatcacaccaatttacgtcgtggtgcagctggatatgttctgaatagtgtactaggtccagctctcggtcttcctctgaatccgaaagcagctgctgaagctgagcagttactaacaaagtctctgtccactctagagactttttggcttaagggcaatgctaaattcttgctcggaagcaaccaaccatctatagctgatctcagccttgtatgcgaacttatgcagctgcaggttttggatgacaaagatcgtcttagattgctcagcactcataagaaagttgaacaatggattgagaatacgaaaaaagcaacaatgcctcactttgatgagacccatgagatccttttcaaagtcaaagaaggattccagaagcggcgagagatgggaaccttatctaaaccgggtcttcaatccaagatctaa

SEQ ID NO: 948 - DNA, 789 bp, Arabidopsis thaliana
atggacaaaagatggagtctcaaaggtatgactgctcttgtgaccggtggagccagtggaatcggttatgccatagtagaagagttggctggttttggagctagaatccatgtatgtgacatctctgaagctaagctcaatcaaagtttaagcgaatgggaaaagaaaggttttcaagtaagtggctcagtttgtgatgtagcctctcgtcccgagagagaagaactgatgcaaaccgtctcctcgcagttcgatggcaaactcaacattcttgtaagcaatgtgggcgtaatccgctcaaagccaacaacagaatataccgaagacgatttcgcttttcatatatcatcaaacgtggaagctgcttaccattttagccagctttcacatcctctcctaaaggcttcaggctatggaagcatcatctttgtttcctctattgcaggggttatatcttttgacgctggatccatttatggtctaacaaaaggagctttgattcagctagctaaaaatttggcatgtgaatgggcaaaagacggcataagagccaacgctgttgcgcctaatgtcatcaatactcctctgtctcaatcttatcttgaggacgtcagtttcaagaaggcattgttgagtaggactccacttggtcgtgttggagagccaaatgaagttgcatcactagtggccttcttgtgtctacctgcagcttcttatattactggtcagactatttgtgttgatggaggtctcaccgttaatggcttctcctatcagccagaggtttga

SEQ ID NO: 949 - DNA, 1125 bp, Arabidopsis thaliana
atggcttcttctaccactaaaatcctctgtgatgctggcgaatcagacctctgtagagacgattctgctgcatttctccttaagtttgtagccattgcctccattctactagctggagctgctggtgtagccatacctctcattggcaggaaccgccggtttcttcaaaccgagggaaatctctttgtagctgctaaagcctttgcagctggtgtcatactcgccaccggctttgtccatatgcttgcaggtggcacagaagctctgagtaatccgtgtttaccggattttccgtggtctaagtttccctttcccgggttctttgcaatggttgctgctttagctactctgcttgttgatttcatggggacacagtactatgagaggaagcaagagaggaatcaggctgctactgaagccgctgctggtagtgaagagattgctgttgttcctgtggttggggaaagagtgaccgataataaagtgtttggtgaagaagacggtggcgggattcacattgtcggcattcgtgcacatgctgctcaccataggcatagtcactctaatagtcatggtacatgtgatggacatgctcatggacattcacacggacatatgcacgggaattcagatgttgaaaatggagctaggcatgttgttgtttctcagatattggagctcgggattgtgtcgcactcaatcatcatcggtttatccctgggggtatcacagtctccatgcacgatcaggcctcttattgcagctctgtcatttcaccagttctttgaaggatttgcgctcggaggctgcatctctcaggcacagttcaggaacaaatcagcgaccataatggcttgcttctttgcgctaaccacaccattagggatcgggattggaactgcagtggcctcatctttcaactcgcatagccctggagctttggtcactgaggggatactggactcgctgtcagctggaatactggtgtacatggctctggtggacctcatcgcagctgattttctgagtaagaggatgagttgtaatttgaggcttcaagttgtgtcttatgtaatgttgttccttggagctggacttatgtctgctctcgccatttgggcttag

SEQ ID NO: 950 - DNA, 1476 bp, Arabidopsis thaliana
atgtgtaacaattttcttggaaagcaagttagtctgatggtcgagaatcgagatcttgatattggtactgcaccatctgataggtcagagatgagtccttcaagcttggcaacgttggcattggatgatacacatggtctaacaataaacaagttgcagattcctaatgatcagcaaaatcaatttcattcttatcaatggtctactacaactaatcatataccttgtactcgtggagctcctaccgttcaaccagcagctaatgatcaaacctttttctccataggtacccatctaggagctcctaccgttccaccaggagctaatgatcactggtttccttatagtgatcctgcgtgtaccaattctggagcttctgccgttccaccagcagataatggtcaatggttgccatatacagatcctacgtataactatactgttgtatattcaaccggtgcaccagcagccactgctcaatggccaacatctaatgatttccttcccatagatactcgagctccaacttttgcaaaagcacctactgcggcatttgaccattttgcaaatggttttggagaagatattaataatagcagcccaaatttccagccgatggatccttcaacagcaaaactactaacacaactcgaccacctgcaacaagacccatatggacaataccaactgccactgcaggttctaaaaaaaccctcactagaagagctgcgaaaacttccatatgaagtaaacaacgtgctgcgatatgatggaaacaacaacgggatgcaaggagtactaatgaaacccgaaaagccgccacaagacctatatggacaatgccaaccgcaaccacagatccaacgaaacttttcagtacaagagctgcaaaaacttcaatatgaagcaaacaacaacgggttgcaatatgatgcacacaacaacgggctgcaaggaggactaacgcaacccgagaagccactacaagacctatatggaaaatgccaacagaatctctcagtagaagatctgctacctcttgaatatgaagcaaacaacaacggactgcaaggaggactaacacaacccgagaagccattacaagacctatatggagaatgccaacaaaatctctcagtagaagatctgctaactcttgaatatgaagcaaacaacaacaaactgctaggagtaccaacgcaacccgagaagccactacaagacctatatggagaatgccaacagaatctctcagtagaagatctgctacctcttgaatatgaagcaaacaacaacggactacaaggaggactaacgcaacccgagaagccactacaagacctatatggagaatgccaacataatctctcaatagaagatctgctacctcttgaatatgaagcaaacaacaacggactgcaaggaggactaacacaacccgagaagccactacaagacctatatggagaatgctaa

SEQ ID NO: 951 - DNA, 1188 bp, Arabidopsis thaliana
atggcttcgctcaggctccccgctcaactagttacacgtggcaatctcatccaccacaactcttcatcctcctcctccgggcgtctgtcttggcgacgttctctcacaccggaaaatacaatcccgctcttcccatcttcctcatcctcatcccttaaccgggaacgatcaatagtagttccggttacatgcagtgctgcagcggttaatcttgctccggggacaccagtccgacccacgagcatcttggtggttggagccactggaactttgggaagacaaatcgtccggagagctttagatgaagggtatgatgttaggtgtttggtccgaccaagaccagctcccgccgatttcctccgtgattggggcgccaccgtagtcaatgcggatcttagtaaaccggagacaattccggcgactttggtcgggattcacactgtaattgattgtgccacgggacgtcctgaagaacctatcaagacggtagattgggaaggaaaagttgctctgatacaatgtgcaaaggcaatggggattcagaaatacgtcttttactcaatccacaattgcgataagcatcctgaggttcctctcatggagattaagtactgcactgagaagtttcttcaggaatctggtttaaaccacatcaccattcggttatgtggtttcatgcaaggtcttattggtcaatatgcagttccaattctggaggagaaatcggtttggggaacagatgcaccaacgcgtgttgcttacatggacacacaggatattgctaggctgacacttatagctttacgtaatgagaagatcaatggaaaacttctgactttcgctggccctcgtgcatggacaacacaagaagtgataacactatgtgagagacttgctgggcaagatgcaaatgtcacaaccgttccagtttctgtattgagagtcacgcgtcagttaactcggttctttcaatggacaaatgatgtcgcggatagactggccttctcagaggttctctcgagtgacacggtcttctctgctccgatgactgagactaatagtctactaggtgtggatcagaaggatatggtgactctagagaagtacttgcaggattacttcagcaacatattgaagaaactaaaggatctaaaggcacaatccaagcaatcagacatctacttctga

SEQ ID NO: 952 - DNA, 810 bp, Arabidopsis thaliana
atgaaggcggagttgaatttgccggcgggattccgatttcatccgacggacgaagagcttgtcaagttctatctttgccggagatgtgcgtcagaaccgattaacgttccggttatcgcagagattgacttgtacaaattcaatccatgggagcttccagaaatggcgttgtacggtgagaaagaatggtacttcttctcgcatagagaccggaaatacccaaacgggtcgagaccaaaccgggcagctggaaccggttattggaaagcgactggagctgataaaccgatcggaaaaccgaagacgttagggattaagaaagcactcgtcttctacgcaggaaaagctccgaaagggattaaaacgaattggattatgcacgagtatcgtctcgctaatgtcgatcgatctgcttctaccaacaagaagaacaacttaagacttgatgattgggttttgtgtcggatatacaataagaaaggaacaatggagaagtatttaccggcggcggctgagaaaccgacggaaaagatgagtacgtcggactcaagatgctcaagtcacgtgatttcaccggacgtcacgtgttctgataactgggaggttgagagtgagcccaaatggattaatctggaagacgcgttagaggcatttaatgatgacacgtccatgtttagttccattggtttgttgcaaaatgacgcctttgttcctcagtttcagtaccagtcctccgatttcgtcgattcgtttcaggacccgttcgagcagaaaccgttcttgaattggaattttgctcctcaagggtaa

SEQ ID NO: 953 - DNA, 1320 bp, Arabidopsis thaliana
atggctacaaacagattcatatgcgatgtatgtaacaaagggtttcaaagagaacaaaatctacagcttcaccgaagaggacacaatctcccatggaagctgaaacaaaaatcaaccaaagaagtgaagaggaaagtgtatctttgtccggagccaacgtgcgttcaccatgacccgtcacgtgctctcggagacctcaccggaatcaagaagcattattaccgtaaacatggcgaaaagaagtggaaatgtgagaaatgttctaagcgttacgctgttcaatcagattggaaagctcactctaagacttgtggtactaaagagtatcgatgtgactgtggtaccatcttctctagacgtgatagttacatcacgcatagggctttctgcgatgcattgatacaagagactgcaagaaaccctaccgtgagctttacgtcaatgacagctgctagtagtggtgtcggctccggcggaatctacgggagacttggcggtggcagtgctctctcacaccaccatttgagtgaccatccaaattttggatttaaccctctcgtgggttacaatctgaacattgcatcttctgataataggagagactttattccgcaatcatcaaaccctaacttcctaatccaaagcgcttcgagccaaggaatgttgaatacaacgccaaacaacaataaccagagtttcatgaaccagcatggtctgatacagtttgatccagtcgacaacatcaacctcaagagtagcggcaccaacaacagcttcttcaacctcggattctttcaagaaaacacgaagaactcagagacgagtcttccttctctatatagcaccgacgttcttgttcatcaccgtgaagaaaacttgaacgcgggttctaacgtgtcagccacggcactacttcagaaagctacacaaatgggttcagtcacaagcaacgacccatctgctttgttcagaggcttagcttcttcgtctaactcatcaagtgttatcgctaatcactttggtggaggacgaattatggagaatgataataatggaaaccttcaaggtctaatgaactcattagccgccgttaatggaggtggcggatccggtggcagtatcttcgacgttcaatttggagacaatggaaatatgagcggctcggacaagttaacgttagattttcttggagttggaggaatggtgagaaatgtaaatcgcggtggtggtggtggtggtcgcggcagtgctcgtggcggagtttctttggatggtgaggcgaagtttcctgagcaaaattatccatttggaagaggttga

SEQ ID NO: 954 - DNA, 915 bp, Arabidopsis thaliana
atgaactccaacgaccaggatccgattccgttcagacccgaagacaacaacttctccggttccaaaacctacgccatgagcggcaaaatcatgctaagtgcaatagtaatcctcttcttcgtcgtcattttaatggtcttcctccatctttacgctcgttggtatctcctccgtgctcgtagacgtcatctccgtcgtcgtagccgtaaccgtcgcgctacgatggttttcttcaccgctgatccttccaccgccgcaacttccgtcgtcgcttcacgtggacttgatccaaacgttattaaatctcttcctgttttcactttctccgacgagactcataaagatccgatcgaatgcgccgtttgtttatcggaattcgaagagagcgagacgggtcgggttttgcccaattgtcaacatacttttcatgttgattgtattgatatgtggtttcattctcattccacttgtcctctttgtcgatctctcgttgagtctctcgccgggattgaatcaacggcggcggcgagggagagggaagttgtgattgcggttgattctgatccggttttggtaattgaaccgagttctagctctggattgacggatgaaccacatggatctggatcttctcagatgctgagggaagattccgggagaaaaccggcggcgattgaggttccgaggaggacttttagcgagtttgaagatgagttgactcggagagactcgccggcgagtcagtcgtttaggtctccgatgagtcggatgttatctttcactcggatgttgagtagagatagaagaagcgcttcgtctcctatcgccggagctccgccgctatcgccgacgttaagctgccggatacagatgaccgagtcagatatcgaacggggaggagaagagagtaggtga

SEQ ID NO: 955 - DNA, 369 bp, Arabidopsis thaliana
atgaataaaggaagcatctttaagatggacgacgatttcgaaaagagaaaagctgaagctggaaggatcagggagaaataccctgatcgaattcctgtgattgtggaaaaggctgagaaaagtgaagtcccaaatatagacaagaagaagtaccttgtgccatcagacctaacagttggtcaatttgtgtatgtgattcggaagagaatcaaactaagtgcagagaaagctatcttcattttcgtagacaatgttcttcctccaacaggagagctaatgtcaagcgtttacgaggataagaaagacgaagatggcttcctttacatcacttacagtggcgagaacacattcggtgcttcttcaatctaa

SEQ ID NO: 956 - DNA, 804 bp, Arabidopsis thaliana
atggctttttccactagctcatgtctcttcttcttcctcttaacacttgttcttttctcaacccaaatcagtgcaagaaacagctactcctttggcaagttccaaagagaggaccccaaagagcaaaaccctaacaatcttgtccctatcgaaaccaacgagaagaaagagccagatgaccagaaccctgcctttatcccccagtccgaaaacgggtacggcttgtatggtcacgagacaaccgacaacaacaatgaagagttgaacaataacaagtacgaggacaacgttaactacgacgactctttctccacccccagcctaagcgaaacggctcaaacccaagaatcttacaagaactacaaagagagctatcctaagactaccgagatttacgacaacaacaaggacacgagctactacgaaaactcgaatgcttacgggacagataagagagataatgatattaatgatccgtacaagggttatagcaacaaggacacgagctactacgaaaaccccaatacttacgggacggagaagagagagaaggagccggcgtacaggggttataacaacaacgtagagagacaagggatgagcgatacgaggtatatggcgaatggtaagtactattacgaccttgacgatgacagaaaccacggccgtttctaccagaatcattactacaactacaagcccaccggttacaatgagaagaagtccaacttcaagaatccatacgattccaaccaacagtccgagatgttgggggaagagcaaggagatcagatcactccatga

SEQ ID NO: 957 - DNA, 3561 bp, Arabidopsis thaliana
atggagagcattggcagccattgttgcagctctcctttcaccttcatcactagaaactcatcatcatcacttcctagactcgttaacatcactcacagagttaatctcagccaccaatctcaccgactcagaaactccaattctcgtctcacttgcactgctacttcttcttccaccattgaggaacaacggaagaagaaagatgggtcaggaacgaaagtgaggttgaatgtgaggttagatcatcaagttaattttggtgaccatgtggctatgtttggatcagctaaagagattggttcatggaaaaagaaatcgcctttgaattggagtgagaatggatgggtttgtgagttggaacttgacggtggtcaggttttggagtataagtttgtcattgttaagaatgatggttcactttcatgggaatctggtgataatcgtgtccttaaggttccaaattctgggaatttttctgttgtttgtcattgggatgctactagagaaacccttgatttgcctcaggaggttggtaatgatgatgatgttggtgatggtgggcatgagagggataatcatgatgttggtgatgatagagtagtgggaagtgaaaatggtgcgcagcttcagaagagtacattgggtgggcaatggcaaggtaaagatgcgtcctttatgcgttctaatgatcatggtaacagagaagttggtagaaattgggatactagtggtcttgaaggcacagctcttaagatggttgagggtgatcgcaactctaagaactggtggagaaagcttgaaatggtacgcgaggttatagttgggagtgttgagagggaggaacgattgaaggcgctcatatactctgcaatttatttgaagtggataaacacaggtcagattccttgttttgaagatggagggcatcaccgtccaaacaggcatgccgagatttccagacttatattccgtgagttggagcacatttgcagtaagaaagatgctactccagaggaagtgcttgttgctcggaaaatccatccgtgtttaccttctttcaaagcagagtttactgcagctgtccctctaactcggattagggacatagcccatcgcaatgatattcctcatgatctcaagcaagaaatcaagcatacgatacaaaataagcttcaccggaatgctggtccagaagatctaattgcaacagaagcaatgcttcaacgaattaccgagaccccaggaaaatatagtggagactttgtggagcagtttaaaatattccataatgagcttaaagatttctttaatgctggaagtctcactgaacagcttgattctatgaaaatttctatggatgatagaggtctttctgcgctcaatttgttttttgaatgtaaaaagcgccttgacacatcaggagaatcaagcaatgttttggagttgattaaaaccatgcattctctagcttctttaagagaaacaattataaaggaacttaatagcggcttgcgaaatgatgctcctgatactgccattgcaatgcgccagaagatcggcctcgaggactacttttttgttctactaagcagattcctcaatgctcttgaaactatgggaggagctgatcaactggcaaaagatgtgggatcaagaaacgttgcctcatggaatgatccactagatgctttggtgttgggtgttcaccaagtaggtctatctggttggaagcaagaagaatgtttagccattggaaatgaactccttgcttggcgagaaagggacctacttgaaaaagaaggggaagaggatggaaaaacaatttgggccatgaggctgaaagcaactcttgatcgagcacgcagattaacagcagaatattctgatttgcttcttcaaatatttcctcctaatgtggagattttaggaaaagctctaggaattccagagaatagtgtcaagacctatacagaagcagagattcgtgctggaattattttccagatctcaaagctctgcactgttcttctaaaagctgtaagaaattcacttggttctgagggctgggatgtcgttgtacctggatcgacgtctgggacattagttcaggttgagagcattgttccgggatcattgccagcaacttctggtggtcctattattctcttggtcaataaagctgatggcgatgaagaggtaagtgctgctaatgggaacatagctggagtcatgcttctgcaggagctgcctcacttgtctcaccttggcgagaaaattgtctttgtgacatgtgatgatgatgacaaggttgctgatatacgacgacttgtgggaaaatttgtgaggttggaagcatctccaagtcatgtgaatctgatactttcaactgagggtaggagtcgcacttccaaatccagtgcgaccaaaaaaacggataagaacagcttatctaagaaaaaaacagataagaagagcttatctatcgatgatgaagaatcaaagcctggttcctcatcttccaatagcctcctttactcttccaaggatatccctagtggaggaatcatagcacttgctgatgcagatgtaccaacttctggttcaaaatctgctgcatgtggtcttcttgcatctttagcagaagcctctagtaaagtgcacagcgaacacggagttccggcatcatttaaggttccaactggagttgtcataccttttggatcgatggaattagctttaaagcaaaataattcggaagaaaagtttgcgtctttgctagaaaaactagaaaccgccagacctgagggtggtgagctagacgacatatgtgaccagatccatgaagtgatgaaaacgttgcaagtgcctaaagaaacaatcaacagcataagcaaagcgtttctcaaagatgctcgtctcattgttcgttcaagtgctaacgtcgaggacttagccggaatgtcagctgcaggactctatgaatcaatccctaacgtgagtccctcggatcctttggtgttttcagattcggtttgccaagtttgggcttctctctacacaagaagagctgttctaagccgtagagctgctggtgtctctcaaagagaagcttcaatggctgttctcgttcaagaaatgctttcgccggacttatcattcgttctgcacacagtgagtccagctgatccggacagtaaccttgtggaagccgagatcgctcctggtttaggtgagactttagcttcaggaacaagaggaacaccatggagactcgcttcgggtaagctcgacgggattgtacaaaccttagctttcgcaaacttcagcgaagagcttcttgtgtcaggaacaggtcctgctgatggaaaatacgttcggttgaccgtggactatagcaaaaaacgtttaactgttgactcggtgtttagacagcagctcggtcagagactcggttcggttggtttcttcttggaaagaaactttggctgtgctcaagacgttgaaggttgtttggttggtgaagatgtttacattgttcagtcaaggccacaacctctgtag

SEQ ID NO: 958 - DNA, 1188 bp, Arabidopsis thaliana
atgaattttctgaatgcctgtctctggccacggtcagatcagcaggctcgttctgcctcagattctggtggccgccaagagggtttgctctggttcagagactccggccagcacgtctttggtgacttctccatggccgtcgttcaagccaacagcttgctagaggaccagagccagctcgagtctggctctcttagctcccacgactctggtccctttggcacctttgttggcgtctacgacggccacggtgggcctgagacatctcgcttcatcaatgatcatatgttccaccacctcaagaggtttactgcagagcaacagtgtatgtcatcagaggtgataaaaaaagcgttccaagccactgaagaaggcttcttatccatagttacaaatcaatttcaaactagacctcagatagccacagtgggatcatgctgtcttgtaagtgtcatctgcgatgggaagctatacgtggccaacgcaggggactcacgggccgttctgggacaagtcatgagggtaacaggtgaagctcatgccactcagctctcagcagagcacaacgcatctatagagtcagtgagacgggaacttcaggccctgcatccggatcatccagatattgtggttctgaaacataacgtctggcgagtaaaaggcatcattcaggtttcaagatccattggtgatgtgtatttgaaaaggtcagagttcaacagggaaccactgtatgcaaaattccggctgaggtcaccgttcagcaagccattactgagtgcagagccggcgatcacggtgcatacactggagccgcacgatcagttcattatatgtgcatcagatggactgtgggaacatatgagcaaccaagaagcagtagacatagtccagaatcatccgcgaaacgggatagcaaagcggctggtgaaagtagcgctacaagaagcggcaaagaagagagagatgagatactcagacctgaaaaagatagacagaggagtgaggagacatttccacgatgacataacagtgattgttgtcttctttgatacaaacctagtgagcagaggaagtatgttgagaggaccagccgtgtcagtgagaggagcgggtgtgaatctacctcacaacaccctggcgccttgcaccacgcccactcaagctgctgctgctggcgcctcctga

SEQ ID NO: 959 - DNA, 321 bp, Arabidopsis thaliana
atggaatctgcagggatccagcaactgcttgctgctgaacgtgaagctcagcaaattgtcaatgccgctaggaccgcaaaaatgactagactgaagcaagccaaggaagaagctgaaacagaggttgctgagcacaaaaccagtacagagcaggggttccagaggaaactcgaagcgacaagtggagattcaggtgcaaacgtgaagaggcttgagcaagagactgatgccaaaatcgagcaattgaagaacgaagctacgagaatttccaaagatgttgtggatatgcttctgaaaaatgtgaccacagtgaacaactga

SEQ ID NO: 960 - DNA, 1620 bp, Arabidopsis thaliana
atgggttacaaagcagtttaccgatctctcacggaattgtttccacagattgatgcaaggcttttaaaagctgttgctattgagcacccaaaggatgttaatgaagctgcagctgtagttgtttcagagattgttcctttcttttaccctaatttggctgatagttctactcaacctgagaacaagacacccggaaatgtgcctaccgaagagatgggtggttcatattcaggatctgcctctatggcttttgaatatcatgaaacaagggccccagttactgaatcggtttctaagaggaatcagttgacacatgttatgccaaatgttgttgttgatattcagagaaaaggtaagatcgggttgagcggatcggatgagtctggagtggtttcctcagaaccccctgtctcctgtcaggcaggagccaaatcgactggcgatgattggcaaggtgttgagtttcacagtacaggtaatcaagcagaagctagcacaagcgcagattcagaagatgctgtgcataagctggtttatcctgcagacaatttggcaattacacagaactcacatcctcttcaaattagatttgggagtatcgatgttgtgaacgagacatcaagtggttcgttggctgttgaaaatagtgatgccgagttgagtggttcaaatcttgtggatgagatatcaaagggctctttggccgatgaaaatggtgatccagagctggatggtgctgttagctctgttggtaacagatcaacccagggatgcaacatggtccaccttgaacagatcattgaagatgccaaaagtaacaagagaaccttgttcactgtgatggagtcgattatgaatctgatgagagaagttgaacttcaagagaaggaggcagaaaaggcaaaggaagatgctagtataggaggctttgatactcttgacaaggtggaggagctgaagaagatgctggaacatgcgaaggaggcaaatgacatggctgctggagaagtttatggggagaggtcaattttgaccactgaagttaatgagcttgaaaatcgcttgatcagcttatcagaagaacgagacaactctctctctgttcttgatgagatgcgtgtagatcttgaaataagactagcgacagctttggggataaaaaatgctgctgagcaagaaaaacaggaaaaagaagggtctgcacgcaaggcatttgctgaacaagaagcgatcatggagagagttgtccaagaatccaagcttctacagcaggaggcagaggaaaactccaagctgcgagagttccttatggatcatggtcgaattgttgattccttacaaggagaaatctctgtgatctgtcaagacatccgacacttgaaagagaaattcgacaaccgagtgccattgagccaatcaatctcctcaagccagactagctgtaaactggcttcttccgcctcatccatgaagagcttattgacggagaagcctttggaagcatcttatgaaacacctgaagcctcgagcaataacaagagcccaaaagcttctgttaatgaacgtaaggagcttctggatgacggctgggacttctttgacaaagagacagagctctaa

SEQ ID NO: 961 - DNA, 1101 bp, Arabidopsis thaliana
atggatacttgtgctctagtaatccatcagtctctgtctcgcatcaaactttctcctcccaaatcttcttcttcttcttcttctgctttctcccctgaatccttaccgatcagacggatcgagctgtgtttccgaggagctatatgtgccgccgtacaaagaaactacgaagaaacgacctcctccgtggaagaggcagaggaagatgatgagtcatcatcatcgtacggagaagtgaacaagatcattggaagccgaacggcgggggaaggagccatggagtaccttatcgagtggaaggacggccattctccgtcgtgggttccatcgagctacatcgcagcagacgtagtgtcggagtacgagacaccctggtggacggcagctagaaaagccgacgagcaggccctgtcacagctcctggaggaccgagacgtcgatgccgtggacgaaaacggccggacggctctgcttttcgtggcaggtctggggtcggacaagtgcgtaaggcttctggcggaggctggagccgatctcgaccaccgagacatgaggggaggcttgacggcgctgcacatggcggctggttacgtgaggccggaggtggtggaggcgctggtggagctgggagctgatattgaagtggaagacgagagagggttaacggcgttggaactagcgagggagattctgaagacgacgccgaaggggaatccgatgcagttcgggaggagaattgggttagagaaagtgatcaatgtcctggaaggacaagtgttcgagtacgccgaggtggatgagatcgtagagaaacgagggaaaggcaaagacgttgaatatctggtcagatggaaggacggtggagattgcgagtgggtgaaaggtgtacacgtggcggaagatgtggctaaggactacgaggatgggctggagtacgctgtagcggagagtgtgatcgggaagagggtgggagacgatgggaagaccatcgagtatcttgtcaaatggactgatatgtctgatgccacttgggagcctcaggacaatgtcgactctactcttgttctactctaccaacaacaacaaccaatgaatgaatga

SEQ ID NO: 962 - DNA, 1503 bp, Arabidopsis thaliana
atggtgcagtaccagagattaatcatccaccatggaagaaaagaagataagtttagagtttcttcagcagaggaaagtggtggaggtggttgttgctactccaagagagctaaacaaaagtttcgttgtcttctctttctctctatcctctcttgctgtttcgtcttgtctccttattacctcttcggcttctctactctctccctcctagattcgtttcgcagagaaatcgaaggtcttagctcttatgagccagttattacccctctgtgctcagaaatctccaatggaaccatttgttgtgacagaaccggtttgagatctgatatttgtgtaatgaaaggtgatgttcgaacaaactctgcttcttcctcaatcttcctcttcacctcctccaccaataacaacacaaaaccggaaaagatcaaaccttacactagaaaatgggagactagtgtgatggacaccgttcaagaactcaacctcatcaccaaagattccaacaaatcttcagatcgtgtatgcgatgtgtaccatgatgttcctgctgtgttcttctccactggtggatacaccggtaacgtataccacgagtttaacgacgggattatccctttgtttataacttcacagcattacaacaaaaaagttgtgtttgtgatcgtcgagtatcatgactggtgggagatgaagtatggagatgtcgtttcgcagctctcggattatcctctggttgatttcaatggagatacgagaacacattgtttcaaagaagcaaccgttggattacgtattcacgacgagttaactgtgaattcttctttggtcattgggaatcaaaccattgttgacttcagaaacgttttggataggggttactcgcatcgtatccaaagcttgactcaggaggaaacagaggcgaacgtgaccgcactcgatttcaagaagaagccaaaactggtgattctttcaagaaacgggtcatcaagggcgatattaaacgagaatcttctcgtggagctagcagagaaaacagggttcaatgtggaggttctaagaccacaaaagacaacggaaatggccaagatttatcgttcgttgaacacgagcgatgtaatgatcggtgtacatggagcagcaatgactcatttccttttcttgaaaccgaaaaccgttttcattcagatcatcccattagggacggactgggcggcagagacatattatggagaaccggcgaagaagctaggattgaagtacgttggttacaagattgcgccgaaagagagctctttgtatgaagaatatgggaaagatgaccctgtaatccgagatccggatagtctaaacgacaaaggatgggaatatacgaagaaaatctatctacaaggacagaacgtgaagcttgacttgagaagattcagagaaacgttaactcgttcgtatgatttctccattagaaggagatttagagaagattacttgttacatagagaagattaa

SEQ ID NO: 963 - DNA, 684 bp, Arabidopsis thaliana
atggctgaagaacaacaaaattcgagttatagcattggtggaaacattcttcctactcctgaagaagctgctacattccagccccaagttgttgcagaaggcggatgggacaaatgttgggaagacggggtaacaccatgggaccaaggaagagccacacctctcattcttcatcttctcgactcttcagctctccctcttggccgtacccttgtccccggctgtggcggaggacacgacgtcgttgcgatggcaagccctgaacgtttcgtagttggattggatatttctgacaaggctctcaacaaagctaatgagacttacggctcctcaccgaaggcagagtacttttcgttcgtgaaggaagatgttttcacttggcgtcctaacgaattatttgacctcatcttcgattatgtgtttttctgcgcaattgaaccggagatgagacctgcatggggtaaatccatgcatgaactcctcaaacctgacggagaacttataactcttatgtatccgatgaccgaccacgagggtggagctccctacaaagtagctttgtcttcctacgaagatgtgttggttccggtaggatttaaagcggtgtccgttgaggagaacccagactccattcccactcgtaagggcaaagagaagcttgcgaggtggaagaagattaactga

SEQ ID NO: 964 - DNA, 1254 bp, Arabidopsis thaliana
atgcttttgataccttccttcaccgcaaattctaacgaaccaccaccgtcgaagctttctctttccgatctttcaatggcgattctcaaatctcacttcttcttactcttccctcttcttcttctccactttcacactgtctcctttgctcagacgctctttgtgttcggagatggtctttacgacgccggaaacaaacagtttctctctcagaaccgagttgacgcaagctttcctccttatggagtcactgtaggacaagccaccggacggtggtccgatggttctatcgttcctgattatcttgctaaattcatgggaattcctaaaatctctccgattctcctaaccacggcggatttttctcacggagctaatttcgccatcgccgacgctaccgttcttggctctcctccggagacgatgactttgtcacaacaagtgaagaaattctcggaaaacaagaataagtggacaaatcaaacacgttctgaagctatctacttgatctacattggttctgatgattacttgagctatgctaagagtaatccaagtccatcagatactcagaaacaagcttttgttgatcaagtcatcactaccataaaagcagaaataaaggtggtttacgggtctggcggaaggaaattcgcattccagaacttggcaccgttaggttgcttaccggccgtgaaacaagcaagcggaaatgttcaagaatgtgtgaaattgccttcggaaatggctgctttgcataacaagaaacttttgcagctcttggttgaactatcaagagaactaaatggtttccagtactcgttttacgacttctttagctcgatccaaaacagagttatcaagtctaagacttatacattcgagacaggaaacgctgcttgttgtggaactggctctatcaacgggagtaattgctcagctaaaaatgtatgcgccaagcctgaagagtatatcttctttgatggtaagcatttgacgcaagaagccaaccttcaggtcgggcatttgatgtggggagcagatccggaagtgattggaccgaacaatatcagggagcttatggtccttcctctagacattacagtcatcttagctggtatacaagaagctatggctgccatgagaccgagacagagcaacattgagagtctctatgatatcaagaagatggagtcagagatggataatcattggctttatcaagttgacaaagctatctcctttatgatataa

SEQ ID NO: 965 - DNA, 1374 bp, Arabidopsis thaliana
atgctcttgtccttgacacttttcttccacttcttcttcatcatctttaatcgttgggaaaagtttgatgatacggagtggacaattcttggtgtagaaggagaatctgagagagagagagtcatggaagctctgaaaaccgcaacttttagccctatgtcggtgttatccgagaaaagatcagaaccacgaaagcctttctcgctccctaacctctttccaccaaaatcacagagaccaatctcccaagaaagcttcttgaagagattcaatggtggattggctcttctaacttctgttctaagcagtgcaacagctcctgctaaatccctgacgtacgaggaagctctgcaacaatctatgaccacttcttcatcttttgattcggatggtctgattgaagggatatccaattttgtcacagacaatcctttggttattgccggtggagttgctgcattggctgttccatttgttctgtctcaggttctgaacaagaagcccaaatcatggggagttgagtctgctaagaatgcttataccaagttgggtactgatgataatgctcagttgcttgacataagagctactgctgatttcagacaagtgggcagtcctaatattaagggtttgggtaaaaaagcggtttctactgtttataacggtgaagacaagcctggtttcctgaagaagctttctttgaagtttaaagatcctgagaacaccacattatacattctggacaagtttgatggaaactctgagcttgttgctgaattggtggctcttaatggattcaaatctgcttatgcgattaaagatggtgcagagggacctagaggctggttgaatagcagcttgccttggatagagccaaagaagactctcagccttgatttaagcagtttgacggatagcatcagcggtgtatttggtgaccgaaagcaaactctaaaacaggtggatgagttcttgaacacaaaggttgcccctaaagaacttgttgatgagttaaaggaaataggaaaggctcttcttcctcaatcaacaagcaacaaagctctcccagcaccagcaacagtaacagcagaagcagaatcagctacagctacaaccaccacagtcgataaaccagtacctgagccagaaacagttgcagctacaacaaccactgtagataaaccagtacctgagccagagccagtgccagagccagtgccagtgccagcgattgaagctgcagtcgctgcacaagtaatcacagaaccaaccgaaacagaagccaaaccaaaacctcattcaagacctctctctccatatgcatcgtaccctgacttgaagcctccatcttctccgatgccatcgcagccctga

SEQ ID NO: 966 - DNA, 1656 bp, Arabidopsis thaliana
atgtctcagaacccatcactcttcttcctcttatgtctagggttaggtttttgcgttgacctgggtcaatccctgaaagttcctttcagcgttaacgatgttcttccgatgctacctcgtcaagtctcatggcctgttttgaacagtttccacaacgctgtggatttgttgccggtgcttgctttaatggtaatgaagctcgtcttgatatcaccggtagtgatcgtgacgtccctggacttggtggtggtgttcttcatctcaaagttgtgttatactttcaacgctcatatgctcagatttcgtaaagtttttccttttatggtaacaaattcaaaattaggagactgttgtgtagttgctgctaattcgaaattgtatgttattctggatgaaattgagttgtttgataacatttgggaactaattttgcagacatccaaggcacatagcttgacatgtatggatctttatgtgtttgcaacgccatacaggatcacttgggactactatttctctgctagagatcatactttgaactttgattcttgggaagagaaagctgaattggaatatgtaggaatgcttgggacgttgctatctttgattgatgtgttacctcttttctccaatactgcttggggacagaatgcgaatttggcgttcttgacgaaacatatgggtgctacctttgagaaacggtctcaaccttggcggtcaatgattaacccagaagatgtgcattctggtgatttcttggcggtgtcgaagattcgaggtagatggggtggttttgagacgttagagaaatgggtgactggggcttttgctggtcatactgctgtttgtttgaaggatgatttggggaatctttgggttggtgaatcaggacatgagaacgaaaagggtgaagaaatcattgttgtgatcccttgggatgaatggtgggagctgactttgaaggataattcaaatcctcaagtagctttgcttcctctacatcctgatatccgggcaaagttcaacaatactgctgcgtgggaatatgcacggagtatgttgggcaaaccgtatggatatcacaacatgatattcagctggatcgacactctaggcgataactacccccctccccttgatgctcacttggttatttctgtcatgtctatgtggactcgtgtacaacctgcatatgctgctaatatgtggaacgaggcacttaataaacgactcggtactgaggatctggatttgtatgggatacttgaagaaacagcgaggcgtggaatgtcatttgatgagttactcaccatccctgaacaggatgagtgggtttatagcgacggtaaatcgacaacatgtgttgctttcatccttgcaatgtacaaagctgctggtatattcgaccctctcgctgatcacattcaagtcactgaattcactatccgagatgcgtacactctgaagttatttgagtctaaccagactcggttaccgagttggtgcaacaccgaggaagggaagcttgacttctgtcaaattctaggtgaatacagaatggagttacctggttataacaccatttacccatatccaaacatgaaccagaattgtccttctttacctcctaattatgagagaccttctaagtgttag

SEQ ID NO: 967 - DNA, 972 bp, Arabidopsis thaliana
atgtctgcttcagcgactcaaacggccggagaagtttcaatggggatcaagcctccttcacaccctacttacgatttgaaagctgttatcaaactagccctagctgaagatgctggtcatacaggagatgtaacgtgtatggctacgataccgtttgatatggaagtggaagcttatttcttggccaaggaagatggtattgttgctggagttgctcttgctgacatgatttttgaacatgttgatccctccttgaaggttgaatggatgcgaaaggatggagattatgttcataaaggattgaagtttgggaaagtatcagggaatgcacataagattgttgttgctgaaagagttttgctcaactttatgcagaggatgagtggaattgcaacccttaccaagttaatggcagatgctgcatcccctgcatgtatactggagacaagaaaaactgctcctggtttgcggttggtagataaatgggcggtactgattggtggagggaggaatcataggatggggttatttgatatggtgatgataaaagataaccatatctcagctgcaggcggtatagtaaacgccgtcaaatccgtagacgaatatctaaagcaaaagaatctcgaaatggatgtagaggtggagacgaggacgcttgaggaagtgaaggaagtgttagagtatgctagtggatccgagactcggttgacgagaataatgctggataatatggttgtgcccttagagaatggagatgtcgatgtcacaatgcttaaagatgcggtagagctaatcaacgggagattcgagacagaggcaatgttacacttgagacagtacacaagatcggacagagtggagttacattcattagcagctcttacgcattcggtgaaagcactagacatatctctgaagatcgatacagagttggctctcgaggtgggaagaaggaccaaacgagcatag

SEQ ID NO: 968 - DNA, 534 bp, Arabidopsis thaliana
atgggaggtgacaatgataatgacaaagacaaagggtttcatgggtatcctcccgctggatacccaccccctggggcttatccacccgctggatacccacaacaaggttaccctccaccacccggtgcttacccgcctgcaggttatcctccgggtgcctacccacctgctcctggtggttatcctcccgcccctggttatggtggttatcctccagctcctggttatggaggttatcctcctgcacctggtcatggtggttaccctcctgctggctatcctgctcatcactcaggacacgcaggaggaattgggggtatgattgcaggtgctgcagctgcctatggagctcaccacgtagctcatagctctcacggtccttacggacatgctgcatatggtcacggttttggccatggtcatggctatggctatggtcatggtcatggtaagttcaagcatgggaagcacgggaagttcaagcatgggaagcatggaatgtttggaggaggcaagttcaagaagtggaagtga

SEQ ID NO: 969 - DNA, 480 bp, Arabidopsis thaliana
atggaggtttcgatgagaaagccttatttcatagaagaagaagacgatggttttgtttctttatctgagatggaagctggagtttcaagtccttcttgttacaactatcctcagagttattattataaccatcatcatcatcagtactctgtttcatctcccagatctggaaaatttcatgattttagattcgacaatagctattacggttatggacagcctcatttcttggactcttgcttcctctgcaagaaacgtcttggtgataacagagacatcttcatgtacagaggagacacaccgttctgtagtgaagagtgtagagaagaacagatagaaagagacgaagcaaaagagaagaaacagagtctgtctacatctgtgaaagctatgagaagaaatgaaaagcgaagctcttcttcttctccaactagatctcgtaactatgctttccgcactggaactgttgctgctgcctaa

SEQ ID NO: 970 - DNA, 1467 bp, Arabidopsis thaliana
atgtcgggtgagaaacaagcggaggagtcaatagtagtctccggggaggatgaggtggccggtagaaaagtggaagattcagcggcggaggaggatattgacggcaacgggggcaatggatttagtatgaagagcttcctctggcatggcgggtccgcttgggacgcctggtttagctgtgcatcaaatcaagtggcacaagtgctgttgacgctgccgtattcgttctcgcagttgggaatgttatcaggaatattgcttcaaatattctatgggttaatgggatcttggactgcttatctcatcagtgttctttacgtcgagtatcgtgcccgtatggagaaacaagaagccaaatccttcaaaaaccacgttattcaatggtttgaagtgcttgatgggctgctgggtccgtactggaaagcagcggggctcgcatttaattgcaccttcttgttattcggatcagtcatccagctcattgcttgtgctagcaatatatattacataaacgataggttagacaagaggacatggacttatatatttggggcttgctgtgccacgaccgttttcataccatctttccacaattaccgtatttggtctttcctcggccttggcatgaccacctacaccgcttggtacctcaccatcgcctcttttctccatggtcaggcggagggtgtgacacattccggtccaaccaagcttgtgttgtactttaccggagccaccaacatcctctataccttcggtggacacgctgtgaccgtggaaataatgcatgcgatgtggaaaccaaggaagtttaagagcatctacttgatggcaactctgtacgtcttcacattaacgcttccgtcagcctccgccgtctactgggctttcggcgaccaacttctcaaccactcaaacgctttctctctcctccctaaaacgcgtttccgtgacaccgccgttatcctcatgctcatccatcagtttataacgttcgggtttgcgtgtacaccattgtacttcgtatgggaaaaagcgatcggaatgcaccacacaaagagcttatgtctaagagcgctggtgaggctaccggtggtggttccgatatggtttttggcaatcatctttccctttttcgggccaataaactcggcagttggagccttacttgttaccttcaccgtctatatcatccctgccttagcccacatgctcacgtaccgcaccgcctctgcccgccggaacgcggcggagaaaccaccgttttttatccctagctgggctggagtttacgtgataaacgctttcatagtggtttgggtcctagttctcgggttcgggtttggcggatgggccagtatgaccaacttcatcaggcaaattgatacttttggcctctttgccaaatgctaccaatgcaaaccacctccagctccgatcgccgccggagctcaccaccgccgttag

SEQ ID NO: 971 - DNA, 1254 bp, Arabidopsis thaliana
atggcagctcgtaagagagcttcatcgatctcaattcccaacaaaccggacccgtcggaacccaactcagcgccatcggagcagaagatgacccgaaagacggtttctgcttccggtgaggaatttcgtctcgcgccgccgaaattaggagtgatcttcgtgatctctactcttctctgttcgctctatctataccttctctgttttcactacaaggttgataatgagctcaagcgatcgattctaattaacgcggggcttagcttggttgggtttttcgtcactctcaaaatgattcctgttactgccagatacgttctgagacgtaacatgtttggttttgatatcaacaaaagaggcacgcctcaaggagatattaaagtgccagagtcattgggtattgttgttggtattgtctttttgatcgtggcgataatatttcagtattttaacttcactgaagattctaatgtaagttggcttgtggagtataatgcagcactagcatctatttgcttcatgattttgcttggatttgtagatgatgtccttgatgtgccttggagagtaaagcttgtcctgccatcttttgctacccttccacttttgatggcttatgctggtcatacaactattgttataccaaaacctcttgttgcttatattggcttggaagtgcttaatctaggaaggatatataagttatatatggggctacttgctgtcttttgtacaaactctattaacatccacgctggtctgaatggccttgaaatcggtcaaacagttgttattgccgctgctgtaacatctgttgatcccgagtatcaccaagctcatgccttctcgatatttcttactcaaccgctgatggccacatccttggcaatgcttgcttacaattggtatccttcttcagtttttgttggagacacttacacagtcttcgccggaatgactatggcagttgttggtattctgggtcacttcagtgaaaccctcctcatcttctttcttcctcaagttctgaactttctattatcgcttcctcagcttgctgggattgtgaaatgtccgcgccatcgtctcccaaggtatgatcctgctaccggattactgaccggcacaaaagatgggacactcgtcaatgtttacttgaggttgtttggtcctaaatcagaaaagtctctttgcatccatcttctcgttttccaggtaggtctcagatatatgtatatcgccattcgtatataa

SEQ ID NO: 972 - DNA, 798 bp, Arabidopsis thaliana
atggcaagagtcttcgaatcggattcgggttctggttgttccaatgtactgagtcttgacttaatcagagaatcgttgattaggcaagaagacaccatcgtcttcagcttgatcgagagagctaagtttccactcaattctcctgctttcgaggaatctcgttgtctagattctggaagtttctcttctctcactgagtttttcgtcagagagacagaaatcatccaagctaaggtaggaagatatgaatacccggaagagaatcctttcttccttgagaacattcctcactcggtttttcctacgcacaaatatccatcggctttgcaccctaaggctctatctgttaacattaacaaacaaatctgggatatttactttaaagaattgcttcctttgtttgtcaaacctggcgatgatggcaactatccatcaactgctgctagtgatctcgcctgtttacaagctctttcgagaaggattcactacggtaaatttgtagctgaggtcaaattcagagatgctccacaagattacgagcctgcgattcgcgctcaggatagagaggctttgatgaagctgttgacgtttgagaaagtagaagaaatggttaagaagagagtgcagaagaaagcagaaacgtttggacaagaagtaaaattcaactctggctatggcgatgagagtaagaagaagtataaagtggatccattgcttgcctctcgcatctacggggaatggcttatccctctcactaagctcgttgaggttgagtatcttctacgtcgtctcgattga

SEQ ID NO: 973 - DNA, 567 bp, Arabidopsis thaliana
atggcggctaataacagatccgatcatgggtcagacgaaaacacaagactttacaatccttaccaaaactacgaagtcccaatcaacaaatctcagtacctttacaagcttcctacctcccctgagtttctcttcacggaggaggctttaaggcaacgtagatcttggggtgagaatctcactttctacaccggaacagcttacctcggtggctccgttgccggagcttctgttggagtcatcactggagtcaaaagcttcgaatctggcgacactactaagctcaaaatcaacaggatcttgaactcttctggtcaaactggtcgaacttggggtaatcggattggtatcattggattggtttacgcagggatcgagagtggtattgtggctgccacggatagagatgatgtttggaccagtgtggtggctggtcttggaaccggagctgtttgtagagcggcgagaggagtgagatctgcagctgtagctggtgctcttggtggacttgcggctggagctgttgtagctgggaagcaaattgtgaagcggtatgtgcccatttga

SEQ ID NO: 974 - DNA, 2154 bp, Arabidopsis thaliana
atggcttcttctgcatttgcttttccttcttacataataaccaaaggaggactttcaactgattcttgtaaatcaacttctttgtcttcttctagatctttggttacagatcttccatcaccatgtctgaaacccaacaacaattcccattcaaacagaagagcaaaagtgtgtgcttcacttgcagagaagggtgaatattattcaaacagaccaccaactccattacttgacactattaactacccaatccacatgaaaaatctttctgtcaaggaactgaaacaactttctgatgagctgagatcagacgtgatctttaatgtgtcgaaaaccggtggacatttggggtcaagtcttggtgttgtggagcttactgtggctcttcattacattttcaatactccacaagacaagattctttgggatgttggtcatcagtcttatcctcataagattcttactgggagaagaggaaagatgcctacaatgaggcaaaccaatggtctctctggtttcaccaaacgaggagagagtgaacatgattgctttggtactggacacagctcaaccacaatatctgctggtttaggaatggcggtaggaagggatttgaaggggaagaacaacaatgtggttgctgtgattggtgatggtgcgatgacggcaggacaggcttatgaagccatgaacaacgccggatatctagactctgatatgattgtgattcttaatgacaacaagcaagtctcattacctacagctactttggatggaccaagtccacctgttggtgcattgagcagtgctcttagtcggttacagtctaacccggctctcagagagttgagagaagtcgcaaagggtatgacaaagcaaataggcggaccaatgcatcagttggcggctaaggtagatgagtatgctcgaggaatgataagcgggactggatcgtcactgtttgaagaactcggtctttactatattggtccagttgatgggcacaacatagatgatttggtagccattcttaaagaagttaagagtaccagaaccacaggacctgtacttattcatgtggtgacggagaaaggtcgtggttatccttacgcggagagagctgatgacaaataccatggtgttgtgaaatttgatccagcaacgggtagacagttcaaaactactaataagactcaatcttacacaacttactttgcggaggcattagtcgcagaagcagaggtagacaaagatgtggttgcgattcatgcagccatgggaggtggaaccgggttaaatctctttcaacgtcgcttcccaacaagatgtttcgatgtaggaatagcggaacaacacgcagttacttttgctgcgggtttagcctgtgaaggccttaaacccttctgtgcaatctattcgtctttcatgcagcgtgcttatgaccaggttgtccatgatgttgatttgcaaaaattaccggtgagatttgcaatggatagagctggactcgttggagctgatggtccgacacattgtggagctttcgatgtgacatttatggcttgtcttcctaacatgatagtgatggctccatcagatgaagcagatctctttaacatggttgcaactgctgttgcgattgatgatcgtccttcttgtttccgttaccctagaggtaacggtattggagttgcattacctcccggaaacaaaggtgttccaattgagattgggaaaggtagaattttaaaggaaggagagagagttgcgttgttgggttatggctcagcagttcagagctgtttaggagcggctgtaatgctcgaagaacgcggattaaacgtaactgtagcggatgcacggttttgcaagccattggaccgtgctctcattcgcagcttagctaagtcgcacgaggttctgatcacggttgaagaaggttccattggaggttttggctcgcacgttgttcagtttcttgctctcgatggtcttcttgatggcaaactcaagtggagaccaatggtactgcctgatcgatacattgatcacggtgcaccagctgatcaactagctgaagctggactcatgccatctcacatcgcagcaaccgcacttaacttaatcggtgcaccaagggaagctctgttttga

SEQ ID NO: 975 - DNA, 702 bp, Arabidopsis thaliana
atgccgagatcatctttgcggctactagctaagcctctcttggagagcaggcgagggttttgcacgagctctgataagatcgtagcttcggtgcttttcgagagattgcgcgttgtgatacccaaaccggatcctgccgtttacgctttccaggagttcaaattcaattggcaacagcagtttcgtcgtagatatcccgatgagttcttagacattgctaagaacagagccaagggtgaataccaaatggactatgtacctgctcctagaattacagaggctgacaagaataacgataggaagtcattatatagagccctagacaaaaagttgtatcttctcatattcggcaagccatttggagctactagtgacaaacctgtttggcacttcccagagaaagtctatgattctgagccaactcttcgcaagtgcgcggaatctgctttgaagtcagtcgtaggagacctcactcacacatactttgttggaaatgctccaatggctcacatggccatacaacctacagaagaaatgcctgatttgccatcttacaagaggttcttcttcaaatgcagtgtagtagcagcatcgaaatacgacataagcaactgcgaggattttgtgtgggtaaccaaagacgagctcttggaattcttccctgagcaagctgaattcttcaacaagatgatcattagctga

SEQ ID NO: 976 - DNA, 1425 bp, Arabidopsis thaliana
atggtgtttttccgcagcgtatcggcctttactaggctgaggtctcgcgtccagggccaacaatcttcactcagcaattctgtcagatggattcagatgcagagctctaccgacctggacctgaagtcgcagctgcaagagttaattccggaacagcaggaccgtctgaagaaactgaagtcagaacatgggaaggtccaactgggaaacatcactgttgatatggttattggtggaatgagagggatgactggattgctttgggaaacctcattgcttgacccggaagagggtattcgctttaggggattgtcgattcctgagtgccagaaagtattacctactgcccagtctggagctgaaccattaccggagggtcttttgtggcttctcttaactggaaaggtacctagcaaagagcaagttgaagcactgtcgaaagacttggcgaaccgtgctgctgtgccagattatgtgtacaatgccatcgatgctctgccttccacagctcatccaatgactcaatttgctagcggtgttatggccctccaggtgcaaagtgagtttcaaaaggcatatgagaatggaattcataagtcaaagttctgggagccaacatatgaggattgcctcaacctgattgctcgtgttcctgttgtagctgcatatgtttatcgaaggatgtataagaatggtgattccattccctcagataaatctttggattatggtgcaaatttttcccacatgttgggatttgatgatgaaaaggtgaaagagctcatgaggctttacatcaccatccacagtgatcatgaaggtggaaatgttagtgctcacactggtcacctggttggtagtgcactttcagacccatatctgtcatttgcagctgcattaaatggtttagctgggccactccatggtttggctaatcaggaagttttgctttggatcaaatcagtcgtagaggaatgtggagaagatatatcaaaagaacagttgaaagaatatgtttggaaaacattaaacagtggcaaggttattccgggatatggtcacggtgttctgcgcaatactgatccaagatatgtatgccaaagagaatttgccttgaagcatctacctgacgaccctcttttccagctggtgtcaaagctttatgaagttgtgcctcctgttctcactgagcttggaaaggtgaagaacccgtggccaaatgttgatgctcacagtggggtcttgctgaaccactatggtctaaccgaagcaaggtactacaccgtgctctttggtgtttcaaggagtcttggcatctgctctcagcttatatgggaccgagctcttggacttgcacttgagaggccaaagagtgttaccatggactggcttgaagcccattgtaagaaagcttcatctgcttaa

SEQ ID NO: 977 - DNA, 3501 bp, Arabidopsis thaliana
atgtctcagaaggttactccattcatgcagtcacttaaatctttgccagcagactatagatttgatggttcaccagtctctgaccgccttgaaaattcttctggtgcaagtgttcgcttgaccaattcgaatgttccaagaaaaggtggcttaaggaatggtgttagtcgaactgatactgctgctggggatagtgaggattcaccatatagcgggcacggtgtttttgttgaagagcagtctttaacggatgatgtagattctggagctgctacaatgcccttgcctcagagtgatgaacgcaggtggagtgacactagtgcatatgctcgaaagaagatactgcaatcttggattcaacttccaaatggtaactgggagcttgggaagatattgtcaacttcaggggaggagtctgttatatctttgcccgaaggaaaagttataaaagtcatatcagagactctagtacctgcaaatcctgatattcttgatggagtggacgatcttatgcagcttagttacttaaatgagccatcagtgttgtacaacctcaactataggtacaaccaagacatgatatatacaaaagcagggccagttttggtggctgtgaatccttttaaggaggttcctttatacggaaatcgatacattgaagcatacaggaagaaatcaaatgagagtcctcatgtgtatgcaattgcagatacagcaattcgcgaaatgatacgcgatgaagttaaccaatctatcattatcagcggcgagagtggagcagggaaaactgagactgctaaaatagctatgcaatacttggctgctcttggaggcggaagcgggatcgaatatgagatacttaagactaatcccattttggaagcatttggaaatgcaaaaacattgagaaatgataattctagtcgttttgggaagctaatagagattcattttagtgaaagtggaaagatatcgggtgctcaaattcaaacctttttactagaaaagtctagagtggtccaatgtgctgaaggggaaaggtcatatcatattttttatcaactttgtgctggggcttcacctgcacttagagagaagctaaatctgacaagcgcccatgagtataaatatttgggacagagtaattgttattcaattaacggagttgacgatgctgaacgttttcacactgttaaggaagctctggacattgtgcatgttagtaaagaagatcaagaaagtgtatttgcaatgcttgctgcagttttatggctgggaaacgtttccttcaccgttattgacaatgaaaaccatgttgaacctgtagcagatgaaagtttgtcaactgttgctaaattgattgggtgcaacatcaatgagcttacgctaactttatcgaaacgtaacatgagagttaggaatgataccattgtacagaagctaacgctaccacaggccattgatgcaagagatgctttagcaaaatcaatctattcgtgcctgtttgactggctggttgaacagatcaacaaatctcttgctgtgggaaagaggcgaactggcagatctatcagtattcttgatatctacggctttgaatcatttgataaaaatagcttcgagcagttctgtataaattatgcaaatgagagattgcagcaacactttaaccgtcatctattcaagctggagcaagaggaatatatccaggatggcattgactggacaagggttgattttgaggacaaccaaaattgtctgagtctttttgaaaagaaaccattggggctgctctcccttttggatgaggaatctacatttccgaatggcacagatttgacacttgcaaacaagctaaaacagcatctacagtctaattcatgtttcagaggagataaagggaagcttttcacagttgtgcattatgcaggagaggttacatatgagacgactggatttctagagaagaatagagacttgttgcattcggattctattcaacttttgtcctcttgttcttgcctccttcctcaagcatttgcttctagcatgctgatccaatctgaaaaacccgttgtgggtcctttatacaaagcaggtggtgctgattcccagcgtttgagtgtagctactaaatttaagagtcaactcttccaattgatgcaacgtttaggaaacactaccccacatttcattcgctgtatcaagccaaataacatccagtctcccggggtgtatgagcaagggcttgttttacagcagctaagatgttgtggggtcctagaagtggttcgaatttcacggtctggatttcctacaagaatgtctcatcagaaattttcccgaagatatggttttcttctggtggagaacattgctgatagagatcctctaagtgtttcagttgcgattctccatcagtttaatatcttgccggagatgtatcaagttggctacacaaagttgtttttcagaactggccagattggggttcttgaggacacaaggaaccgtactctccacggcattttacgtgttcaaagttcttttagaggataccaagcacgctgtctcctgaaggaacttaaaaggggaatttctattctccaatcatttgttcgtggagagaagataagaaaagagtttgctgagttacgaaggaggcataaggctgctgctactatacagagccaagttaaaagcaagattgctaggatacagtataagggcatagccgatgcatcagttgtgatacaatcagcaattcgtggttggttggttagaagatgttcaggggatattggatggttaaaatctggaggtgccaagacaaatgagttaggtgaggtgctagtgaaagcatcagtactttccgagctccaacgcagggtacttaaagcggaagctgctctgcgtgaaaaggaagaagagaacgacattcttcagcagaggcttcaacaatatgagaaccggtggtcagagtatgagacaaagatgaaatcaatggaagaaatctggcaaaagcaaatgaggtcgttgcagtccagtctttccatagcaaagaaaagcttagctgttgaggactcagcgagaaactcagatgcatctgtcaatgcgagtgatgcaacagattgggattcaagcagtaatcagttcaggagccaaacaagcaatggagtagggtcaagactacagcctatgagcgcagggctgagcgtgattgggcggttagcagaagaattcgagcagagagctcaagtgtttggtgatgatgcaaagttcttggtggaagtgaaatctggtcaggtggaagcaaacttggacccagacagagaactgaggaggctgaaacagatgtttgagacgtggaaaaaggattatggagggagattgcgggaaacgaaactgatactgagcaagctcgggagcgaagagagcagtggttcgatggagaaagtgaagaggaagtggtggggaaggagaaatagcaccaggtattga

SEQ ID NO: 978 - DNA, 735 bp, Arabidopsis thaliana
atggagtctagacattttgccactgctttagtgttcttagcttctaagggtttcgttgatatattgtactgggtttatcgtttccaggcatctagtatggctttctgcactaaacttggcggtcactggaaacaaggggtaaatgttccagtgtcatcaatgctcggttctcttcgctacatgtccacaaaactttatattggtggcctgtcccctggaactgacgagcactccttgaaggacgctttctctagcttcaatggagtgacagaggcaagagtcatgacaaacaaagtgaccgggaggtctagaggttatggatttgttaacttcataagcgaggattctgccaactctgctatttcagcaatgaatggacaggagctgaatgggtttaacataagtgtgaacgttgcaaaagattggccaagtttgccattgtctttggatgagagtatagaagaagctgagaagaaagaaaataagatgatgagccgatctgtatggaaagatccattcgttgatgcgttcctgatgaagaagaagaatgcagctctgaacaggaaaatatggtcaaggagatcgacgattcttcccgagtatgttgattcggcggtgagaatctacaacggcaaaactcatgtgcgttgtaagatcacagaggggaaagttgggcataaattcggagagtttgcgtttacaagaaaagtgaagaagcatgctaaagcaaagtag

SEQ ID NO: 979 - DNA, 609 bp, Arabidopsis thaliana
atggcaaaacaatatctctttgtactcctctcaatctcctatctcttatcactggagctcacggcggccaccgcagcctcacagaccggagcttccaaaaaagccataaacttcatccaatcttcttgcaaaaccaccacataccctgccttatgtgtccactcactctccgtctacgcaaacgacatccaaacaagccctaaacgtttagctgagaccgctatagccgtgacactaagccgagcccaatccacgaagctcttcgtctcgcgtctaacacgtatgaagggtcttaagaagcgcgaggtcgaagccatcaaagattgcgtcgaggagatgaacgataccgttgaccgtttgaccaaatctgttcaagaactgaagttgtgtgggagtgccaaagatcaagaccagtttgcgtaccacatgagtaatgctcagacttggactagtgcggctttgactgacgagaacacttgctccgatgggttctcgggtcgggttatggatgggaggatcaagaactcggttcgggctagaatcatgaacgtgggacatgaaaccagcaacgctttgtccttgattaatgcctttgctaaaacttactaa

SEQ ID NO: 980 - DNA, 753 bp, Arabidopsis thaliana
atgaatgttctgggggtttcatctttcaaggcttcttctattattccgtttcttcaagggtcgaaatggattaagaatccaccggtgattgatgacgtggataaaggaggaacagtttgtgatgatgatgatgataaggaatcgaggaatggaggaagtggatgggttaataagcttttgagtgtttgttctgaggatgctaaggctgctttcacggcggttactgtttctatcctttttagatcagctcttgcggagccaaagtcgattccttcaacgtctatgtaccctaccttggacaagggtgatcgcgttatggcggagaaggtctcatactttttcaggaagccagaggtttcagatatagtaatcttcaaggctcctccaattttgctggaatatccggaatatggctacagttccaatgatgtattcataaaaaggatagtggcaagtgaaggtgactgggttgaagttcgtgatgggaagctctttgtgaatgacattgtgcaagaagaagattttgtcttagaaccaatgtcatatgaaatggaaccaatgtttgtccccaaaggttatgtctttgtccttggtgataaccgcaacaaaagctttgactctcataactggggtccacttccaatagagaacatcgttggaagatctgtgttccggtactggccaccgagcaaagtatcagacaccatataccacgaccaagctatcacaaggggacctgttgcagtttcatga

SEQ ID NO: 981 - DNA, 1851 bp, Arabidopsis thaliana
atggcggcgaggataaacacttcgcttcataacgccctctcttttttaaagccttttaacactcccctcaataccaaaccattctcttttagaagaaacagcttcagattttccaaaaagcttccttattattctcagttttcctcagggaagagagctctctattgcacttccagttcccaggaaagtaccgtcgatgaaggcgagacatttgtcctcaccactcctctttattacgttaatgcccctccccacatgggtagtgcttacaccactatcgccgccgattcaattgctcgtttccagagactgcttggtaagaaggttatctttatcacaggaacagatgaacatggtgagaagatagctacttcagcagctgctaatggacgtaatcctcctgaacattgtgacctcatttctcaatcttatagaactctttggaaagatctcgatatagcttatgacaaattcattagaactactgatcctaagcatgaagctattgtaaaagagttctacgctcgtgttttcgcaaacggtgatatttacagagctgattatgaaggtctttactgtgttaactgcgaggaatataaggatgagaaagagttgcttgaaaacaattgttgccctgtccatcaaatgccatgtgttgcaaggaaagaagataactacttctttgctttgtcgaaatatcagaaaccacttgaagacattttggcccagaatcctcgttttgtgcagccttcgtatcgtcttaatgaggtacaaagttggataaagagtggcttaagagatttttccatttctcgagcattagtggattggggaattcctgttcccgacgacgataagcaaaccatatatgtttggtttgatgctctacttggttacatatcagctctaacagaggacaacaaacaacaaaatctagaaactgctgtttcatttggctggcctgcttcattgcatttgatcggaaaggatattctacgatttcacgctgtctactggcctgccatgctaatgtctgctggtcttgaacttcccaagatggtgtttggccatgggtttctgacaaaggatggaatgaagatgggaaaatcgttggggaatactctagaaccgtttgagttggttcagaaatttgggccagatgccgtgaggtatttcttcctacgggaggttgaatttggaaacgatggggactattcagaagaccgatttataaaaatcgtcaatgcacatctcgccaacactataggaaatcttcttaaccgtactcttggtcttcttaaaaagaactgtgaatccactttagtggtagactcgacagttgcagccgaaggagttcctttgaaagacacagtggagaagctggttgagaaggctaggacaaactatgaaaatctgtcactatcatcagcgtgtgaagctgttttagagattggaaatgcgggaaatacctacatggatcaacgagcaccatggtttctgttcaaacaaggtggtgtctcagcagaagaggcagccaaggatctggtgattatactggaagtaatgagagtcatagcggttgcgttatcccccgttgcaccttgcctaagtctgaggatctattcacagcttggctatacagaggatcaattcaatagcataacctggagtgacaccaaatggggagggctaaagggaggacaagtaatggagcaagcgagtcccgtatttgcaaggatcgagctgaatccagagaaagaagaagatgagaagaagccaaaggttggtaagaaaactggcaaagccaaggtcaaagtagtagagcaaactcctacagtagctgaagcttaa

SEQ ID NO: 982 - DNA, 594 bp, Arabidopsis thaliana
atggcgcagatggttgcgatgcccgtagcgcactcgctctcactcatttgcaattgggcaaaatccaatcctctctctcgcaacactcttgccctcccagcttcaaacactcccaatgtaatcatttctcttggactctctcttgcgtatgatgttaagcagagtctaagcatcagatgtgctcgtgttggtggagtggagattccggctaataagagaattgagtactctcttcagtacattcatgggattggtcgaactagggctcgtcagattcttgttgatcttcagatggagaacaagattactaaagacatggctgaggaagaactcatcattcttcgtgatgaagtctccaagtacatgattgagggtgatctggcctttgtgaatgaattattgatttgtgttgtggatgttgtgcagaggaggttcaatgctcttgcaatcaagaggttgaaggagatccagtgttaccgtggggtaaggcacatccaagggctgccatgtcggggacagagaaccaagaacaactgcaggactcttaaaggcaagaaaattgctattgcagggaagaagaaagtttccaagtaa

SEQ ID NO: 983 - DNA, 663 bp, Arabidopsis thaliana
atggcgtcttcttcagcgacgctctctctctgctctactttctctgctcattgcaatgtcaattctcgccgttctagcactatcctctgttctctctctaaaccttcgcttaatttggctaaacctctgactggatttctttctccttccactgcgtcgacgtctcgaaccgcattcaccgtcgctccgaaattcgcggaatcagtcgtcgaagctgaaccggagactaccgatatcgaagctgtggtggtttccgatgtttcggaggttactgaggaaaaagctaaacgagaagagattttcgctgttattatggttggtggacgccaatacatagtgtttccagggagatatctctacactcagaggctaaaagatgcaaatgttgatgaccagattgttctcaacaaagtgttgcttgttggaacaaagacacacacttacattggcaagccggttgtgaccaatgccactgtacatgctgttgtggaaagtcaaggtttgaatgataaagtggtagtcttcaagtacaagcctaagaagaagtaccgtagaaatatcggtcacagacagccgaatacgaggattaggattaccggaatcacagggtatgaagagtatccagcctcgcccaatgttgcagttggagaagtaaatctttga

SEQ ID NO: 984 - DNA, 897 bp, Arabidopsis thaliana
atgggtagggctccatgttgtgacaaggcaaatgtgaagagaggtccatggtctcctgaagaagacgcaaagcttaaagattacatcgagaaacaaggaactggtggcaattggattgctctccctcacaaagctggtttaaggagatgtgggaagagttgcagactgagatggttaaattatttgagaccaaacataagacatggagatttcactgaagaagaagacaatattatctacagcctctttgcctccattggaagcaggtggtcagtaatagcagctcacttgcaaggtagaactgataatgacatcaagaactattggaacactaagctcaagaagaagctcatagccaccatggctcctcctccacatcaccacttagccattgctacatcatcatcatcagcatccccatcatcatcatcacattacaacatgatcaatagtcttcttccgtataacccatcaacaaaccaacttctcacacctcatcagggtatcatgatgacaatgatgggccaacaacaacaactattttatcaagaagacatgggcaatttggtaaattctccaaacagaaacaatctcataatgagccatcaagaagacaaccaagagcaaagtacaaacaagggaataatgttgttgagtgatgtaagaagtgggtcgagtacaacaagtacagtaacaagagtgaagatggaacatcgtgatcatgatgatcatcatcatcatcatgaagaagatgagagatcaatgacctcggtagtgatggaagattatggaatggaggagatcaagcaattaataagtagtagttgtacgagtagtaacaatagcttgtggtttgacgaaaacaagacggaggataagttcatgttgtactactga

SEQ ID NO: 985 - DNA, 675 bp, Arabidopsis thaliana
atgcgtagagagatctcgtttttgctacagcccaggtgtcttcttcttctcgttgccctaacgattttcctcgtcttcgcgctcttcaacaccggaaaagatgaggagaagcaagtaattgaagatcatgaaatcaccaacagggtttttctcgatgttgatattgatggccaacgcttaggcaggattgttatcggactatatggcactgttgtacccaaaactgtagaaaatttcagggctttatgcacaggggagaagggtaaaacctcaagcggaaagcctttacattataagggaacaccatttcatcgtataatatctggatttgtaatccaaggaggagacattatccatggtgatggaaaaagtagtgactcaatctatggtggaacctttcctgacgaaaatttcaagatacagcattcacacgcaggtatggtagcaatggctaatacaggaccggattctaatggctcgcagttctttatcactactgttaaggctagctggttggaaggagaacatgtggtgttgggaaaggtgatacaaggaatggacaatgtattcgccattgaaggtggagctggaacttacagtggcaaacccaggaagaaagttgtgattgctgattctggagagatccctaaagacaaatgggatgaagagagatga

SEQ ID NO: 986 - DNA, 2043 bp, Arabidopsis thaliana
atggctacaataaacgatattggagtagcagcagcaatcaatatagtcacagcatttgcttttctcttagcttttgctatattcaggattcaaccagtaaatgacagagtctatttccctaaatggtatctcaagggcttaagaagtagttctatacaaactggtggctttggtagcaaattcatcaatttggacttcaggtcctatattcgtttcctcaattggatgcctgaagcacttaaaatgccagaaccggaactcgtcgatcacgctggactcgattctgttgtctacttgaggatctacttactcgggctcaagatctttttccctatagcttgtgttgcttttacaacaatggttcctgttaattggacaaacaaaggattggatcggttaaggcattccaatataagtttcagtgatattgataaactctctttatcaaatataccaaatgggtcacctagatcactatctcactttccaggtataatcatctttggattttctattgtatacatctctgacttgatttctgagttgatgatggttgatctgcttttaactcaggcagtccacgatgcaaccaaactctcggaattggttctgacgaggaaacaaatgcagaacctgcttgattacaatataaacaaacacatgaggaatctatctaacaggccagtaataaagatatctgaggagaaacagaggttaaggaccggcacaaagtccatagtgcctgcagcttttgtatctttcaagagccgttggggagcagcggtttgtgctcaaactcaacagacaagaaacccaacagaatggctaactgagtgggctgcagagccacgtgacatctactatgacaatctggcattgccatatgtagaccttaagataaggaggctcatagtcggcgtcgcatacttcttcctcaccttcttcttcatgataccaatagcatttgtacagtcactcgccaacatcgaaggcatagagaaggcttttcctttcttgaagccccttatagaagtgtatgtctctgtctatctcaacatgaaattgttaaagtcgatcatccaaggtttccttcccggaatcgccttgaagatcttcctccttttcctcccaagaatactcatgcagatgtccaaatttgaaggttttgtcagcacatcctcattagaaagaagagctgcaactagattctacatgttccaattcatcaatgttttccttggaagcatagtcaccgggactgcgtttcaacagctcaacagtttccttaaccagtctgcaaacgatattccaaaaacaattggtgtctcgattccaatgaaagcgaccttctttataacatacataatggtggatggatgggctggtgttgctggtgagatattgaggttgaagccactcataatctatcatctaaagaactccttcctcgtgagaaccgaaaaagatagggaagaagcaactgatcctggaaccataggattcaacactgcagttagccccatccttctcccttttatcctcgtcttcttcggcctggcttttgtagtgtaccgtcatcaggttataaatgtgtataaccaaaagtatgagagcgcagggaagttctggcctgacgttcacaggcgtgttgtgaccgcattggttgtttcacagctgctcttgatgggtcttctaagcaccaaacacgcttctaagtccactcctttgctgcttgtgcttccgttgctgaccatcgggttccacaaacactgcaaaaaccgttaccaacctgcctttgtcacatacccgttacaggaagccatgatcaaagatacactggaccgtatacgtgaaccaaacttaaacctcaaagctttccttcgagacgcctacgcccacccggagttcagggttggagaagatccagagcccgaggagaagctggagtctgatatgtcacctccggatttagtggccactaagcgttggtcatggaggaacactcctttgcctagcaaagatagctgccgtgaaataccctaa

SEQ ID NO: 987 - DNA, 738 bp, Arabidopsis thaliana
atggaagagaagctacgttacgcctgcgactctacctccgccgcatctgaaggttacggtagccgtatgttgcttggtgctaaagatgacgtcgttttggattggagagattactttgatcatcacacgtttccttcctctcgtcgtaacccttctcattggccgattcatccttctgactacagacaagttgttggagaatatggtgatgagatgaagaaactagctcagatgctattagggctaatctcagagagtttgggtcttccttgttcatctatagaagaagcagtaggtgaaatctatcagaacattactgtaaccaattaccctccttgtcctcagcctgacctcactcttggtcttcagtctcattccgattttggtgccattactctcttgattcaagatgatgttgaaggtcttcagctttacaaggatgctcaatggctcactgttcctcctatctctgatgctattctcattcttattgccgatcaaaccgagatcattaccaatggaagatacaaaagtgctcaacatagagctgtgactaatgcgaatcgggcgcggttatcagtcgctacctttcatgatccctccaagactgcaaggatagcaccagtttctcaactctccccaccgtcttacaaggaagttgtgtatggtcaatatgtttcttcctggtactctaaaggtcctgagggtaaacgaaacctcgatgctcttctctactaa

SEQ ID NO: 988 - DNA, 1344 bp, Arabidopsis thaliana
atggatgcaggtttgaatcggtgcccacttcaagaacactttcttcccagaaaaaattccaaggaaaatctggacaggttcataccgaatagatcagcgatgaattttgactatgctcactttgccctcactgaagaaagaaaaggtaaggatcaatctgcaacggtaagttcaccatccaaagaggcctacaggaagcaattggctgagaccatgaacttgaaccacacaaggattctcgccttcagaaacaaacctcaggctcctgtcgaactgcttccgagcaatcactctgcttctcttcaccaacaacccaaatctgtaaagcctcgtcgatacattcctcagacttctgagagaaccttggatgcacctgacattgttgacgatttctacctcaacttgctggactggggaagtgcaaatgtcttagccatagcgttggaccacactgtctacttgtgggatgcttccactggttctacatctgagcttgtgaccattgatgaggagaagggacctgtcacaagtatcaactgggctcctgatggtcgtcatgttgcagttggactcaacaactctgaagtccagctgtgggattctgcatccaaccgtcaactgagaacattaaagggtggtcaccagtcaagagtaggatcactggcatggaacaatcatatccttactactggaggaatggatggactgatcatcaacaatgatgtgaggatcagatcacccattgtggaaacttacagaggtcacactcaagaagtttgtgggctcaagtggtcaggatctggacaacaactagcaagtggtggcaacgacaatgtggtacacatctgggatcgttctgtcgcttcctcaaactcaaccacacaatggctgcacaggcttgaggaacatacatctgctgtgaaggctcttgcgtggtgccctttccaagcgaatttgcttgcaactggtggtggtggaggagacaggacgataaagttctggaatactcacactggggcttgcttgaattcagtagacactggttcccaagtttgttcgttgttatggagcaagaatgaaagagagttgcttagctcacatgggtttacacagaatcagcttacactttggaagtacccatccatggtgaaaatggctgagctcactggtcatacatcaagagttctatatatggcccagagtccagatggttgtactgtagcttcagcagcaggagacgagaccctgaggttttggaacgtttttggagtaccagagactgcaaaaaaagctgcaccaaaagcagttgccgagccattttctcatgtgaatcgtattcgatga

SEQ ID NO: 989 - DNA, 1377 bp, Arabidopsis thaliana
atgcctcgcctacaatgcctaacaatggcgacttcactaattctgctgcttcaagctctgagtttagtgagctcaactattctgtcccgggccgatcggatcacccgtttacccggtcaaccccgagtcgggtttcagcagtactcaggttatgtcactattgacgagaagaaacagagagctctgttttactacttggctgaagcagaaaccaaacccatctctaaacctctcgttctctggctcaatggaggacctggatgttcatcattaggtgttggtgcattctctgagaatggaccttttagaccaaagggatcaatcttggtgagaaatcaacacagctggaatcaagaggctaatatgttgtatctggagacacctgttggagttggattttcttatgcaaatgagagctcctcttatgagggtgtgaatgataagatcactgcaaaagacaatcttgtgttcttgcaaaaatggttcctcaaattccctcaatatctcaacagaagtctcttcatcactggtgaaagctatgctggccattatgttcctcagttggctcagcttatgattcagtacaacaagaagcacaatttgtttaatctcaaaggcattgctattggcaatccggttatggagtttgcaacggatttcaattcacgagcagagtatttctggtctcacgggttgatatcggatccaacttacaaattgttcacatcttcttgtaattactcgagatttttgagtgagtaccatagaggatcagtgtcgagtatgtgcactaaagtgctaagtcaagttggcatcgaaacaagtagattcatagacaaatatgacgttactcttgacgtctgcattccctctgtgctatctcaatccaaacaagtgggagagacggtggatgtgtgtctagaagatgagacggtgaactatcttaaccggagagatgtgcaaaaagctctccacgctcggcttgtcggaactcgcaaatggactgtttgcagcgatgtgctggattacgaagtacttgatgtggaagtaccaacgataaatatcgtaggaagtcttgttaaagctggtgttccagtttttgtgtacagtggagatcaagactctgtgattccgttaaccggaagtagaacattagtgaagcgactggctgaagagttgggactaagaacaaccgtgccttatcgagtttggttcgcaggacaacaggttggtgggtggactcaagtttatgggaacacattggcgtttgccactgtgagaggagcagcccacgaggtaccattctcgcagcccgcgagagcgcttgtgttgtttaaagcattcttgggtggtcgtcctctccctgaagaattctaa

SEQ ID NO: 990 - DNA, 1179 bp, Arabidopsis thaliana
atggcatgtggttgtggccgtcgtcagtttccttcattagcgaagactgtttgtaagtttactagcagcaatagaagctatggcggtctggtggggagttgcaaagcggtgccaacgaaatcaaaggagatctctttgctcaatggtattggtcaatctcaaacagtgagttttgatttgaaacaagagtcaaaacagcctatttcgttggtgactctgtttgagctagtagctgttgatctgcagactttgaatgacaatcttttatcgattgttggtgcggaaaatccggttttgatatctgcggctgagcagattttcggagctggtggtaaaagaatgagaccgggtttggtattccttgtatcacatgccacggcggaattagcaggcctaaaggaactaacaacagaacaccggcgtttggctgagatcatcgagatgatacacactgcaagcttgatacacgacgatgtgttagacgagagtgacatgcgaagaggaaaggaaacagttcatgagcttttcggcacaagagtagcggtgctagctggagatttcatgtttgctcaagcgtcatggtacttagcaaatctcgagaatcttgaagttattaagctcatcagtcaggtgatcaaagactttgcaagcggagagataaagcaggcgtccagcttatttgactgcgacaccaagctcgacgagtacttactcaaaagtttctacaagacagcctctttagtggctgcgagcaccaaaggagctgccattttcagcagagttgagcctgatgtgacagaacaaatgtacgagtttgggaagaatctcggtctctctttccagatagttgatgatattttggatttcactcagtcgacagagcagctcgggaagccagcagggagtgatttggctaaaggtaacttaacagcacctgtgattttcgctctggagagggagccaaggctaagagagatcattgagtcagagttttgtgaggcgggttctctggaagaagcgattgaagcggtgacaaaaggtggggggattaagagagcacaagaattggctagggagaaagctgatgacgctataaagaatctacagtgtctacctcgaagtggcttcaggtcggctctagaagatatggtgttgtataacctcgaaagaattgattag

SEQ ID NO: 991 - DNA, 2805 bp, Arabidopsis thaliana
atggagggttgtttaggacaaaaccaaacaactgaaatcaaagtaggagtagtgcttgatctccatacttcattttccaagctctgcctcacttccattaacatatcgttgtccgatttctacaaatatcattctgattacaccacgagacttgcgattcacattagagattccatggaagatgttgtccaggcctcatctgcagccttggacctaatcaagaacgagcaagtgagcgccatcatcgggccaagaacctctatgcaagctgagttcatgataagactcgccgataaatcacaagtaccgaccatcacattctctgcaacatgccctcttctgacatccatcaacagcccttactttgtccgagccactctcgatgactcatcccaggtcaaagccattgcggccattgtcaaatccttcgggtggagaaatgtagttgccatttatgtggacaacgaattcggagaaggaatattgccattattgactgacgctttacaagacgtgcaagcttttgtagtcaatagatgtttgatccctcaggaggctaatgatgatcaaattctcaaggagctttataagctaatgacgatgcagacgagggtattcgttgtccacatgccaccaactctcggttttcgtttttttcagaaagctagagagattggtatgatggaggaaggatatgtatggttattgacagatggagtgatgaatttgttgaaatctaatgaacgcggtagcagcttggagaatatgcaaggggttttgggtgtaaggagccatatccccaaatcgaagaagctcaaaaatttcagattgagatgggaaaaaatgtttcctaagaaggggaatgatgaagagatgaacatttttgcgttaagggcatatgattcgatcactgccttagcaatggccgtggagaaaaccaatataaagagcttgcggtatgatcatccgatcgcttcaggaaataataagacaaatttggggacattaggggtctctcgctacggtccaagtcttcttaaggctctttcgaatgtaagattcaatggtttagccggagagtttgagctcattaacgggcagctagaatcatcagtgtttgacgtcatcaatattattggaagtgaagagagaattattggattatggagaccaagcaatggaattgttaatgcaaagtcaaaaaacactacgtcggttttaggggagaggttggggccggtgatatggcccggtaagtcgaaagatgttccgaaaggttggcagattccaacaaacggaaagatgcttagagtgggcattccagtgaagaaaggcttcttagaatttgtggatgcaaagatagatccgatcagtaacgcaatgaccccaacgggttactgtattgagatattcgaagctgttcttaagaagttgccttactccgtcattcctaaatatattgctttcttgtctccagatgagaactatgatgaaatggtataccaagtatacaccggggttagttcgtctatttctactatggcctatgacgcagttgtgggagatgtaaccatagtagcaaacaggtcattgtatgtcgatttcacgctaccgtacacagagtctggagtgtctatgatggtacccctcaaggacaacaagaacacatgggtgttcctcagaccttggagcttagacctatgggtcaccactgcttgctttttcgtattcattgggtttatcgtgtggattttagaacatagagtcaacaccgactttcgcggaccgcctcaccaccaaataggcaccagtttttggttcgctttctccactatgaactttgcccaccgtgagaaggtggtgagtaatttagcgaggtttgtggtgttggtgtggtgcttcgtggtgcttgtgctgattcagagctatacagcgaatctcacatctttcttcacagtaaaactgttgcaaccaacggttacaaattggaaagatctcataaaatttaacaaaaatattgggtaccaacggggcactttcgtgcgtgaacttttgaaaagtcaaggatttgatgaatcacagctcaaaccttttggttctgccgtagaatgtgacgagcttttttccaatgggacaatcacagcatcttttgacgaagtggcctacattaaagttatcctttctcagaattcctccaaatatactatggttgaaccatcctttaagactgctggttttggctttgtattccccaaaaaatcacctttgacggatgatgtctcaagggcgatcttgaatgtgacacaaggcgaagaaatgcaacatattgagaataaatggtttaagaaaccaaataattgtccagatctaaacacttctctgtcctccaaccatctcagcctgagtagcttctggggtctgtttcttatagcaggcatagcttcattcttggcacttctcatcttcgtggccaacttcttgtacgaacacaagcacacgctctttgatgactccgaaaattctttccgtggaaagctaaaatttttggttagaaactttgatgagaaagacataaagtcgcatatgttcaaggagaatgccgttcataatgtgagttcacctattactcaaggaagttcaagccctttgaccgatcagagcactccattgccgcgaagtccggaacagtatagggaattagagctaagaagagtgtcttccatctcgagcggtgaacttttcactacgcaatcagaacaagttgaagatgaggaatctgctataattcaatgtgaaggtgaatga

SEQ ID NO: 992 - DNA, 1287 bp, Arabidopsis thaliana
atggcaggagctgcctccgcgctgtttctgcttgatatcaagggacgcgttctcgtctggcgtgattatcgtggcgatgtctccgctgctcaagccgagcgattcttcactaagctcatcgagaaagagggtgattcacagtcaaatgatccagttgcttacgataatggggtgacttatatgtttgtacaacatagtaatgtatacttgatgatagcatccaggcagaattgtaatgctgccagtcttctcttctttcttcaccgcgttgtcgatgttttcaagcattacttcgaggagttagaagaggaatcattgagggataactttgtggtagtgtatgagctacttgacgagatgatggactttggttaccctcagtataccgaagcaagaattctcagtgaattcatcaagactgatgcatatagaatggaagttacacagagacctccaatggctgtgacgaatgctgtctcctggaggagtgagggaatacagtacaagaagaatgaagttttcttggatgttattgagaatgtaaatattcttgtcaacagtaatgggcaaattgtcaggtctgatgttgttggagcgctgaagatgcgaacttacttgactggaatgccagagtgtaagttaggactgaatgatagagtattgctggaagcgcagggacgagcaactaagggaaaagccattgatttggaggacatcaaatttcatcagtgtgttcgattggcccgttttgaaaacgataggacgatatctttcataccacctgatggggcttttgatctgatgacatatagactcagcactcaggtaaagccacttatatgggtggaagcacaaatagaaagtcattcaagaagtcgtgttgagatgctcataaaagctagaagtcagttcaaggaacgaagcaccgcaacgaacgttgagattgagttgcctgtaccaaccgatgcatctaaccccaccgttaggacatctctagggtctgcctcttatgctcctgaaaaagatgcgttagtctggaaaatcaaatctttcccggggaacaaggagtacatgttaagggcagagttccatcttccaagtatcactgcagaggaagcaactcctgagcgaaaggctcctatccgtgtcaaatttgagatcccttatttcactgtttcagggattcaggttcggtacctaaagattattgagaagagtgggtaccaagcacttccatgggtgagatacataaccatggctggtgagtacgaactaagactcgtgtaa

SEQ ID NO: 993 - DNA, 3037 bp, Arabidopsis thaliana
aagaaatatatcggccattagcggattttccggtgaatatatgggaagatcccttgatctctttttctgttttggatccggtacgtacccacacgacttgaagtcacaattaggcaaatttgttcacaaaacactatgaatatactctatattatgatgtcttctctcgtgccattattttgatgtatataggagagtgagataaacgaagagaagctgagttcactaaaggaaaccgtaagaggattgttaatggcttcaaaagaagagccgatagagaacatcaaattcattgatgctctttgtcgccttggtgtttcctaccactttgaagtagacatcttcacgcagttagagacgatgtttggtgtcatggttttatgcagatgataagaggcaatgagttcgatttatacaccgtctccctcgtcttccaaatttttagacaatttggctataaacttggtgtcggtaagtcactctaatgttagaattatcgagcgtaatatgttaattaatttatcagtatgaataagtttcttatttatgtttccatattttttgggttaaaaaaaatttgaattgatattactaagaaaaagtcatgaaagagaatgttgctaattgttagtagtattttgtttttggtctaagaactatattacattttggttaatgtgaaaactgacataagtatagcgagcgtattttttcttctttttcaacttcacctaattcgatcatattaatactgtggaagcgcaaggtatactcactttgtactctctgtgcataatgattagtaaatctaccaagtcaatgttaattattaaacttgattactaacaaaaaattatatgtgtaagatgtgtttaacaacttcaagaataaggatggaaagttcaaggagcacctagctgaggatgcaagaggtcttttatgcctttatgaagctgcacattggagcacccatggtgaagacattctcgatgaagctcttgctttctctaggtctcatttggaaggactggctgatcaatctagtccacctatgtccatccgcattaaaaatgccctcaaacatgcataccctaggggtatatcaaggatagagacacgacaatatatctcatactatgaagaagaagatctgcacgaccaaaccttgctagaatttgctaagatagatttcaatcttctgcaaattttgcaccgcaaagagctttgccaagtcttcaggtgccattatgagctagcaagatagattatatatacattttaaaactcttatatatggagagactaccataatgattgtcgattcttctttttttgtaggtggtactcaaatctagagctcgacttgaaagtaccatatgcaaggaataggactgtcgaaagctacttgtgggctgttggagcatactttgagccccgatattctcaagcaaggattagattggccattgttgttatcttattgactcttgttgatgatacgtacgatgcatttggcacgattgaggaactcgaaccatttcattgattatgtggaatcctagcggcatagaagggctcccggagagcatgaggtatcttcatcatgtggtgttagatttctacggaaaacttgaggaggatatggagagggaaggaaggtcaggatgcggccttttcgctaaaaaatcggtattactaaatacttatatacacaactacttcaaaagcacaaaactaattagtaattaagtactaagtctatgttcatgtgtgttgaatctaaatgaaaaatttgttggttatatgttaataaatcagatgattgtaactgctaaagcctatcttcaagaggcaaaatggttgagtgaagactttgtggcaacatttgacgagtacaaagagaacggagtttattcatcgagctacttagctctgttaacaggatcctttctagggatggtggatgaaggcacccttgatgtgtttgaatggttaagcactttcccaccccttcttgtgacttctgcactaataggccgtctctgtggtgacattgctagttgcgaggtaattaactcacattattgtagtgatgccaataagttaataaccagtctagtttgacctatcggatcctaaatgacaaagatattgcttctaaaagattatattattaactagattttgaccagagtagccatgaatcagaaaatttaggaaagataggagaaaatttatagatttccacaaacaaaagacaaaaattcagtagcatatgtagtttggggaaaaacatgaaacaaataataataacacaaaatctgaaaggagaaaaaaattaagacaggagttttgtcagtgaaagagagatatccgaaagaatgagaaagaaatcaatgtcatttaaaaaaaaacatgtcatactgaaagaaaaaaacaatgtcatgtgtaaaattttgtctccatgctttcggaaggaatagcatgtgatcgtagtatataacatgtactatgagaaagcaacatgttacaaaagaaaatgacacacattactacattagaaaaagaacatgatatttgacgttggacattccaagagagattgagatccaatttcttgtagaattcgaattataatatcagacctaagaacttaagctgtagttgacactctacatacaaatacaatttttgtcaccacgttggtgtaaagataattttaaaatctgagatctatctaatgcagtttgaacataagagaaagcacgtaggaacatccattgattgttacatgaagcaatatggtatttcatgggaaaaagccgaagaagagatcaaaatcatggcattggattcatggaagagtcttaatcaagaactgatgacgagagatcactcttttgctttccctatcgtcatgcgattcctaaacctctcgagggtcgtcaaggttttgtacaaagacactgacatttttacacatcctgagttgatgaaacatcacgtggtttctttattccttaacagaatatctatt

SEQ ID NO: 994 - DNA, 2049 bp, Arabidopsis thaliana
atggaaaactttctagctttgtttaatgaaggcatggacgaagaagcatcccgccttgaaaaattgttaccatttcatgagcatccgttgataccttttacacgcttcgagttcaccaagtgtaaaggatgctactcgaccgatgaagataatacaagcttcatttccaaacatcccggttgcagttacatttacggaggacaccgatgcaatgagccgggatgtgatgttgtgttccatgaagagtgcgccaagccgttaccagaaatcgaccacccttaccatccagtccatcctctcaagctgatcctcctacataccagagtttctaattgtagtttctgtggagaatttttcagtgtcggttatcgctgtaacaaatgtgatttccagttggatttgatttgcgcgaggagaccagccctacttgttcttgctgaaaactcctacctacacgagcatccactccaactctcccatgaagcgcacgaaacactcagagattgcaaagggtgtggccatcaacataatagctggaaacatttctacacatgtcatcaatgcgagtttttcatcagtctggattgtatcgatcataatagtccagaagcataccacacttctcacccccaacacccactcaagtcacttagatatgaagtccctggttacgccgacaagaaatgtcttctttgccgcgaggagtttgatggaatccatcgccagcttcaccactgtggtgtttgtaattttagcatatgcagatcatgtatgaaaaacccaccaccggttcttgttaaaagcccgaggacccatgaacatcaacttcaccttgttccaagacgcattgacttcacttgcaatgcttgtgggacgctaggtgaccgtagcccttatttctgtcttcagtgcaatttcatgattcatcgggaatgtatcgatctacctcgcgtcataaacatcaaccgccacgaccaccgcatctcttacacccctcgcctcggacatggagacgggaaatgcagagtttgtcgtaaaaatgtggatgggttctacggggcttattcttgctccaaatgttttgattattttgttcattcaagatgcgcaaccagaagggatgtatgggacatgatcgaactggaagggacacccgaagaagaggaaactgcgccattcaaggtgattgatgacaacacgatagaccattacggccataagcataacttacgaatttaccgtggctggaatctaccagaaagtgtagtttgtaccgcatgtgtcttccagatttgttcagaaccgttctacgcttgcgcgagaaagagatgcgatttcataatccacgaaaaatgtgccaagcttcctttaaagaaacgtcatgtgtgccacaaccagccactcgaactatccccaaattatggcacctacttgttacataggtgtagtatttgccgtcaactgttcaccggtttctcctatgaatctaaggaattaaggatagatgtacggtgcgctacagttacagaaccatttgagcacaaaagccatcaacatcctttacactactctacagatcactccaaacgttgtagtgagtgtgatggagacgggaaattgagttgcgatgattgtgaatttggtttgtgcttcaagtgtgctattttaccgcaaaaggtaatgaggcataggtacgacgatcatcctctcttcttatcttatggcgaaatgggcgtggctggcaaatattggtgtgaagcatgcgaaacaactgtgaacccagaaaaatggttctatacatgcaatgagtgtgggatcacattgcatatttcctgcgttatagatacttacgcatattccatgccaggagcgttaacatggataggaacatttgtatccaaccactctatttgtagaccactttgctgcgtgtgcaactctcgatgcaagctccctttcgttcgtacgcttcccgaggacggagctgatctatacttttgttctttagaatgtgagaagaaaatttatcaggaacgtttcgaattttaa

SEQ ID NO: 995 - DNA, 1218 bp, Arabidopsis thaliana
atggcggcggctctgcagacgaatatccggacggtcaaggttccggctacgttcagagctgtaagtaaacagtcattggcaccctttagagtaagatgtgctgttgcttcccctggtaaaaaacgatacaccatcactctccttcccggagacggcatcggtccggaggttgtctccattgccaaaaatgtgcttcagcaagctggatctttggaaggagtggaatttaacttccgtgagatgcccattggaggagctgctttggatttggtcggagtgcccttgccggaggagactatctcagctgcaaaagaatcagatgcagtgcttcttggagccattggagggtacaaatgggataacaatgaaaaacatctgaggcctgagaaggggttacttcagattcgtgcagctctcaaagtctttgcaaatctgagacctgctacagtcctcccacagttagtggatgcttccaccttaaagagagaggtagcagaaggtgttgatctaatggttgtaagggagcttacaggaggtatttactttggagagccaaggggcataaagaccaatgaaaatggcgaggaagttgggtttaatactgaggtttatgctgctcacgagattgatagaattgctcgtgttgccttcgagactgctcggaaacggcgtggcaagctgtgttctgttgacaaagctaatgttttggaagcctcaatcttatggaggaaacgagtaacagcattagcctctgaatatcctgatgttgagctgtcacatatgtatgttgacaatgccgcgatgcagcttgttcgtgacccaaaacagtttgacaccatcgtcacaaacaacatttttggtgatatattatccgatgaagcttcaatgatcacaggaagcataggaatgctgccatctgctagtctcagtgattcgggacctggactctttgaacctatacatggttctgcacctgatattgctggacaggataaggcaaacccattggcaaccattctaagcgctgcaatgcttctgaaatacggacttggagaagaaaaggcagccaagagaattgaagacgcagtgttggttgctctgaacaacggattcagaactggagacatatactccgcgggaacaaaactggtgggctgcaaggagatgggagaggaggttctgaagtcagtggactcccaagttccagcttctgtttaa

SEQ ID NO: 996 - DNA, 756 bp, Arabidopsis thaliana
atggcggcttctctgcaatcagcaaaccctacattgtcacgaaccctagcttctccgaacaaaccttcctccttcgccaccttccgatctccatttctcagattcaattcaacatccgtcgcttccaatttcaaacccctagtttctcgagaagcatcctcatcgttcgtcactcgctccgccgccgagccacaagaaagaaaaaccttccatggactgtgctatgtcgtcggcgacaacatcgacactgaccaaatcattcccgcggagtttctcactctcgtcccttcgaatccagaggaatacgagaaactcggttcttacgctttagttggtcttccagcttcttacaaggaacgattcgttcagccaggtgagatgaagacgaagtactcaatcatcattggcggtgaaaactttggatgtggatcgtcacgtgaacatgctccggtttgtttaggagcagcgggagctaaagcagtggtggctcagtcttatgctagaatctttttcaggaactctgttgctactggtgaggtttatcctttggattctgaagttagggtttgtgatgagtgtacaactggtgatgttgcgactgttgagttgagggaaggagatagtattttgatcaatcatacgactgggaaagagtacaagcttaagccgattggtgatgctggaccagtgattgatgctggtggtatatttgcttatgctaggaaagctggaatgattccatctgctgctgcttga

SEQ ID NO: 997 - DNA, 792 bp, Arabidopsis thaliana
atgccacaagtcgatatagaagcctttgtttcttcagtatgcatcggtggctccgaccaccgcaagatcgtatgcgaaaccctcgccgacgactcaacgatcccaccttattacaacaactccgccgttagtccgagtgatttcccaccggaatcttatttcttgtcaaacgatgctcagctagagtggctcagcgacaacgccttctttgatcgtaaagactcacaaaaaggaaactctgggattctcaattctaatcccaactcgaatccaagctcgcaacggttcttactaaaatccaaagcgtcgatcatcggtttgcctaaaccgcagaaaacgtgtttcaacgaggcaaagcaacggagacacgcgggcaagaaccgggtcatcttgaaacgggtcgggtcaaggataaagacggatatttcgcttctggaaccttcttctcctaaagtctcttgcatcggtagagtgagatccagaagagaacgcagccgccgtatgcaccgtcaaaaatcaagtcgggtcgaaccggtaaaccgggttaagaaacccgggtttatggcgagtttcagagctattttcaggatcaaaggcggctgcaaagacgtgtcagcgcgtgagactcacacgtcgacgagaaacacacacgacatcaggagccgacttcctgcggaagctgatgagaagtcggtattcgacggcggagaaccggtggtacccggtttgggtgggatgacgcgtttcgcatctggtagaagagcggatttgttgggtggtggaggatgttga

SEQ ID NO: 998 - DNA, 792 bp, Arabidopsis thaliana
atgatatgcgcaagaatccgaccgctaatttcgtcaccactagctttcactatctcaacaaccaaacactccagaatcaatctccgattactccctcgccgctccttctccgtcatgtcttcttcaaccccacagagtcagatcatagaacacatcgtcttattcaaaaccaaagacgacgctgactccaccaaaatcacctccatgatcaacaacctcaacgctcttgcatatctcgatcaagtgcttcacatctccacctctcctctccaccgtatctcctccgctaccgccttcactcacgtactccatagccgttacgaatctaaagaagatctagcctcctacgctgcacatccagatcacgttcgtgttgttaaggaatctgtgttaccgatctgtgatgatatcatggctgttgattggatcgctgatcgaatccccggaaccgtagcgccgcttcctggttcggttgctaaactcacattgctcaaattgaaagaggatgtagcagatgaggcgaaatcggagattacgggagtgattaagggactaagtgagaaatttccagggattgatcagattactgttggagaaaacttttctcctgctagagctaaaggtttctctattgcttcgattgcgtatttcaaggatttgagtgaaatggaagctgtggatgctcagaaagagttggtgaattcgcaaaaggataaggttcgtgattatgtggattctaccattgttgttgagttcgttgtgccgtcttcttcacagtcttctagtctgtag

SEQ ID NO: 999 - DNA, 1155 bp, Arabidopsis thaliana
atggaaaacacagacgagcttgtctccattgagctaccagctccagcttcatggaagaaactgttttatccgaaaagagccggtactccgagaaagacggagattgtgtttgtggctccaacgggtgaagagattagctcgcggaagcagttggagcagtacctgaaggcccatcctggcaatcctgtcatctctgagtttgagtggacaactggggaaactccaaggaggtcttcaaggatcagccaaaaggttaaggctacaacgcctactcctgacaaagagcccctcctgaagaagagacgatcttctctcacgaagaaggacaataaggaggctgctgagaaaaatgaagaggctgctgtgaaggagaacatggatgttgataaggatgggaagacggaaaacgcagaggctgagaaggagaaagagaaggagggagtgacagaaattgcagaggcggagaaggagaacaacgagggtgagaagactgaggctgagaaggtgaacaaagagggtgagaaaactgaggctgggaaggagggtcaaacggaaattgcagaggctgagaaggagaaggagggtgaaaaggctgaggctgagaacaaagaggcagaagttgtgagagacaagaaagagtccatggaagtggatacctctgagttggagaagaaggctgggagtggagaaggagctgaagaaccttccaaagttgaaggcctcaaggacactgaaatgaaagaggcgcaggaagttgttactgaggctgatgtagagaagaagcctgcagaggaaaagactgagaacaagggcagcgtgacaaccgaagctaacggagaacagaatgtaaccctgggtgagcctaaccttgatgcagatgctgaagcagataagggaaaagaatccaaagaatatgatgagaagacgacagaagctgaggcgaataaggaaaatgacactcaagaatctgatgagaagaagacagaagctgcagcaaataaggagaacgaaacccaagagtctgatgtcaagaagaccgaagctgcagtagcagaggagaagagtaacgacatgaaggcagaagacacaaacagaagcttggaggcgaatcaagttcaacagcagcagggagctgcagcttccgtgagctgttaa

SEQ ID NO: 1000 - DNA, 525 bp, Arabidopsis thaliana
atgaaggaagacgcaggaaaccctttgcatctcacgtcactgaaccatgtctctgtcttgtgccgatccgtcgacgaatctatgaatttttaccaaaaggtgttagggttcatcccgatacgaagacctgaatccttaaattttgaaggcgcttggttgtttggtcacgggattggaatacacctcctgtgtgccccagaaccagagaaacttcccaagaaaactgcgattaatcccaaggataatcacatctctttccagtgtgagagtatgggagtagtggagaagaagctggaggaaatggggatagattatgtaagggcattagtagaagaaggagggatccaagtggaccagctcttcttccatgaccctgatggcttcatgatcgagatttgcaactgcgatagcctccccgtagtccccctcgtaggagaaatggctcggtcctgctcaagagtcaaactccaccagatggtgcagccacaaccgcagactcagatccaccaagtggtctacccttaa

SEQ ID NO: 1001 - DNA, 837 bp, Arabidopsis thaliana
tgtcgcgccgtcttttcgcctgtttcggcctcaagaaatcttcaactaaacctatctctggtggtaacaattccgccgccgtagccgcagaaattcccgccggagatggtcccgttctcgtccagctattctcgtctcagggatgtaaaacatcgcccgcggcggagatgttgatgtcccggctaggtcgaggtgatttcgacgctcagatccgtggcgaagatggtggatctggatctccgacgatggttttggtgtttcatgtggattattgggattacaaggggtggaaagatccgtatggatcgagccaatggacggtgaggcagaaggcgtatatagaggcgttgaatctggatacgatgtttactccgcagcttgtgatccaaggtcgttctcaattgatcggaaacgaagaggagacgctgctcaaatctatctccgaagcgcctaggtttccttctccagccttccgggcgactttccagagaccaacctcagagacactgcaagtatcactcaccggagctttgagaatgaaagtagacggagacggaatggacataatggtggcaatatacgaaaccgggcttgtgaacgactgtgcaagaggagagaacgaaggaagaatgttgtcgaatgattacgttgtaagaaagatggaaaagatgtgcactgtgaaagatgtagcaccgaagaagccagtctcggggactgctcattttacgctctgggatggattcaacagcagcaaatgtggagtcgccgtctttcttcagaactcttctcttcagatttttggtacacagagttttaaattacctgatgagatttgag

SEQ ID NO: 1002 - DNA, 291 bp, Arabidopsis thaliana
atggcatcgttttgcagatcagcgttaatggcaggttccagaaacttagtatcaagatccagaaccgtaactcaaaagtccctcaatcttaaacccacaactacttcatctcctttcgcttcaatgtctcaatccatccctcgcgcttcgagggttctctctgctttgggaagtgttgaaacgatgattccacttcacagtgccgttgcttcagctcgtctccggtcaagcatcgctgctgattcctcttgttggagcttgctttctcaggaactgggagttcctcggtga

SEQ ID NO: 1003 - DNA, 1521 bp, Arabidopsis thaliana
atgagaggtaattatctttctttgctagtagtgctcattgtcttggcctccaatgatgttcttgccaacaacaactcttcaacacctaaattaagaagaagtgattttcctgaagatttcatttttggatctgcaacatctgcttaccaggtcgaaggaggtgctcatgaagatggtagaggacctagtatctgggataccttctctgagaaatatccagagaagataaaggatggtagcaatgggtctgttgcagataactcttaccatctttacaaggaagatgtggcgttattgcatcaaattgggtttaatgcatacagattctcaatctcatggtcgaggatcttgcctcgtgggaatctaaaaggaggaatcaaccaggctggtattgactattacaacaacttgatcaatgaacttttgtccaaaggaattaagccttttgcaaccatgttccattgggacacaccacaagcccttgaagatgcttatggtggattccgtggtgccgagattgtgaacgatttccgcgattatgcggatatttgcttcaagaattttggagatagagtgaagcattggatgacattgaacgagccattgacagtggtgcaacaagggtatgttgcaggtgtaatggctccaggaagatgctccaaattcacaaaccctaattgcacagatggaaatggagccaccgagccttatatcgttggtcacaacctcatcctttctcacggagccgccgtccaagtctacagagaaaaatacaaggcttctcaacaaggtcaagttggtattgctttgaacgcgggttggaacttgccatatacagaatcaccgaaggatagattagctgcggcacgagccatggccttcacatttgactactttatggagccgcttgtgacgggtaaatacccggttgatatggtcaacaacgtaaaaggccgcttacctatattcactgcacaacaatctaagatgttgaaaggctcatatgatttcattggcatcaactattactcttctacttatgcaaaggatgttccctgctccaccaaagatgttactatgttctctgatccttgtgccagtgtcacaggtgaaagagatggagttcccattggtccaaaggctgcatcagattggcttttaatatatccaaagggaattcgtgatcttgtgctctatgcaaaatacaagtttaaggaccctgtcatgtacataactgaaaacgggagagatgaatttagtaccaataaaatcttccttaaagacggtgacaggatcgattactacgctcgacatctcgaaatggttcaagacgctatctctgttggagccaatgtgaagggatttttcgcatggtcgttgctagacaatttcgaatgggcaatgggatacacggtccggtttggactggtttatgtggatttcaaagacggatgtaagagatatcccaagaaatcagctgaatggttcagaaagttattgaatgaaaagaaaaacgattga

SEQ ID NO: 1004 - DNA, 1116 bp, Arabidopsis thaliana
atgagtgtgagaaaccataccgagaggaggaaactaggttactttacttgcggaacaggaaaccctatcgacgattgttggcgatgtgaccccaattggcacaagaaccgtaaacgcctagcggattgcggtatcggatttggaagaaacgcgatcggtggtcgtgatggacgattctacgtagtcactgacccaagagacgacaatccggttaaccctagaccggggactttacgtcacgccgtgatccaagaccgaccactatggatcgttttcaaacgtgacatggtgattcagctaaaacaagagcttatcgttaacagtttcaaaacgatcgatggacgtggcgcaaacgttcacattgctaacggtggttgcatcacgattcagtttgtgacgaatgtgatcgttcacggattgcatattcatgactgtaaaccaactggtaacgctatggtgagaagctcagagacgcattttgggtggaggacaatggcagatggtgacgcgatttcgatctttggatcgagtcatgtatggattgatcataactcgttgtcccattgcgctgatgggcttgtggacgcagtcatgggctcaaccgcgattaccatctctaacaaccacttaactcaccataacgaggttatgttgctaggacatagtgactcgtacatgagggacaaagctatgcaagtgaccattgcttacaatcattttggagtcggacttattcaaagaatgccgaggtgtcgacacgggtacttccatgttgttaacaacgactacactcactgggaaatgtacgcaataggtggtagcgcaaacccgacaatcaacagtcaaggaaaccgctatgccgccccaaaaaacccctttgctaaagaggtgacgaagagagtggacacaccggctagtcattggaaaggatggaattggagatcggaaggagatttgcttcagaacggtgcttacttcacttcttcaggagccgccgcgtctggcagctacgcacgtgcctccagcctttccgcgaaatcttcgtcattggtcggacacattacttccgacgctggagctctaccttgtcgcagaggacgtcaatgttcctcatag

SEQ ID NO: 1005 - DNA, 1497 bp, Arabidopsis thaliana
atgaaacatttctctctacttttcatttttctggtcatcctcttggcaacaagctacagtgatgcctttaccagaaacagttttccaaaggatttcctcttcggagccgccacttctgcttatcagtgggaaggagctgttgctgaagatggaagaactcctagtgtctgggatactttctccaactcttacgatacaggtaatggagatgtaacatctgatgggtatcacaaatacaaggaagatgttaagctgatggcaacaatgggcttagaatcattcagattctctatctcctggtcaagacttatacctaatggaagaggactcattaatccaaaaggactattgttttacaacaatctcatcaaagacctaaaaagccatggaatcgaaccacatgttacactttaccactatgatcttcctcagtctcttgaagatgagtacggcggatggatcaaccgcaaaatcatagaagacttcactgcttatgcagatgtatgcttcagagagtttggggaggatgtgaagttatggactacaataaacgaagctacaattttcgccattggttcttatgaccaaggaaccgcgccgcctggacattgttctcctaataaattcgtcaattgttctactggaaattcttctacagaaccatatattgcaggccataacatattgctagctcatgcctctgcttcaaagttgtataaactaaagtacaagagtaagcagaaaggatccatagggcttagtatatttgcattcgggttatctccatatacaaactccaaggatgatgaaatcgcaactcaaagagctaaaactttcttatatggctggatgttgaagcctttggtatttggagactatccggatgaaatgaagaaaactgtgggatcgagattaccagttttctcagaggaagagtcagagcaagttaaaggatcatctgactttataggaattattcattacacaacattctatgtcacaaaccaccaaccttcagcttctctctttcccagcatgggtgaaggcttctttaaagacatgggattgctttttttgaagtgggaggctactccatggggtcttgaaggtattcttgagtatataaagcagagctataacaatcctccagtctatattcttgaaaatggtatgccgatggtacgcgattcgacactacaagacacacaaagaattgaatacattcaagcttacattgacgctgtactcaacgcaatgaagaatggatcggacacgagaggttactttgtatggtcgatggttgatgtgtatgagatattgagtggatatacgaccagcttcggaatgtaccatgtgaatttcagcgatcctggtcgcaagaggactccaaagctctctgcttcttggtacactggtttccttaatggtacaattgatgttgcttctcaagatactattcagttgtggagcaacttctctgtctcttcttcattgtaa

SEQ ID NO: 1006 - DNA, 2526 bp, Arabidopsis thaliana
atgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgcttctgggacgaccacagacaacagctgtgagtctgtggtcgtgagtggtcagcaacgtcagcagcaaaacccaacacatcagcatcctcagcgtgatgttaacaacccagctaatcttctctcgattgcggaggagaccttggcggagttcctttgcaaggctacaggaactgctgtcgactgggtccagatgattgggatgaagcctggtccggattctattggtatcgtagctgtttcacgcaactgcagtggaatagcagcacgtgcctgtggcctcgtgagtttagaacccatgaaggtcgctgaaatcctcaaagatcgtccatcttggttccgtgactgtcgatgtgtcgagactctgaatgttatacccactggaaatggtggtactatcgagcttgtcaacactcagatttatgctcctacaacattagcagcagctcgtgacttttggacgctgagatatagtacaagtctagaagatggaagctatgtggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtctcaagtgttcctgaagtcctcaggcctctttatgagtcttccaaaatccttgctcaaaaaatgactgtcgctgctctgagacatgtgcgccaaattgctcaagagactagtggagaagtccagtatagtggtggacgccagcctgcagttttaaggactttcagccagagactctgccggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagagtttctcgaagtggttagacttggaggtcatgcttactcacctgaagacatgggcttatcccgggatatgtatttactgcagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccgaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacagtattcatacaggtgcagatctgtttggagctgattctcagtcctgtggaggagacacattgcttaagcaactctgggaccatagtgatgccatattgtgctgctccctgaaaactaatgcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttga

SEQ ID NO: 1007 - DNA, 447 bp, Arabidopsis thaliana
atggcttctaagaggatcttgaaggagctcaaggatctgcagaaggatcctccttcaaactgcagcgctggtccggtggctgaggacatgttccattggcaagccactatcatgggacctcctgaaagtccgtatgccggaggagtgtttttggtttctattcatttccctccggattatcctttcaagccaccaaaggtgtcttttaagactaaggtgtaccatccaaacatcaatagcaatggaagtatttgccttgatattttgaaagagcaatggagccctgctcttactatctctaaggttctgttgtcgatttgctcgctgttgactgacccaaacccagatgatcctcttgtgccggagatagctcacatgtacaagacagatagatccaagtacgagtcaactgcgagaagctggacacaaaagtacgcaatgggttga

SEQ ID NO: 1008 - DNA, 852 bp, Arabidopsis thaliana
atgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtgggtggcccatcatcatcgaaccatcaccacaatcacaggcccgtttctatcaatccgtgggttgcttgtgctggtcaggtggctcatgggctgaattttgaagccttgcgtccacgatcgtga

SEQ ID NO: 1009 - DNA, 1554 bp, Arabidopsis thaliana
atggatgcaatcgtcgttgactctcaaaactgcttcatcatcattcttctatgttccttctcactcatctcctactttgtcttcttcaaaaaaccaaaggttaactttgatttgcttccgagccctccttcacttccaatcattggtcatcttcacctcttgctctctactcttatccacaagtctcttcagaaactctcctccaagtatggacctcttctccatctccgcatctttaacatccccttcatcctcgtctcctcggactcactggcctatgagatcttcagggatcacgacgtgaacgtctcctctcgcggtgttggagcgatcgacgagtccctggcgtatggatcttctggtttcatacaggctccctatggagattactggaaattcatgaagaagctcatcgcaactaagttgctgggaccccaaccactggtgcggtcacaggattttcgttctgaagagctagagaggttctacaaaaggctgttcgataaggccatgaagaaggaaagcgttatgattcataaggaagcgtccagattcgttaacaatagcctttacaagatgtgcacgggaaggagcttttcagtggagaataatgaagtggagagaataatggaacttactgccgacttaggtgccttgtcacagaagtttttcgtgtcaaagatgtttcgtaagctgcttgagaagctcggtatctcacttttcaaaacggagataatggttgtttcacgtagatttagtgagctggttgaaaggattcttattgaatatgaagagaaaatggacgggcatcaaggcacacagtttatggatgccttgttggcagcttatcgagatgaaaatacagaatataaaatcactaggagccatatcaagtcgcttctcacggtaaatgtacatgagtttttcattggagccgctgacgcctcatcaatagcaatacagtgggcaatggcagatatcataaacaaccgtgagattcttgagaaattgagagaagaaattgattcggttgtaggaaaaacaagattggttcaagaaacagatttaccaaaccttccttatttgcaagctgtagttaaggaagggctaagattgcacccgcctacacctctggttgtaagggagttccaagaagggtgtgagattggagggttctttgtaccaaagaacacaacacttattgttaattcttatgctatgatgagagatcctgattcatggcaagatcctgatgagtttaaaccagagaggtttctagcttccttaagtagagaggaggataaaaaagagaaaatccttaacttccttccttttgggagcggaaggagaatgtgtcctggatcaaatcttggttatatatttgtaggaaccgcgattgggatgatggtccagtgctttgactgggaaatcaatggagacaagattaatatggaagaggctactggagggtttctcatcaccatggctcatccccttacatgcactcctattcctcttccccgaacccaaaactctttaatttcccatctttaa

SEQ ID NO: 1010 - DNA, 378 bp, Arabidopsis thaliana
atggaatcaaagacgttctggatcgttactcttcttctctgtggaacaattcaattagcgatttgcagatcagaagagaaaagcacagagaagacgatgatgctaggaggcgttcatgatctccgaggaaatcagaacagtggagagatcgagagtctcgctcgatttgccattcaagaacataacaaacaacagaacaaaattcttgagttcaagaagattgtcaaagcaagggagcaggtagttgcaggaacgatgtaccacttaaccctagaagcaaaagaaggtgatcagactaagaattttgaagccaaagtgtgggtgaagccatggatgaacttcaaacagttgcaggagttcaaggaatcatcttcttga

SEQ ID NO: 1011 - DNA, 1842 bp, Arabidopsis thaliana
atggagtcatgcgattgttttgagacgcatgtgaatcaagatgatctgttagtgaagtaccaatacatctcagatgcgttgattgctcttgcatacttctcaatcccactcgagcttatctatttcgtgcaaaagtctgctttcttcccttacaaatgggtgcttatgcagtttggagcctttatcattctctgtggagctacgcatttcatcaacctatggatgttcttcatgcattccaaagccgttgccattgtcatgactattgctaaagtctcttgcgcggttgtgtcgtgtgctaccgcgttgatgttggttcatattattcctgatcttctcagtgttaagaacagggaattgtttctcaagaagaaagctgatgagttagatagagaaatgggtcttattttaacacaagaggagactggtaggcatgttaggatgcttactcatggaattagaagaactcttgataggcatactattttaagaaccactcttgttgagcttggtaaaactctttgtcttgaggaatgtgcgttgtggatgccttctcaaagtggtttatatttgcagctttctcatactttgagtcataaaatacaagttggaagcagtgtgccgataaatctcccgattattaatgaactcttcaatagcgctcaagctatgcacatacctcattcttgtcctttggctaagattgggcctccggttgggagatattcacctcctgaggttgtttctgtccgtgttcctcttttacatctctctaatttccaaggcagtgactggtcggatctctctggcaaaggttacgctatcatggtcctgattctcccaaccgatggtgcaagaaaatggagagaccatgagttagagcttgtagaaaacgtggcggatcaggtggctgtggctctctcacatgctgcaattttggaagaatccatgcacgctcgtgaccagcttatggagcagaattttgctttagacaaggctcgtcaagaggctgagatggcagtacatgctcgaaatgatttcctagctgttatgaaccacgagatgaggacaccgatgcatgccatcatctctctttcttctcttctccttgagactgagctgtctccagagcaaagagttatgatcgagacaatactgaaaagcagcaatcttgtggctacactaatcagcgacgttctggatctttcgagattggaagatgggagcttactcttggaaaatgaaccattcagtctacaagcgatctttgaagaggtcatctctttgataaagccaatcgcatcagtgaagaaactatcaacgaatctgattctgtctgcagacttaccaacttatgctattggtgatgagaaacgtctgatgcaaacaattcttaacatcatgggcaacgctgtgaaatttactaaggaaggctacatctccataatagcctctatcatgaaacccgagtccttacaagaattaccatctccagaattttttccagttctcagtgacagtcacttctacctatgtgtgcaggtgaaggacacagggtgtggaattcacacacaagacattcctttgctctttaccaaatttgtacagcctcggaccggaactcagaggaaccattccggtggaggactcgggctagctctctgtaaacggtttgtcgggctaatgggaggatacatgtggatagaaagtgaaggcctagagaaaggctgcacagcttcgttcatcatcaggcttggtatctgcaacggtccaagcagtagcagtggttcaatggcgctacatcttgcagctaaatcacaaaccagaccgtggaactggtga

SEQ ID NO: 1012 - DNA, 2085 bp, Arabidopsis thaliana
atgcctttaacgagatcaaagagtcttccggcgacggagaacggtggatccgatcgggagacactccaatcaggaagatcagtggctgggattctctataaatggactaattacggaaaaggatggagatctagatggttcctcctccgcgacggaatcttatcgtattccaagatccgaagaccggagaatgtcaatctcttatctccttccgatgatctgaggttaatcggagatatttccaccgatcgtctcttgagaatgaagagttgtagtggccgtagtcgtcggaaacatcacaaaaacattggcattgttcatctcaagcaggtttcatcttaccgagaaagcaagtctgatcatagaaagttttatatctttactgcaaccaagactctgcatctgaggactgattctagaagtgatagagcagcatggttacaagctttagcatctaccaggggcatagttcctctccagtcaattaatggggatttctccttcgtatcaccaaaggatttatccatatctaccgagagactaaagaaacggttgtttgaagagggaatgaacgagagtcttgtaaaagagtgcgagcagatcgtggattcagagttctgtgaagttcaagaacagattaaacttcttcacgaagagcggaaaaagttgcttgatgctttgaggcagctagagatggccaaccttgaagctgaagcctcagggatccatgacgatgtctaccaattaagaaatcacaagtattccagcttaggacgtggaaaatatagtgaatgcagtacaagtgcttcatctgatgataagcaagagtttgaggatatctctgaggaagacgaggcttccttccatgacacaaaggagtcatttggtgaacctgatgttggttctgtgctcacgcattttaagagacgaacaaagcttcctgatccagcagagaaagagagaggtgtcagtctctggtctatgatcaaagacaatgttggaaaggatctcacacgagtttgtcttcctgtttatttcaatgaaccaatatcttccctccaaaagtgttttgaagacttggagtactcttatctcttggaccaagcatatgaatacggaaaatccgggaagagtctccttagagccctcaatgtcgctgcttttgcagtctctggttatgcttccaccgaaggacgacactgtaaacctttcaaccctttgctcggagaaacatatgaagctgactttcctgaaaagggaattcgtttcttctctgagaaggttagccaccatccaacagttatcgcctgccattgcgaaggtaaagggtggaagttctggggcgacacaaacctccggtcgaagttttgggggagatcgatccaacttgaacccgttggaatcttgactctcgagtttgatgatggagaaattttccagtggagcaaagtaacaacaactatatacaatatcctacttggtaaactgtactgcgatcaccatgggataatgaaaatccgtggaaatcgccaatattcttgtatgttaaagttcaaggagcaatcgattcttgatagaaatccccaccaggttaatggttttgtagaagatgtaactggaaaaaaggctgcgacggtatttggtaaatggaatgatagcctttattatgttgctggtgatggaatcaacaaggcaagcgcctcattactgtggaaagcgacaaaggcaccacctaatgtcaccagatacaactttacatcattcgcgatgacgctaaatgaattgatacctggtttggaggaaaagctgcctccaacagattctaggctccgaccagatcaacgacacttggagaacggtgaatatgagaaggcaaatgaagagaaacaaagattagagagaagacaaagaatgtcacggcaaattcaggaaagtgggtggagaccgagatggttcgagcctcaaggagagagtgaaagctataagtatacgggcggttattgggaagcacgagatgttaaaagttgggatgattgccctaacatatttggagagttcaccgaagaggttgcagattgtgcttaa

SEQ ID NO: 1013 - DNA, 684 bp, Arabidopsis thaliana
atggcggagagatcaaattcagaggaagtgaagcttttgggaatgtgggcgagtccttttagtcggaggattgagattgctcttacgcttaaaggtgtttcgtatgagttcctggagcaagatatcacaaacaagagctctttgttgcttcaattgaatccggttcataagatgattccggttcttgttcataatggtaaaccgatttctgaatcacttgtgattcttgagtatattgatgagacttggagagacaatccgattcttcctcaagatccgtatgagagaactatggctcgattctggtctaaattcgtcgatgaacagatttatgtgacggcgatgaaagttgtggggaagaccggaaaagagagagatgctgtggttgaagcgacgagagatttgttgatgtttttggagaaagagcttgttgggaaagattttctcggtgggaaaagtttagggtttgtggatattgtggcgactttggtggcgttttggctgatgagaacggaggagatcgtcggggtaaaggtggttccggtggagaagttcccggagatacatagatgggttaagaatttgttgggtaatgatgttatcaagaaatgtattcctcctgaagatgagcatcttaagtacattagagctcgtatggagaaactcaatatcaaatctgcttga

SEQ ID NO: 1014 - DNA, 1662 bp, Arabidopsis thaliana
atggcgatcaaagaggagacggaggagagttgcggaagcagagccgtggtagcttcaataacgaaagaaagccctagacagcaccgtatgaaactggaggtgtacggtgaggttcttcaacgaatccaggaatccaattacgaagaagctaatttccctggttttgatgatctcctctggcttcacttcaatcgtcttcctgctcgatatgctttggatgtaaatgttgagagagcagaagatgtacttactcatcagagattgttgaaattggctgaagatcctgctactagacctgttttcgaagttcgttgtgtgcaggtttctcccacattgaatggaaattctggtgacgttgatccttcggatcctgcggtcaatgaagatgctcaaagctcctataactcgaggtctcttgcacctccaacttttggttcttctccgaatttcgaagctcttactcaagcttacaaagatcatgctcaagacgatgatagtgctgtcaatgcacagttgcctaattctcgaccgatgcacgaaatcaccttttctacaatcgacaggccgaaactccttagtcagctaacttccatgcttggtgaacttggattgaatattcaagaggctcatgctttctctaccgccgatggtttctctctcgatgtatttgttgttgatggctggtcgcaggaggatcaaccttgttcaaaacagaaatctatcactttctttgagcatgacaaatcaaccaacgagctgctacctgcgtgtgttgaaatacctacggatggaactgatgagtgggaaattgacatgaagcagctcaaaattgaaaaaaaggtggcatgtggatcatacggggaactatttagaggaacctattgtagtcaggaagtagctatcaaaattctcaagcctgagcgtgttaatgcggaaatgctacgagagttttctcaggaagtatatataatgaggaaagttcggcataaaaatgttgtccagttcattggtgcatgtacacgatcaccaaacctctgcattgtgacagagttcatgactcgggggagcatttatgatttccttcacaaacacaaaggggtttttaaaattcaatctttgctcaaagtggcactcgacgtctcgaaaggaatgaattatctgcatcaaaacaatattattcatagagaccttaagactgctaatcttcttatggacgaacatgaagttgtcaaagttgccgattttggtgttgccagagtgcagactgagtcaggggttatgacagcggaaacagggacataccgatggatggctccagaggtcattgagcacaaaccttatgatcacagggcagatgtcttcagctacgcgattgtgctgtgggaacttttgactggggaactcccatattcttacttgactccactgcaagctgctgttggcgttgtccaaaagggacttagaccaaaaattccaaaggaaacacacccaaaactgactgaacttcttgagaaatgctggcagcaagacccagctctaagacccaattttgcagaaatcatagaaatgcttaaccaactaatccgcgaggtaattgatttatcattgcataaggataaacatggtggttacttttcaggcctaaaaaaaggccatcgttga

SEQ ID NO: 1015 - DNA, 822 bp, Arabidopsis thaliana
atggcgaccaataatgattttggagctttcattgagaaagttacaatctctccaacttctacttcctcgtcgcctccttctctacagggtcttactttcgccattaaagacatttttgatgtggaaggacgcgttaccggttttggtaacccggattggttaaggacacactcggcagctacttctacagctccagtagtttcatctctcttagaagctggtgccacagctttgggtattaccattatggatgaaatggcttacagtataaacggagaaaatgcgcattatgggactccgagaaacccgattgctttcgatagagtgcctgggggatcatcgagtggctcagccgtagctgtagctgctcgtcttgtggatttttctattggaactgataccggagggagtgtacgagttccagcatcttactgtgggattttcggtttccggccatcccacggtgcagtttccactgtcggacttactccaatggctcagagcttcgacacagttggatggtttgctcgggacacagccactttgaaacgtgtaggttgcgttctcctgcagcagcatcacttgaaccccatcgaaccatctcaactgattatcgcggatgactgcttcaagctgtgtagtgtaccgcatgatctcttggtgcagcctctgaatgttccaagccttaaacatttcatgacaagtgacgatgtcactacacaacaagagttctgcattccgtctctcatggccctatcgagttcaatgagattgttacaaaggtacaacatttttctcattttacattctatcgatttctaa

SEQ ID NO: 1016 - DNA, 1143 bp, Arabidopsis thaliana
atgagtatggatttttcacctttgttaacggttcttgagggagatttcaacaaggataatacttcttctgcaacagaaattgatactttagagaacttagatgacactaggcagataagtaaaggaaaacctccgaggcacctcacaagcagtgctactaggctgcagcttgcagccaatgcggatgtggatgtttgtaacttggttatgaagtcacttgatgacaaatcagagtttctacctgtataccgatcaggaagttgtgctgagcaaggggcaaaacagttcatggaagatgaacacatttgcatcgatgatcttgttaatcatcttggtgcagctattcaatgctcttctcttggagccttctatggggtatttgatggccacggtggcacagatgcagcacactttgttagaaagaacattctgagattcattgtagaggactcctccttcccactatgcgtaaagaaagcaattaagagtgctttcttaaaagctgattatgaatttgcagatgattcttctcttgacatctcttctgggaccactgcgcttacagcttttatttttggacggaggttgataattgcaaatgctggtgattgccgagcagtactggggagaagaggtagggcaattgagttgtccaaagatcacaaaccaaactgcacagccgagaaagtaagaatagaaaagttaggtggagttgtgtatgacggttacctcaacgggcaactatcagttgcacgtgccattggagactggcacatgaaaggtcccaaaggctctgcttgtccgctaagcccagagccagagttgcaagagacagacctgagtgaagacgacgagttcttgataatgggatgtgatggtctgtgggatgtgatgagcagccagtgcgctgtgacaatagctaggaaggaactgatgattcataatgatccagagagatgctctagagagcttgtgagggaggcccttaaacggaatacatgtgacaatttgacagtgattgttgtgtgcttctctccggatcctccacagaggatagagatccgaatgcagtcacgggtgaggcggagcatatctgcggaagggttaaacctactcaaaggcgtgctcgatggctatccgtga

SEQ ID NO: 1017 - DNA, 1263 bp, Arabidopsis thaliana
atgttcggtagaggaccctcgaagaagagcgacaacactaagttctacgagatcttaggtgttcctaagagcgcttcaccagaagatctcaagaaagcttacaaaaaagccgctatcaagaatcatcctgataagggtggagatcccgagaagtttaaggagttagcacaagcttatgaagtgcttagtgacccggagaagcgtgagatttatgaccagtatggagaggatgcactcaaggaaggaatgggtggtggaggaggtggacatgatccatttgatattttctcatccttctttggtggaggcccctttggaggtaataccagccggcaaaggaggcagaggcgtggtgaggatgttgttcatcccttgaaggtatctcttgaggatgtgtaccttggtacaatgaagaagctttcactttctaggaatgctctctgctctaagtgtaacggaaagggatcaaaatctggagcctccttgaaatgtggagggtgtcagggatctggtatgaaggtgtctattaggcagcttggacctggaatgatccagcagatgcagcatgcatgtaatgaatgcaaagggacaggtgagaccatcaatgatcgggacaggtgtccacaatgcaaaggagacaaggtcattcctgagaagaaggtgcttgaagtgaatgtggagaagggaatgcaacacagtcagaagatcacatttgaaggacaagcagatgaagcgcctgacactgtcactggagatatagtgtttgtccttcagcagaaagagcacccaaagttcaagagaaagggagaagacctctttgtggagcacacactttctctaaccgaagctttgtgtggcttccaatttgttctgactcacttggatggcagaagtcttctcattaaatctaatcctggggaggtcgtgaaacctgattcatacaaggcaataagcgatgaaggaatgccgatataccagaggccattcatgaagggtaagctctacatccacttcacagtggagttcccggactcgttgagcccagatcagaccaaagcactggaagctgttctacctaagccgtcaacagctcagttgagtgacatggagatagatgaatgcgaggagaccacgctccacgatgtcaacattgaggatgagatgaggaggaaggcacaagctcaaagagaggcttatgatgatgacgatgaagatgatgaccatccgggtggtgctcaaagggtgcaatgtgcccagcagtaa

SEQ ID NO: 1018 - DNA, 465 bp, Arabidopsis thaliana
atggcgactcttcctctcccgactcaaacttctacaatctctctccctaaaccttatctctccaattccttctccttcccactccgtaacgcaacactctcaacaacaacaaaccgccggaactttctcaccaccggaaggatcatagctcgggcatataaagtggtggtagagcacgacggaaagacgactgaattggaagtcgaaccagacgagacgattctatctaaggctcttgactctggccttgacgttccctacgactgcaatctcggtgtttgtatgacttgtccagcgaaactcgtgaccggaacggtggatcaaagtggtgggatgctaagtgatgatgtggttgaacgtggctacacgcttctatgtgcttcgtatccaacttctgattgtcacattaagatgatccctgaggaagaactcttgtctctccagctcgccactgccaacgactaa

SEQ ID NO: 1019 - DNA, 7287 bp, Arabidopsis thaliana
atggcttctccgttggagtctcttctctccatctctggctctgtctctacaagctccactttaatcagactccggatcttccgccatgatatccccgagattctccagaattccgatatgacgtctgatattgcgcctgttatagttgacatgatattccaaacattggctatatatgatgaccgtgcctcacggaaagctgtagatgatttgattgtaaagggactgggaaatgttaccttcatgaaaacttttgcggccatgcttgttcaagttatggaaaagcagttgaaattttgttttgatacatcacaagctatctacagtttatatatggatgaagttaaaggttcacggattccgtacaaggatagccctgagttattaggactactgcttgagttctcttgttcgtctcctgctctatttgaacagtcaaaggccatatttgttgatatctatgttaaagatgtcctgaattctagagaaaagcagaaaccaaatcttagtaattgtttcaaacctcttcttcaacgcttgtcacatgaggaattccaaactgtcatccttcctgcagctgttaaaatgttgaagcgtaatccagaaattgtcctggaatcagttggatttctattagcaaatgtaaacattgatctaagtaagtatgccctggaactgctaccagttatactaccacaggctcggcatacggatgaagacaggcgtctaggagctttatcaatggttatgtgcttaagtgaaaaatcaagtaatcctgatactatagaagcaatgtttgcgtcagttaaagccataattggagtgcaagaactggcaagtgctcctgaaggaaagtatattggtagtttgtcgaggacgatatgcagctttctcatagcctgctacaaggatgaagcttcatgggcatcacgatcttctgttgccatccaaccaaacttagtatctttcattgctgccggccttaaggagaaagaagctctaaggagggggcatctccgctgtatatcagacttgctatcccctttaattcaacttgtaaagacgggatttacaaaggcagtacaacgtctggatgggatatatgcgctactgatcgtttccaaaattgctgcctgtgacatcaaagcagaggatactatggtgaaggagaaattatggactttgatatctcaaaatgagccttcacttgtgcaaattactttgggttttggaagcattttcattgaaatcactatcacaggtagcctaagcgagttcatgttttctgaaccgtttctccctttgcttctctttctgctttgccatccaagctggaatgttcgtaaaacagcttacaattctgttacgaagatcttcctcgcgacttcacagctagccactactcttttagacgagttctcggattttctttccataactggggaccaaatcgtttcttctagaaccagtgacgcagataatcccgcggatcatcaagctcctttcgtcccctctgtagaggtgttagtgaaggctttgattgtcatttcatcggcagcagttgctggacctccaagctcatggattgttcgtgccatattttgctcgcatcatcccagcatagttggtactggaaaaagagatgctgtttggaagagtctacttggaccaatgggtttaacgagtgctaaaactccggagcagcaagcggccgtatattccttgtccaccatgatgtctctggcaccagaggatacattcacagtgttcaagatgcatctacaagaccttccagatcgactgtctcatgatatgctctcagagactgacattaagatctttcatacacctgaggggatgcttttaagtgagcaaggtgtctatgttgctcagacaattggtgccaagtatacaaagcaggagccgagttctaatcattctctaaagaaaggattggctagtagagaaactgcaaactcagggagaagggacactgcaaagttgacaaagaaagctgacaaaggaaaaacggcaaaggaagaggcacgggaactgatgctcaaagaggaggcctcaacacgggaaaatgttcacaggatacaaaaaagtctttcgttggtgcttcatgcccttggggagatgggtcttgctaatcctgtgttttgtcacagccagttaccttttttggctacttttttggatccattgctgcgatcacctattgtaagtgctgcagcctttgaaaacttggtgaagcttgcacgttgtacagttcagccactgtgtaactgggctctagaaatttcaactgctctgcgtttgatcgcgattgatgaagttgatacttcatttgattttcgtccatcagttgacaaggctgggaaaacatatgagggtctttttgagaggattgtaaatgggttatcgatatcttgtaaatcaggaccacttcctgtagatacattcacgttcattttcccggttctatatcatgtgctaggtgttgttcccgcgtatcaagcatcagttggacctgcactgaatgaattgtgtcttggattgcaagcagatgatgtcgcaaatgcgctctatggagtctattcaaaagatgttcatgtcagactcgcctgcttaaacgctgtgaagtgtattccagctgtttccaaatgctcccttcctcagaatgttaaaatagcaacaaacatttggatagctctacatgaccctgaaaagtcagtggctgaatcagcagatgatttatgggcccgctatggtcatgatttggggactgattattcaggaatctttaaagcactttctcatataaatctcaacgtccgtttagctgcagcagaagcactggctgatgctcttcatgaaagcccgtcatcaatccagttatccctttcaactttattttctctgtacatccgtgatgctacgtctggtgaggatgtctttgatgctggttggataggaaggcaaggaattgccttagcactgcaatctgctgctgacgtattgacaacaaaggaccttcctgctgttatgacctttttgatatcccgcgcactggctgatcccaacacagatgttcgtggaaagatgatcaatgctggtatcatgattattgataagcatggcaaagaaaacgtttcattgctgttccccatctttgagaattatttaaataaagaggcatctgatgaagaggaatatgacttggttcgtgagggtgttgttatattcactggagcactagcaaagcacttagcaagagatgatcctaaagtacataatgttgtggaaaagctgttggaggtgttgaatacaccatcagaatctgtgcaacgtgctgtctcgacatgcctttctccacttgtgttatcaaagcaagaggaggcccctgccctttttttgaggctcttggataagctaatgaagagtgataaatatggtgagcgtagaggagcagcttttggtcttgcgggagtagttatgggctttggaatttctagcttgaagaaatatggtcttatagtcactttgcaagaagcacttattgacagaaattctgctaaacgtcgtgaaggagcattactcgcatttgaatgcctctgcgagaagcttggaaaattatttgaaccgtatgtgataaagatgttacccttacttctggtgtcgttctctgaccaagtcggagcagttcgcgaagcagcagaatgtgctgctcgagctatgatgtctcaactatctgcatatggtgtgaaacttgtccttccttctctactcaagggacttgaagataaagcatggagaacaaagcaaagcagtgtacagctcctcggtgctatggcattttgtgctcctcagcaactgtcccaatgtcttcctagggttgtgccaaaacttacagaggttttgacggatacacatccaaaagtccagtcagccgggcagttagcacttcagcaggttggaagtgtcataaagaacccagagatatcctctcttgtccccacccttctattggccttaacagatcccaatgagtacacacgccatgctcttgacacccttcttcaaacaacattcgttaattctgttgatgccccctcgcttgcactgttggtaccaatagtacatagaggattgagagaaagaagttctgaaacaaaaaagaaagcttctcaaattgtcggtaatatgtgttctttggtgacagagccaaaggatatgattccttacataggattgctccttcctgaggttaaaaaggttcttgtggatccaattcccgaagtacgttctgttgcagcaagggctgttgggtcacttattagaggaatgggagaggataatttcccagatcttgttccgtggctgtttgaaactctaaaatctgatacaagcaatgttgaaagatatggagccgctcagggattaagtgaggttatagcagctcttgggacagattactttgagaatatacttcctgacctcattcgtcattgttctcatcaaaaagcatcggtccgagatggataccttacgcttttcaagttcttgccaagatccttgggtgctcagttccagaagtacttgcagcttgttttaccggccattctggatggtcttgccgatgagaatgaatctgttcgtgatgcagccctgggggctggccatgtactggtggagcaccatgcaacaacgtctctgcctcttcttcttccagctgtggaggatggtattttcaatgataattggcgtatccgtcaaagttctgttgaactgcttggggatctattgttcaaggttgctggtacatcgggcaaagctctactggagggtggaagtgatgatgaaggtgcaagtactgaagcgcagggtcgtgccattattgatattttaggaatggacaagcgcaatgaagttcttgcagcgttatatatggtccggactgatgttagtttgtctgttcgtcaggcggcactacatgtatggaaaaccatcgtagcaaatacaccaaagacgttgaaggaaataatgccaattttgatgagtaccttaatttcttctttggcatcaccatcttctgagaggcgccaggtagcaggaagatcacttggagagctggttaggaagcttggtgaaagggtgcttcctcttatcattccaattttatctaaaggactgaaagacccagatgttgacaaaagacaaggtgtatgcattggcctgaatgaagtgatggcaagtgctggaaggagtcagttgctgagtttcatggatcagcttattcccacaattaggacagcactttgtgatagtgctctcgaggttcgggaatctgctggactagcattcagcactctgtataagagtgctggactgcaagcaatggatgagattattccaactcttttggaagccttagaagatgatgaaatgtctactactgccttggatggacttaaacaaattataagtgttaggacagcagctgttcttccacacatcttgcccaagcttgtccatcttcctctctctgccttaaatgctcatgctttgggagccttagctgaggttgctggtgctggttttaacacgcatcttgggaccatacttcctgctttgctctctgcaatgggaggtgaaaacaaggaagtccaagaattggcacaagaggccgcagagagagtggtgcttgtcattgatgaagaaggcgttgagactctattatcagaacttctcaaaggagtgtctgatagtcaggcttcaattagaagaagttctgcatatctgattggttacttcttcaagagtagcaagctttacttaattgatgaagctccaaacatgatatctaccttgattgttatgctcagtgattctgattcaacaacggttgcggtttcctgggaagctttggctagggttattggttcagttccaaaggaagtacttccttcatatataaaacttgtacgtgatgctgtatctacagctagggacaaagagcgcaggaagcgtaagggaggatatgttgttattcctggtctatgcctccccaagtcccttaagccattacttccagtatttctacagggtctaataagtggatctgctgaactaagagagcaagctgcaattggtcttggtgaacttattgaagttactagcgagcaagctttgaaggagttcgtcatacctataacagggcctcttattcgaatcattggagaccggtttccatggcaagtcaaaagtgctatcttggctacattaatcatcctaatacaaaggggtgggatggcgctaaagccattcctccctcaactgcaaacaacatttgtcaagtgtctgcaagactctacaaggaccatccgttctagtgctgcggttgccctgggaaagcttagtgcattaagcacaaggattgacccattagttggtgatttgatgacaagtttccaggctgcagattctggggtacgtgaggccatcctatctgcaatgagaggtgtaataaagcatgctgggaagagcattgggcctgctgttagagtacgcatttttgatctcctaaaggatctaatgcaccatgaggatgaccaagttcgaatatctgccacaagcatgctgggtgttttatcacagtacttggaagctgcacaactcagtgttctgcttcaagaggtcaatgatttatctgcttcgcaaaattggggtgctaggcatggctcagttctctgcatttcatccttgctgaaacacaatccttccaccattatgacgtcatcgctcttttcctctatgttaaattctcttaagagctctttgaaggatgagaagtttccattacgtgaaagctcgacaaaggccttgggaaggcttttgctaaaacaacttgcgacggatccttccaacacaaaagtggttatcgatgtcctttcatcgattgtctcagctttgcatgatgattcgagtgaggttcgaagaagagcactctcttcacttaaagcttttgcaaaagataatccatcagcaaccatggcaaatataagtgttatcggacctcctctagctgaatgtttgaaggatgggaacacaccagtgagacttgctgcagaaagatgtgctttgcacgtgttccaattaacaaaaggcgcagaaaatgttcaagcagctcaaaaatacattacaggattggatgcccgacggttatccaagtttcctgaacaaagcgatgacagtgaaagcgatgatgataatgtaagtgggtag

SEQ ID NO: 1020 - DNA, 1374 bp, Arabidopsis thaliana
atggaatctgaaagactcgaatcacatcttctgaataagcaagaagaagaagcttcttccttcacttctggtcttcttctcagcacatccgtcgttgtcgctggatccttctgttatggctgcgccatgtcatattcgtcgcctgctcagtccaaaatcatggaagaactgggactttccgttgcagattattcgtttttcacttcggtaatgacattaggaggaatgattaccgccgtgttcagcggtaaaatctctgctctcgttggtcgtcgacagacaatgtggatctcagatgtttgctgtatttttggttggctcgctgtagcgtttgcacatgatattataatgcttaatactggacgactcttcttggggtttggggttggtctcattagttatgtggttcctgtgtatatagcagaaattacacccaaaacatttcgtggaggattttcttattccaatcagcttctacaatgtcttgggatttcactcatgttcttcaccggaaactttttccattggcgaacattagctcttttaagtgcaatcccaagtgctttccaagtgatatgtttattttttattcctgaatctcctagatggctggcgatgtatggtcaagatcaagagcttgaagtttcgttgaaaaaactaaggggagaaaatagtgatattctaaaggaagctgctgaaatcagagaaacagtggaaatatccagaaaagagtctcaaagtggaataagagacttgttccatatcggaaacgcacattcgttaatcattggattgggtttaatgctcttgcaacaattttgtgggagtgcggcgataagtgcttatgctgctcgaattttcgacaaagccggttttccaagcgacataggaacaaccatcctcgcagtgattctgataccgcaatctatagttgtcatgttaaccgttgaccgatggggacgccgaccacttcttatgaaaaataaaagagtattatttaattatgttttcctcggtgagcagaagaatggtgaatttcagaagttatgttccgttatgttaatcgtcggtttagtgggttatgtctcatcctttggcattggcctaggtggattaccatgggttataatgtctgagatatttccggtgaatgtgaaaatcaccgccggtagccttgtaacgatgtcaaattggttttttaattggattatcatctatagttttaatttcatgatacagtggagcgcttccggaacatatttcatattttctggagtttctctggtgacgatcgtattcatatggacattggtgcctgagacgaaaggccgaacactcgaagagattcaaacatcattagtccgactttcgtaa

SEQ ID NO: 1021 - DNA, 1176 bp, Arabidopsis thaliana
atgttctcacatgggtcattgcccttcttgtccatgacgggaatgtccagaaatatgcatcctcctcgcagaggatctcgcttcactgttagagctgatgcagattactattcggtactcggagtttcgaaaaatgcaaccaaagctgagattaaaagcgcttatcggaagctggctaggaattaccatccggatgtgaacaaggatcctggcgcagaagagaaattcaaagaaataagtaacgcatatgaggttttatcagatgatgaaaagaaatctctttacgataggtatggtgaggccggacttaaaggcgctgctggatttggcaatggggattttagtaatccgttcgatctattcgactcattattcgaaggcttcggtggtgggatgggtagaggttcaagaagcagagctgtggatggtcaagacgagtattacacgctaatcttaaacttcaaagaagcggttttcggaatggagaaagaaatagagatatcccggctcgagagctgtgggacatgtgaaggttcaggtgcaaaacctggaaccaaaccgaccaaatgcaccacgtgtggcggacaaggccaagtggtttcagcagctagaactcctctgggcgtgttccaacaagtcatgacttgctcgtcctgtaatggcactggagagatctcgacgccgtgtggtacttgctctggagacggacgcgtgaggaagacaaaacggataagtctcaaagtaccagccggggttgattcaggtagccggttgagagtgagaggagaaggcaatgccgggaagagaggcggatcaccaggcgatctgtttgttgttatagaagttatcccagacccgattttgaaacgagacgatacaaatattctctacacttgcaagatatcgtatatcgatgcgattttagggacgacactgaaagtaccaacagtggatgggacagtagatttgaaagttccagctgggacacaacctagcacgacgcttgtgatggcgaaaaaaggagttccggtattgaacaagagtaatatgagaggagatcagttggtgagagtacaagtggagatacctaagagattgagcaaagaggagaaaaaacttattgaagagcttgctgatatgagcaagaacaagactgctaatagcaccagtagatga

SEQ ID NO: 1022 - DNA, 585 bp, Arabidopsis thaliana
atggaacgtgacgactgccggagatttcaggactcgccggcgcagacgacggagagaagagtgaaatataaaccaaagaagaaaagagccaaagatgatgatgatgagaaagttgtttcgaagcatccaaattttcgaggtgtcagaatgagacaatggggaaaatgggtgtccgaaatcagagagccaaaaaagaaatcaagaatctggctcggtactttctccacggcggagatggcggcgcgtgctcacgacgtggcagctttagccatcaaaggcggttctgcacatctcaacttcccggagctcgcttatcacctccctagaccagctagtgccgaccctaaagacatccaagctgccgccgccgcagctgcagccgctgtggccattgacatggatgtagagacgtcttcgccgtcgccatctcccacagttacggaaacgtcatctccggctatgatagcactctccgacgacgcgttctccgatcttcctgatctcttgctcaacgtgaaccataacatcgatggcttctgggactcttttccctatgaagaacccttcctctctcaaagttactag

SEQ ID NO: 1023 - DNA, 885 bp, Arabidopsis thaliana
atgtggttttttggatcgaaaggagcatctggattctcgtctcgttcaactgcagaggaagtcacacatggtgttgatgggactggtctcactgccatagtcacaggagcatcaagtggtataggagtagagacagcgcgtgttctttcactgcgtggtgtgcatgtggttatggcggtgaggaacactgactctggtgctaaagttaaggaagatattgtcaagcaagtccctggagctaaactcgatgtcatggagttagatctcagctcaatgcaatctgtcaggaaatttgcgtctgagtacaaatctactggtcttccactcaacctcttgatcggttttgatttattgatggttaatgttttgaattgtcttaatcttgtaagcaacaatgccgggattatggcatgtccttttatgctctctaaggacaacatcgagctgcaattcgcaaccaatcatttaggtcattttctgttgactaaacttctgctagatacaatgaagagcacatcacgtgaaagcaaacgagaaggaagaattgttaacctatcatcagaagctcatcggttctcgtatccagaaggagttcgttttgataagatcaatgacaagtcaagttacagtagtatgcgagcttatggacaatctaaactctgcaatgtgttgcacgccaacgagcttacaaagcaactgaagggagcggcaacaacttgctatgtggcattgaatcctcaagttgcaggagtttcaggggaatacttccaagatagcaacattgctaaaccattaccacttgtcaaagatacagaattggccaagaaggtttgggatttcagcaccaagcttaccgattcacaatcaggagaaagcagttcttga

SEQ ID NO: 1024 - DNA, 264 bp, Arabidopsis thaliana
atgggtcagatccaatactccgagaaatacttcgatgacactttcgaatacaggcacgtcgttcttcctcctgaagtcgctaaacttcttccaaagaatcgtcttctctccgaaaacgaatggcgagcgataggagtgcagcaaagccgcggatgggtacattacgcggttcatcgacctgagccgcacataatgctattcaggaggcctcttaactatcagcagcagcaggagaatcaagctcagaacatgcttgttaagtga

SEQ ID NO: 1025 - DNA, 783 bp, Arabidopsis thaliana
atggataaaaggtggagtctccaaggtttgactgctcttgtgaccggtggagccagcggaatcggtcatgctatagtagaagaactcgccggttttggggccaaaatccatgtgtgtgacatatcgaaaactctgctcaatcaaagtttatccgaatgggagaagaaagggtttcaagtgagtggttcagtctgcgatgcatccaatcgtctcgaaagagaaacacttatgcaaactgtcaccacaatatttgatggcaagcttaacattcttgtgaacaatgttggcacaattcgcacaaagccaacaatagaatatgaggcagaagatttttcgttccttatttcaacaaacttggaatctgcttatcatctaagccaactttcacatccactcctaaaggcttcaggcaacggaattattacttttatttcctctgctgcagggatcgtatcatttgatgctgcatccatttatggtctaacgaaaggagctttgaatcagctagcacgaaatttggcgtgtgaatgggcaaaagacggcattcgagccaacgcggttgcgcctaattttatcaccactgctctggctaaaccttttctcgaagacgctggttttaacgagattttgtcgagtagaactccacttggtcgcgctggagaaccaagagaggttgcctcacttgtggcttttctgtgtctacctgctgcttcatatattactggtcagaccatttgtgttgatggaggtctcactgttaatggcttctcatatcagccatag

SEQ ID NO: 1026 - DNA, 1602 bp, Arabidopsis thaliana
atgaagagagatcatcatcatcatcatcatcaagataagaagactatgatgatgaatgaagaagacgacggtaacggcatggatgagcttctagctgttcttggttacaaggttaggtcatccgaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccactacagcgacggctgagtcaactcggcatgttgtcctggttgactcgcaggagaacggtgtgcgtctcgttcacgcgcttttggcttgcgctgaagctgttcagaaagagaatctgactgtagcggaagctctggtgaagcaaatcggattcttagccgtttctcaaatcggagcgatgagaaaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattag

SEQ ID NO: 1027 - DNA, 996 bp, Arabidopsis thaliana
atggaggcttctaaagaagctcatcaccttccaaactacatgaaagacgacaacgttagtcaagaaaccaagaacttgatcacttctctaccttcagacaaagatttcatgggttatggtctctacaactacaaaggttgttggtactatccaaacacactccaagccgttcttgacgtccaaaaacacttcaagccacgagatactgatataatcctcgcttctttgcccaaaggtggaaccacttggctcaaatccctaattttcgctgttgtacatagagaaaagtaccgcggaacccctcaaacacatcctttgctcttacaaaaccctcatgaccttgtcccatttcttgaggttgagttatacgctaatagccaaattccggatctcgcaaagtattcttctcctatgatcttttctacacacatgcacttacaagcattgcgtgaagccaccacaaaagcttgcaaaaccgtatatgtgtgtagaggtatcaaagatacgtttgtctccggctggcattatagaaacatgttgcatcgcaccaagatggatcaagccacttttgagctcatgtttgatgcttattgtagaggagttctcttatatggaccttattgggaacatgtattgagctattggaaagggagcttggaagcaaaggagaatgttcttttcatgaagtacgaagagataattgaggagcctcgtgttcaagtcaagagactcgccgagttcttggaatgtccattcaccaaggaagaagaagaaagtggatcggtggaggagatcttgaagttgtgtagtttacgaaatttaagcaatttggaggttaataagaatgggacaacgagaattggtgtagattctcaggtgttctttaggaaaggtgaagttggtgattggaagaatcatcttacgccacaaatggcgaaaacctttgatgagattattgactatagactaggagactccggtttgatatttcaataa

SEQ ID NO: 1028 - DNA, 1842 bp, Arabidopsis thaliana
atgaagtctcttaatgatcttcctgcgcccaaatcaaccactaccacgtattatgatcattctaatgatgcttggttcaaaaaccgagtcactgaatccgagacggtgaaatcctccagtatcaaatttaaagtggtgcctgcttacctgaatcgtcaaggtttacgtccgaagaatccagaggattttggcgatggtggtgctttcccggagattcatcttcctcagtatcctcttcttatgggtaagaataaatccaataagcctggagctaagactctccctgttactgtcgatgctcagggaaacgtggtctttgacgctatagtgaggcagaatgagaactcgaggaagattgtttattctcagcataaggatattattccaaagtttctgaaaaacgagggagacttgggtactgttgttgatgaagaggaggaattgcagaaggagattcaggagactgctgaagaaacgaaagctgccattgagaagattgtgaatgtgagactgagtgcagcgcagcctagtaatatagcaaggcaatcgggagattcacagtacattaaatataagccatcccagcaatcttctgccttcaattctggtgctaaagagaggatcattaggatggtggagatgcctgtagatccacttgatccaccaaagttcaagcacaagagagtcccaagggcttctggttctccgcctgttccggtcatgcattcaccgcccaggcctgttaccgtcaaggaccagcaagactggaaaatccctccttgtatctccaattggaagaatccgaaaggttacacaatccctcttgacaaacgtctagctgctgatggaaggggcctacaagacgttcagatcaatgataactttgccaagttatcagaggccctctatgtagctgagcagaaagctagagaggctgtttcaatgcgttccaaggtgcaaaaagagatggtgatgaaggacaaggaaaggaaagagcaggaattgagggctcttgcccaaaaagctcgctccgaaagaaccggtgctgctatgagtatgcctgtctcatctgacaggggtaggagtgaaagtgttgacccaagaggtgattatgacaactatgaccaggatagaggaagggaaagagaaagggaagagcctcaagagacgagggaggagagggaaaaaaggattcagagagaaaagatacgagaagagcgtcgcagggaaagagagagggagagaaggttggatgccaaagatgctgccatggggaagaagagcaagatcaccagagacagagaccgtgacatcagtgagaaagttgctcttggaatggcatctactggaggaaaaggtggtggtgaagttatgtatgatcaacgtctgtttaaccaagacaaaggaatggactctggtttcgctgctgatgaccaatacaacttatacgacaaaggcttgttcactgcacaaccaactctttcgactttgtacaagccaaagaaggataacgatgaagaaatgtatggaaacgctgatgagcagctcgataagatcaagaatactgagaggtttaagcctgacaaagctttcacaggggcttcagagagggtgggtagtaagagagaccgacctgttgagtttgagaaggaagaggaacaagatcctttcggtcttgagaagtgggtttctgatttaaagaagggtaagaaacctttggacaagatcgggtctggtggaactatgagagcaagtggcggtggtggtagctcttcaagggacgatgaccacggcggttctggtcgaaccaagatcaatttcgaacgcagtgaccggcgttaa

SEQ ID NO: 1029 - DNA, 768 bp, Arabidopsis thaliana
atggaagcaggtggcgcgtacaatccacgcactgttgaagaggtgtttagggattttaagggtcgtagagctggcatgattaaggctttaaccactgatgttcaggagtttttccgactttgtgatcccgaaaaggagaacctttgcctttacggacatccaaatgagcactgggaagtgaatttgccagctgaagaggttcctcctgagctcccagagcctgtcttgggtatcaattttgccagagacgggatggcggaaaaggattggttgtcccttgttgctgtccacagtgatgcttggcttcttgctgttgctttcttttttggagccaggtttggatttgacaaagctgataggaagaggcttttcaatatggtgaatgacctcccaacaatctttgaggttgtagctggcactgctaagaaacaaggaaaagataagtcctctgtttccaacaacagcagcaacagatccaaatcaagctccaagcgaggatctgaatcccgtgccaagttctcaaagccggagccgaaagatgatgaggaggaggaagaggaaggtgtggaagaggaggatgaggatgagcaaggtgaaacacagtgtggagcatgtggtgagagctatgcagctgatgagttctggatttgctgtgacctctgtgagatgtggtttcatggaaagtgtgttaagataacaccagcaagagctgagcacatcaagcaatacaagtgcccttcttgcagcaacaaaagggctcgttcctaa

SEQ ID NO: 1030 - DNA, 4218 bp, Arabidopsis thaliana
gatggagaagcaagatcaaacaagcagagaagagattctgaagaagataatggattcattgggacaagacggtgtaccttcaaaaaccgtcctcgttggtgaagctggtatagggaagacatggcttgcaaaagaagtcagccaacgtgttactcaagaaaagtacaatgtcctctggttacacctgaacaaaaagattgaagacgagaagtcgctttacgagattctagctgctcagttgtcgataatttacgagtttgaagaaggcgaagaacctgatgagcttgattatccattggagagcttgaaagagaagattaaagaagagatgatcaaacacaagaaggataatcttctgttgattttggatgatgaaggaagtatgacaactgaagaagatgtgatgcaagaattaaacctccaagattttcttaaggagtactcggctgtgaagattctagtcacaagaagagatgaaagagaggagaaagaatccacaacgatcaaagtcggtccgcttacagaaaaggagtcattggacttactccacgatgccgaggacttacttacatcatttacctctgaagattggcctgttctgctaaagagactttgcgataacaaagagatcaaagaacctactttgatgtcttgcattttaagcaagagcaagggcttaccagctgcgatcgttgtcttaatcaagtctttaaacagcattaagtcgatgtctgcgaagcagaggaagatctttaaagaactgattctatcttccaagtcattagatgaagcagctgcttccaagaacgctatagatcgcagccgctacaatcctgtcttgcaattaagctacgagctgttaaagcctgacgagacggtcaaacgtccggtgattgcttgcttttggcatatcttggacttctacaagtactctggatgcgcttactaccgtgacctaatagtgcattggatgcttgaagggtattttgatccggttaagtcagttgacaaagcttaccaagaaggacattccattttaatggactttatgaacagaggaatcttgaaaatacaagaagacaacatggtggttccagagttctccatgagcaacctattagatcttcaagattgtggattctttggaagatcttctcttggatttgacagagtttacggtggagacaagagaaaggggctagggaaaatcatcttgatcgatgatatgatacagacaattcaatcgaagaagaagaatatcacgacgattatcgctagcggaaaccgtttacgtagagaggttcatgggaagttctttgagaaaccagagatgcaagatcttgaagttgtagtcctctttgagccaacgttccatgaacttgttctgtctttatctaagctaaagaaactccgagtacttgttatcagagactgtgatctaatcgataacatcgataagctcagtggtcttcaaggcctacatgttcttgaagtctctggtgctagctctctagttaacatccctgatgatttcttcaagaacatgactcagcttcaaagccttaatctttcgggacttgcaatcaaatcttcgccttccacaatcgaaaagctaagcatgcttcgttgcttcatcctaaggcactgctctgagctacaagatctgcctaacttcattgtggaaacaagaaaacttgaagttattgacattcacggagctaggaaacttgagtcttactttgatagagttaaagattggaaggactataaaggcaagaacaagaactttgctcagcttcagctgcttgaacacctagacttctcagagactaaaatcatccgtctgccgatatttcatctcaaagactctactaacgatttcagtactatgccaatcttgacccggctcttgctgagaaactgtacaaggcttaagagattgccacagcttaggcctttgactaatcttcagattcttgatgcatgtggtgctacagacttagtggagatgcttgaagtgtgtttagaggagaagaaagagcttaggatcctcgatatgtcaaagacaagtcttcccgagttagccgacacgattgctgatgttgtcaatctcaataagcttctgttaaggaattgctcactgattgaagagcttccaagcattgagaaactgacacaccttgaagttttcgacgtttctggttgcattaagttgaagaatatcaatggatcctttggggagatgtcttacctccatgaagtgaatctttcagaaactaatcttagtgagttacctgacaaaatctcagagctatctaaccttaaggagctcatcataagaaaatgttccaagctaaagactcttccaaaccttgagaagctaacaaatcttgagatcttcgatgtttcgggctgcaccgagttggaaacaatcgagggatcattcgagaatctgtcttgcctccacaaagtgaatctttcggaaactaatcttggtgagttacctaacaaaatctcagagctatctaacctcaaagagctcatcctaagaaactgttctaagctaaaggctcttccaaatcttgagaagctaacacatctagtgatcttcgatgtttcgggatgcaccaatctggataaaatcgaggaatcattcgagagtatgtcttacctttgcgagagcatcctctgttcttcaaaacgtattgttctcgcggattcgagttgtatagagcgagaccagtggagccaaataaaagagtgtttaacaagtaagtcagagggctctagcttctctaatgtaggggaaaaaacccgcgagaaacttctttatcacggcaatagatacagagttattgatcctgaagttcctttgaatatcgatattgttgacatcaaaagatccactgatcttaaaacagagtatatagccaaagcagagtatgtctctatagcagagaatggatccaaaagcgtatcttctctcttcgacgagttgcagatggcatcggtaaaaggttgttgggtagagaggtgcaagaacatggatgttctcttcgaatcagatgaacaactagagaaagagaaatcatcatcaccatcattgcagactctttggatctcaaatcttccattgctaacaagcttatacagtagtaaaggaggattcattttcaagaaccttaagaagctaagcgtagattgttgtccaagcatcaaatggctattcccggagattcctgataaccttgagattcttcgtgtgaagttctgtgataagttggagagattgtttgaagtaaaagcaggagaattatcgaagcttcgtaagcttcaccttcttgatttgcctgttttatcagtacttggagctaatttcccgaatctggagaaatgcacaattgagaaatgtccgaaattgaaagctagagaagatgaaccgaggattggagcaaggattacagatgaaatttcagaggatcaacctcacaggaatactattgggcctgaaacccaaactcctacccagcccacaaaagctacagacacgatctttcgaatagttattcctgattggaacttgatggaaccaagaaatcaaaagactttccgtcctaagaagagcgcaccatcaggaaccaagggagcagagcttcgaaagcatatagatgcaactttaggtagtggtaatcttagagaagccgtcaaacttcctccgggagaggatttaaacgaatggcttgcagttaacgctgtggatttcttcaatcaggtgaatctgttatttggtacacttaccgagttttgcaccccggagaactgttctacaatgactgctggtcccaggtacgaatacagatgggccgatggtgtacaaatcaagaagcctattgaggtttcagctccaaagtatgttgaatacttgatggattggatcgagacacaactcgatgatgagaccatatttcctcaaaaacttggtgcagcttttcctccaaacttcaaggaagtggtgaagacaatctttaaacgactattccgagtttacgcacacatataccactctcatttccagaaaatagttagtctcaaagaggaagctcatctcaacacttgcttcaaacacttcatcctcttcactcaggagtttgttctcattgacaagaaagaactcgctcctcttcaagaactcatagaatctatcattgcaccttacta

SEQ ID NO: 1031 - DNA, 591 bp, Arabidopsis thaliana
atggccggagttttcaaaacggttacgtttcttgttttggttttcgctgccgttgttgtcttcgcggaggactacgatgttggtgatgatacggaatggacgagacctatggaccccgagttctatactacttgggctaccggtaaaactttccgtgtaggcgacgagctcgaatttgatttcgctgctgggaggcatgatgtggcagttgtatcagaagctgcatttgaaaactgtgagaaagagaaacccattagccacatgaccgttcctccggtcaaaattatgctaaacaccactggaccacaatactttatctgcaccgtcggtgaccattgtcgttttggtcaaaaactttccatcactgtagttgctgctggtgcaactggaggtgctactcctggtgccggtgctaccccagcacctggatcaaccccaagtactggaggaaccactcctcccactgcgggtgggaccacaacaccttcaggctctagcggaaccactactccagctggaaatgccgcttcctcattaggtggtgctacttttctggtcgcttttgtttctgctgttgttgctctcttttga

SEQ ID NO: 1032 - DNA, 462 bp, Arabidopsis thaliana
atgggtgttcttgatcatgtctctgaaatgtttgactgctctcatggtcacaagattaaaaagcgcaaacagttgcagacggtggagattaaagtgaaaatggactgcgaaggttgcgagcggaaagtgcggcgttctgtcgaaggcatgaagggtgtgtcttctgtgacgttggagcccaaagcccataaagtcactgtagtcggctacgtcgatcccaacaaggtggtggctcgaatgtctcacaggaccggcaagaaagtcgagctctggccatatgtgccctacgacgtggtcgctcatccttacgctgccggtgtctacgacaagaaggcaccctccggttatgtccgaagagtcgacgaccccggagtgtcgcagctggctcgtgctagctccaccgaggtccgctacaccactgcatttagcgacgagaacccggcggcttgtgtggtcatgtga

SEQ ID NO: 1033 - DNA, 426 bp, Arabidopsis thaliana
atggagtctgagaaaaagatagctcatgagatcggtggtgtcaaaaacgacgctcttcgatttggtcttcacggcgttaagagcaacatcatcggatctcacccactcgaatcgtcatacgaatctgaaaagaaatcgaaagaggcgttgaagaggacggtcattgcgcatgcctacgggactgcacttccgttgaagatggatatggataggcaaattctctcaaggtttcagagacctcctggaccaattccgtcgtcgatgctcggtttagaagtctacacgggagctgtggatgactttggttttgaggattacttgaatgatcctcgtgattccgagacattcaagccggtagacttccaccacgggatggaagttcgtcttggcatctcaaagggaccgatttacccaagtttcatgtaa

SEQ ID NO: 1034 - DNA, 1071 bp, Arabidopsis thaliana
atggcgacaattcagaagcttgaagaagttgcaggcaaagatcaaactctaagagccgttgatctaaccatcatcaacggcgtcagaaacgtcgaaacttcaagacctttccaagtaaatcccacagtgagtctcgagcccaaggcggagccggtgatgccgtcgttttcaatgtctttagctccaccgtcttcgacaggaccaccattgaagagagcttcgactaaagaccgtcacacgaaggttgaaggaagagggagaaggatacggatgcctgccacgtgtgcggctaggatttttcaattaactcgagagttaggtcacaaatccgacggcgaaacgattcggtggttgttggagaacgctgagccggcgattatagccgccacgggtacgggaacggttcccgccatcgccatgtcggttaacggaaccttaaaaatcccgacgacgacgaacgctgattctgatatgggtgaaaatctgatgaagaagaaacgtaaacgaccttctaacagtgagtatatagacataagcgacgccgtttcagcttcctccggtttagctccaattgccacgacgacaacgatccaacctccgcaagctctggcatcatccactgtggctcagcaacttctgccgcaaggaatgtatccgatgtgggctattccatcaaacgcaatgattccgacggtcggagctttcttcttgattccacaaatcgctggtccgtcgaatcagcctcagttattagcttttcccgccgccgctgcttcgccgtcgtcttacgtcgccgctgttcaacaggcttccacgatggctagaccacctcctttacaagttgttccaagcagcggctttgtatccgtttcagacgttagcggttcgaatttatcaagagcgacgtcggttatggctccgagctcaagctcaggcgtaacaaccggtagttcatcgtcaattgcaacaacaacgacgcacacgctgagagacttctccctagagatatacgagaaacaagagcttcaccagttcatgagcaccacaacagcacggtcatcgaaccactga

SEQ ID NO: 1035 - DNA, 1083 bp, Arabidopsis thaliana
atgaagaataacaacaatggcgacgttgtggataacgaagtgaacaaccggttaagccggtggcatcacaattcttcccggataattagggtttcacgagcttccggtggtaaagatcgacacagcaaagtcttgacttctaaaggaccacgtgaccgtcgtgtccggttatcagtctccaccgctcttcaattctatgatcttcaagatcggttaggttatgatcaacctagcaaagctgttgaatggttaatcaaagctgctgaagattcaatctctgagcttccttcactcaacaacactcattttccgaccgatgacgagaatcaccagaatcagacattaacaacagttgctgctaattccttgtctaaatctgcttgtagtagcaattcagacacgagcaagaactcttctggtttgtctttatcaagatcggagcttagagataaagctagagagagggctagagagagaacagctaaagagaccaaggaaagagatcataaccacacttcgtttacggatttgttaaattccggttcagatccggttaactcaaaccggcaatggatggcttcagctccttcttcatctccaatggagtatttcagttcgggtttaattctcgggtcgggtcaacaaacccatttccctatttcaacaaattctcatcctttctcatcaatctccgatcatcatcatcatcatcctcatcatcagcatcaagagttttcattcgttcccgaccatttgatatcaccggcagaatccaacggcggagcattcaatcttgattttaatatgtcaacaccctccggcgccggagctgccgtctccgccgcatcaggtggtggcttcagtggtttcaacagggggacccttcagtccaattcaacaaatcagcatcagtcattcctcgctaatctacagaggtttccaacatcagaaagtggaggaggtccacagttcttattcggtgcactgcctgcagagaatcaccaccacaatcaccagtttcagctttactatgaaaatggatgcagaaactcatcagaacataagggtaaaggcaagaactga

SEQ ID NO: 1036 - DNA, 1263 bp, Arabidopsis thaliana
atggagattttctactacttggtgtttggggttttgggtctcgtcgtcgcggcgttggagcttagcaagaacaacaaggatcgaatcaacacttcttcagctttcaattctttcaagaacaattatctccttgtctattcgctcatgatggcgggtgattggttgcagggtccatatgtgtactatctttatagtacttatggatttggtaaaggggacattggacagcttttcattgctggttttggttcctctatgttgtttggtaccatcgttgggtctctagccgacaaacagggtcgtaagagggcatgtgttacctattgtattacctatatattgagctgcatcaccaagcattctcctcaatataaggttttgatggtaggccgtgtcttgggaggcattgctacttcccttctgttttcgtcatttgaatcatggctagttgctgagcacaataagaggggctttgagcagcaatggctgtctgtgacattttcaaaggcagtgttttttggcaacggtctcgttgcaattatcgctggattgtttgggaacctgcttgttgataccttctctcttgggcctgttgcgccatttgacgctgctgcatgctttcttactattggaatggctgtcattctatcatcatggacagaaaactatggagatccatcagaaaacaaggacttgcttacccagttcagaggtgctgcagtggccattgcctctgatgagaagatagcactattgggtgctatccagtcgctctttgaaggatctatgtatacttttgtattcctctggactcctgctctaagtccgaacgatgaggagattccccatggtttcatttttgcaacatttatgctagcttcgatgctaggcagttcccttgcatctcgtctgttgtctcgttcaactcccaaagtagagagctacatgcagattgttttcctagtttccggtgctgcactattgcttccaatattaatgactgcgtgtgtaggactgttttggccatccataatgaagatgagatcccaatacatcccagaagaagccagaagcacaataatgaactttttccgcattcctctgaatatctttgtctgcgttgtattgtacaataaacaaatgactggacaccccttgaagaaagaaacacagaagaagatcccctcaacatatgatgaattaactatacatatgcacattctggattcagtaatggagacagatagaagaagaggactttaa

SEQ ID NO: 1037 - DNA, 1209 bp, Arabidopsis thaliana
atggcgtcttcttccacctttctggaattaactccatttcaatggaatcaacctctcccatacacacaacgaccccatcatcgtactgttcttctctactccaaacctcaaaggagatcaaattcgattcgtctccaaatctccgtcaaatacaagcaatcaacatcttcttcagatccagatttgagatccaatttcaatccatttgaacaaatcgcgattcaggtcaaaaaagcgttagattcgttgaagaaacctgctatagctgcggttttacttggtttgcttttgttctatgatcctaattcggctttagctgcgtctggtggtagaattggtggtaattccttctcgtcgaggtctcggagctcttcttcttcttcttcgcaatcgtattctgtgccgagaacatcgaatccgagcttttcgtactctgctaggaccgctccgtactatggaccgtcacctttcggtgggggttttgtgggcccggcggttggttttgggtttggtggtttttcgagcttctccttgattttggttggtttcgctgcgtttgttttggtctctggattcctctcagatcggtcacaggatgatagcattttaacagatactcagaaaactagcgtcattaagctacaggtggggttgcttggtttggggaggacactacaacaagattttaatcgtcttgctgaaagttcggatacatccacaccggagggtctgagctatgttttaaccgaggcaacattagctttgctgagacaccctgattactgcatctcttgttattcatcagtaagtatactggtggatgtgaagccgagtatagaaaagggagagaagcgatttaatcaactctccattgaagaacgaggaaaatttgatgaggagacacttgttaacgtgaatagcataaagagacaaagctcgaagattcggaaagctagcggtttcagcaatgaatatattgtgaaaagtgttgtacatgttcaggtaaccatcttgatggctgcagagggtatacataaactgccaccaataaacggaactacagatctgaaggaagccttactgaaactcgggtcaataccaagaaacaaaataatggcagtagaagtactatggacaccgcagaacgaagccgacgcattgtcagaaagggaactacttgaagattacccacttttgaggcctttgtaa

SEQ ID NO: 1038 - DNA, 1071 bp, Arabidopsis thaliana
atgacggaggcgatgataagaaataagccaggaatggcgagtgtgaaggatatgccgctgcttcaggatggtccgccaccgggtgggttcgcaccggtccgatatgcccgccggatatccaatacgggtcctagtgcaatggccatgttccttgccgtttctggtgcctttgcttggggaatgtaccaggtcggccagggaaacaaaatccgcagggcattgaaggaagagaaatatgctgctcgtagaacaatacttcccattcttcaagcagaagaagatgaaaggtttgtgtctgagtggaaaaagtatctggaatatgaggctgatgtaatgaaagatgttccgggatggaaagttggcgagaatgtgtacaattctggtcgctggatgcctccggctactggggaactccgtcctgatgtcaattttgtaaaactaaactacaagatcattccatgggaagcttctctccgatatgcaagacaagacgccaaagaatggcaagatgcagaagagtacacccaccgtttatcatcaaaacctgacagagtaacgtcacaagaaccaacagctaatctctggacaacaccccctattggttggacgaaatgcaactatgacggcacttaccacagcaacgctccgagtaaagcgggttggctcttacgggatgatcgaggaacctttctaggtgcagctcatgctataggctctattactaccaatccgatggaaagtgaactccaagctttagtcatggccatgcaacattgttggagtaggggctataggaaaatttactttgaaggtgacaataaagaagtctcagagattgtcaatggtcggtcttcaaattttgcagtttttaattggataagagatataagcgcttggagatcaaaatttgaagaatgcaagtttacttggacaaggcgattttcaaacatggctgcagatgctctggcaaaacaacaacttcctttgaacactcagttttattgctataactatatcccgtttgtaataactgattttttacatcgcgactttgctacagcaaattattaa

SEQ ID NO: 1039 - DNA, 3078 bp, Arabidopsis thaliana
atggtttggtttagaatcggttcttctgtggcaaagcttgccataagaaggacactgtctcagtctcgttgtggttcatatgccactagaacaagggttttgccttgtcaaaccagatgttttcactctacaatactcaaatcaaaggcagagtctgctgcacctgttccacgtcctgtcccactttctaagctaactgatagcttcttagatggaacaagcagtgtgtatctagaggagttacaaagagcttgggaggctgatcccaacagtgttgatgagtcgtgggataacttttttaggaattttgtgggtcaggcttctacatcgcctggtatctcggggcaaaccattcaagaaagcatgcgtttgttgttgctagttagagcttaccaggttaatggccacatgaaggccaagcttgatcctttaggtctagagaagagagagattccagaggatctcacgccaggtctttatgggtttactgaggctgatcttgatcgggaattctttctgggtgtatggaggatgtcgggttttctctctgagaaccgcccggttcaaacactgaggtcgatactgtcgaggcttgagcaagcttactgtgggactatagggtatgagtacatgcacattgctgatagggataaatgtaactggttgagagacaagatcgagaccccaactcctcgacagtacaatagtgagcgtcggatggttatttatgataggcttacctggagcacacagtttgagaatttcttggctactaagtggaccacggctaaaaggtttggactggaaggtgctgaatctttgattcctggcatgaaggagatgttcgataggtctgcagatctcggggtagagaacatagttatcggtatgccccataggggtcgacttaatgttttgggtaatgttgttagaaaacctctacgccaaatattcagcgagtttagcggtggtactaggccagtagatgaagttgggctttacaccggaacaggtgatgtgaaataccacttgggtacatcttatgatcgtccaactagaggaggcaaacatctccacttgtctttggtagcaaatcccagtcacttggaagcagtagatcctgttgtgataggtaaaaccagagcgaaacaatattacacgaaagacgagaacagaacaaagaacatgggtattttgatccatggggatggtagctttgccggacaaggagtggtgtatgaaactctccatcttagtgcacttcctaactactgtaccggtggaacagtgcacattgtggtgaataatcaagtggctttcacaaccgatcccagggaaggaaggtcttcacagtattgcactgatgttgcaaaggctttgagcgccccaattttccatgtcaatgcagatgacattgaagcagtagtgcatgcttgtgagcttgctgctgagtggcgccagacgttccattctgatgttgttgttgatttagtatgctaccgtcgctttgggcataacgagatagacgaaccgtcattcacacaaccaaaaatgtacaaggtgatacgcagtcatccctcgtcacttcaaatctaccaggagaagctcttgcaatctggacaggtaacccaagaagatattgataagattcaaaagaaagtaagctctatcctcaatgaagaatatgaggcaagtaaagattatattccacaaaaacgtgactggctggcaagtcactggactggattcaagtctccggagcagatttctaggattcgaaacaccggagtgaagccagagattttgaagaatgtgggaaaggcaatctcaaccttccctgagaactttaagccacacagaggagttaaaagagtttatgaacaacgtgctcaaatgattgaatcgggagaaggcattgactggggacttggagaagcacttgcttttgctacactggttgtggaagggaaccatgttcggctaagtggtcaagatgttgaaagaggaactttcagtcatagacactcagtgcttcatgatcaagaaaccggggaggaatattgtcccctcgatcacctaatcaaaaaccaagaccctgaaatgttcactgtcagcaacagctccctttcagaatttggtgttctcggtttcgaactgggttattcgatggaaaatcccaattctctggtgatatgggaagctcagtttggagactttgctaatggcgcacaagttatgtttgatcagttcataagcagtggggaagccaaatggctccgtcaaactggtctagtagttttacttcctcatggatatgatggtcagggtcctgaacattccagtggaagattggaacgtttccttcagatgagtgatgacaatccttacgttatccctgagatggacccaactcttcgaaagcagattcaagaatgtaattggcaagttgttaatgttactacacctgccaactatttccatgttctgcgtcggcagatacacagggactttcgcaagcctcttatagtgatggcccccaaaaacttgcttcgtcacaaacagtgtgtatctaatctctcggaattcgatgatgttaaaggacatcctggatttgacaagcaaggaactcgatttaaacggttgatcaaagatcaaagtggccactctgatcttgaagaaggtatcagacgtctagtcctctgctctgggaaggtctactatgagcttgacgaagagcgaaagaagtctgaaacaaaggatgtagccatttgcagagtagagcagctttgcccatttccatatgatctcatccaaagagaactaaagcgatatccaaatgcagagatcgtgtggtgtcaagaagagccgatgaacatgggaggataccaatacatagccctaaggctttgcaccgcgatgaaagcactgcaaagaggaaacttcaacgacatcaaatacgttggtcgtcttccctcagctgctacagccacaggattttaccagcttcatgttaaggagcagactgatcttgtgaagaaagctcttcaacctgaccccatcacccccgtcatcccttaa

SEQ ID NO: 1040 - DNA, 1758 bp, Arabidopsis thaliana
atgtcgttcgaggaagaagaagaggaggaaacattcgagcatacacttctcgtggtgcgtgaggtctccgtttacaagatcccgccgcgaaccacatccggcggatacaagtgcggcgaatggcttcaatccgataagatctggtctggtagactccgcgtcgtatcgtgcaaggatcgatgcgagatccgcctcgaggattcgaattccggtgatcttttcgcagcttgttttgtggatcctggacgtagagagaactctgtagagccgtctctcgattcgtctaggtatttcgttctcaggatcgatgacgggagagggaagtatgcgtttatcgggctaggattcgctgagaggaacgaagcgtttgatttcaatgttgcgttatcggatcatgaaaagtacgttaggagggagaaagagaaggagacaggggaaacgagtgagagcgataatcatattgatatccatcctgccgttaatcacagattgaaggaaaattcttggcatttggacttggtagaacctgaaaagattgttgttttgatgggttttaaggaaggtgaaaccataagaatcaacgtgaagccgaaaccaacaacaaatggcactgggatgctctcagctgctctttcaggaacggggaagccaaaacctctagcacttgccccaccccccaaagctgccggagtaaccaggtctcctttacctcctcctccaaacgatcccgtcgcttcaaggattgcatctgatggctgcaaggaatcacgcaggaacgagcctctatctgatctatctcagctcaaggatcgagcaagtcaacaggagctgcatcaggttgggcagctttctgatgaatggagtagcttttggagactggcaaaaatggcggagaaagatgcgacggcgagtggcgatgacgccattagagttagcggtatgcaattcgcatacgaagttgaggatccaatattcttcgacttcaacctcgatcttccagctggttctcgctgtcttctggttggtgccaatggatctggcaagacaaccttattgaagattctggctggaaagcatatggtgggaggaaagaacgttgtacaagttcttagccgctcggctttccatgatactcaacttgtttgcagtggtgacttgtcttaccttggaggatcatggagtaaaaccgttggttcagctggagaggttcctctccagggagatttctcagcagaacatatgatatttggagttgaaggaactgatcccgtgagaagagaaaaactgattgatcttcttgatatcaatcttcaatggcgtatgcataaggtttctgatgggcagaaacggcgcgtgcagatatgtatgggactcttacatccattcaaggtgttattactcgatgaggtcactgttgacctagacgtcgttgcaaggatggatttgctggaattcttcaaagaagaatgtgatcagagaggagctacaatcgtgtatgcaactcacatattcgacgggctagagacatgggcgacacatttggcctacattcaggacggtgagctgaatcgtttatcgaaaatgacagatattgaggagctgaaaacttcacccaacctcctctccgtggtagaatcttggctccgttctgaaatcaaactcgtgaagaagaagaagaagcctgtggcgccatggaaaccatctccattcgataactctccttttagatcatcgagacacatggcttattaccgatga

SEQ ID NO: 1041 - DNA, 1398 bp, Arabidopsis thaliana
atggttgagattcagggaagattcaaaagaattgagtcggctttcaacgtagccgcggctcgtgtacatccaccgtgtgataacagtagcggaagcgatcattcgccggatctttccgatttggtcgcatcttttatagagaaagagggacaaatagtattacgtgaagaagaagaaacttcttccgacgataacaatttggaagatgtgaatgagaggttacggaagcttctagaaggtttatcctgtggcgaagagcggatgagaatactgtcagcgacgatggaggttgctggaacgttcgtcggagatattagttcttctaagcgtcacttaatggcgtttctacgtaacaagggttttgatgcaggtctttgcaagtcgagttgggaaagattcggcaaaaacaccggcggaaaatacgagtacgtcgacgttcgttgtggcggagattataataatcggtatttcgtcgagacaaaccttgccggagagtttgagatagctagaccaacgaaaaggtacctctcaatactaagccaagtgccacgcgtcttcgtgggaacttcagaggaactgaaactgctcgtgagaatcatgtgccatgagatgagacggtcgatgaagcacgtagggatccacgtgccaccgtggaggagaaacggttacatgcaagctaagtggttcggtttctataaacgaacttcgacgaccaataactacgaaatggttaatacttatgatacgactgcgtttaagggttgcaaggaagagttttgggaagctaaaggtcttaaggttatggttggtcagctttcgattgctttcaacattagtgcgctttgccggaaaggaaccgttcatccgtcgccaccgccggcgataaagaccgacgaacagtttctatctcttctccccgtagctatcctctctctcgtggcggcgctctcggtggaggatcgtgaagttcttgcttacctcatctcaaactccggcgactcaaatcgtatctctcgtctcaagaaaaacaaagaagataatcatcactctcctctctttctttgtgattgttttagttgttacacgagttactgggtcagatgggacacgtcaccgaggcgccaactcattcacgagatcatcgatgcttacgaagatagtttggagatgaagaagaaaaagaaagatcggagaaagcgatcgggaaaagcttctggacgagttaactcgataggaacgagtcgactcagtgaattgggttcgagttcagccgagtttgctggtggtgactcggagaaagatggaaattgcggcggtgaagaggcggagaaggagaaaggctccgttggaaaggttatgagtttcattggtcagagatttttgggagtttggggataa

SEQ ID NO: 1042 - DNA, 486 bp, Arabidopsis thaliana
atggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaa

SEQ ID NO: 1043 - DNA, 3798 bp, Arabidopsis thaliana
atgtcttctacatgttcttctccatccgccgtggaggatcctgaattagggtttcggattgatttagattggacggcaggcgattcggaggatcaggtagcgttgcgattggaatcgcagctgatggtggctttgcctgcaccgcatgatacagtagtggttgaattgaagggaattggcgatgacgatgaaggtggtttagagaatgttggattagagatgagagttgagaaacggagagagccgttacgagcagttacattgatgaaagcggttggttccggtcagcagtacgacggtgtcggcgttttgacaaggctaatgcggtctgatatgatgcctgcagccattcctgcgccggctatcgacgttgcttcttcttgtggggtgcattggaagactgtgacttcgttgagtctatctggttgtggtttattggtaatgccagttgaagtgactgagttacctctgcttgagaagctatgccttgagcacaataaactgtcagttttgccacctgagatagggaagctgaagaaccttaagatacttagggttgacaataacatgcttatttctgtcccagtggaactaagacagtgtgtaggtcttgttgaattgtcgttggaacacaataaacttgtccggcctcttcttgatttcaggtcattggggcagagagctgaaaacacttcctattttggggcatctaggcacaagctcagtgccttctctccccttatattccgttcgtcgtcttgtcatcatcctcttctagcatctacattggtgaagataatgcaagatgaaggaaatcgttctgttattggtaaagatgaaaatgcggtgaggcagcttataagtatgataactagtgacaatcaacacgtggttgagcaagcttgtgttgctttatcatctcttgctcgagatgttggcgtagcaatgcagctgatgaagtgtgatataatgaagccgactgaaacagttctgaaatcttcgtccccagacgaagtgatatccgttttacaagtcgtggtcaccttagcttttgtatctgattccgtttctcagaagatgctcaccaaggatatgctaaaagctttaaaatccttgtgtgcccataagaatcctgaagttcaaagacaagccttattagcagttgggaacttggccttctgtttagaaaatcgtcgtattctgattacttcagagagtttgagagagttattgatgcggttaattgtcacacctgaaccacgagtcaacaaagctgcggctcgagctttggcaattcttggagaaaatgaaattctgcgacgttccataaaaggcaggcaagtaccaaaacagggactgcggatactcaccatggatggaggaggaatgaaaggtcttgcaacggtgcagattcttaaggagattgagaagggaagtggcaagcctattcatgaactattcgaccttatatgtggcacatcaacaggaggaatgctagctattgcccttggtgtcaagcttatgacattggaacaatgtgaagaaatttacaagaatctaggaaagcttgtttttgctgaatctgtcccaaaggacaatgaagctgcaagctggcgggaaaagttggatcagctatataaaagttcatcgcaaagttttagagttgttatccatggatctaagcacagtgcaaacgagtttgagagactgttaaaggaaatgtgtgctgatgaggatggagatttactaatagaatcagctgtgaagaatgttccaaaagtatttgttgtatctactcttgttagtgtgatgcctgcgcaaccatttatatttcggaactaccagtatcctgttggaacaccggaaatgtcgtatgcattttcagatcattcaggcggcagtacactaacttcatcaactgccagtgatcaagctggctactacaagcaaagtgcttttatgggaagttgtaagcatcaggtttggcaagcgatacgagcatcatcagctgctccatattatcttgatgatttttcagttggtacaaactcatatcgctggcaagatggtgcaatagtggcaaacaatcctacaatctttgccatcagagaagcacaacttctatggcctgacacaaaaattgattgcttggtttcgattggctctggctctgtaccaacaagggtacggaaaggtggatggcgttatttagatactgggcaagtactgattgagagtgcatgctcagtggaacgtgttgaagaagctctaagcacattgctccctatgttgccagaaatacaatattttcggttcaacccagttgacgatcgctgtggaatggagttggatgagactgatccagcgatctggctaaaattggaagctgcgattgaagaattcatacaaagcaatccccaagtatttaaaaacgtatgcgagagattaacactccccttcctaaacgatgagaaatggtgtgataatttgaaaccacgatttatgaatggaaagctaccaaatagcagagtagagagcagtccttctcttggatggagacgcaatgttttgcttatggaggctcagcatagtcctgactcagggagagtaaagtatcatgctcgtgcgctcgagtcattttgttcgaataatggaataaagttatcctcattacatactactgctactcctggatgccaaaaaccatctccaggaactgcttttcccacaccatttacctctcctcttataactggaagcttgcctccgagcccccttctcttcactcctgagcttggcccacaaaagttcaataggattgatatggttccgccacttagcttggatgggggacatgttgggaagacggttatgtcgcctccatcatctcctccgcgacaaagacaactctatcttccactacgacagatgcatgaaaagttacagaatttaccccaagtggggatcttacatctctcacttcaaaatgattctaatggttcaatactgagttggcaaaatgatgtatttgtggttgctgaacctggagatctagctgataagtttctccaaagcgtcaaagtcagtatattgtcagtcatgcaaagtaatcgccgaaaggctgcatcagttctttccaatatctgttcaatctcggatttggtgcgtagcaagaaatgcttccaagttggaaatatcatccaccgttatattggacgccagaccctagtgatggaagatgatcaagaaattgcatcgtttatgttccgcagaactgtaccttcggcacacttgactcctgatgatattcgctggatggtaggagcatggagagataggataatagtcttctcaggaacatttggaccaacacaagctgtagttaaagcctttttggactctggtgccaaagctgtgattggtccatcaaacgagccacaagagacaccactaatcacatcccaaggctcatctgagtacaacattggagatcagaacgggaagtttgagattggagaagaagaagacgaagatgaagaagtaaacgaggaaacggaaagggaagagatggaaccaccgacaccgacaagtgactgggaagatagcgaccacgagaaaacaaacagagacggtaagtattgtggtctttgggaagatgatgaagaagaagtgtctgaatttgtttgccagttatatgatcagttgttcagagagaactcaagagttgatgttgctcttcaaaaagctcttgcctctcatcgaaagctcaggtacacttgtcatcttcctaatgtatag

SEQ ID NO: 1044 - DNA, 1656 bp, Arabidopsis thaliana
atggcctctttgaagttgaagaaaagggataatggcgctgaacccgacaagaaaaagctggtcatcgccggtattcgccaccagttactccttctccttcgccgccgtcaccgtctatttccgctggtatctgccgtctccggctgtctcctcctcatcctcttctcattctccaccctctctcctcctccattgatccatcataacaatcaagtggccgtcgaacccaatccaaccactccatttcgtgtacccgaaaatggcggaaggtcggatcgccagttatggagctcgagattgtccaacttgtactatgcctgcagtaatgcaactgacacctttcaagttacggatacgagaagccaaaccaatcggtatttactgatcgcaacaagcggagggttaaaccaacagcggacagggataatagatgctgtagtagcggcatacattctaaacgccactcttgtggtccctaaacttgaccagaagtcgtactggaaggacaccagcaactttgaggatatatttgatgttgattggttcatatcgcatctctccaaagacgtgaagatcatcaaggagcttcctaaagaagagcagtcaagaatatccaccagcctacagtcaatgcgtgtcccaaggaagtgcacgccttcttgctacttgcagcgtgttttgcccattcttactaagaaacatgttgtacaactctccaaattcgattacaggctgtccaacgctcttgatacagagctccagaaactgcgttgtagagtcaactaccatgccgtcaggtatacagagtctatcaacaggatgggccaattgttggttgaccggatgagaaaaaaggccaaacattttgttgcccttcatctcagattcgaacctgatatgctggccttctccggatgctattacggcggtggtcaaaaggagagactcgaactcggagctatgagaagaaggtggaaaacgttacatgcggcaaaccctgaaaaggtacggcggcacgggagatgtcccctgacgccagaggagattggtctgatgctcagaggcttaggttttgggaaagaggttcacttgtacgttgcatcaggcgaggtatacggaggggaggatacattggcacctttaagagctctgtttccgaatcttcatacaaaagagacactgacctccaagaaagaactggctccgtttgcaaacttctcatcacgcatggctgctcttgacttcattgtctgtgataagagcgacgcatttgtcacaaacaacaacggcaacatggctcgaatcttagctgggagaaggagatacttgggacacaaagtaaccatccgtccaaacgccaagaaactctacgaaatcttcaaaaatagacacaacatgacatggggtgagttctcatcgaaggtcagaagataccagacgggtttcatgggggagccagatgaaatgaaaccaggagagggggagttccatgagaacccagcctcctgcatttgtcgaacctctgaagcaagagtcaaagaaaaagcaaaacatgtaaatgaagatgactcatcggagtactcagagattggtaatgtccccatatccagtagaagcgatttggatcactcacaatttgatgaagtgatcttctga

SEQ ID NO: 1045 - DNA, 1362 bp, Arabidopsis thaliana
atggagtctagtatcctcgattccctcggagttgagattatcggcgtgatggctcccgtctccatctgcatgttcctcgtcgtccttctcacctactctctctctgtcacttctgaccctcagatccgtagcgccgctaacctcatttacatcgagaatccctccgactccaccaccgtcaagctcgaaggtagtctcgccaacgccatcgtcttcgtcgtcctcattgccgccgtcactttcatccttgttctcctcttctactataacttcaccaatttccttaagcattacatgcgtttctctgccttctttgtcttaggtacgatgggaggtgcaattttcctatcgataatccagcatttctcaattcctgttgattccatcacctgcttcatattgcttttcaatttcacgatcttggggactttgtctgtgtttgctggtgggataccaattgtgcttagacagtgttatatggttgttatggggatagttgttgcagcttggttcactaagttacctgagtggactacatggtttatcttggtggctttagctttgtatgacttggttgctgttttggcacctggtgggccacttaagttgttggtagagctggcttcgagccgcgatgaggaacttcctgctatggtttatgaagctaggccgactgtttcatcaggcaaccaaaggagaaaccgtggctcgagtttaagggctttggttggtggtgggggggtttcagattctggatcagttgagctgcaagcagttcggaatcatgatgtaaaccaacttggaagggaaaattctcataatatggattataatgctattgcggtgagggatatagacaatgtagatgatggtattggtaacggaagcagaggtggacttgagaggtcacctctagttggaagtcccagtgcgtcagagcactcaacctcagtaggaaccagaggaaatatggaagacagagaaagtgttatggatgaagaaatgtctccactagttgagttgatgggttggggagataatagggaagaagcaagaggtttggaggagtcggataacgttgtggacatttcaaatagaggcataaaacttggtcttggagactttattttctacagtgttcttgttggtagggcagcaatgtatgatctgatgactgtgtatgcctgttaccttgcgatcatctccggacttgggtgcactcttattttgttatctgtgtacaaccgagctctgcctgcccttcccatatccatcatgttgggtgttgttttttacttcttgacgcgactattgatggagccctttgttgttggggtgacaacaaacttgatgatgttctga

SEQ ID NO: 1046 - DNA, 768 bp, Arabidopsis thaliana
atgacgaagattttctctctattggtcgcaatgatcttctccacaatgttcttcatgaagatcagctcagtttctgctggttggttgcaagctcatgcgaccttttatggcggaagtgatgcctctggtacaatgggtggagcttgtggttatggaaacctatacacagacggctacaagacaaacaccgcggcgttaagcacggccctgttcaacgacggcaagtcatgcggtggatgttaccaaatcttgtgtgatgcaaccaaagtaccacaatggtgtcttaaaggcaaatcaatcactatcacagctacaaacttctgtccaccgaactttgctcaggcaagcgacaatggaggttggtgcaacccaccgagacctcatttcgacatggctcagcctgcgtttctcaccatcgctaagtacaaagctggaatcgtccccattctttacaaaaaagttggatgtagaagaagcggagggatgagatttacaataaacggtagaaactatttcgagcttgttctcatctcaaacgtagcaggagggggtgagatctctaaagtttggatcaaaggatctaagagcaacaaatgggagacaatgtcaagaaattggggagctaattatcagagtaatacttaccttaatggtcaatctctatctttcaaagttcaacttagtgatggaagtatcaaagcagctctcaacgttgttccttcgaattggcggtttggtcagagcttcaagagcaacgttaacttctaa

SEQ ID NO: 1047 - DNA, 504 bp, Arabidopsis thaliana
atgcgagctccgatctccggaattttctcgagatctctcggttacctccaccgtacgacgccgctatcctccgctactcgtcacctatgcgccgtcgcttctcccgaagctcgaacgaagaaactcgagcgaatcgccgacgatttactcaaactgaatcggattgagctttacgattactcactcctcttcagccataaaataggtctcaatcgctacggttccgccgtagctgttaccggatctgtcggcgacgcgtcagcttctacggagacgaaaacggcggagaagactactttcgatgtgaagcttgagaaattcgaagcggcttcgaagattaaagtgataaaagagatcagagcattcacggatctgggattgaaagaagctaaggctttggttgagaaagccccagtgattgtgaagaatggtcttactaaagaagaagctgagaagatcatggagaaactcaaagcggttggtgctattgtagctttggaatga

SEQ ID NO: 1048 - DNA, 876 bp, Arabidopsis thaliana
atgcggagcacaccgttggggacgacggcggtttcaccagcttcaatcaaacacaactcttatgggtatggccgcttcgtttcctcttcaggagtctctaatttctctatccatcgtcggagacgccactcgtcgttttctatctctcaagctccttcacaaatcaactcaggagcttgcaatgcaagtcaaatagttgatctttttccagcggtttcacctgaaatcgttgttcgtgaagcacggttagaggactgttgggaggtggcagagactcattgcagctctttcttcccgggatattcgttcccgcttgatgttgttctaagagtagataggttaatggcaatggtgatgggattttctattccacctgggtgccagaggacttgtttagtggctgtgataggtagttcagtagatgaaaccatctgctttggaagtgatgatttcaaaattggagcttttgatgcaaagatcagcttaaacaaaggttatgttgctggaatcttgactgttgatactgtggctgattaccttccaagaaaaggacctctccgccagagaaggaccgggatcgcttatgtatcaaatgtggcagttcgagagaatttccggcgcaaaggaatagccaagagactcatatggaaagcagaggctttagccaagaactggggatgtagagctatcggccttcactgtgatctcaacaacttaggagcaactaaactttacaaagatcaaggtttcagatccatcaagatccctgaaggagcgacttggcctcaaccgaagacatctcctgacaccaggtttaccttcatgatgaagctagtgaacaacaacaatacacaagctcttgaacagtttcggtaa

SEQ ID NO: 1049 - DNA, 534 bp, Arabidopsis thaliana
atgtcctctccaagagaaagaggaaagagtttgatggaatcatcaggatcagagccaccggtgacaccaagccgttacgagtcgcagaagagacgtgactggaacactttcggacagtacttgaagaatcagagaccgcctgtgccgatgtctcactgcagctgtaaccacgtgcttgatttcctcaggtacttagaccagttcggtaagacaaaggtgcacgtgcctggctgtatgttctacggccagcctgagccaccagctccttgcacgtgccctctcagacaagcttggggaagtcttgacgctttgatcggacggctgagagcggcttacgaggagaacggtggacctccggagactaaccctttcgctagcggagcgataagggtttatctgagggaggttagggagtgtcaggctaaggctagagggattccttacaagaagaagaagaagaagaagccaacgccggagatgggaggtgggagagaggactcttcttcctcctcctcttccttcagcttctcttaa

SEQ ID NO: 1050 - DNA, 831 bp, Arabidopsis thaliana
tgtttaccagatcaatatatatctgtgtttctttgcagacgttatctactggaaccgttatactaatctctgcagtagctgtgcttttgcttaacccgcttcttgcaccacctgctttcgctagctttcaaactgcagctaaatccggttggctaacaagtgcgtggaccggtttccttgctggttgcttgcacacgctctcaggacctgatcacctcgctgctttagctccgctttcgatcggacgcagcaaaatggaaagtgctgctgttggagctctctggggatgtgggcatgatgctggtcaagtcatctttggtttactgtttctgctacttaaagaccggcttcacattgaagtattacaaacttggggtacaagaattgtgggattgactcttgttattatcggtgctatgggaatcaaggaagcttctgagattccagaaccttgtgtcgctttagaaaccgacatcagcatggtatcaacagagaaagaagccttaccactgcccaaaaagaagaagatcgggtttgctacatttgcaactggagtggttcacgggttgcaaccggatgctctgatgattgttttgcctgcattagctctcccatcacggttagcagggtctgcgtttttgataatgtttctggttgggacagttatagcgatgggaagttacacagcgtttattgggtcttgcagtgaggctttgaaagagaaagttccaaggatcacagagaaactaacttgggtttcgtcacttgtggctattggtcttggattgggaattgtcatcagccctttctttggttttagcctctactgag

SEQ ID NO: 1051 - DNA, 1488 bp, Arabidopsis thaliana
atgggtgtttctcttctgaaacaacaacatcgtattacaaatcaagctgatactttttctagattcatggaaagatcaccagagaataatctaagcagaaatgagcacatcatcattgacattccaagaaatgccgccattgcatcatcatcatcttctcatgatagaatctcaaatgttttggaacctttacaacatgaggaagagagaccttctactgtttctcccatggctgctcctcagccagctacagctacagcttcttcttcttcttctatgcgatcaaatcctagaagtgtccgtcgtagaagaagtcctttgaattctggcttatggatttctattgaactattcctcactgttggtcagatcattgcagctattgtcgttttgtctttgtcaaaacatgagcatcctcgtgctcctttgttcacttggattgttggttatgcgtgtggatgcgttgctacactcccgcttttgtactggagatattatcattcgaatcaggcttctgaacaggattctggtcagcaccgtcctaatcttaatgttgcagcaggaccattcgccttctcgatatccaggacatccgaagcagatggtcgacagaccaataccacctcttctcgtggtagtagatatcctgggtttataagtgctgccagacttaaagttatcgtggaatacttcaaaatggctctggattgcttctttgcggtgtggtttgtggtaggtaatgtatggatatttggagggcattcatctgctgccgaggctcctaacttgtacaggttatgtttagtgtttcttacctttagctgtattggctacgcgatgcccttcatcctctgtacaacaatatgttgctgcttgccttgcataatctcaattctcggatatagagaagatttaacgcaacctcgaggtgccacacctgagtcgattaatgcgttgccgactcataaatttaagttgaagaaaagcagaagtaatggcgatgacaatggttcaagtactagcgaaggtggagttgtggcggctggaacagataacgaacgagctatttcaggagaggacgcagtctgttgcatttgcttagcgaaatatgcgaataacgaggagttaagagagcttccatgctcacatttcttccacaaagagtgcgttgacaaatggctgaagatcaatgcctcttgccctctatgcaagagcgaagttggggagaagaactctgatttgactagccaagggatcttaacctcgctctcttctggggaaaacgataaccatcaacaacagcaacaacaacaacggagtgaacttagagttgagaatgatcttcgagatttgctctatgtccgagaaaacggcaaattagccgtttggcgatgttcctacacaaaatggggtttgcttctcattgctaagaaggtgaagaaagacacggcgaagatcctgttctgtaaatgctttttgccgttgtga

SEQ ID NO: 1052 - DNA, 1365 bp, Arabidopsis thaliana
atgggggtgaaagtagcttcttcgtctactttccttcaatggactactcagcctattattcatcagtcttcttcaccatctcaaaccctagcttcgggaaccataacatctccttcaaaacgacgtagcacagtacacgacggccggtttctatcatgtcgtttcgtgacacagagactaaaccgttcggctcttttcggaactccgtcgacgaagcttcatcgacccaagtcatgtgagctatggaaatcatcatcatcatcatctagaccgatcaaaactcagtcgtttcgaagagtttatagcgcaaacttagatccattctccgacgaagagttctcgaaaaaaatccaagagctaactctcagattcaatatcccacaccatgacgacgacgagaattcaatcgagccgccatggaacgagatggttcatttgtcgagtattgaaatgaaagcaaacagtgttgatcttcctctttcacttcgtattataaagaagaaacgtcaatgggaagaaggagttaaacaagctggtgaatctgcgtgttgctcgatgaataaagctttttcttcaatggtgtttatgatacgggagcttcagagctttactttacatatgagagagattctgttctacgaagacttgcaagagattttgctaagagttagagaagagatgcaacaatctttcgtttggttgtttcaacaagttttctctgctactcctacgttgatggtttatgttatgattctcttagccaatttcactgtttattctatcggtaacaacagctccgctttagccgctgttgctcctcttcctccgacgattacggagttaacaactgttagtgaaacagaggaaacaaacgtgaagtttgattcctcggtggtgaaaacgttctttgtatcatctcctagtgggagtatagcttcagttggtggtaacaacaatggcggcggtggaaacgtcaagccggtgttaagcggaactgacggtgatggatccgatggatcagaacagttcagaacaatcatacccgaaggagtttctcaattgtcatcatcgaatttcgggtcagagccgtcagtatcgggacaagatgaacatagattgtggaattcgatggtggaggaagcagaacgaatgcagtattcaaatattgacgattcgttggatcaggagacgaggaagcggttcgtgtctcatgtagaggctcgagtagaagcagaggaagacactggttacttcaaaacagagctaatgtatcaaacagaactgtctcaagagcctaataatcctctactactcgctaactatgctcagttcctttacctcgtctctaatgaccatgacaggtaa

SEQ ID NO: 1053 - DNA, 504 bp, Arabidopsis thaliana
atgcagaggatatcgttagactcatcagcttcgaagctccatagctatggaggacgaaaggacgatacctacgatattgatgacttgaaaccagcttcctcttctccttcttcgtcgtcatccgcagtagattacgacgatcacgagctcaaagactttaagccgcgacggttatcatcgttgcaatctccttttgttacgacgaatcagaaacaagagaagcttgttcacttcattccgattctcactctcatctgctttatcatcctttacctcacttcttacgctccgtctcaatcagatttggctcagtttaatggattcatgcgtccttcgaaacatctagaatcatccgacgaaaatggcgacgaaatttctggatttatcagagccgatactctatccatccgtagtagtgtacgaaacctacaagagacggaaagcttcacgacgaaatcacttccccgtcgccggacttctcaccggaaaaccgccgacttctag

SEQ ID NO: 1054 - DNA, 1653 bp, Arabidopsis thaliana
atggcattccttgttcgttcgccggagatacccaccgtctcggcgagaatcttctccgatgcgaattcgagtgttattagtcatgtgtttatgaggaggaaggctacggtttcggcgattgacgccagagatttgcctggtgttaagaatccgaaatcgagattgtactggcaattctcagctccggtgaaagaagactacaagattagcagagaggaggaagaagaagaagaagaagataagcagagttactacgtgaatatgggtcacgccgttcgtagtatcagagaagagtttcctttgttgttctacaaagagcttaattttgacatttacagggatgatattgttttcaaagaccctatgaacactttcatgggaattgataactacaaatccatatttggggccttacgtttccatggaaggatcttcttcagagcactatgtgtggacattgttagtgtttggcaacccacagagaacactctgatgatacgatggactgttcatggaattcctcgtggtccgtgggagactcgtggtcgattcgatggtacttctgagtataaattcgataagaatggcaagatttatgagcataaatcactgcaactccatgaggcaccgaaactagtaagcctggttgtggaacttggtccacgaagtcgtgttgacggtagatgtcaaaaagagttgacaaggcagttaagcaaggagctcaagaacttgaggcctcaactttattcagctgctgattactgtgaaaagtcttatcttcatagcgagcaaaagcaaatggtattggacaatttgaaagactacactgtgaaggctctagttaatgctgttgatcaccttggaactgtagcttccaagcttactgatctttttgatcaccaaaattcagacatatcaactatggaaatgagagcttcttgtgttagccaggcaatctcccttaaggtttgtgtatgttcttttcatcagcaactgcttacatgccggacatatatcgacaaagaaggtcttagacagcaacagctattagcagttatcccattgcatcacaagcattacattcttcccaattctgttaacaagcgggtacactttagtcctctcagacgaactgacacaagacagaatcattaccaagctatatcccgtcttcaaccttcaggtgcaatgtcctcatctttgagcttattagttaataatacaagcagtcaaatatcaaacagtttaagtaatatgcttggtttgactcacttagatgcccctgcatcgaaatcactctcctggcatttaggctcagagaccaagtctaccctcaaaggaacatccacagttgcaccaagctccaaagattcaaaagctttctcaaagacatctggagtgttccatctcttaggtgatgatgaaaacatagcaaacaagaagcctttggctggttctcaggtctcaggtgttcctgctgcatccactgcccataaggatttggaggttccgaaacttctaactgcacacaggtcacttgataacaacccgcgacgagagatcattcaagctcctgtccggacaaagagtgttctttctgcgttctttgttaaacagaaaactccaaagctcaaagctggctatgtctcgtga

SEQ ID NO: 1055 - DNA, 1227 bp, Arabidopsis thaliana
atggcggtgggagagaaggagcacgaaggaactgtggttgaaagcggcggcgagaagaatgattccgccgttgtactctctgcttccggcgagaagaagacgacgaagcgtaaaggtttgttctcgcgtctttggaatgcgatatttagggttagaggtgatgatttcgagaagagacttaaaaatatctcaaaggaagaagcgactgttcggaatagaatgaagcgtagatcgattacaaggaggaacttcattagaaatctcatcgctttctctgtcttctttgaggtaattgcagtgagttatgcaatcatgaccaccagagatgaggatttggattggaaactgaggagtttcaggatcttgccaatgtttcttttacctgctgttgcctttcttctctattcttcacttgttggcttctggaggatgtgtgaccgcagagatcagcataccttggaaaaacttcaagcagaaatgttgggaaagattaatgagttaaaggaaaggaccaattattacattacacagcaacttattcagaggtatgaccctgacccagctgcaaaggcggctgctgcaactgttctggcatccaagttgggtgctgagtcaggcttgaaagtatttgtaggagatgaatcccaacttgagcccaccgcaggaaagaacaatgccaaacactcgggagggctcaggaaccgaaaacagacaaatacaagaggcaacagcgctgagaccactccaattcatcattcggataatgagtctaaccattctggaacaagcgaaagaatcaccggcacagaacaaaaccaacagatggtgtttgagcattataatcctcaggaatatgctgctcatgatggtagctggatctcacgcattgcggctctccttgtaggcgaagatccaagtcagtcatatgcactcatctgtggaaactgccgtatgcataacggactcgcccggaaagaggatttcccatacattacttactactgtcctcactgtcgagctctgaacaagccgaaacattcagaagagcattcacttattgctcctgcagatacactccctaaagtttctctaaagccaatggaaagtgaagtgatcaatagcagtagctcgactagtgaacgcggtaacagtccaatccctttgttacacactccagaaatcgtggaagaagtcccggaaacagctgagaatgagacaccaaactga

SEQ ID NO: 1056 - DNA, 312 bp, Arabidopsis thaliana
atggaggttccaggttcatcgaagaagatgatcgcaacgcaagaagagatgtctgcagctaaaatagcacttggatctagagatatgtgcgctcatctcttgattccgctcaacaaatgtcgtcaggctgagttttaccttccatggaaatgtgaagacgagcgtcacgtttatgagaagtgtgaatacgagcttgttatggagagaatgcttgcgatgaagaagatccgtgaagaagaagctttggctaaacagaataaactacaaggaaacgctgctgttcctcttatccctaaaactgctaatgcttag

SEQ ID NO: 1057 - DNA, 1041 bp, Arabidopsis thaliana
atgttctcatcttctacactcgtttattctctatctctcttcctctctctttctcttctcttcttcctcttcatcctctcaccacacatccttctctcttcctctaccctcatttccaccgccgatgacctagacgacctctctctcttccaccgcgccgtcgtctcttcctccaccaacaacaaccgtcgtctcatctccctctctccaaatccacccccaaagatcgctttcctcttcctaacaaactccgatctaaccttcttacctctctgggaaagcttcttccaaggtcaccaagatctctacaacgtttacatccacgcagatccaacctcctccgtctctcctcttctcgattcttcatcaatcaacgctaagttcatcccggcgagaagaaccgcacgagcttctccgacgttaatctccgccgaacgacgattactagcaaacgcaatcctcgacgatcctaacaatctctatttcgctttaatctcacaacactgtatccctctccattccttctcttacatccacaaccacctcttctccgatcatcatcaacaaagcttcatcgagatcctctccgatgaaccgttccttctgaaacgatacaacgcaagaggagacgacgcgatgcttcctgagatccagtaccaagacttccgtgttggatctcagttcttcgtattagcgaaacgtcatgctctaatggtgatcaaagagagaaagctatggaggaaattcaaattaccatgccttgatgttgaatcttgttaccctgaagaacattattttccgactttgttgtctcttgaggatcctcaaggatgtagtcactttacactcacacgtgttaattggaccggtagtgttggtggtcatcctcacacgtacgatgcctctgagatctcgccgcagctgattcactctctgcggagatctaattcgagtttagactatttcttcgccagaaaattcacgccggagtcattgcaaccgcttatggagattgcagatgctgtgatctttagggattga

SEQ ID NO: 1058 - DNA, 570 bp, Arabidopsis thaliana
atgagcaagatggggcagtatcactcttcgagaacgacttggcatgatgtgatcggaaagcattgcccgatcttcgccgtcaatcgcgaggtgttgatcccaatagcgaaaccaattggctacacaggaactgatccttataagataaaattccaagttggaagtgagaaatttctgattcactggcttttggtaattaatcgtaagagctcagaagttccgatgatcgatgtaaatttgagatattctggaggagatctgcttggagtcacagctcaagttatcgacatgcctcatagctatctgaatacacacccggagatccgcaaacagttttgggatcctcaacactggccaaaacatgttcttgttagatacacatggaaggagcagtcagagattgatgtatcctcaggattctatgtcctgtttggctcagctctcacattttcttttgtactctccatttacgtcttacaatcgtcacgagagaagctggcaaggtttgtaagagagacggtggtggagagcagcagcatgaatgttggagaatttggcaagggggattga

SEQ ID NO: 1059 - DNA, 1554 bp, Arabidopsis thaliana
atgggagcaattgatctctctttctcacagagtcttctcttctcttcgtcgcgttccaatctttcctcctccacacaccgttccgtctcttttttgccgccgggaagcaagtcacggtgtctgccgccgttgcgttcaatgagtcatgacgacgacacggcctcaaaggaggtgaagctatggggtggaaggttcgaagagagtgtcactgagaaagtggagaagttcactgagtcaatttcatttgataaggttctctacaagcaggacattatgggtagcaaagctcatgcttcaatgcttgctcaccaggggctaataactgatagcgataaagatagcattttgagaggtcttgatgatattgagagacaaattgaagcaaataagtttgaatggaggactgatcgagaagatgtgcatatgaacattgaagcagctcttactgatcttattggtgaacctgcaaagaaacttcatactgcaaggagcagaaatgaccaagttgctactgacttcaggctttggtgtcgtgatgctatcgatacaattattgtcaaaatcagaaatcttcagagagcacttgttgaactggctttgaagaatgaggctttgattgttcctggttatactcatcttcaaagagctcagcctgttttactcccacacgttctcttaacttttgtagagcagctcgaacgtgatgctggtcgttatgtggactgtcgagcaaggctaaatttctcccccctgggagcttgtgctttggctggaactggtctgcctattgataggtttatgactgcaaatgctcttggatttaccgaaccaatgagaaacagtatcgatgcagtctcagaccgagacttcgtgctggagttcttatatacaaatgccaacaccggtattcatttatcacggcttggagaagagtgggtactgtgggcttccgaggagtttgggttcatgactccaagtgattctgtgtcaaccggaagtagtataatgccacagaagaaaaatccagacccaatggaacttgtcagaggaaaatccgcaagagtcataggcgatctggtcactgtcttaacactgtgcaaaggacttccccttgcttacaacagagattttcaagaagacaaagagccgatgttcgatagtaccaagacaataatgggaatgatcgatgtatctgcagaatttgctcagaatgttacattcaacgaagacagaatcaagaaaagtcttcccgcaggacatcttgatgcgactactctcgctgattatcttgtgaagaaggggatgccttttaggtcatctcatgacatagttggaaaactagttggagtttgcgtctcaaaaggctgtgaacttcagaacttaagtcttgaagagatgaaaaagctgagccctgtgtttgaagaagatgtgtttggatttttgggggttgaaaattcagtcaataagttcagttcctatgggtcaacaggatcaaactgtgttgctgagcaacttggctactgggtcaacaagctcaacattacttccacctga

SEQ ID NO: 1060 - DNA, 3645 bp, Arabidopsis thaliana
atgggttctgcaatgagcttgagctgttccaagaggaaagcaacgagtcaggatgttgattccgaatcttgtaaaagacgaaagacatgctcaacaaacgatgctgagaattgcatattcattccggatgagtcatcttggagtttatgtgccaacagagtcatcactgtggcagccgtagctttaacaaatttcagattccaacaagataaccaagaaagtaattcttcttctttatctcttccctcccttgcaacttctgtgtctcgaaactggaaacacgatgtcttcccgagcttccacggagcagatgtccgaagaacctttcttagtcacatcatggaatcgttcagaagaaagggaattgacacattcattgataataatatagagaggagtaagtcgatcggtcctgagctcaaagaagctatcaaaggatcaaagatcgcaatcgttttgctctcaagaaaatatgcttcttcgtcttggtgtcttgatgagttggccgagatcatgaaatgcaggcaaatggtgggtcagattgtcatgaccattttctatgaagtggagccaactgacataaagaaacagaccggtgaatttggaaaagccttcacaaaaacatgtagaggtaaaccaaaagagcaagttgagagatggagaaaagctttggaggatgtggcaacaatcgccggatatcattctcacagctggaggaatgaagcagacatgattgagaaaatagccactgatgtttcaaacatgttaaatagtttcacaccatcaagagatttcgacgggttagtagggatgagagctcatatggatatgctggaacaattgttgcgcttagatttggatgaagtaaggataatcgggatttggggaccgcctgggattggtaagacaactatcgccagatttctgcttaaccaagtctccgacagattccaacttagtgcaatcatggtcaatatcaaaggatgctatccaagaccttgtttcgatgagtacagtgcacaattgcaactacaaaaccaaatgttgtcccagatgatcaatcataaagatatcatgatttctcatttaggagtggctcaagaacggttgagagacaagaaagtgtttcttgttctcgatgaagtggatcaattaggacaactagatgccttggcgaaagaaactcgatggtttggtcctggaagtcggattattatcacaacagaagatctaggagttttgaaggctcatgggatcaatcatgtttacaaagtcgaatatccatcaaatgacgaggcttttcaaatcttctgtatgaatgcctttggtcagaaacaaccacacgaaggtttcgatgagattgcttgggaagttaaggctttagctggtaaactccctttgggattgaaggttctaggctctgctttgcgggggaagtccaagccagagtgggaaagaacactaccaaggttaagaactagcctcgacggaaaaatcgggggcattatacagttcagttacgatgccttatgtgacgaagataaatatctatttctttatatagcctgcctttttaacggcgaatcaacaaccaaagtgaaagagcttcttggaaagttcttggatgtgagacaaggccttcacgtattagctcagaaatctctcatatcctttgatgaagaaatctcttggaaacaaattgttcaagttcttcttttaaacaagttctcgcatgtgaggcatacgaagagaaacaagtcgcaaataatacggatgcatactctgctagaacaattcggaagagaaacttcccgtaagcaattcgttcatcaccgctatacgaaacatcagcttttggttggtgaaagggatatatgtgaagtgctcgacgatgatacaacagataatagacgttttatagggataaatttggatttatataagaatgaggaagaattgaatataagtgagaaagcacttgaaagaatccatgattttcaattcgttaaaatcaattacgtatttactcatcaacctgagagagtgcagttagcactagaagatctgatttatcactctccacgaattagatcattgaaatggtttccttaccagaatatatgtttgccttctacttttaatccggagtttctcgtcgaactagatatgcgttgcagcaagcttcggaagctatgggaaggaactaaacaacttagaaatctcaagtggatggatttgagtgattctagagatttgaaagagcttccctcctctattgaaaaactcaccagtctccaaatattagatctccgggattgctcaagtcttgtgaagctcccaccatctatcaatgccaataatctccagggattgtctctaacaaattgttcacgtgttgtgaagctccccgctattgagaatgtgactaatctccatcaattgaagctccaaaattgctcaagtctaatagagctccctctttctattggaactgccaacaatctttggaaattggatatcagaggatgttcaagtctcgtgaaacttccatcctctattggagatatgactaatctcaaagagtttgatctatctaactgctcaaatctggtggagcttccttcttctattggaaaccttcaaaaattgtttatgttgagaatgagaggatgctcaaagctagaaactcttccaacaaacatcaacttgatatctctccgtatacttgatctcacagattgctcgcagttgaaaagttttcccgagatctccacacacatttcagagctcaggttaaaaggaactgcaataaaagaagttcctttgtcgatcacgtcgtggtctcgtcttgctgtatatgaaatgtcatactttgaaagccttaaggaattcccgcatgctcttgacatcatcaccgacctacttttggtaagtgaagatatacaagaagttcctccatgggtcaagagaatgtctcgtttacgtgctcttagactcaacaactgcaatagtctggtatcactcccacaacttccagattcccttgattacatatatgcagataattgtaagtccctcgagagactggattgttgctttaacaatccagagatccgtctctatttccccaaatgcttcaaactgaatcaagaagccagagatctcatcatgcacacatcaactcgtaaatatgcgatgttaccaagtatacaagtgcctgcctgcttcaatcaccgagctacttctggggattacttgaaaatcaagttgaaggagtcgtctcttcctacaaccttgagatttaaggcttgtatcatgcttgttaaggttaatgaagaaatgagagatgatgagatgtggccgagtgtactcattgccatcagggtcaaacagaatgatctcaaagttctatgtacagcaagcatatatccagttttaacagagcatatatacacatttgaacttgaagtagaggaggtgacttccacggagcttgtctttgagttcacaccattccacaaaagcaattggaagataggagaatgcgggatactccaaagagaaacgagatcattttgccggagctcttcgccggatcttccgccagaatcttctcgtgtgtttctagctaggaccactgtttga

SEQ ID NO: 1061 - DNA, 1302 bp, Arabidopsis thaliana
atggaagctatgaaggagactgtggaggagagcttgagagagatgagagagacgtttgcgagtgggaggacgaggagtctgaagtggaggaaggcacagatcggagctatatacgagatggttaaagacaacgaagacaagatctgcaatgctctgtttcaagatttgggcaaacacagtactgaagcttttagagatgagcttggtgttgtcttgcgaacagctactgttgcaatcaactgtcttgataaatgggccgtccccaaacatagcaaacttcctctgttgttctacccagcaaaagggaaagtcatatcggaaccctatgggacggttcttgttctgtctagctggaattttcctatatctttgtctctggatccattgattggggcaatagcagcaggaaataccgtgcttctcaagtcatctgaactaagccctaacgcatctgccttccttgccaagacaattccagcttatctcgatactaaagccatcaaagttatcgaaggaggacctgatgtcgctactatcctcttgcagcatcaatgggacaagatcttcttcaccgggagtcccaagattggaaggatcataatggctgcagcagcacagcatctgactcctgtgacattggagcttggtggaaaatcttgtatctctgtagattacgttcttatcgaaaagagtttcgcgcctactctgattgatatgttgaagcctacgataaagtctttctttggcgaaaatcctaaagaatctggatgtctctcaaggattgcaaacaagcaccacgttcagagactgtctcgtcttcttagcgatcctcgtccaacgatcttgttggaccctcctcttgattctgagatcatgaatgaagagatctttggtccaattctcccgattatcacggtacgtgacatccaagaaagcatagggatcattaatacaaaaccgaagccacttgccatttatgcattcacaaatgacgagaaccttaaaactagaattttgtcagaaacatcctcaggaagtgttaccttcaatgacgtcatgatccagtatatgtgtgatgcgttaccttttggaggagtgggagaaagtggaatagggaggtatcacgggaaatactcatttgattgtttcagtcacgagaaagcaataatggaaggaagcttaggtatggatcttgaagctcgataccctccatggaacaacttcaagctcaccttcatcagactcgcatttcgtgaagcttacttcaagcttatcctccttatgcttggtcttaaaagataa

SEQ ID NO: 1062 - DNA, 1083 bp, Arabidopsis thaliana
atgggtagcaacgaagaaggaaaccccactaacaactctgataagccatcgcaagctgctgctcctgagcagagtaatgttcatgtgtatcatcatgactgggctgctatgcaggcatattatgggcctagagttggtatacctcaatattacaactcaaatttggcgcctggtcatgctccaccgccttatatgtgggcgtctccatcgccaatgatggctccttatggagcaccatatccaccattttgccctcctggtggagtttatgctcatcctggtgttcaaatgggctcacaaccacaaggtcctgtttctcaatcagcatctggagttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagagctccgagaatgatggctctagcaatggtagtgatggtaatacaactgggggagaacaatctaggaggaaaagaaggcaacaaagatcaccaagcactggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatggaatgaaaaagaggttaaacgagagaagagaaaacagtcaaaccgagaatctgctaggaggtcaagactgaggaagcaggctgaaacagaacaactatctgtcaaagttgacgcattagtagctgagaacatgtctctgaggtctaaactaggccagctaaacaatgagtctgagaaactacggctggagaacgaagctatattggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctga

SEQ ID NO: 1063 - DNA, 1800 bp, Arabidopsis thaliana
atgggaggctgtacttccaaaccttcctcctccgtcaaacctaatccttacgcacccaaagacgcggttctccaaaatgacgattctacccctgctcatcccgggaaatcaccggttcgttcatctcccgccgtaaaggcctctccttttttccctttttacacgcctagtcccgcccggcaccgccgtaacaagagccgcgacggcggaggaggagagagtaagagcgttaccagcactcctctccgtcagctcgcgcgtgctttccaccctccgtcaccggcgagacatatacgggatgttctgcggcggaggaaggagaagaaggaggctgctctgccggcggcgaggcagcagaaggaggaggaggagagggaagaggtagggctggataaaagatttgggttttccaaggagttacagagtaggattgagctaggggaagagattgggagagggcattttgggtatacttgctctgctaagttcaagaaaggagagctcaaagatcaggaggttgctgttaaagtcatcccaaaatctaagatgacatctgcaatatctatagaggatgtgagaagagaagtgaaaatactgcgggcgttatctggacatcaaaatttggtacaattctatgatgcgttcgaggacaatgccaacgtttacatcgttatggagttatgtggaggtggtgaacttcttgacaggatactagcaaggggaggaaaatactctgaagatgatgcaaaagcagtgcttatacagatccttaacgtcgtagctttctgtcatctccaaggagttgttcatcgagatctaaaaccagagaacttcttgtacacttccaaggaggagaattctatgttgaaagtcatagattttggcttatcggactttgtcagaccagacgaaagactaaatgatatagtgggaagtgcatattacgtagcccctgaagttctacacagatcttataccacagaagcggatgtatggagcataggagtcatagcatacattctcctatgtggaagccgtcctttttgggcaagaactgaatcaggaattttcagagcagttctaaaagctgatcccagttttgatgaacctccttggccttcgttatcctttgaggcaaaagattttgttaagagattattgtacaaggaccctcggaaaagaatgactgcatctcaagctttgatgcatccttggatcgcgggttataagaaaatagatatcccatttgatattctgatcttcaagcagatcaaagcatacttgagatcttcgtctttgcgcaaagctgctttgatggctctgtccaagacattaactaccgatgaacttctttatctgaaagcgcagtttgcacacttagcacccaacaaaaatggcctcatcactttagatagcatcagactggcacttgcgacaaatgcaacagaagcaatgaaggaatcacggatcccggactttcttgcattgttaaatggacttcaatacaaagggatggattttgaagagttttgtgcagcttccattagcgttcatcagcatgagtctcttgattgttgggagcagagcattcgtcatgcttatgagctatttgaaatgaatggaaaccgagttatcgtcatcgaagaactcgcttctgaacttggtgttggatcatccatcccggttcataccattctaaatgactggataagacatactgacgggaagctgagtttcttgggttttgtcaaactgctgcacggtgtctcgactcgacaatctttagcgaaaacgcgatga

SEQ ID NO: 1064 - DNA, 1479 bp, Arabidopsis thaliana
atggcgcgaaaatccctaattttcccggtgattttgctcgccgttcttctcttctctccgccgatttactccgccggtcacgattaccgcgacgctctccgtaaaagcattctcttcttcgaaggtcaacgttccggtaaactccctccagatcaacgcttaaaatggcgccgtgactcagcattacgcgacggttcctccgccggcgttgacttatccggtggttactacgacgccggagacaacatcaagttcggttttccgatggcgttcacaacaacgatgctttcatggagtataatcgatttcggtaaaaccatgggacctgagcttagaaacgccgtgaaagctgttaaatggggaacagattacctccttaaagcgacggcgattcccggagtagtcttcgtccaagtcggagacgcttactccgatcataactgttgggaaaggcctgaagatatggacactctccgtactgtttacaaaatcgatagagctcatcctggttctgacgtcgctggtgaaaccgcagccgctttagccgccgcttcaatcgtttttagaaaacgcgatcctgcttattccagacttctacttgaccgtgccactagggtattcgcgtttgctaacagatatcgcggcgcgtatagtaacagtctctaccacgcggtttgtcctttttactgtgatttcaacggttaccaggatgagttactgtggggagcggcatggctacacaaagcctcgaggaaacgagcgtacagagaattcattgtgaagaacgaggtcattcttaaggctggagataccattaatgagtttggttgggacaataagcatgctgggattaatgtcttaatctccaaggaagtgttaatgggaaaagcagagtattttgagtctttcaagcagaacgcagatgggtttatctgttctatattgcctggaatttctcacccccaagtccaatactctcgaggagggctactagtgaagactggagggagtaacatgcaacatgtaacatcactatctttcctcctattggcttactctaattatctgagccatgccaaaaaggttgtgccttgtggcgaattaactgcttccccatctctcctccgtcaaatcgccaagcgtcaggtggattacattctcggagacaacccgatgggactgtcttacatggttggatacggtcaaaagtttccacgtaggattcatcaccgtggtagctcggttccttcggtttcagcccatccaagccacatagggtgcaaagaaggctctcgctatttcctaagcccaaatcctaacccaaaccttttggttggtgctgtagtcggtggacctaatgtcactgatgcttttccggattcaagaccttactttcagcagtctgagcccacgacttatatcaatgcaccactagtgggccttctcggttacttctccgcccattctacttggcgatga

SEQ ID NO: 1065 - DNA, 2265 bp, Arabidopsis thaliana
atggcttcttcttcttcttcttcttcctccatcacaatcatcaccaccttcctcttccttctcctccacacaaccgccaaaaaaacctacatcatccgcgtcaatcactccgataaaccggaatcattcctcactcaccacgattggtacacatctcaactcaattcagaatcatctcttctctacacttacacaacctccttccatggcttctccgcttacctcgactccaccgaagccgattctctcctctcctcctcaaactcaatcctcgatatcttcgaagatcctctctacacacttcacactacgcgtactcctgagtttctcggtctcaattccgaattcggtgttcacgatctcggttcttcttctaacggcgttatcatcggagttttagatactggcgtttggcctgaatctagaagcttcgatgatactgatatgcctgagattccttctaaatggaaaggagaatgtgaatctggttccgatttcgattccaagttgtgtaacaagaagcttatcggagctagaagcttctccaaaggatttcaaatggcttctggtggtggtttttcgagtaagcgtgaatctgtttctcctcgtgatgttgacggacatggaacacatacttcaactaccgccgcgggatccgccgttagaaacgctagcttcctcggttacgccgccggtacggccagaggtatggccactcgtgctcgtgttgctacttataaagtttgttggagtactggttgttttggatctgatatactagctgctatggatcgagctatacttgatggtgttgatgtgctttcgttatctcttggtggtggttctgctccgtattatcgcgatacgattgcgattggagcgttttcggctatggagagaggtgtttttgtgtcttgttctgctggtaatagtggtcctactagagcttctgttgccaatgttgctccttgggttatgactgttggtgctggtactttagatagagattttccggcttttgcgaatctcggtaacgggaaacgacttaccggtgtttcgctgtatagcggtgtaggaatggggacgaagccgcttgaattggtttataataaagggaatagtagttcgagtaatctttgtttacctggttcgcttgattcgagtattgttcgtgggaagattgttgtttgtgatagaggtgttaatgctagagttgagaaaggagctgtggttagagatgctggtggtttagggatgataatggcgaatactgctgcgagtggagaggagcttgtggcggatagtcatttgcttcccgcgatcgctgtagggaagaagactggtgatttacttagggagtatgttaagtcagattctaaaccaaccgctcttcttgtttttaaaggaacggttcttgacgttaagccgtctcctgtggttgctgcttttagctcgagaggtcctaatactgttactcctgaaatcttgaagcctgatgttattggtcctggagttaatattttggctggttggtctgacgctattggtcctactggtcttgacaaggactctaggaggactcagttcaacatcatgtcaggtacgtcaatgtcatgcccacacatcagtggtttagcgggtcttttgaaagcagctcaccctgagtggagtccgagtgctatcaaatcagctctcatgactacagcttacgttcttgacaacaccaacgctcctctccatgatgctgcagacaacagcctatctaacccatatgctcacggctcgggccatgtagatccccaaaaggctctctcaccaggtcttgtctacgacatctcaaccgaggaatacatcaggtttttgtgctctctagactacacagtcgatcacattgttgcgattgtgaagcgacctagcgttaactgctcgaagaagttctcagatcctggtcagctcaactacccaagtttctcggttttgtttgggggtaaaagagttgtgcggtacactcgggaagtaacaaatgttggtgcagcaagctcggtttacaaagtgacggttaatggagctcctagtgtcggaatctctgttaaaccatcgaaactttcgtttaaaagcgtgggagagaagaagaggtacacagtcacgtttgttagcaagaaaggagtgagtatgacgaacaaggctgagtttggttccatcacttggagcaatccgcagcacgaagtgagaagtcccgttgcattctcttggaaccggttttga

SEQ ID NO: 1066 - DNA, 1986 bp, Arabidopsis thaliana
atgtctcgtgaacttattattctctgccaaccaattcttgttctgttccttactctgttttacaattctcatggctacttcgtctcacaaggatctgtaggaatcggcttcaacggttacttcactttaaccaacaccacaaaacacacattcggtcaagctttcgaaaacgagcacgttgaaatcaagaactcatcgacaggtgtcatctcatctttctcagtcaacttcttctttgcgatcgtccctgaacataaccagcaaggctcacacggtatgactttcgtcatctctcccacaagaggccttcccggagcttcctccgatcaatacctcggaatctttaacaaaacaaacaacggtaaagcctcgaataacgttatagctatcgagttagatattcataaagacgaagagtttggagatattgatgataatcatgttgggattaatattaacggtttgagatctgttgcctctgcttctgctggttactatgatgataaagatggaagctttaaaaaactttctttgatcagcagagaggtaatgaggctttccatcgtttatagtcaacctgatcaacagctcaatgttactttattccctgctgagatccctgttccgccactaaaaccgctcttgtctttgaaccgagatctctcgccgtatttgcttgagaaaatgtatcttggattcactgcatcgacggggtcagttggagcaattcattacttgatgggttggttagttaatggtgtaatcgagtatccgagattggagcttagtataccagtccttcctccatatccaaagaaaacatctaatagaacgaaaactgttttagccgtctgcttaacggtatctgtgtttgctgcgtttgtcgcttcgtggatcggtttcgtcttctatttgaggcataagaaggttaaagaggttcttgaagaatgggagattcaatatggacctcataggtttgcttataaggagcttttcaatgccacaaagggtttcaaggagaaacaacttcttggtaaaggaggctttggtcaagtctataaaggaacacttccgggttctgatgcagagatcgctgtgaagcggacttctcatgattcaagacaagggatgagcgagtttctagccgagatatcgaccattggtcgtctcagacatccaaatttagtcaggcttttaggatactgtaggcataaagagaatctctacttggtgtatgactatatgcctaatggaagccttgacaagtatctaaaccgtagcgagaatcaagaacggcttacttgggaacaacgtttcaggatcatcaaagatgttgcaactgctctactacacctgcatcaagaatgggtacaagtcatcattcatcgagatatcaaaccagctaatgttttaatcgacaatgaaatgaatgcgaggctcggggatttcggactggcgaaactgtatgatcagggattcgatcctgaaacatctaaagtagcgggaacattcggatatatcgcaccagagtttctaagaacaggaagagcaaccacaagcactgatgtttacgcctttgggttggtaatgcttgaagtagtgtgtggtagaaggataattgagagacgtgcagcagaaaatgaagaatatcttgtggattggatcttagagctttgggaaaatgggaaaattttcgatgcagcagaggaaagtatacgtcaagaacaaaacaggggacaagttgagcttgttttgaagctaggtgtgttgtgttcgcatcaagctgcatcgataagaccggctatgagtgtggtaatgaggattttgaatggagtttcacagctaccagataatcttcttgatgttgtaagggctgagaaatttagagaatggcctgagacatcaatggaattactactacttgatgtgaatacatcgagttcattggagttaaccgactcttcttttgtctcccacggccgctga

SEQ ID NO: 1067 - DNA, 1551 bp, Arabidopsis thaliana
atgttggagaaagagtttttcacggagtatggtgaagcaagtcaatatcagatccaagaagttgttggcaaaggaagctacggagttgttgcttctgcggaatgtccacacacgggaggcaaagtagccatcaagaagatgacaaatgtgtttgaacatgtctcagatgctattcgtatcctcagagagatcaagcttctcaggcttcttcgacatcctgatatcgtggagatcaagcatatcatgcttcctccttgtcgcaaggaattcaaagatatatatgttgtttttgagttgatggagtctgatcttcaccacgttcttaaggtaaatgacgacctcactcctcagcatcatcaattcttcttgtaccaacttcttcgtggcttaaaattcatgcactcagctcatgtgttccatagagatctgaagcctaagaacatcctcgctaatgctgattgcaaaatcaagatctgtgatttaggacttgctcgtgtctcctttactgattccccttctgctgtgttttggactgactacgttgctacaagatggtaccgtgcgccagagctctgtggttccttctattctaactacacgccggcgattgacatgtggagtgttgggtgcatatttgcagagatgctaactggaaaacctttgtttcctggcaaaaacgttgtgcaccagctagaactcgtgactgatctgcttggaactccgtcgccgataactctatccaggattcggaatgagaaggctagaaagtatttgggaaacatgaggcgaaaggatcctgtacctttcacccataaattccccaatatcgatcctgtggcgctgaagttacttcagcgtttgatcgcttttgacccaaaggaccgtccctctgcagaagaggcattggctgatccgtattttcaaggattggcaaatgtggactatgaaccatcgaggcaacctatctcgaaacttgagtttgagtttgagaggaggaaattgactcgcgatgacgtgagggaactcatgtacagagaggaatctcttaaaacttttttttttgttctctttctggatatgaaacagattttggagtatcatccacagatgttgcaagagtatctacaaggagaagagaacataaactctcattttctatacccaagagaaagtgtgtcttactttggtgaatcaatcttgatatccagcggagttgatcagttcaaacaagagtttgcccgactcgaagaacacaacgacgatgaagaggaacacaactccccaccacatcagagaaagtacacttcactccctagagaacgggtgtgctcatcagaagacgaaggttctgattcagttcatgctcaatcgtcttcagcttcagtggtgtttacacctccacagactccaaacacagcaactggcttatcatcacagaaggcgtcacaagtagacaaagcagcaactccggtaaaacggtctgcatgtctaatgaggagtgatagtatctgtgcttcaagatgtgttggtgtctcctctgcagtgtcatag

SEQ ID NO: 1068 - DNA, 1803 bp, Arabidopsis thaliana
atggcagatcgattgacacgtattgctattgtgagttcagaccgttgcaagccaaagaaatgtcgccaagagtgcaagaagagttgtcctgtggtcaagacaggaaaactttgtattgaggtgactgttggttccaagcttgcttttatctcagaggagttgtgtatcggttgcggtatttgtgtgaagaaatgcccgtttgaagctattcagattatcaatcttccaagagacttggagaaagatacgacccatcgttatggggcaaacacttttaagttacacaggctcccagttccaagaccagggcaggtgctagggttggttggaaccaatggtattggaaaatcaactgctctgaaaattttggctggaaagctcaaaccaaatttgggccgtttcactagtcctccagactggcaagaaatcttgactcacttccgtggttcagaacttcaaaactacttcacacgtattctagaagataatcttaaggccattataaagcctcaatatgtcgaccacatcccaagagcagttaaaggcaatgttggagaggtccttgaccagaaggatgagagagataagaaggcagagctctgtgctgatctggagctgaaccaggtcattgaccgtgatgttgagaatttatctggtggtgagctgcagaggtttgcaatcgctgttgttgccatacaaaatgcagagatttacatgtttgatgaaccatctagttacctcgatgttaagcaaagactcaaagctgctcaagttgttcgttctctcctgaggcctaatagctacgtcattgttgtggagcatgatctcagtgttcttgattacttgtcggatttcatttgctgtctgtatgggaaaccaggagcctatggtgtggtgactctccccttctctgtcagagaaggaatcaacattttcttggctggatttgttcctacagaaaatttacgttttagagatgaatctttgaccttcaaggttgctgagactccacaagaaagtgctgaagagatacagtcgtacgctaggtacaaataccccacgatgaccaaaactcaaggaaacttcaggttgagagtgtcggaaggtgaattcactgactctcagattattgtaatgcttggggagaatggtacagggaagacaacatttattcggatgctggtattctcttcttccatgatatacagagagataccagaattcaatgtttcgtataagccacaaaagatcagcccaaagtttcagaattcagttaggcacctgctacatcaaaagattcgagattcttacatgcatccacaatttatgtcggatgtgatgaaaccacttcagattgagcagttgatggatcaagaagttgtcaatctctcaggaggagaattgcaaagggttgcattaactctgtgcctcggaaagcctgcggatatatacctgatcgatgagccaagtgcatatctcgattctgagcaacgtattgttgcttctaaagtcataaagcgatttattctccacgcaaagaaaactgcatttgtagtcgagcatgactttataatggcgacctatttggcagaccgggtcattgtgtatgaaggacaaccatccattgattgtactgcaaattgtcctcaatcactgctcagtggaatgaatctcttcttatctcatctgaacatcacattcagacgggatcccaccaatttcagaccaagaatcaacaaattggagtcgaccaaagacagggaacagaagtctgcaggctcatactactacttggatgattag

SEQ ID NO: 1069 - DNA, 747 bp, Arabidopsis thaliana
atgggtcttttgggaattgctctgttttgttttgctgcaatggtgtgctctgttcatggctatgacgctggatgggtcaatgctcatgctaccttctatggtggaagtgatgcttcaggaacaatgggtggagcttgtggctacgggaacctctacagtcaaggttacgggaccaacacggcggcgttgagcactgctctgttcaacaacggtcttagctgcggggcttgttttgagatcaagtgtcagagcgacggcgcgtggtgtttacctggtgctatcattgtcacagccaccaatttctgtcctcctaacaacgctcttcccaataacgctggtggttggtgtaaccctccgcttcatcatttcgatctctctcagcctgtttttcaacgcattgctcagtacaaagctggtgttgtccctgtttcctacagaagggttccgtgtatgagaagaggaggtataagattcacaatcaacggtcactcttacttcaaccttgtcttggtgaccaatgttggtggtgctggagatgttcattcggttgcggttaaaggttctagaacaaggtggcaacaaatgtcaagaaactggggacagaactggcaaagcaacaatctcttaaacggtcaagcattgtcatttaaggtgactgctagtgatggtcgtaccgtcgtctctaacaacattgctccagctagttggtcctttggacaaaccttcaccggccgtcaattccgttaa

SEQ ID NO: 1070 - DNA, 852 bp, Arabidopsis thaliana
atgaaaggtaaaggtggacctgaaaacgggatttgtgactatagaggagttagacagaggagatggggtaaatgggttgctgagatccgtgagccagacggaggtgctaggttgtggctcggtactttctccagttcatatgaagctgcattggcttatgacgaggcggccaaagctatatatggtcagtctgccagactcaatcttcccgagatcacaaatcgctcttcttcgactgctgccactgccactgtgtcaggctcggttactgcattttctgatgaatctgaagtttgtgcacgtgaggatacaaatgcaagttcaggttttggtcaggtgaaactagaggattgtagcgatgaatatgttctcttagatagttctcagtgtattaaagaggagctgaaaggaaaagaggaagtgagggaagaacataacttggctgttggttttggaattggacaggactcgaaaagggagactttggatgcttggttgatgggaaatggcaatgaacaagaaccattggagtttggtgtggatgaaacgtttgatattaatgagctattgggtatattaaacgacaacaatgtgtctggtcaagagacaatgcagtatcaagtggatagacacccaaatttcagttaccaaacgcagtttccaaattctaacttgctcgggagcctcaaccctatggagattgctcaaccaggagttgattatggatgtccttatgtgcagcccagtgatatggagaactatggtattgatttagaccatcgcaggttcaatgatcttgacatacaggacttggattttggaggagacaaagatgttcatggatctacataa

SEQ ID NO: 1071 - DNA, 1875 bp, Arabidopsis thaliana
atgaacaatattgaagcaactctattcctctgcttcttctgcatcttctcatcttctaatgtgcatttcgccggagctaaacaaaccgccggcaacatcacgccatcggagaatccattcacaccaaaagcttctttgattcgttattggaacaatcacatcaatggcgattcaccaaaaccttcttttttcctctcaaaggcctctcctctaaccgccgtggactccacgcgtttcgcctcactcgcttctaatcacgcgcttaacacgcatcactctgatttctgctccgccgcgaaactcttctgcttccctgagctcgccgctcattccctggaaaaacacggcgatgacgtcaacttcgccgcttacagcggcaagaacttcacaaactacggctccgaccgtctctccggagcagactcattcaaaaactattccggcggtgacaacatcgccgtagactcattccgacgttacagccgaaactccgccggacacgacgatggatttacaaattacgccggagaagtaaacgtagctgaccaaagcttcacaacttacgccaccggaacaacaggaggctccggcgaattcacgaactacaacacagacgcaaacgaaccaaacggaagattcacttcttactccgataaagccaacggaagatcacaaaccttcactacctactccgagaacggcaacaccggatatcaatcattcacaagctacagcaaaaacggaaacggagctccgaatgagttctcgggttacggaaccgggtcaaacgtagttaatacgggttttaccaaatacggagaatccgctaacggagctaacgacagtttcacgagctacggagaaaacggtaatgttccggttaacgaatttaaaggatacggtgacggaggtaacggcgccgtttatgggtttaaaaattacagagaccaatcaaacatcggagttgattctttctcttcttacgctaaaaactcaaacaacgagaaggtcaatttcgtaaattacggtaaatcttttaaccttggctctgataatttcaccggttacggccaagataacgtcggaggtaacgtcagcttcaaaacttacggccaaggacagagttttaaggtttacactaaagacggcgtcgtttttgcgcgttattctaataatgtgagttctaatggcaaaacggtgaataagtgggttgaggagggtaaattcttcagagaagcgatgttgaaagaagggactttgatgcaaatgccggatattaaagataaaatgcctaaaaggacatttttaccccgaaacatagttaagaatttaccgttttcgtcatctacgatcggagagatttggagggtttttggtgccggtgagaattcatcaatggcggggataatctcgtcggcggtttcagagtgtgagagaccggcgagtcacggtgagacaaagcggtgtgttggatcagcggaggatatgatagatttcgctacgtcggtgctcggacgcggcgtagtggtgaggacgacggaaaatgttgtcgggtcaaagaagaaggtcgtcattggaaaagtcaatggaatcaacggtggagatgtaacaagagcagtttcgtgtcaccagagtttgtacccgtatttactgtattattgtcactcggttcctcgggtacgtgtttatgaaacggatctacttgacccgaagagtttagagaagattaaccatggtgttgccatctgtcacattgatacgtcagcttggagtccgagtcatggagcgtttttggctttaggttctggtccgggtcagattgaagtttgccattggatctttgagaatgatatgacgtggaatattattgattaa

SEQ ID NO: 1072 - DNA, 372 bp, Arabidopsis thaliana
atggctggtcttatgaagttaggatgcttggtctttgtcttcgtgattgcggccggtccaatcacagcaaaggcggctctgagctgtggcgaagttaacagcaatttgaaaccgtgcactggctacttgaccaatggtggtatcactagcccaggcccacagtgctgcaatggtgttagaaagcttaacggcatggtccttacaaccctagaccgtcggcaagcatgtcgttgcattaaaaatgccgctagaaacgtcggccctggtctcaacgctgaccgtgctgctgggattcctaggagatgcggaatcaaaataccttacagtacccaaatcaggttcaacaccaagtgcaacacgtacatatgttaa

SEQ ID NO: 1073 - DNA, 2892 bp, Arabidopsis thaliana
atgcctcaccggactacttacttctttccgcggcagtttcccgatcgtggattcgattcgttttcgcttaagaatgatcacgacaagaagaaatcgtcgtctaacgttggagagagttttggatttcaaagagataataaatctaatggagtcggagaagattctaacaaggagaaggagagtactgtgttctcctctaatcctctgctttctaaaagctcagccgtttcagatctctttagcgatgatcgcaagtcggagaagaagcatcagcagcaactagccgctttctatgagtggttggcggagaagaaggctaatctctctaggtcatcatctactactactactcatggacgcggggtgaagcccacgcgcttctctatgtctagcgacgccgatgaggagagagagcttctgttgtcttctccggctgatcccgctccgcttcctgctacttcttcgccggattctatcattgattcggctaggacggttaacatacatgaacgaaacattgatcggagctttgacagagaggtttcgcttccccgaatgtcgagtgagagcagcttcgctggaagcttcttctccgggacgacggtggacgggaatttctccaatttctcaagtcatacagacgcaagggaaacttcgaccaccacgcttgtctcagtgaacaaagaggaagaagaagttgaggttagggaacagggcaaagagcaaagcttagcgcagaagtcaagagaaggctattacttgcaggtcacgcttgctaagtggctaagttctcaagcaaacctagcatgtgagtctgttcatatacagagcacagaatctatctcctaccgtttttgggtaagtggttgtttatcatacagtgacaagatatcagatggattttacagtatattaggaatggatccgtatctttggttgatgtgtaacaattctgaggatggcaaacgaattccatctcttttgttactcaaggagactgagccgaatgatacatcaatggaagtggttttgatagatagacgtgaggactcacgtcttaaagaactggaggataaggcacatgagctgtattgttcttcagacaacatgttagtgctcgtcgagaaacttggcagacttgttgcggtctatatgggggggaatttccaggtggagcaaggtgatctccagaaacgatggaaactggtcagcaatagactcaaggaatttcggaaatgtatcattcttcctataggtagtctaacaatgggcctttgccggcatcgtgccatcctatttaagaaattggctgattacataggtttaccatgtcggatagctcgaggttgcagatactgtaaagagagccaccaatcttcttgccttgtcaagattgacgatgacaggaagctttcaagggaatatgtagttgacctcatcggggaaccaggaaatgtccatgatccggattcctctatcaacggtgaaacacagtgtcagattccttcacctcttcaaatgagtcatcttacagatttttccaggccttgcgtgcatagtacatctccttgtcagactgtagagtcaaagacttcacgcactctttctgaaaacattcaacgttcagggagtcaaggccaagtacacaaagaatttgagttgcctgataacgcagggacagtatgttgtgctcatattgatcaaacttgctgtgcaaaagtatcatcaatggttttgacagaatctgttcttcgagctctaccacttgatataccaaaccttagtgaagaaaagattgccccacaagaaacctgcaaagaagaaaccgttctattagaagatccaacagctatgaagcagccaaacttatcagttgaaccagagatagtagaggctgacactcgaaaagataaaaaaggaaggttacctgttgacgccatctcaccttacttgactattgaaccttctttggcatcagattggctggaggtctcatggaatgaattacatatcaaagagcgtgtgggtgctggatcatttggaactgttcatcgtgctgagtggcatggatcagatgttgctgtcaagattttgtctattcaagatttccatgatgaccaattcagagaatttctcagagaggtatgtaagcaagcggttgctataatgaaacgtgttcgtcacccaaatgttgttctcttcatgggtgctgtgacagagcgaccccggttatcaataataacagaatatttgccaagaggcagtctttttcgccttatccataggccagcttctggggagttgctagatcagaggaggaggctacgtatggcattggatgtggtttgtgctattccccattatgccaaggggctcaactacctacactgtcttaatcctcctgtagtgcattgggacctgaaatctccaaatctactggttgataagaactggacagtgaaggtttgcgattttggactttcaagattcaaggcaaacactttcataccatcaaaatctgttgcaggaacacctgagtggatggctccagagtttcttagaggggaaccgacaaacgagaaatcagatgtttacagtttcggagtagtcttatgggagttgattactttgcaacagccttggaatggactcagtcctgctcaggtggttggagcagttgcattccagaacaggcggcttataattcctcccaacacctctccggttttggtatctctaatggaagcttgctgggcagatgagccgtctcagcggccagcatttggtagtatagtggacacattgaagaagctactaaagtctccggtgcagctgatccaaatgggtggagacaaaggggtaattccaactaaatcagctcccatactatag

SEQ ID NO: 1074 - DNA, 2916 bp, Arabidopsis thaliana
atggtttttccttttcatttgagctcacagatttttttctctttcactttttgtgcagcaccggagaagatggacaaatctagtaccatgcttgttcactatgacaaagggactccagcagttgctaatgagattaaagaagctctcgaaggaaatgatgttgaagctaaagttgatgccatgaagaaggcaattatgcttttgctgaatggtgaaaccattcctcagcttttcataaccattataagatatgtgctaccttctgaggaccacacaatccaaaagcttctgttgctgtacctggagctgattgaaaagactgattctaaggggaaggtgttacctgaaatgattttgatatgccagaatcttcgtaataaccttcagcatcctaatgagtacatccgtggagtgacactgaggtttctctgccggatgaaggagactgaaattgtggagcctttaactccatcagtgttacaaaatctggagcatcgccatccatttgttcgcaggaatgccattctggccatcatgtcgatatataagcttccacaaggcgaccaactctttgtggatgcgcctgaaatgatcgagaaagttctatcaaccgaacaagatccttctgccaagagaaatgcatttctaatgctctttacctgtgctgaagaacgtgcagtgaattatcttctgagcaatgttgacaaggtttcagactggaatgaatcacttcagatggtggtgctggagttgattcgaagtgtgtgtaagactaaaccagcagagaaggggaaatatattaagattattatttctctgttaagtgctacttcttctgcagttatctatgaatgtgctgggacacttgtttctctctcatctgcccctactgcgattcgggctgctgccaacacctactgccaacttcttctttctcagagtgacaacaatgtgaagcttattttactcgatcggttgtatgagcttaagacattgcacagagatatcatggttgagttgataatagatgtgctcagagcactctcaagcccaaaccttgatatccgcaggaagacgcttgacatttcccttgacttgattacccatcataatatcaatgaggtcgttcaaatgttgaagaaagaagttgtgaagacacagagtggagaacttgagaagaatggggagtacagacaaatgcttattcaagccatccacgcttgtgcagtgaagttccccgaagttgcaagcacagtggtccaccttctgatggacttcttgggagatagcaatgtggcttcagctcttgacgtggttgtttttgttagagagataatagaaacaaatcccaagttaagagtttcaatcatcacaaggttattggacacgttctatcagatccgagcaggaaaggtctgcccttgtgccctttggataattggggagtattgcctatcactttcggaagttgagagtggcatttcaactatcacgcaatgccttggcgaattaccattttactctgtttctgaggagtctgagccaactgagacatcaaagaagattcagcctacctcttctgccatggtgtcctctagaaagccagtgattcttgctgatggaacttatgctacccaaagcgcagcctctgaaaccacattctcctcacctacagttgttcaaggatcactgacttctggaaatttgagagcactgctactaactggtgattttttcctcggagcagtggttgcttgcacgttgaccaaacttgttcttaggttagaagaggttcagtcttctaaaactgaagtaaataagacagtcacacaggctttgttgatcatggtttctatgttgcaacttgggcaatctcctgtttctccacaccctattgataatgattcgtatgagaggattgtgttgtgcataaaattgctttgccataggaatgatgagatgaaaaagatatggttagaatcctgccgccagagttttgtcaagatgatttctgaaaaacagcttagagagatggaggaactgaaggcgaagacccaaacaacgcatgctcaacctgatgatctaattgacttcttccatctaaagagtcggaagggaatgagtcaacttgagttggaagaccaagtacaagatgacctaaagcgtgcaactggagaattcaccaaggacgagaacgatgctaacaaacttaaccgcattcttcaactcacaggattcagtgacccagtctatgctgaagcatatgtgacggtacaccattatgatattgctcttgaagttacagtaatcaaccgaaccaaggaaacccttcagaacttgtgcttggagttagcaaccatgggtgatctcaaacttgttgagcgtcctcagaactacagtctggcacctgaaagaagcatgcagattaaagcaaacatcaaggtgtcgtccacagagacgggagtcatattcgggaacatcgtctatgagacatcaaatgtaatggagcgaaacgtcgttgttcttaatgacatacacattgatatcatggactatatctcccctgctgtgtgttcagaggttgctttcagaactatgtgggcagagttcgaatgggaaaacaaggttgctgtgaacaccacaatacaaaacgaaagagaattcctcgaccacattatcaaatctacaaacatgaaatgtctcactgctccatccgcaatagaaggcgaatgtggattccttgcagcaaacttatacgcaaaaagtgtatttggtgaggatgctcttgtgaatgtgagtattgagaagcaaacggatggagcattgagtggttacataaggataaggagcaagacgcaagggattgccctaagtcttggggacaaaatcaccctcaaacaaaagggtagtagctga

SEQ ID NO: 1075 - DNA, 1425 bp, Arabidopsis thaliana
atgggcatatcttcactatttccagtgcaagttgcagtttggcatgaaactatagggccaggtggttttgaaagagacatctgtgttaactctccaacaggaagtggaaagactctttcttatgctttaccaattgtgcagctccttgcatctcgtcctgtgagatgccttcgtgctttagtcgtattgccaacacgtgatttagccttgcaggttaaagatgtatttgatgcaatagctccagctgtaggattatctgttggctcagctgtgggtcaatcttctatagctggtgaaatctcacagcttatcaagacacctaaacttgatgcgggaatatgctatgatcccgatgatctttctcaaaaccttgaaagtgctgtggacatattagtagcaacaccaggaaggctgatggatcatatcaacaacaccaagggctttacgcttgagcatttgcgttaccttgttgttgatgaaaccgacagattgcttagggaggcatatcaatcctggctaccaactgttctgcaactgactcagacatctgacgatagcctatttccttcatttacaccatttgttccttccgcttttggttctctgcagactgttcgtagacaaagtgtggagagaggattcaagggtaaaccatacccaaggctggtgaaaatggtactatcagctacattgacgcaggatccaagcaagcttattcagcttgacctgcatcacccgttattcatgacaactggaggaagccgatacagactacctgagaagttggaatgtcttagactgatttgcgaaaccggaatgaagcctgtatatttggttgctctcctaaaatcatgggaaggtgaaaagtgtatcattttcacatcttccgttgagacaactcgtcgtctatgcaagttactcaacttttttggtgacccaaaaataaaagcaaaagagtattcaggtggtcttaaccaatcacttcggagcaaagaactaaaagcgtttagaaaaggtgatatccaagttcttgttgcatctgatgctctaacacgtggaatggatgttaaaggggtaacaaatgttattaattatgatatgccaccatttgcaaagaccttcatccatcgtgctggacggacagctagagcaggccaggctggccgctgcttcacattgctgagtaatcatgaggtaaggcgtttctcgaagctcctggagaaagttgggagtgattcatgtcctatctatccgatcccgcctacttcattagattccattcgtgccacttacacacccgctctagagaagctcaaggagttggttgagtcagaagcacccaagaaaggaagacaagcttttagacataattcaagaacgggtaactcccaaaccaaacttaacaaaccgagatcagaagcatag

SEQ ID NO: 1076 - DNA, 1911 bp, Arabidopsis thaliana
atgggagttgatggaaaattgaaaagtgttagaggacgcttgaagaaggtttacgggaagatgaaaacactcgaaaactggaggaagaccgtcttgttagcttgcgtggttgctttggctattgatcctttgtttctgtttatccctttgattgattctcagagattttgcttcactttcgacaagacacttgtagcagtagtttgtgtcattcgtacttttattgacacgttctatgtgattcacatcatttattatcttataaccgagaccattgctcctcgttctcaagcatctttgagaggcgagattgtcgtgcattctaaggctacactgaaaacacgtctcctctttcacttcattgttgacattatctctgttctccccattcctcaggtggtggttctcactctcataccactgtctgcgtcgctggtgtcagagagaatactgaaatggattatacttagtcaatatgtaccaagaatcattcgtatgtatccgctttataaagaagtgacaagagcctttggtacggtagcagaatcaaagtgggctggagctgctttaaacttattcctttacatgctgcacagttatgtgtttggggctttttggtacttgagttcaatagaaaggaaaagcaaatgttggcgtgccgcgtgtgctaggacatccgactgcaatctcacggtcacggatctgctttgtaaacgagctggcagtgacaacattcgattcctcaacacttcatgcccattaatcgaccctgcccaaatcacaaactccacagacttcgactttggtatgtatattgatgcattgaagtcaggggtgctagaggtgaaaccaaaggattttcccaggaaattcgtctattgcttttggtggggtctccgtaatattagtgctttgggccaaaacctggagacaagcaactctgcaggggagattttctttgctatcatcatatgtgtctctggtttactcttgtttgctgtgctcattggaaacgttcagaagtacttgcaatcatctactactagagtagatgaaatggaggagaaaaggagagacacagaaaaatggatgtcctaccgggtgataccagagtatttgaaggaacgcattaggagatttgaagattacaaatggcgagaaaccaagggaaccgaagaggaagctcttcttcgtagtcttccaaaagacctcagactcgaaaccaaacgctatctttacttggatatgttaaagcgtgttccatggcttaacatcatggatgatggttggctactagaagctgtgtgcgaccgggtgaagtctgtgttctatttagcgaacagcttcatagtgagagaggggcacccagttgaggagatgctgattgtaacgagaggcaagctgaaaagtacaaccggatctcatgaaatgggtgtccgcaacaattgttgtgacctccaagatggtgacatatgtggagaacttctcttcaatggttctcgccttcctacctcaaccagaaccgtaatgactttgactgaagttgaaggtttcattctcttgcctgatgatatcaagtttatagcttctcatttaaatgtctttcaaagacaaaaactccaacgaacattcaggttatactcacagcaatggcgctcatgggcagcattcttcattcaagcggcatggaggaaacattgcaaaaggaagctttctaagacaagagacaacgagaatattccacaaggcacgcaactcaatcttgcatcaacgctctacgtgtccagatttgtgtccaaagctttgcaaaatcgacgaaaagatacagcagattgttccagctctcctgatatgtcacctccggtacctcataaaccagccgatctcgagtttgcaaaggctgaagcatag

SEQ ID NO: 1077 - DNA, 3123 bp, Arabidopsis thaliana
atggatgagggatcagtaggggatgtgagtaggattgatgaagctgatgttgctcaccttcaattcaagaatagtgagcagtcgtttaaaccggagaacattgaagtccgggaagtaaaagaagtgcaggttcagagagaagctgatggtaagaatggtggtgaccatgtggagcttatagggaatgaaccatgttctagccggcagaatacaaatgatgagggggatgttgtcgaggagttgactgttaaaacttgtgagggatcgagtatggctatagttggtagaccaagtagtagagctagattagagatgaatcgcagtcagtttctgcatcgttttccgctagacggtgatttaccgggtagtagttctatgagtaagaaggtaattgacaggggaacagtaagtatcttgagaaatgctgggaaaatgtctttgcctgagacttcaaatggacaactggctattattgctgttaatggagaagctaatgaacatttgacaaatgttgaacgaaatcctgtacctgtagaggcattgtctcatgaaggcatcaagacaaagatgttatcgcagtctgggttttctcagttttttgttagaaaaacattgaaagggaagggagttactttcagaggcccgccaaacaatagatctaaagcgaggaatatggatcagcaaactgtagctagttctggtagcgctttagtaatagctaatacttcagcaaagatttctagcagcatccctttggcggcttatgatgatacacatagaggttgtggaggtgaaggtttaagtctgagagaatggttgaagtcggagcggcaggaagttaataaagcagaatgtatgtatatctttaggcagatcgtggatcatgtggactgttctcattctcaaggagttgttttatgtgacctgcgaccatcttcattcaaaattttcaaggaaaatgcagtaaagtatgtggtttcaggttctcaacgagagtcttttgacagcaacatgaacaaagagactttaagtcaactcgaaaaccctctggttagaagacggttaggagatacttctagtctctctatccctgcaaagaagcagaaatcaagtggaccaagctctagacagtggcctatgtttcaacgagctggtggcgtcaatatccaaactgaaaataatgatggcgcgatacaggagtttcatttcagatctagtcaacctcattgtagtacagttgcctgcccttttacttcagtgagtgagcagttggaagagaaatggtatgcgagccctgaggagctcaggggtgacatgcgttcagcctcttcaaacatctatagtttgggtattcttctttatgagttgctgagccaatttcagtgtgaaagagctcgtgaggctgcaatgtctgatatccgacaccgcattcttcctcccaaatttctgtcggagaatccaaaggaagctgggttttgtctttgggacatcttacaatctgaagtagttaatggaatcccggatttgtatgctgaaggcttatctttatccattgaacaagaggacacagagtctgaactcttgcagcatttccttttcttgtcccaagagaaaaggcagaagcatgctggaaatttgatggaagaaattgcgtccgtagaagcagatatcgaggaaattgtcaagagacgttgtgccatagggcctccgtccctggaagaagcttctagctcatctcctgcttctagtgtacctgaaatgagactgatcaggaacattaatcagcttgaaagcgcttatttcgctgcaaggatagacgcacatctccctgaagcacgttataggttacgcccagatagagatctgctaagaaatagtgataatactgtagcagaagtagaaaacagtgagacttggagctcagatgatcgtgttggagcgttctttgatgggttatgcaaatatgctcgatatagtaagtttgaaactcggggtgtgctgaggaccagtgagttgaacaacacttcaaatgtgatttgttctctgggttttgatcgggacgaggattattttgccacagctggtgtgtcgaaaaaaattaagatatatgagttcaattcccttttcaacgaatctgttgacattcattatccagccatagaaatgccaaatagatcaaagcttagcggcgtttgctggaacaactacattaggaactacctagcttcctctgattatgatggtattgtcaaggtatttgaacctttgaagttttacgtagattgtttatcacttgattacccctttatttccttcggacaggccatttcacatttcatagagcatgagaagagggcttggtctgttgacttctctgaagcttgtccgacaaaattagccagtggaagcgatgattgttctgtgaagctatggaacatcaatgaggcatgctcttctatactggattttgtcgttttaatagctactcctactgagatatctggcatatatacatatgaatatatcaatagcactttggattattctgtcaataggaactgcttaggaacaatcaggaacattgcaaacgtttgttgtgtgcaattttctccacagtcctctcacttgctagcctttggatcatcagacttcagaacctactgctatgatctaaggaatttaagaactccttggtgcatactgtcaggacacaacaaagcagttagctatgcgaagttcttggataatgaaactcttgtaacagcatcaactgataacacgttaaagctttgggatcttaagaaaaccactcacggtggcctctcaacaaatgcttgcagcttaacttttggcggccatacaaatgagaagaactttgttggtttgtctacttctgatggatatatagcttgtggctctgagacaaatgaggtttatgcctatcaccggtctcttcccatgccaattacctcgtacaagtttggttctattgatccaatatcaggtaaggagatagaggaggacaacaacctgttcgtttcaagcgtttgctggagaaaaagatcgaatatggttgtttcagctagctcaaatgggtcaatcaaagttctacagttggtctga

SEQ ID NO: 1078 - DNA, 990 bp, Arabidopsis thaliana
atgaagacgatgacgcaattaaatattgcggttgtggttgtagtgacggttcttattggaatgttgagatcatcggaggctcaacttcaaatgaatttctacgcgaagagctgtccaaacgcagagaaaatcatttcagatcatattcaaaatcatatccacaatggtccttctcttgcagctcctctcatccgaatgcacttccatgattgcttcgttaggggatgtgacggatcggtgttgataaattcaacatctggtaacgcagagagagatgcaccaccgaatctaacacttagaggattcggtttcgtggaaaggattaaggctcttcttgaaaaagtgtgtcctaagactgtttcttgcgcagatatcattgctttgactgctagagacgcagttgtcgccaccggaggtccttcatggagtgttccaacgggtagaagagacggtaggatctcaaataagacggaggctactaataacattccacctccaacgagtaatttcacgactttacaacgacttttcaaaaaccaaggccttaatctcaaggaccttgttctgctctctggggctcacacgattggcgtctcacattgttcttccatgaatacgcgtctctacaacttctcgactacagtaaaacaagatccatctctcgatagccagtatgcagcaaatctaaaggctaacaaatgtaagagccttaacgacaatagcaccatcctcgagatggatcccggtagtagcagaagcttcgatctcagttattataggcttgtcttgaagaggagaggcttgtttcagtctgattctgcattaacaacgaactcagcgactttgaaggtgatcaacgacttggtcaacggttctgaaaagaagtttttcaaagcttttgctaagtcaatggagaagatggggagagttaaagtgaagactggctcagctggtgtgatcaggacacggtgttctgtcgctggaagttag

SEQ ID NO: 1079 - DNA, 2124 bp, Arabidopsis thaliana
atggcgttgaaggcggtggttattgtatattgtgtggtttctctcgtcagtgttcaattagctgatgctcaacatgaaggactgccagtttcaccaacgttatcaccttcaacttcaccagttatcactgatctgcccctaccagctgaatttccgcggtttcacagaaagtatttcgcaccacaacaagcagaagcacctcagcattctcccccttatagtcgtttggtcgcttctgatcatccccctaccagctcacatttctccaaaccttccatgaaaaggaatgctcagtctcctggagccggcttggctgatattgctccagcacaatctagcaatggtgttcttcctgatgccttaactcagccacctttgtcgccctccatttcaaattgttgcaaatcagatatggtgcttaaacgaagaagtattggttgccactgcgtgtatcctataaaactggacatccttctcttgaatgtttcagaaactcctagttggaacatgttcttgaacgaatttgctacccagcttggtctcctacctcaccaaatcgagctgattaacttctatgtgctaagcttatcaaggatgaacatatcgatggatatcacccctcattctggaattagtttctcagctagtcaggcatccgcaataaactcttcccttatcagccacaagattcaatttagccctactttggtgggagattacaaacttctaaaccttacttggtttgaggcccctgcaccttcgcaagcacctctagtggcttcttcacctcataaagcaccatcacaaggatcctcagcaactacgtcagtaagatctccagggaaaaagaggcatcccaatcttattcttatcttttctatagccgctggtgtgcttatacttgccataatcactgtacttgttatttgttcccgcgcactccgagaagagaaagctccagatcctcacaaagaagctgtaaaaccaaggaacctggacgctggttcatttgggggatctcttcctcacccagcaagtacacggtttctgtcatatgaagaactcaaagaggcaactagcaattttgaatctgctagcattctaggagaaggtgggtttggcaaggtttacagaggcatcttagccgatggtactgctgtagcgattaagaagctcacaagtggtgggccacaaggtgataaagaattccaggtggagattgatatgcttagccgtcttcatcatcgtaatcttgtgaaacttgtgggttactatagtagtcgagattcttctcagcacctactttgttatgagcttgttccaaatggcagcctcgaggcttggctccatgggcctctcgggttgaactgtcctcttgattgggacaccagaatgaagattgcacttgatgctgcaagaggacttgcataccttcatgaagactcgcaaccctccgttatacacagagattttaaagcctctaatatactccttgaaaacaacttcaacgccaaagttgcagattttggcctagccaaacaagctcctgaaggcaggggtaatcacttatctactcgtgttatgggcacatttggatatgttgcgcctgaatatgcaatgacgggacacctactcgtcaagagtgatgtttatagttacggtgtggtccttctcgaattgttaactggtagaaaacctgtggatatgtcacaaccttcaggccaagaaaatctcgtcacttggacaaggccagttttaagagacaaagaccggttagaagaactagtcgattcaagacttgaaggaaaatacccgaaagaagatttcataagagtatgcacaatcgctgcagcttgtgttgcacctgaagctagccagagaccaacgatgggcgaagtggttcagtcacttaaaatggttcaacgggtggttgagtatcaagacccggttttaaacacttcaaataaagctcgtcctaaccggagacaatcatcagctacgttcgagtcagaagtaacctcttctatgttctcttctggtccttattctggtctaagcgcttttgatcatgaaaatattacacgaacaactgttttctcagaagatcttcacgaaggccgatga

SEQ ID NO: 1080 - DNA, 345 bp, Arabidopsis thaliana
atggcgtcgtttgatgaagcaccaccaggaaacgccaaggccggtgagaagatcttcaggaccaagtgtgctcagtgtcacaccgtcgaagcaggcgccggtcacaaacaaggacccaatctaaacggtctatttggaagacaatctggtacaactgctggttactcttactctgctgctaacaagaacaaagctgtggaatgggaagagaaggccttgtacgattacttgctcaaccccaagaagtacataccaggtaccaagatggtgttccctgggctaaagaagccgcaagaccgtgctgatctcatcgcctacttgaaggaatctactgcgcctaagtga

SEQ ID NO: 1081 - DNA, 339 bp, Arabidopsis thaliana
atggcgtcgttcgacgaagcacctcccggaaaccccaaagccggtgaaaagatcttcagaaccaagtgcgctcagtgtcacaccgtcgagaaaggtgccggtcacaaacaaggaccgaatttgaatggattgtttggaagacaatctggaacaactccaggatattcttactctgctgctaacaaaagcatggctgtgaattgggaggagaagactctttacgattacttgttgaatcctaagaagtacatccctggaacaaaaatggtgtttcctggactgaaaaaaccgcaagatcgtgccgatctcatcgcttatttgaaggaaggtactgcttag

SEQ ID NO: 1082 - DNA, 1359 bp, Arabidopsis thaliana
atggctcgactccttctcctcttcttcttcttccttattctactccattacgcttcttgttccagacacgaacaagaaaaagaccgaatctttcaccttcccggtgaaccaaacgatgtctccttctctcacttctctggttacattaccgtcaacgagtcagcaggaagagcactattctactggctcactgagtcaccaccgagtgaaaaccctgagtctaagcctcttgtcctctggctcaacggtggacctggttgttcctccgtagcttacggtgccgctgaagaaatcggaccttttagaatcaatcctgatggcaaaactctttaccacaatccttactcttggaacaaattggcgaatttgctcttccttgaatctcctgctggtgttggtttctcgtattcgaatactacctccgatttgtatactgccggagatcagagaactgcggaagatgcttatgtgtttcttgtgaaatggtttgagaggtttcctcaatacaaacacagagagttctacattgctggagaaagctatgcaggtcattatgttcctcagttgtcacagattgtttatgagaaacgcaatccagctatcaactttaaaggcttcattgttgggaatgctgtgattgatgactaccatgattacgtgggtttatttgaatattggtgggctcatgggttgatatctgatctcacttaccacaacttacggatcacgtgtgaatttggatcatccgagcacccgtcctctaaatgcaccaaggccatggaagctgcagacttggagcaaggcaatattgatccttatagcatttacactgtcacttgtaaaaaggaggctgcagctcttaggtctcgcttctcgagagttcgtcatccatggatgtggagagcctatgacccttgcacagagaaatactccggcatgtatttcaattctccggaggttcaaaaggctatgcatgctaatataacaggactagcttatccatggaaagggtgcagtgacatcgttggagagaaatgggcagattctcctctgtctatgcttccaatctacaaagaactcatcgccgcaggtctcaggatatgggttttcagcggagacactgattcagtggttcccattactggaacacgatactccattagagccctcaagttacaaccactctccaaatggtacccttggaacgatgatggacaggttggtggatggagccaagtttacaaagggctgactctggtgacaatacatggagcaggacatgaggtacctcttttccgccctcgtcgagcttttcttctttttcagtcgtttctcgacaacaagccattgccaatgtaa

SEQ ID NO: 1083 - DNA, 1089 bp, Arabidopsis thaliana
atgttgaagctttcgtgtaatgtgactgattctaagttacagagaagcttactcttcttctcccattcatatcgatctgatccggtgaatttcatccgtcggagaattgtctcttgttctcagacgaagaagacaggtttggttcctttgcgtgctgttgtatctgctgatcaaggaagtgtggttcaaggtttggctactctcgcggatcagctccgattaggtagtttgactgaagatggtttatcttataaagagaagtttgttgttagatcttacgaagtgggtagtaacaaaaccgctactgttgaaaccattgctaatcttttacaggaggtgggatgtaatcatgcacaaagtgttggtttttcgactgatgggtttgcaacaacaactactatgaggaagttgcatctcatttgggttactgcgagaatgcatatcgagatctataagtaccctgcttggggtgatgtggttgagatagagacttggtgtcagagtgaaggaaggattgggacaaggcgtgattggattcttaaggattctgtcactggtgaagtcactggccgtgctacaagcaagtgggtgatgatgaaccaagacacgagacggcttcagaaagtttctgatgatgttcgggacgagtacttggtcttctgtcctcaagaaccgaggttagcatttccggaagagaataacagaagcttgaagaaaatcccgaaactcgaagatccggctcagtattcaatgattgggcttaagcctagacgagctgatctcgacatgaaccagcatgtcaataatgtcacctatattggatgggttctcgagagcataccacaagaaattgtagacacgcacgagcttcaggtcataactctggattatagaagagaatgtcaacaagacgatgtggtggattcactcaccaccaccacctctgaaattggtggaaccaatggctctgccacgtctggcacacagggccacaacgatagccagttcttgcacctcctgaggttgtctggagatggtcaggagatcaaccgcgggacaactctgtggagaaagaagccttcaagttaa

SEQ ID NO: 1084 - DNA, 2010 bp, Arabidopsis thaliana
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccacctcttccacttccttcaatgggtccgatatttaccggtgttactttctcgtctcatagctcatcgacggcttcaggaatggggtctgatgatgatgacgacgatatggacgttgatcaggctaacattgcgggttctagtagccgaaaacgcaaacgtggaaaccgcggtggaggcggtaaaatgatggaattgtttgaaggtttggtgagacaagtaatgcaaaagcaagcggctatgcaaaggagtttcttggaagctcttgagaagagagagcaagaacgtcttgatcgtgaagaagcttggaaacgtcaagaaatggctcggttagctcgagaacacgaggtcatgtctcaagaacgagccgcctctgcttctcgtgacgccgcaatcatttcattgattcagaaaattactggccataccattcagttacctccttctttgtcatctcaaccgcctccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaagccagaagaccttgtgatgagagagctgattcaacaacaacagcaactacaacaacaagaatcaatgataggtgagtatgaaaagattgaagagtctcacaattataataacatggaggaagaggaagatcaggaaatggatgaggaagaactagacgaggatgagaagtccgcggctttcgagattgcgtttcaaagccctgcaaacagaggaggcaatggccatacggaaccacctttcttgacaatggttcagtaa

SEQ ID NO: 1085 - DNA, 2661 bp, Arabidopsis thaliana
atgtcgaagatgaagcatcttctacggaagctccacatcggcggaagtagtggcgtcggcggcggatttgctgaccatcacaggttagacgactcgactagacctatgatcgatcctagccctattcttagtactagccctagccctgcatcgacttcttccgtctcttcctctggttttggtaacgcttccacgacaatgccgagactggatacatttgagcctgttggccgtgatctgacggctgttgatggtgttgatttcaatttgatggaggaggagtaccaagtccagttagctatggcgatcagcgtctctgatcctgatccgagagagaatgcagatacagctcagcttgatgccgctaagaggattagccttggggtttctgctccggtcaccgacgctgattccgccgttgactttctctcgcttcgttattggtctggttgctcgattagcgagggtttaaaggaattaggatcttggctattgcctgcagtgttctcttcgttgcgagtatttctgaatcctaattgtggacataaggtcattaattatgaccagaaagtcagggatggattttacgatgtgtatgggattacatctaattctctttcacaggggaagatgccacttcttgttgatcttcaagcgatctctatttcagataatgttgattatgaggtcattctagttaacagattgattgatcctgaactacaagagctagagaggagagtattcgctttggcttcggaatgtccagactttgctcctggtcaggtgtcaagtgatttgactcagaaaattgcaaatatagttgtagagcaaatgggtggccccgttgaaaatgctgatgaagcattgagaaggtggatgcttcggagctatgaactaagaaattctttgaacactactattcttccacttggtcgagttaatgttggtcttgcacgacacagggctttgcttttcaaggtccttgctgataggattaatctcccatgtatgctggtaaaaggcagttactacactggaactgatgatggggctgtgaacttgattaaactagatgacaaaagtcctaattcgttcttcacatgcagtgaatacattattgatttaatgggtgctccgggtgctctgatcccttctgaggttccaagcagttttcttccagtttcttgcacagatacaagagtatttcctgagaatttggactctttgcaacattcatcccccgtacttgagaaagaaattgaaacgccagcattttcagtttcgaaggaagcagattctagatctggtatggtagcaaacttcttcactggaaaccaggaagaaaacagtgacagatgtgctgttgaaaaacatcaaacagagagatttgagcatgattttgggaagttaatgcactcacagcagatatctggtgaaaatatgccaccattttctgggaaaccgacttgtgcacagaaagttaaagttaaaaatgtctcaaagtatgtcataagtgcagcaaagaaccctgaatttgcgcagaaattacatgctgtgttgttagaaagtggtgcatcacctcccccagatttgtttatggatattaacccacataacttgagggggaagaatttgcttcaagagctccgccaagaaagtagcaattctatggtttctggtattccatgctacccagaaaaggtagctgaacaactgagagaatctgaaaggaaccccacagccgagagttaccaacaatcagtggaggtcgatttgtcaatgaagaggaactttgatttggataatactggtaaagcttcttcatccgaaaatatggaggttggcactgctgatggggagtctgctgtttgtgatagtcatgaccaagggattaatccattgctcggagaagctgcaaagtgggaaattatgtgggaagatcttcagattggcgagcgcattggtattggttcatatggagaagtttatcgtgcagagtggaatggaactgaagtggctgttaagaagtttctggaccaagatttctctggtgatgcattgacacagttcaaatctgaaattgaaataatgttgaggttacggcatccaaacgttgttcttttcatgggagcagttactcgtcccccaaatttctccatcctgacagagttcctacccaggggaagtttgtatagattactccatcggccgaaccatcagcttgatgagaagaggagaatgcggatggctcttgatgtggcaaagggaatgaactacttacacaccagccacccgactgttgtacatagggatttaaaatctccaaaccttcttgttgataaaaattgggttgtgaaggtttgtgattttggattgtcccgcatgaaacaccacacatatttgtcctcgaaatcaactgcaggaacgcctgagtggatggctccagaagtgttgaggaatgaaccggctaatgagaaatgtgacgtgtacagctttggtgtcatattgtgggaattagctacttcacgcgtcccctggaaaggtttgaacccgatgcaagtcgttggagctgtgggattccagaatcgacgccttgaaatcccagatgatatcgatctaactgtggcacagataatccgtgaatgttggcaaacgtaa

SEQ ID NO: 1086 - DNA, 1581 bp, Arabidopsis thaliana
atgggtcacggaggagaagggatgtcgcttgaattcactccgacgtgggtcgtcgccggagtttgtacggtcatcgtcgcgatttcactggcggtggagcgtttgcttcactatttcggtactgttcttaagaagaagaagcaaaaacccctttacgaagcccttcaaaaggttaaagaagagctgatgttgttagggtttatatcgctgttactgacggtattccaagggctcatttccaaattctgtgtgaaagaaaatgtgcttatgcatatgcttccatgttctctcgattcaagacgagaagctggggcaagtgaacataaaaacgttacagcaaaagaacattttcagacttttttacctattgttggaaccactaggcgtctacttgctgaacatgctgctgtgcaagttggttactgtagcgaaaagggtaaagtaccattgctttcgcttgaggcattgcaccatctacatattttcatcttcgtcctcgccatatcccatgtgacattctgtgtccttaccgtgatttttggaagcacaaggattcaccaatggaagaaatgggaggattcgatcgcagatgagaagtttgaccccgaaacagctctcaggaaaagaagggtcactcatgtacacaaccatgcttttattaaagagcattttcttggtattggcaaagattcagtcatcctcggatggacgcaatcctttctcaagcaattctatgattctgtgacgaaatcagattacgtgactttacgtcttggtttcattatgacacattgtaagggaaaccccaagcttaatttccacaagtatatgatgcgcgctctagaggatgatttcaaacaagttgttggtattagttggtatctttggatctttgtcgtcatctttttgctgctaaatgttaacggatggcacacatatttctggatagcatttattccctttgctttgcttcttgctgtgggaacaaagttggagcatgtgattgcacagttagctcatgaagttgcagagaaacatgtagccattgaaggagacttagtggtgaaaccctcagatgagcatttctggttcagcaaacctcaaattgttctctacttgatccattttatcctcttccagaatgcttttgagattgcgtttttcttttggatttgggttacatacggcttcgactcgtgcattatgggacaggtgagatacattgttccaagattggttatcggggtcttcattcaagtgctttgcagttacagtacactgcctctttacgccatcgtctcacagatgggaagtagcttcaagaaagctatattcgaggagaatgtgcaggttggtcttgttggttgggcacagaaagtgaaacaaaagagagacctaaaagctgcagctagtaatggagacgaaggaagctctcaggctggtcctggtcctgattctggttctggttctgctcctgctgctggtcctggtgcaggttttgcaggaattcagctcagcagagtaacaagaaacaacgcaggggacacaaacaatgagattacacctgatcataacaactga

SEQ ID NO: 1087 - DNA, 9163 bp, Arabidopsis thaliana
catttgatacgactttgcaagggatcagttcagctgatagagcctttaaggatgatgattttgaacaagtttctctgggagatcaggaaaaggctgcgaatgaatctcagggtgaccttcaggaacctggaagcttttcaaattctgatcatgggaggtcttcatttggtggcactgaagtagttacttatcaattatccgggactcaggagatgtatgatctcatgcctatggacgatgtgcaaagtgaccgactttctagccctggacctgagagagaggcagcttattccatgcagcagtccctttctgaaactagtctggattctgtccaccatccagaatctggatattcccctgttcattccccgcagaagcccaagccaaaggccactgttccaaatgtttctccagagctactgcatcttgtggattcagccatcatggggaagcctgaaagcttagacaaactaaagaatgttgtatgtggtattgagaattttggctgtggagaggagtcagaggccactgctttccttgttgttgattcacttattgccaccatgggtggagttgagagttttgaagaggatgaagatagcaaccctcctagtgtcatgttaaattcccgtgctgctattgtttctggggagcttattccttggcttcctggtttaggtgataacgtaaattttatgtcccccaggactcgcatggttcggggtttgcttgttattttacggtcatgcacgagaaatagagctatgtgttccacggcagggttattaggagttttgttgcgatcagtggaagcgataatttccaaggacgttgatatgaaatggaatgctgctgctattttgctactatgtattcaacatttagccgggcactcccttagtgtcgatgatttacacaggtggcttcaagttataaaagccgcaattacaacagcctggtcaagtccgttgatgcttgctttggagaaggcaatgagtggaaaggaatcaagggggcctgcttgtacttttgaatttgatggtgaaagctctgggttacttggtcccggagaaagtcgttggccctttaccaatggctacgcatttgcaacatggatctatattgaatcatttgctgacacattaaatgctgcaactgcggcagctgcaattgctgctgccgcagcagccaagtcagggaaaacatccgcaatgtcagctgcagcggctgcgagtgcgcttgctggtgaaggcactgctcatatgccacgtttgttcagctttttgtccgctgataatcagggaatagaagcatatttccacgctcaatttctggtggttgagagtggtagtgggaaaggaagaaagtcttcgctgcattttactcatgcatttaagcctcaatgttggtattttattggtcttgagcatagctgcaagcaaggacttctggggaaagcagagagtgaactacgattatatattgatggatccttgtatgaaagtcgtccttttgattttcctcgtatatccaagcccctttctttctgttgcattggcacaaatcctcctcctactatggctggtctacaacgtcgccgtcgtcaatgtcctttgtttgcagagatgggaccagtttatatatttaaggaaccgattggtcctgagagaatggcgcgtttggcgtctagaggtggagatgttttgccttgttttggcaatggggcaggccttccttggctagctacaaatgactatgtacgtaataaggcagaagaaagtagtattttggatgcagatattggaggatatacccacctgctttaccacccttgtctgctaagtgggagattttgtccagatgcttcactttctggagcagcaggcactctaaggcgaccagctgaggtccttggacaagtccatgttgcaacgagaatgaagccagtggagtctttctgggccttagcttatggaggacccatgtccctgcttcctttgaccgtaagcagtgtgcataaagatagcttggagccatgtcttggaaatcttccactgtctttgtccacagttacacttgctgcacctgtatttagaattatgtcagtcgctattcaacatcctgggaacaatgaagagttgtgtcgtactcagggacccgagattcttgctagaattctgagttatcttctacactcacttgcatcccttgacaggaagcatgatggagtaggagaagaggagctagttgctgccattgtttcgctttgccaatctcagaagatcaatcatgttctcaaagtgcagctctttcgtacgcttttattagatttgaaaatatggagcctgtgcaattatggactccaaaagaagctattgtcatcccttcaagatatggttttcactgaagcaacagctatgagggatgccgaagctattcagttgcttctagatggctgtcgaagatgctattggatgatttctgagaaggattctgagaccacttttcctcttgatgggaatacgcgtcaaatgggggaactcaatgctctgattgatgaacttctggtgattattgaacttctaatgggagcagcatctccttctttagctgctgatgacctccgtcgattacttggtttcataattgacagcccacagccaaatcaggttgcgagggtattacaccttatgtataggttggttgtacagccgaatgctgcaagagctcagatgtttgcagaggtatttataacgtctggtggtatagaaacacttcttgttctgctgcagagagaagctaaaactggtgaggataatgttttagctatgggtaggagtggaaaaaggtcatcgactgatccaagtgaaaagagtccgtacaacgagtctggttcggtaaaacagttggattccaatccacacgataatgagattggctttgaccttcctggtcctgatggaaattctgttgaggatgataatgttgggtctctgaatgtaccagagtcagttcgacaagaaaaggagcatggttccacacctgtcgtttgtgatagtgactcagtttccatctccaattccataaatactgagagactatcagctgaaattggtggtataagtctttcaataagtgctgatagtgcaagaaataacgtgtacaatgttgacaatagcgatgctgttgtggttgggatcatcagattgattggtgctttaatttctagtgggcacctaacatttgatttcgatgcccgttctgatgtgacaagtaacatcctgggtagtgggctccatgaaaatggtggaacaatgtttgatgataaagtcgcattgcttctatttgctttgctgaaggcatttcaagctgctccaaacaggctgatgactgacaacgtctatacaactttgcttggggcctcgatcaatgcttcgtcaacagaagatggccttaacttttacgattcaggtcatcgctttgaacattcccaacttttgttagtcctcctgcggtctctaccatctgcatctaaggctctacaaagccgagcacttcaggatcttctttttttggcttgcagtcatccggaaaatagaagcagtctgacaacaatggaagagtggcctgagtggatcttggagatactgatctcgaactatgagaaggatgcagggaagcagtctgcttcagtgggttcttgtgaggtagaagatatgattcacaacttcttgatcataatgttggaacattcaatgcgccagaaagatggttggaaggatatcgaggctacaattcattgtgcagagtggctttctatcgttggtggttccagcactggagagcaaagaattaggcgtgaggagtcactaccaatttttaaaagacgactttttggtggattgctagactttgctgccagagaactgcaagctcagactcaagttattgctgcagcagctgctggtgttgctgcagagggtctagcaccaaaggatgcaaaagcaggagcagaaaatgctgctcagctttctgtttttctggtggaaaatgcaatcgtgattttgatgcttgtcgaagatcatttgcggtcacaaagcaaacagacttgtgcaaccaatgcagttgcttctccatcccctcttaaaaaacgtacaagcacactgacagcgatcggagaatcatcagagatttctagcagccgtgcttcactgtcaagtgattcagggaaagtccctttagatatactcgcatcaatggctgattcaagtggacagatttctgcagtcgcaatggagcgccttactgctgcttctgcagctgagccttatgaatctgtttcatgtgcttttgtttcatatggcagctgtgccatggatttggctgagggttggaagtacaggagtcgattgtggtatggtgttggccttccctctaaacccagttcacttggtggtggtggcagtggttcagactcctggaaatctactttagaaaaagatgctcatggaaactggattgaacttccattggttaaaaaatctgtatccatgcttcaagctttgctattagatgagtctggactcggaggtggccttggaataggtggaggatctggtacggggatgggagggatgacagccctctaccagttgctggacagtgatcagcctttcttatgtatgctgcggatggtgcttctgtctatgagggaggaagactatggcgaagataatatgttgatgagaaatctaagttctgaacgctcctcagggaattcagttacattagatagtggttctcagatgtctatgcgacaatcccgatcagctttattgtggagtgtgctatctcctatcataaacatgccaatatccgattcaaagaggcagagagtactggttactgcatgtgttctctattctgaggtatggcatgctatcagcagagacagaagaccacttcgtaagcagtatatagaggctattgtaccaccatttattgcagtcctccggagatggcgaccacttttggcgggcattcatgaacttgccactgctgatggtatgaatccccttgtcgttgatgatcgtgccttggctgctgatgcgctccccgttgagggtgctctttctatggttactccggagtgggctgctgcttttgcttcaccgcctgctgcaatgtctctggcaatgatagctgcaggggcagctggttgggaagcaccaccacctcctacaccttcacatcttaggcgagactcttcaatgcttgagcgtaagactgcgaaacttcagaccttttcaagcttccagaaaccactggagcctccaaacaacaatgcaccacctcgaccaagagacaaagctgctgcaaaggcggcagctttggcagccgcacgagatcttgaacggaatgcaaagattggttcaggaagaggtctgagcgctgttgcaatggcaacatctgcacagcggaggaatatcggtgacatggagcgtttacagagatggaacacttctgaagctatgggagtggcgtggatggaatgtctccaaccagtggatacaaaatcagtttatggaaaagattttaatgctttgtcctacaaatttattgctgtacttgttgcgagttttgcattagcacgtaacatgcaaagatcagagattgataggcgtatgcaagatgatatcatagcggcaaaccgtctatgcttgggaagccgtgcttggcgaaaactaattcgttacttggcagagatgcgatgcttttttgggccttttggagatggaatatgcagtcctgaacgcgttttctggaaacttgattctatggaaagcttttcgaggatgagacagtctataaggaggaattattctgggactgatcatcacggggcagcagcagattatgacgatcagacagaaacaaaaagtgataatggtagcaagggttctcaatcaaatcctcctgttgttgctgctgaagtaatattaatggaaatagcgtatgaagaggatgaacatggagagggtgatcagcttgatgtcaaaggtaatgctgaagaacataaaagggatgaagggagaatatctgggtcacatgagcatgcatccagaacttcagcaggaaacagtgatcctcgaacatcaaatgaccttgaaatggtccgagattcttcagtagtagcacctggctttgttcccagtgaacttgatgaaaggatccttcttgaacttccaacatctatggtccggccactaagggttgtgaaaggaacctttcaaattacaacaaggagaataaattttattgttgacaacagagaaagccagaatttggctgatcactcagatgagtcccaatcaggtgatcaagaaaaggatcgtagttggccaatgtcttctcttcatcagatttatagccggagatatctcctgagaaggagtgccctggaactttttatggttgaccgttcaaacttcttctttgattttgggaatactgagggaagaagaaatgcatatcgagctatcgtgcaagcaaggcctcctcacttaaacaatatttacctagcaactcagaggccggaacagcttttgagaagaactcagttaatggagcgctgggctagatgggagatcagcaattttgaatacttaatgcagcttaacacgttggctggccgtagttacaatgacattactcagtatcctgttttcccgtggattatttctgacaacagttcagaaagtctggacctttcaaatccatctaccttcagagatctttccaagccaattggtgcattgaacccagagcggctcaaaaaatttcaagagcggtattctagcttcgaagatccagttattcccaaattccactatggctcacattactcgagtgctggagcagtgttgtattatcttgccagagttgaacctttcacaaccctatcaattcaacttcaaggtggaaagtttgatcatgcagaccgcatgttttcagactttccaggcacttggaatggagttcttgaagacatgagtgatgtgaaagaattggttccagagttgttttacctccctgaggtgctgaccaacgaaaattcgattgactttggtacaacacagttgggagaaaagcttgatgctgtaaaacttcctccttgggccaaaaacccagtggattttgtacacaagcaacgaagggctcttgagagcgagcatgtatctgctcatttgcatgaatggattgatctcatatttgggtataagcaacgtggcaaagaagctataatggcaaataacgttttcttctacattacctacgaggggactgttgatattgataagatcacggacccggtacaacaacgtgccacacaagaccagatagcttattttgggcaaacaccatcccagctgttgacagttcctcacatgaagaggatgccgttgaaagatgtcctacatatgcagactatttttcgaaatccaaaagaaataaaaccatatactgttcaaaccccagagcgctgcaacttaccagcctcagccattcaggcatcttcagatagtgttgtgattgtggacatgaatgtgccagcagctcgtgttgcacagcacaagtggcaaccaaacactcctgatggccaaggtactcctttcctcttccatcacgggaaggcaacaacaacttcaactagtggatcattgatgcgcatgttcaagggtccagctagttctggaactggtgactggcaatttcctcaggcacaagcatttgcctcatcaggaatcagaagttcgtccgtgattgctattactagcgatggggaaataatcacaggtggacatgcggataatagtatcaagctagtctcatctgatggggcaaaaactctggaaacagcttttgggcactgtgcccctgttacatgtctggctctttctccagacaacaacttccttgtgacgggttcacgggacagtactgttttgctatggagaattcacaaggcgtttacttctcgaacaagcgtgtctgagccatcaactggctctggagcgccttcctccacaagcaacacgaatctggccaatacgttggcaaacaaaggcaaaaaatgtcgccttgaagggcctatacaagtgctccgaggccatcgaagagaattagtttgttgttgtgtcagctcagaccaaggagtcgttgtttcgtcttctgagtcctcagatgttctattgcattccattagaaaaggacggctgatcagacgattagttggtgtgaaggcagattctctctgcatttcatcggatggggttataatggcgtggagtagttcagaaggttctattagcgtgttcaccattaacggtgttctgattgccaaagcaaaatttcccctcttttgtagcgttggttgcatggaaatatccatggatggtcaaaatgccttgatagggatgaactcatgttccaactcggattattcgagtagtaatgatacatcgaaagatagcaaagaaattgaaagactggatgttccatctccttcaatttgcttcctcaacttatacacactacaggtattccatgtgctaaagcttggtcaaggccaggatataaccgcactggctctgaacgttgacaacacgaacctcttagtttccacagaagataaacaattgataatcttcactgatccggctttaagcttaaaggtggtggatcagatgctgaagctcgggtgggaatgagagaaaagaatcaaacctcactgatacagaatggcggaaactcacggcaaggaaaatctcatgtttgaatactcggggaagtcaaaggtgtagcaagccgtggaaatcttaaaatcagattgtggacatgtttgttcgtctgtaacatatgtaagtttggttagtcccagtaaagtgaacccgtttcatatttttgtttgttctgatttcgtcggtccatagtttttgtgaagatggtttacagatatcaaaggcttgttgagtttgttgaggtatacacacaccgaagcttcctttttctctcccccattgagtttgtttgttgggttatacgtgtgtgataaatggtgtctcactgatgattttaatataaattcatttattcatagcaa

SEQ ID NO: 1088 - DNA, 762 bp, Arabidopsis thaliana
atgtacactccatcatacttaaaatattcaataatctcaattatatccgtattattcctccaaggaactcatggagacgacggaggttggcaaggtggtcacgccacgttttacggcggcgaagatgcttccggcaccatgggcggagcttgtggctatggaaatttgtatggccaaggttacgggacgaacacggcggctttaagtacggctctattcaacaacggactcacgtgtggcgcgtgctatgagatgaagtgtaacgatgacccgaggtggtgtctcgggtcaaccatcaccgtcacagctacaaacttttgcccacctaaccctggcctctccaacgataatggaggttggtgcaatcctcctcttcagcatttcgacctcgccgagccagcttttcttcagatcgctcagtatcgtgccggcattgttcctgtctctttccgaagagtaccatgtatgaagaaaggaggaataaggtttacgatcaacggacactcatacttcaacctcgttctgatctccaacgtaggaggagcaggagacgtacacgccgtctcaatcaaaggctcaaaaacacagtcgtggcaagcgatgtctagaaactggggacaaaactggcagagcaattcatacatgaacgaccaaagcctttccttccaggtaacgaccagcgatggtcgcacactcgttagcaacgacgtggctccttctaattggcagttcggacaaacctaccaaggtggtcagttctga

SEQ ID NO: 1089 - DNA, 348 bp, Arabidopsis thaliana
atggtgaaatcgacgagtaaggatgctcaggatctatttcgatctcttcggtctgcttattctgctactccgactaatcttaagatcatcgacttgtatgtcgttttcgctgtcttcaccgctctgattcaggtggtttatatggctttggtgggatcatttccatttaactcgttcctatctggagttctctcttgtatcgggacagcagttcttgctgtttgcctccggattcaagtgaacaaagaaaacaaggaattcaaggatttagcacctgagagagcttttgctgattttgttctctgcaacttagtcctccatttggtgatcatcaacttcctcggatag

SEQ ID NO: 1090 - DNA, 1107 bp, Arabidopsis thaliana
atggagataacaaacgtgatggaatatgagaagatcgcaaaggagaaattaccaaagatggtttatgattactatgcatctggtgctgaagatcaatggactcttcaagagaatcgaaacgctttctctaggattctatttaggcctcggattcttatcgatgtaagcaagattgatgtgagcacaacggttttagggtttaatatttctatgccaattatgattgctcctactgcaatgcagaaaatggctcatcctgatggcgagcttgcaaccgcgagagctacttctgctgctggaacaatcatgactttatcttcatgggctacttgtagtgttgaggaagttgcttcaaccggaccagggattcgttttttccaactttatgtttataaggatagaaatgtggttatacagcttgtgaaacgagctgaagaagctggattcaaagctattgctcttactgtagatactccaaggcttggacgcagagaatctgacatcaaaaacagattcgcgcttcctcgaggtctaacgttgaagaacttcgaagggttggatcttgggaaaatagacaagacgaatgactcagggctagcttcatatgttgctggtcaagttgatcaatcacttagctggaaggatataaaatggctccaatctatcacaagcttgccaattcttgtcaagggtgttattacagctgaggatgcaagaattgctgttgaatatggagctgcagggataatagtctctaaccacggagctcgtcagctagattatgttcctgcaactatagtggccttagaagaggtggttaaagccgtggagggtcggattccggtttttcttgacggtggggttcgccgtggaaccgatgtctttaaggcattggctcttggcgcttcaggtgtctttgtcgggaggccgagcttgttctcgcttgcagcggatggagaagcgggagttaggaagatgctacaaatgctaagagacgagtttgagcttacaatggcactaagtggttgccgttcactgagagagatcagccgaacccacatcaagactgattgggacactcctcattacctctcggccaagctgtag

SEQ ID NO: 1091 - DNA, 2247 bp, Arabidopsis thaliana
atgtctaatcgcaaattcggaatggaaggattcggcattaatcggcaaactagctacagtttcgagcgatctcaagcaccgcaacgtctctacgtccctccctcgtctcgcggcggagacaactccgaagatgccgatcttgataacattgattacatggaaaacgaagaagctgaggaagatattgaggaaggcggttctgctgcggctagcggtggcgaggttgatgagatcgatccattagatgcttttatggagggaattcaccaggagatgaaatctgctccacctcctaagccaaaggagaaactagagaggtacaaggacgacgatgacgatcctgttgagagttacctcaaggccaagaaggatttgggcctgacactagccgccgatgcacttaacgccggttataactccgacgaggaggtgtatgctgcagctaaggcggtcgatgcagggatgctagattatgattccgatgataatccgattgttgtggataaaaggaagattgagcctattacagctctggatcatagctccatcgattatgaacctattaataaggacttttacgaggagctagaatcaatatcaggaatgactgagcaagaaaccacggattaccgtcagagattagggattcgggtctcgggttttgatgttcataggccagttaagacctttgaggattgtggattttcctcacagattatgagtgctatcaaaaagcaagcttatgaaaaacctacagcaatccaatgtcaggctttacctattgtgttgtctggtcgagatgttattggcatagccaaaactggttcaggtaagactgcagcgtttgttcttccaatgattgttcatattatggatcagcctgaacttcagagagatgaaggtccaattggtgtcatatgtgctccaaccagagaattggctcatcaaatcttcttggaagccaagaaattttcgaaagcatatggcttacgagtctctgctgtgtatggtggaatgtctaaacatgaacagtttaaggaactcaaggcaggatgcgaaatagttgttgctactcctggaaggttgatagacatgctgaagatgaaggctttgacaatgatgagagccagttatttggttcttgatgaggcagatcggatgtttgaccttggctttgagccacaagtaaggtctattgttggccagattcgtcctgatcgccagactttactattttcagccactatgccttggaaagttgaaaagttagctagggaaatcctttcagatcctattagagtcacagttggtgaagtggggatggccaatgaagatattacgcaggttgtcaatgtcataccttctgatgctgaaaaacttccctggctacttgaaaagctccctggaatgattgatgagggtgacgtattagtgtttgcatctaaaaaggccactgttgatgagattgaagctcaacttactctaaattccttcaaagttgctgctcttcacggtgataaagaccaagcatcacgaatggaaactctgcagaagttcaaatctggagttcaccatgtgctgattgccactgatgttgctgcccgaggtcttgacatcaaatcgcttaagacagtggttaactatgacatcgcaaaagatatggacatgcatgtacatcgtattggtagaacaggccgtgccggtgacagagatggggttgcctacacacttgttacgcagagagaggctagatttgctggtgaattggtaaacagtctggttgctgctggtcaaaatgtgcctccagaactcacagatcttgccatgaaggatggacgattcaagtccaagcgtgacgggagaaaaggaggtaagaaaggccgaggaggaggtggtggaaacaaaggagtacgtggagttgattttggtcttggtattggatttagctcggaatctagtaggacaccttcttctaaagctgcaccaagtagaagtggggcaatcaattcagtgagaactggagtaatggcccaattcaagaatagttttgtcgctgcaacgccatcaaatccacaaaaccaagcttatccaaacaagagaccatccctaatgggctttgtctcaggtggtactattggtggagacatgggtagaactcagagtcaagctcccccagtagcacctactcaaaacgcctcatcacacaactccagccagaatcactcacagaggtttgattccttttag

SEQ ID NO: 1092 - DNA, 540 bp, Arabidopsis thaliana
atgggaggtggtaaagacaagcatcatgatgagcaagagaaaggatttcatggttttccaggaggtggacattacccacctgctcaaggaggttaccctcctcaaggttacccaccacaacaagggtatcctccagctggaggctacccacctgccggatatcctcctggtgcttaccctgctgcgcccggtggttatcctcctgcacctggaggttaccctcctgctggctatcctgcacctggagctcaccattcaggacattctggtggtggactcggaggcatgatagcaggtgcagctggtgcagccgcagcagcttatggagctcaccatgttggtcacgcctctcacaacccttacgggcatgctgtaggacatggagggtatggccatgcccctgctcatggctttggccatggtggtcatggtaaattcaagcacggaaagcatggaggcaaattcaagcacggaaagcatggaaagcacgggaaacatggcatgtttggaggaggaggcaaattcaagaagtggaagtaa

SEQ ID NO: 1093 - DNA, 417 bp, Arabidopsis thaliana
atgaaaggcggcgaatccaaagctgaagcaacgagcactgatcagagactcaaaaccagaggtagaaaggctgggaagaagacgaagaaggatccaaatcaacctaagagacctccaagtgctttcttcgtcttccttgaggatttccgaaaagagtttaacctagcgaatcctaataacaaatccgtcgctactgttggtaaggctgctggagctagatggaaggcaatgactgatgaagataaagctccttacgtcgctaaggctgagagcagaaagactgaatatattaagaatgtgcaacagtacaacttgaaactggctagtggaaccaatagagaagaggatgactctgacaaatccaagtctgaagttgatgaagcagtaagcgaagaggaggcagaagacgacgattga

SEQ ID NO: 1094 - DNA, 1551 bp, Arabidopsis thaliana
atgacttacgcgtggttatggacgcttctcgcctttgttctgacatggatggtttttcacctcatcaagatgaagaaggcggcaaccggagatttagaggccgaggcagaagcaagaagagatggtgcaacggatgtcatcattgttggggcgggtgttgcaggcgcttctcttgcttatgctttagctaaggatggacgacgagtacatgtgatagagagggacttaaaagagccacaaagattcatgggagagctgatgcaagcgggaggtcgcttcatgttagcccagcttggcctcgaagattgtttggaggacatagacgcacaagaagcgaagtccttggcaatatacaaggatggaaaacacgcgacattgccttttccagatgacaagagttttcctcatgagccagtaggtagactcttacgtaatggtcggctggtacaacgtttacgccaaaaagcagcttctcttagcaatgttcaattagaagaaggaacagtgaagtctttaattgaagaagaaggagtggtcaaaggagtgacatacaaaaatagcgcaggcgaagaaataacggcctttgcacctcttactgtcgtatgcgatggttgttattcgaaccttcgtcggtcactcgtggataatactgaggaagtcctctcgtacatggtgggttacgtcacgaagaatagccgacttgaagatccccatagtctacatttgatattttctaaacctttggtttgtgttatatatcaaataaccagtgatgaagttcgttgtgttgccgaagttcccgctgatagtattccttctatatcgaatggtgaaatgtctaccttcctcaagaaatcaatggctcctcagatacctgaaactggaaatcttcgggagatatttttgaaaggcatagaggaaggattaccagagataaaatcaacagcgacgaaaagtatgtcatcgagattgtgtgataaaagaggagtgattgtgttgggagatgcattcaatatgcgtcatcctataatcgcgtcaggaatgatggttgcactctcggacatttgcattctacgcaatcttctcaaaccattgcctaacctcagcaatactaagaaagtctctgatcttgtcaagtccttttacatcatccgcaagccaatgtcagcgaccgtgaacacgctcgcgagtatcttttcacaagtgcttgttgctacaacagacgaagcaagagagggaatgcgacaaggctgcttcaattacctagctcgtggagattttaaaacaaggggattgatgactattctcggaggcatgaaccctcaccctcttactctagtccttcatcttgtagccatcacccttacgtccatgggccacttgctctctccgtttccttcgcctcgtcgcttttggcatagcctcagaattcttgcctgggctttgcaaatgttgggtgcacatttagtggatgaaggattcaaggaaatgttgattccaacaaacgcagctgcttatcgaaggaactatatcgccacaaccactgtttga

SEQ ID NO: 1095 - DNA, 1305 bp, Arabidopsis thaliana
atggcagaagaagcggatacgaacatcgagatctggaagattaagaaactaatcaagggacttgaatcagctagaggtaatggaacgagtatgatctctcttattatgcctcctcgtgatcaagtatctcgtgtcacaaagatgcttggtgatgaatatggaactgcttcaaacattaagagtcgagtcaatcgtcaatctgttttgtctgccattacttctgctcaacaaaggttgaagctttacaacaaggttcctactaatggtcttgttctctataccggcaccattgttaatgatgacggtaaagagaagaaggtgacgtttgatttcgagccctttaggccgattaatgcttccttgtacctttgtgacaacaagttccatactgaggcattgaacgagcttcttgagtctgatgacaagtttggtttcattgttatggatggtaatgggacactgtttggaactttgagtgggaatactagagaggttcttcataagtttactgttgatctcccgaagaagcacggaagaggaggacagtctgcacttcgttttgcccgtcttaggatggagaagagacacaattatgttaggaaaaccgctgagcttgctacacagttttacatcaatccagctacgagtcagcctaatgtctctggtctgatccttgctggttcagctgatttcaaaactgagctcagtcaatcagagttgtttgatcctcgtcttcaagctaagatattgaatgttgttgatgtttcttacggaggtgaaaacggtttcaaccaagcgattgagctgtctgctgagattctatccaatgtgaagttcatacaggagaagaaactgattgggaagtactttgaggagataagtcaagataccgggaaatacgttttcggtgtggaggatactctaaaggctctagaaatgggtgctatcgaaacccttatcgtgtgggagaatctggacataaacaggtatgagctaaagaacagtacgacaggagaaatggtggtgaaacactttgggaaagatcaagagtctgatacaagcaacttccatgattcagagactaacgcggagctagaagtacaggagaagatgcctctactcgaatggtttgcaaatgagtacaaacgtttcggctgcactcttgagtttgtgactaacaaatcccaagaagggtcacagttttgcagaggttttggtgggattggtggtatgttacgttaccagcttgacatgaggacatttgatgagttatcagatactgaagtttacgaagattctgattaa

SEQ ID NO: 1096 - DNA, 300 bp, Arabidopsis thaliana
atggcgatcagaatccctcgtgtgctgcaatcatcgaagcagattctccgacaagccaaactgttgtcatcatcttcttcttctagctctcttgatgttcccaaaggctacttagcggtttacgtaggagaacaaaatatgaagagatttgtagttccggtttcgtacttggaccagccttcatttcaagatctattaagaaaggcagaggaagagtttggatttgatcatccaatgggtggcctcacaatcccttgcagtgaagaaatttttattgatcttgcttctcgcttcaactga

SEQ ID NO: 1097 - DNA, 894 bp, Arabidopsis thaliana
atggctaataacaacaacatcccacatgatagcatctccgatccatctcctaccgacgatttcttcgagcagatcctcgggctttccaacttctccggttcttcaggttctggtctctctggaatcggcggcgtgggtccacctccgatgatgcttcagcttggttcaggcaacgaagggaatcataatcatatgggtgccattggaggaggtggacctgtagggtttcataatcagatgtttccgttgggattaagtctcgatcaagggaaaggacatggctttcttaaacctgatgaaactggtaaacgtttccaagacgatgttcttgataatcgatgttcctctatgaaacctccaatgtcacagccagctccaccaatgccgcatcaacagtctactattcggcctagagttagggctaggcgaggtcaagctaccgatccacatagcatcgctgagaggctccgaagggaaagaatagcagaacggatcaggtcgttgcaggaacttgtacctaccgttaacaagacagatagggctgctatgatcgacgagattgtcgattatgtaaagtttctcaggctccaagttaaggtcctgagcatgagccgtcttggtggagccggtgctgtcgcaccactagtcactgaaatgccattatcttcatcagttgaggatgagacgcaggccgtgtgggagaaatggtcaaacgatgggacagagaggcaagtggctaagctgatggaagaaaacgttggagcagcgatgcaacttttgcaatcaaaggctctttgcataatgccgatctcattggcaatggcgatttaccattctcagccaccagacacatcttcttcaatcgtcaaaccagagatgaatcctccaccgtag

SEQ ID NO: 1098 - DNA, 528 bp, Arabidopsis thaliana
atgtggttttttggatcgaaaggagcatctggattctcttctcgttccacagcagaggaagtcacacatggtgttgatgggactggtctcactgccattgtcacaggagcatcaagtggtataggtgtagaaacagctcgtgttcttgcactgcgtggtgtgcatgtggttatggcggtgagaaacactggcgccggtgctaaagttaaggaagatattgtcaagcaagtccctggagctaaagttgatgtcatggagttagaactcagctcaatggaatctgtcaggaaatttgcatctgagtacaaatctgctggagctgttggtgcagtggctaaatatatggtcaagtctgttccgcagggggcggcaacaacttgctatgtggcattgaatccacaggttgcaggagttacaggggaatacttctcagatagcaacattgctaaaccaatagaacttgtcaaagatacagaattggcgaagaagctttgggatttcagcactaagcttactgattcgcaatga

SEQ ID NO: 1099 - DNA, 1725 bp, Arabidopsis thaliana
atggagccgaaagagaacggctcagaattgggtcagaagatcattgacggaccaacgaatccaatggtcacacctttactcaatgatctttatcaattcaccatggcttatgcttattggaaagctggcaaacacaacgaacgatccgttttcgatctgtattttcgtaagaacccatttggtggtgagtacactgtgtttgctggattagaagagtgtgttaagttcttagccaatttcaaattgactgatgaagaaatcgatttcgttcaagagtgtttgcctggatctgaggaagctttttgtgattatcttagagggcttgattgttctgatgttgaagtttatgcaattccggaaggatcagttgtttttcctaaagtacctctcatgagagttgaaggacctgttggtgttgttcaattgttggaaactccattcctcaatcttgtcaattttgcatctttggtagctactaacgcagctaggcatcgctttgttgccggaaaatctaagagtctactcgagtttggtgctcgaagggctcagggtccggatggtgcaataagcgcatcaaaatattgctaccttggaggttttgatgcaacaagtaatgtagcagctggaaaactttttgggattcctcttcgtggaacacactctcatgcttatgttagctcattcatgagtactgatgagattgttgacaaagtacttcgtagtgctgatgggaaaaccacgtgcgaggattttgttagtcatgttcagacatggttaaaaaagattcagtattcaccatctctaagtggcattttctctgagacaaatcaaagcgagctagcagctttcacctcatatgcactggcattccccaaaacttttcttgccctcgtagatacatacgatgtgatgaagagtggaatccctaacttctgtgcagttgctttagcactcaatgactttgggtgtgatcatatggaatttgagatgcaattgatgtttattgtgctgcgcagatataaagcattaggtattagactggattcaggtgatttagcttatctatctagagaggccagaaatttcttctgcacggtagagagagaactaaaagtgcctggttttgggaagatggtcgtcactgctagtaatgatctaaatgaagagacgattgacgctttaaataaacagggacatgaggtggatgcttttggcatcgggacctacttggtcacttgctattcacaagcggccttaggttgcgttttcaaacttgtggagataaacaatcagcctcggattaaactttctgaagatgttacaaaggtatcaataccgtgtaaaaagcgaagttacagattatacggcaaagaaggttaccctctggtagatataatgactggagagaacgaaccacctccaaaggttggtgagcgtttactttgtcgtcacccattcaacgaatccaaaagagcatatgtagtgccacaacgtgtcgaagagctcctcaaatgttattggcgtggaagtgcagatgaagcaagagaagtattaccgcctttgaaagagataagagaccgttgcatcaaacagctcgaaaacatgcgacctgatcatatgaggagattaaacccaactccttataaggttagtgtaagcgcaaagctgtacgatttcatccacttcttatggctaaacgaagcacctgttggtgaattgcagtga

SEQ ID NO: 1100 - DNA, 2301 bp, Arabidopsis thaliana
atggaagaatcagaacaagttcttcctctattaacaaacccaaaagatctgacaaacccatcatatgcgtcatcatcttcatcttcatctgaaccaagagatgaaacagaggatcttcttttaccaatctccgacgagaatgaggaggaagaagaagagaactcaccaatccgacaagtagcactcactgttccgacaacagatgatccttcattacctgtcttaacatttcgcatgtgggtcttaggaactctctcttgcatcctcttgtcgtttctcaatcagttcttctggtatagaacagaacctctcactatctctgccatctccgctcaaatcgccgtcgtaccacttggtcgtctcatggctgctaaaatcaccgatagagtcttcttccaaggatcaaagtggcagtttacgttgaatccaggtccgtttaatgtgaaagagcatgtgttgatcactattttcgctaacgcgggagctggatctgtttacgcaatacacgttgttaccgtggtcaaagcgttttacatgaagaacataacgttctttgtgtctttcatcgttatcgttaccacccaagtgttaggttttggatgggctggaatatttaggaaataccttgttgaaccggcggcgatgtggtggccggcgaatcttgttcaagtctcactatttagagctttgcacgagaaagaagaacggaccaaaggagggctgacacgtacacaattcttcgtgatagcattcgtttgcagtttcgcttattatgtctttccgggctacttatttcagatcatgacgtcgttgtcgtgggtttgttggttctttccatcatcagttatggcccaacagatcgggtctggtcttcacgggttaggtgttggggccataggacttgactggtcaaccatttcctcttacttgggtagtccactcgctagtccatggtttgctacggctaatgtgggtgtgggatttgtgctggtgatatatgtcttggtaccaatatgctattggctcgatgtgtacaaggccaagaccttccccatattttcgagctcacttttttcgagccagggttcaaagtacaacatcacatccattatagactctaatttccaccttgacctcccagcctacgagcgtcaaggccctttgtatctttgcactttcttcgccattagttacggtgttggttttgccgctttaagcgctaccatcatgcatgttgctctcttccacggaagggagatatgggagcagagtaaggagagttttaaagaaaagaaattggatgtacacgcgaggctaatgcaaaggtacaaacaagttccagagtggtggttttggtgcatactcgttaccaacgttggagccacaatctttgcttgtgagtattacaatgaccaacttcaattaccatggtggggtgttctattggcatgtaccgtcgccattatctttacacttcctatcggtatcatcaccgccatcaccaatcaggcgccaggattgaacattattacagaatatatcataggatatatctatccaggatatccagttgcaaatatgtgctttaaagtatatggatacataagcatgcaacaagccatcacgtttcttcaagactttaagcttggtcactacatgaagataccacctagaaccatgttcatggcacagattgttggaacactcatctcatgttttgtttacctcacaacggcttggtggctaatggagaccatccccaacatatgtgattcggttactaactcggtttggacatgtccatcggataaagtcttttatgatgcatcggtgatatggggacttattggacctcgtagaatctttggagatcttggtttatacaaatccgttaattggttcttccttgtgggcgctatagcccctattcttgtatggttagcttcaaggatgtttcctagacaagagtggatcaagcttataaacatgccggttcttataagcgcgacaagctcgatgccgcccgcaacagccgtgaactacacaacatgggttcttgctggattcttatccggatttgttgtgtttaggtacaggccaaatctatggcagaggtataattatgttttgtcaggagcattggatgctggattagcatttatgggtgtgttgctttatatgtgtttgggacttgagaatgtgagtttggattggtggggaaatgagcttgatggttgtcctttggcctcttgtccaaccgcgcctggtattattgttgaaggatgcccgctttatacgtaa

SEQ ID NO: 1101 - DNA, 1248 bp, Arabidopsis thaliana
atggcgtttgctagagcagtgagaagaccaattggagtcttttattatagtgttagtagtagatttagttctggaaatgagtattctactgtggcaagcaaattcgaaactttgtctcagtacaaaagctctgtaccgtctggttacacaagccttgttcgtggttttgggaatttcatacggagttttagttcggaagctcctcctgctgtatctgaccaaatgagtcttattaagcaacttagggaaagaactagtgctcctattaaagatgttaaggcttctttagttgaatgcaattgggatcttgtgggtttttttggatttgacacagaggctgctcagaaggatttgagaaagagagggaaagttttggcttcgaaaaagtcgtcacggactgctgcagaaggaatgcttgccgttgctcaaaatgaagggaaagttgctgttattgaacttaactgtgagactgattttgttgctaggaatgagattttccagtacttggttagtcccatagcaatttcacattggttgttgctgaatgatgggctttttgctttagctatggcaaaacatgctttgctggttgagagtagttcgcagcaagtttctggtgtcttcccctttgggccggagctttttgaggagttcaagcttaacctcgatcatccaaaagttaatggtgaaacaacggtttcaaacgctgttacagaagtagctgcaatcatgggagagaatgtaaaatttaggagaggtttcttgatgtcaaaatcttcagcaggcgtcctttctgcatatcttcacacaagtcctcaaccagctgggattgtatctctcgaagtagaaggtgaaaatactcaactagaggctattcagcgtgtaggctcagaactggctatgcatgttgtagcagcaaagcctttgtttttaagcaaagaccttgtttcttctgaagcaatggcaaatgaacgcgagattctaaagtctcaggcagaaagtacaggcaagaatcagatggcgatagagaagattgtggaagggcgtctccgtaagtattttgaagaagttgctctaatggagcaaaagtttattgtgaacgatgctataaacattaagacactggtggataatttgtccaaggaggtaggttctccagtgaaggttaccgattttcttagagtcgaggttggggaaggaatcgaaaggcttgaagcatctgatgaaccagttgctcaaactgcttga

SEQ ID NO: 1102 - DNA, 681 bp, Arabidopsis thaliana
atgttttgctggtcagataacaatgaaagtcatgcgaagaaagaacgtccagattcccaaacccgaccacaggttccttcaggacgaagttcggaatctattgatacaaactctgtctactcagagcccatgttttgttttgatgcttacaatgccaaaacttggttgtttgagataattcaagcaagaaagtcccgggatcatcgcctttctgcagttttagacttcgcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatcttga

SEQ ID NO: 1103 - DNA, 2118 bp, Arabidopsis thaliana
atggaggagatacagtctcaatcggatttataccgttcgtcttcgtcttctgcaagtagtcctactagtagagttccatctagtcactttttctatgtaagaaaacctggttctcttcgacaacctatatcttttgaagactctcctgaatgggaagacacacctgatgttgatttaagaatggaagatgaagctggtggtggtgattctattaatgacgctacaacaacgcctgtttctccttcgttgtcgaagatgaatagcggatcaatggcttctcctcctgttcctgaaggaggagctgggactggtgttgttagaaagattgctggtgcttctattgcttggaaagatttgactgttactatgaagggaaagagaaaatattctgataaggttgtaaagagttcgaatggttatgcgtttcccgggactatgactgtaattatgggtcctgcaaaatccgggaagtctactctattgagggctcttgctggaagattgcctccttcagcaaaaatgtacggtgaggtgtttgtgaatggctcaaagtcacatatgccttatggatcctatggatttgttgagagggaaacacaattgattggttcacttacagttcgtgaattcttgtactattcagcgttgcttcagcttccgggtttcctctttcagaaaaggagtgttgttgaagatgcgatacaggccatgtctctgagtgattatgcaaacaaattgatcggtggtcattgttacatgaagggtcttcgaagtggtgaaagaagacgtgtctctattgctcgtgaacttgtgatgcgaccacatatcttattcatcgatgagcctctttatcatcttgacagtgtttcggcactgcttatgatggtgacactaaaaaagcttgcaagtatgggatgtactcttgtattcaccatttatcaaagtagtaccgaagtgtttggtttgtttgatagaatctgccttctatcaaatggaaacacactcttctttggggagacactggcttgcttacagcatttttcaaatgctggattcccgtgcccgataatgcaaagtccatcagatcattttttgcgggctataaacacagatttcgataggattattgcaatgtgcaaaaactggcaggacgataatggggacttttcagcagtgaacatggatactgctgttgctattcgcactctcgaggcgacttataaatcatctgcagatgctgattctgtcgaagctatgataataaaacttaccgaaagggagggcacacagcttaaatccaagggaaaggccggtgctgctacacgtgttgcagtgctcacatggcgatcacttttagttatgtcaagagaatggaaatactattggctccgacttatcctctacatgattcttacacttagtattggcacattatattctggcttaggtcactctttgtcttctgttgcaatttatagaagtgaagcatcgaaccagcattcgggcgcttttgtcttcttactagggcagtttctgggaagcataccgttcttgtttctcatgtccatttcctcaagtcttgtgttctacttcatggttggattaagagatgatttcagcttgttgatgtactttgtgctcaacttcttcatgtgcctattggtgaacgaaggattgatgctcttcattgcttgcatttggcgagatgtttactggagcactttgactctcatctctgtacatgtgatcatgatgctcgcagcaggacacttcagaatccgtaccgccttgcccaaacctgtctggacttacccgtttgcttacatctcgttccacacctactccattgagggtcttttggagaacgagtacctcggggaagtgtttgcggtcggagaagtgaggagtatatcgggttaccaagcaatccaaggaaattaccaaatatctccagacacaaatgccaaatggaggaacatgcttgtgttgctagcgatggcttttggctaccgtcttcttgtttatgttttactacgttttggcctaaacaagaatgtgtctggtcgtttactgcttagtcataagaaaaataacagctctagaaatttgggtagataa

SEQ ID NO: 1104 - DNA, 2082 bp, Arabidopsis thaliana
atggtattaggagaaacgaataagaaagtgatcaagaatgtgattaagctcttaacgatggtgattttgatgggcactgtggtgatttggatcatgatgccaacgtctacttacaagaagatttggttgaaatccatgcgtgccaagctcggcaaatcgatttattttgggaaaccaggagtaaaccttttggtttacatgttcccaatgattctactggcttctcttggatctatttaccttcacttgaagaaacaaacgagagtaaaccaatttaatagaatggataggaagaagatagacaagtttggtgcattgaaaagaccaatgttagtgaaggccggattagggatagtgacagtgaccgaggttatgttcttgatgatgttcatggctcttcttctttggagcttagccaattacttttaccatacctttgtcaccatcactcctcaatcacttccaaccgacggagataacttatggcaagcaaggctggattcaatagcagtaaggttaggtctaacagggaatatatgcttggggttcttattttatccggtggcacgtggctcgtcgttgctggctgcagttgggcttacgtcggagtcaagcaccaagtaccatatatggctcggtaacttggtcatgaccttattcacaagccacggtctttgttattgtatctattggatatccacaaatcaagtctctcagatgttggagtgggataggaccggtatctcgcatttagccggagagatagctctggtggccggacttttgatgtgggccaccacattcccggcgattagaaggagattcttcgaagtcttcttctatactcactatctctacatggtcttcatgctcttctttgtcttccacgttggcatctcttacgcgttgatctcatttcccggtttctacatcttcatggtcgatcgtttcttgagatttctccagtcgcggaacaatgtcaagctagtctctgctcgtgttcttccttgtgaaactgtcgagcttaatttctccaaaaaccctatgctgatgtatagcccgacgagcatattgttcgtgaacataccgagtatttcgaagcttcaatggcatccatttacgataacttcgagtagcaaactcgaaccaaagaagctaagtgttatgatcaagagccaaggcaaatggtccagtaagcttcaccatatgcttgcttcttctaatcagatcgaccaccttgctgtttccgtcgagggaccctacggccctgcttccactgattacctacgacatgactctctggttatggtgagtggaggcagtgggataacaccgttcatctccataatccgcgacctactctacgtgagctcaacgaacgcttacaaaacccccaaaataaccttaatatgcgcgttcaagaattcttccgacctctcaatgctcaacctaatcttaccgaactccaccgagatctcctcctttatagatatccagatcaaagcctttgtcacccgagagaaagtatcaacctgcaatatgaatatcatcaaaaccctcagtttcaaaccatatgtctcagaccaacccatctcaccaatcctcggaccgaactcctggctgtggctggccaccatcctctcttcttcattcatgatctttataatcatcatcgcaatcatctcaagatatcacatttacccaatcgatcaaagctcgaaagagtacacttcggcttatacatctctcatttaccttctagcaatctctattagcgtggtggctacgtctacggtcgctatgttgtgtaacaaaaagagttattttaagggtttatatcaaaacgttgacgcattgtctccgttgatgatcgagagctcgccagatcagttgctaccggaattcaccaacattcattatggagaaaggccaaatcttaacaagctcctagttggtttaaagggttcgagcgttggagttcttgtgtgtggtccaaggaagatgagagaagaggttgcaaagatttgttcctttggttcggctgcgaatcttcaatttgaatctattagtttcaactggtga

SEQ ID NO: 1105 - DNA, 2751 bp, Arabidopsis thaliana
atggcgactctgaagccgtcatttactgtttctccgccgaatagtaatccgattagatttggaagttttccgccgcaatgctttctccgtgttccgaaaccgcggcgacttatattgcctaggtttcggaagacgactggtggtggcggcggcttgattcgatgtgagcttccagattttcatctatcagcaacagcaactactgtatcaggtgtatcgacggtgaatttagtggatcaagttcagattcctaaaggtgaaatgtggagtgttcacaagtttggtgggacttgtgtgggaaactctcagaggatcagaaatgtagcagaggttataatcaatgataattccgaaagaaaacttgtggttgtctcggcgatgtcgaaggttacggacatgatgtatgacttaatccgcaaggcacaatcacgagatgattcttatttatccgcgttggaagctgtcttggaaaagcatcgtttaacagctcgtgaccttctcgatggagatgatctcgctagtttcttgtcacatttgcataatgatattagtaatcttaaagcaatgcttcgtgctatatacatagctggccatgcatcagagtcgttttcagattttgttgcaggacatggggagctttggtctgctcagatgctatcatatgttgtcagaaagactgggcttgagtgcaagtggatggatactagagacgtgctcattgttaatcccaccagctctaatcaggttgatcctgattttggtgaatctgagaagagactcgataaatggttctccttaaatccgtcgaaaattattattgcgactgggtttattgctagcactccgcaaaatattccaacaactttgaaaagagatgggagtgatttctcagcagctattatgggtgctttattgagagctcgtcaagtaaccatttggacagatgttgatggtgtatacagtgcggatcctcgtaaagttaatgaggcagtgatactccagacactttcttatcaagaggcctgggaaatgtcttattttggagcaaatgtgttacatcctcgcaccatcattcctgtgatgcgatataatattccgattgtgattagaaatattttcaatctctctgcaccgggaacaataatctgtcaacctcctgaagatgattatgaccttaaactgacaactcctgtcaaagggtttgcaactattgacaatttggccctcataaatgttgaaggtactggaatggctggtgtacccggtactgcaagtgacatttttggctgtgtaaaagatgttggagctaatgtgattatgatatcacaggctagcagtgagcattctgtgtgctttgctgtgcctgagaaggaagtaaacgcagtctctgaggcattgcggtcgagatttagtgaagctttacaagcgggacgtctttctcagattgaggtgataccaaactgtagcatcttagctgcagtcggccagaaaatggctagtacacctggagttagttgtacacttttcagtgctttggcgaaggctaatattaatgtccgagctatatctcaaggttgttctgagtacaatgttactgtcgttattaaacgtgaagatagcgttaaggcgttaagagctgtacactcgaggtttttcttgtcaagaacaacattagcaatgggaatcgtaggaccgggcttgattggtgcaacattacttgaccagctgcgggatcaggctgctgttctcaaacaagaatttaacattgatctgcgtgttttgggaatcactggttcaaagaagatgttattgagtgacattggtattgatttgtcgagatggagagaacttctaaacgagaagggaacagaggcggatttggataaattcactcaacaagtgcatggaaatcattttatccccaactctgtagtggttgattgtacagcagactctgctattgcaagccgttactatgattggttacgaaagggaattcatgtcattaccccaaataaaaaggctaactcaggtcccctcgatcagtacttgaaactgagagatcttcaaaggaaatcctacactcattacttctacgaagccactgttggagctggtcttccaattatcagcactttacgtggtctccttgagacaggagataagatactacgcatagagggcatttgcagtggaactttgagttatctattcaacaattttgttggagatcgaagtttcagcgaggttgtcactgaagcaaagaacgcaggtttcactgagcctgatccaagagatgatttatctggaactgatgttgcaaggaaggtgattatcctcgctcgagaatctggactgaaattggacctcgctgatctccccattagaagtctcgtaccagaacctctaaaaggatgcacttctgttgaagaattcatggagaaactcccacagtacgatggagacctagcaaaagaaaggctagatgctgaaaactctggggaagttctgagatatgttggagtggtggacgctgttaaccaaaagggaacagttgaacttcgaagatacaagaaagaacatccatttgcgcagctcgcaggttcagacaacataatagccttcacaacgacaaggtacaaggatcatccacttatagtccgaggacctggagctggtgctcaagtcacggccggtggtatattcagcgacatactaaggcttgcatcttatctcggtgcaccgtcttaa

SEQ ID NO: 1106 - DNA, 855 bp, Arabidopsis thaliana
atggatgaagattttttcttacccgatttctcactagtagacattgatttcgactttaatatttacgaagaaaataatttatcacctgatgaatctttatcaaattcacgaagagctgatcaatcgtcaaagtttgatcatcaaatgcattttgagtgcctcagagagaagccaaaggcagcggtgaagcctatgatgaagatcaacaacaagcaacaactgatttcttttgatttctctagtaatgttatttcttctccagccgcggaggagatcattatggataaattggttggtcgtggaaccaaaagaaaaacatgttctcatggcacaagatctccggttcttgcgaaagaacatgttttagccgagagaaagcgccgtgagaagctttctgaaaaattcattgctctttcagctctccttcccgggcttaagaaggcggacaaggtaacgattcttgatgacgcgatctcgcgtatgaaacaactccaagaacaactaagaacgctcaaggaagaaaaagaagcaacgagacaaatggaatccatgattcttgtaaagaaatctaaagtgtttttcgacgaggaacctaacctatcatgttctccttcagttcatattgaattcgatcaagcattaccagaaatcgaagcgaaaatttctcaaaatgacattctcatccgaatcctttgcgagaaaagcaaagggtgcatgatcaacatactaaacacaattgaaaactttcaattgcgcattgaaaatagcatcgtattgccattcggagactcgactctcgacatcacagtccttgcacaggtgatcattaataactatatatatatgcaatactaa

SEQ ID NO: 1107 - DNA, 1128 bp, Arabidopsis thaliana
atgtcagagaccgccgtgtcaatcgattcggaccgatctaagtcggaggaagaagacgaagaagagtattctccaccggtgcaatcatctccgtcagcgaatttcgagaaagatcgacacttgatgtatttggagatgatgtacgagttgcttccgtaccattaccaatctcaggagatcaatcgtcttacactcgctcatttcataatctcgggtcttcattttctcggcgcaagagaccgtgttgataaagatgttgttgcaaagtgggttttgtccttccaggcctttcctactaacagagtttcactgaaagatggagaattctatggtttctttggttcaaggagttctcagtttcccattgatgagaatggggatttaaagcacaacggtagtcacttggcaagcacttactgtgctttggctattctgaaggtcattggacatgatctctcgaccatcgactcaaaatcattgctaatttccatgataaaccttcaacaggatgatggaagcttcatgcctatccatattggaggtgaaacggatcttcgatttgtatattgtgcagctgcaatctgttacatgctggatagttggagtggaatggataaggagagtgctaagaactacatattaaactgtcagtcatatgatggtggttttggattgatccctggttctgaatctcatggtggtgccacttactgtgctattgcatcccttcggttgatgggatacattggagttgatctgctgtcaaatgattcatccagttcaataatagacccttcattacttctcaactggtgcctacagagacaagcaaatgatggtgggtttcaaggtaggactaacaagccaagtgacacatgctatgcattttggattggagctgtccttaaacttataggaggcgatgcattgatcgacaaaatggctctgcgcaaatttttaatgagttgtcagtccaagtatggtggattcagtaaattccccggacaattaccagatctgtatcattcatactacggttacacggcttttagtctcttggaagaacagggcttgagtcctctatgtcctgagctaggtttacctcttcttgcagccccgggaatttga

SEQ ID NO: 1108 - DNA, 1137 bp, Arabidopsis thaliana
atggcagtggtggatgttcatcgtttcgctgagtcaatcacttgccatgcttggagtcctgatctctccatggttgctctctgtcctaacaacactgaagttcatatctataaatcattgtctcaagaccactgggagaggttacatgtcctccaaaagcatgaccaaattgtttctggaatagattggagctcaaagtccaacaaaatcgtcactgtttctcatgacaggaactcgtacgtctggagcctggaaggagctgaatgggtaccaactctcgttattcttagactaaatcgtgctgcactttgtgtccaatggagccccaaagagaacaagtttgctgttggaagtggtgctaaaactgtttgtatttgctattatgagcaagagaataactggtgggtcagtaagctaatccggaaaaggcacgaatcttcagtcacatctgttgcttggcatcctaataatgttcttctggcaacgacatcaacagatggaaaatgtcgggtattttcaacattcatcaaaggagttgacacaaaggattcaaaagcaggctcaccagcggaaacgaaatttggggagcaaattcttcagcttgatctctcatattcttgggcatttggtgttaaatggtctccaagtggaaacaccttagcatatgtaggtcatagctccatgatttactttgttgatgatgttggcccttctcctttagcccaaagcgttgcattccgagatttgcctcttcgtgatgtcctgtttatttctgagaaaatggtgataggggttggatatgacagcaacccgatggtatttgctgcagatgatactggaatatggagcttcataagatacattggagagaagaaagcggcatcttcaggttccagttacagttcgcagttttccgaagcgtttggaaaattctacggtagtcaatcaaagtctacaacagccaacgatgcttctgattcacgtggaggcgttcatgataacagcataacttccattgtgcctctgggcaaaggagggagtcctaaagttatgcgattcagcacttcaggattggatggcaaaatagccatatgggatctagagaacatgcaacaagaacttggcaatcagttttaa

SEQ ID NO: 1109 - DNA, 1929 bp, Arabidopsis thaliana
atgtcatcgacgtttcgagctccggcgggagccgctactgtgtttacggcggatcagaagatcagacttgggaggctcgacgctctgagatcctctcattctgttttcttaggaagatatggacgcggcggcgtcccggttcctccttccgcttcttcgtcgagttcttcgcctattcaagccgtctccactcctgcgaagcctgagactgcgaccaagcggagcaaagtcgaaattatcaaggagaagagtaatttcataaggtatcctttgaacgaggagcttttaacagaggctccaaatgtcaacgagtcagccgtgcagcttatcaagttccacggtagctaccaacagtacaacagagaagaacgtggtggaagatcttactccttcatgcttcgaactaagaatccatctgggaaggtccctaaccagctctatttgactatggatgacttagctgatgagtttggaattggtactcttcgtttgaccacaaggcagacgtttcagcttcatggtgttctgaagcagaatcttaagactgtgatgagctcgattattaaaaatatgggtagcacgcttggtgcatgtggtgatctgaacagaaatgttcttgctcctgctgcaccttatgtgaagaaagactatctctttgcacaagaaactgctgacaacattgcggctcttctttctcctcaatcagggttctattatgatatgtgggttgatggagagcagttcatgactgctgaacctccagaggtagtgaaggctcgaaatgataactcccatggaactaactttgtcgactctcctgagcccatctatggcacccagttcttgcctagaaagttcaaggtcgctgtaactgttcctacagataattccgtcgacctcctcaccaatgacattggcgttgttgttgtttcagatgaaaatggggaaccacagggtttcaatatttatgttggtgggggtatgggaagaacacacagaatggagtctacttttgcccgcctggcagaaccaataggttatgttccaaaggaagatattttgtatgctgtgaaggccattgtagtcacacagcgagaacacgggagacgagatgatcgtaaatatagcagaatgaaatatttgatcagctcctggggaattgagaagttcagagatgttgttgagcaatattatggtaaaaagtttgagccttcccgtgaacttccagagtgggagttcaagagttacttgggatggcatgaacagggagatggtgcatggttttgtgggcttcacgtagacagtggtcgtgttggaggtataatgaagaagacgctgagagaagtaatagagaaatacaaaattgatgtccgcatcacaccaaaccaaaacattgtcttgtgtgatataaagactgaatggaagcgtcccatcaccacagtacttgctcaggccggcttactgcaacctgagtttgtcgacccattaaaccaaactgcaatggcttgcccagcttttcctttgtgccctctggcaataactgaggcagagcgcgggatccccagcattctaaagagagttagggcaatgtttgaaaaggttggtctggactacgacgagtctgttgtgataagagtaaccggttgtccaaacggctgtgcaagaccgtacatggctgagctcggtctagtcggggatggtcccaacagctatcaggtttggctaggaggaacaccgaacctgacccagatagcgagaagtttcatggataaggttaaggttcacgacttagagaaagtctgcgagccattgttctatcactggaaactagagaggcaaactaaagaatcatttggagaatacacaacccgcatgggattcgagaaactgaaggagctgatagatacatacaaaggagtttctcaatga

SEQ ID NO: 1110 - DNA, 297 bp, Arabidopsis thaliana
atggctatcagaatttctcgagtgctgcaatcatcaaagcaacttctaaaatcgttgtcacactcatcaaacaatgtcgctattcctaaaggacaccttgcggtttacgtaggagagatgatgcagaagaggagattcgtggttccagtgacatacttaagtcacccttgttttcaaaagcttctaagaaaagcagaagaagagtttgggtttgatcacccaatgggtggcctcactattccctgcactgaacaaatcttcatcgatctcgcctctcgccttagcacttcatcgtga

SEQ ID NO: 1111 - DNA, 2310 bp, Arabidopsis thaliana
atgggttcttatccggatggattccctggatccatggacgagttggatttcaataaggactttgatttgcctccctcctcaaaccaaaccttaggtttagctaatgggttctatttagatgacttagatttctcatccttggatcctccagaggcatatccctcccagaacaacaacaacaacaacatcaacaacaaagctgtagcaggagatctgttatcatcttcatctgatgacgctgatttctctgattctgttttgaagtatataagccaagttcttatggaagaggatatggaagagaagccttgtatgtttcatgacgctttggctcttcaagctgctgagaaatctctctatgaggctcttggtgagaaatacccttcttcgtcttctgcttcttctgtggatcatcctgagagattggctagtgatagccctgacggttcttgttcaggtggtgcttttagtgattacgctagcaccactaccactacttcctctgattctcactggagtgttgatggtttggagaatagaccttcttggttacatacacctatgccgagtaattttgttttccagtctacttctaggtccaacagtgtcaccggtggtggtggtggtggtaatagtgcggtttacggttcaggttttggcgatgatttggtttcgaatatgtttaaagatgatgaattggctatgcagttcaagaaaggggttgaggaagctagtaagttccttcctaagtcttctcagctctttattgatgtggatagttacatccctatgaattctggttccaaggaaaatggttctgaggtttttgttaagacggagaagaaagatgagacagagcatcatcatcatcatagctatgctcctcctcccaacagattaactggtaagaaaagccattggcgcgacgaagatgaagatttcgttgaagaaagaagtaacaagcaatcagctgtttatgttgaggaaagcgagctttctgaaatgtttgataagatcttggtatgtggccctgggaaacctgtatgcattcttaaccagaactttcctacagaatccgctaaagtcgtgaccgcacagtcaaatggagcaaagattcgtgggaagaaatcaacttctactagtcatagtaacgattctaagaaagaaactgctgatttgaggactcttttggtgttatgtgcacaagctgtatcagtggatgatcgtagaaccgccaacgaaatgctaaggcagatacgagagcattcttcgcctctaggcaatggttcagagcggttggctcattattttgcaaatagtcttgaagcacgcttagctgggaccggtacacagatctacaccgctttatcttcgaagaaaacgtctgcagcagacatgttgaaggcttaccagacatacatgtcggtctgccctttcaagaaagctgctatcatatttgctaaccacagcatgatgcgtttcactgcaaacgccaacacgatccacataatagatttcggaatatcttacggttttcagtggcctgctctgattcatcgcctctcgctcagcagacctggtggttcgcctaagcttcgaattaccggtatagagcttcctcagcgcggttttagaccagcggaaggagttcaggagacaggtcatcgcttggctcgatactgtcagcgacacaatgttccgtttgagtacaacgcaattgctcagaaatgggaaacgatccaagtcgaagacttaaagcttcgacaaggagagtatgtggttgtgaactctttgttccgtttcaggaaccttctagatgagaccgttctggtaaacagcccgagagatgcagttttgaagctgataagaaaaataaacccgaatgtcttcattccagcgatcttaagcgggaattacaacgcgccattctttgtcacgaggttcagagaagcgttgtttcattactcggctgtgtttgatatgtgtgactcgaagctagctagggaagacgagatgaggctgatgtatgagaaagagttttatgggagagagattgtgaatgttgtggcttgtgaaggaacagagagagtggagagaccagagacatataagcagtggcaggcgagactgatccgagccggatttagacagcttccgcttgagaaggaactgatgcagaatctgaagttgaaaatcgaaaacgggtacgataaaaacttcgatgttgatcaaaacggtaactggttacttcaagggtggaaaggtagaatcgtgtatgcttcatctctatgggttccttcgtcttcatag

SEQ ID NO: 1112 - DNA, 1512 bp, Arabidopsis thaliana
atgggttcggaagcgaccaccgccgtgaacaaccttcagcaaccgttactggagtcaacaaaatcagaagctgacttcaggatggagagtgtattaacggacacacacttgtcatattttcggcggatctaccttgcgtcgttgatcgagatgaagtaccttttccacttggcggctccggcgatctttgtctacgtcatcaacaatggcatgtctatgctcactcgtatcttcgctggtcgtttgggaagtatgcaactcgctgccgcttctctaggaaacagcggtttcaatatgttcactcttggtctcatgcttggaatgggaagtgcagtggagacattatgtgggcaagcgcatggagctcatagatacgacatgcttggagtctacttacaaagatccacgattgttcttgtcataaccggacttccaatgactttactcttcatcttctcaaaacctctcctcatttccttaggcgagccagctgacgtagcatcagtggcatcagtattcgtctacggtatgatcccaatgatcttcgcttacgccgtcaacttccccatccaaaagtttctccagtcgcaaagcatcgtcacgccgagtgcttatatctcagccgcaacactagtcatccacttaatcctctcttggctctctgtctttaagtttggttggggcttacttggtctctccgttgttcatagtctctcgtggtggatcattgtcctcgctcagattatttacattaagataagtccaagatgtcgccggacttgggatggttttagttggaaagcttttgatggtctttgggactttttccagttatccgcagcttccgccgtcatgctctgccttgaatcttggtactctcagattcttgttctcctcgccggacttcttaaagaccctgaacttgctttggattctctagcaatctgcatgtcaatctctgcaatgtcgttcatggtgtcagttggattcaacgcagctgccagtgtgagagttagtaacgaattaggtgctggaaatccaagatcagcagcattttcaaccgcggtaactacaggagtgtcatttttactgtcattgtttgaagccatcgtgatcctctcgtggcgacatgtcatcagttacatttttacggatagtccagcggttgcggaagccgtcgccgagctctctcctttcttagccattaccatagttctcaatggagttcaacctgttttatctggtgtggccgttggatgtggatggcaagcatatgtagcttacgttaacattggatgttattacattgtggggattccgattggttatgttcttggtttcacctatgatatgggagctaggggaatatggacagggatgattggtggcacactcatgcaaactattatcttggtcattgtcacattccgaaccgattgggataaagaggtggagaaggcttcgagacgattggaccagtgggaggacacatctccgcttcttaagcaataa

SEQ ID NO: 1113 - DNA, 1224 bp, Arabidopsis thaliana
atggaagaagaaggcagcccagatatcatcatcgttggcgccggtatctccggcctttccaccgctgttggactacacaggcttgggatcagaagcatggtgctggaatcttcggagacactgagagcgacaggatttgcatttaccacttggttcaatgcttggaaggccatggaagctctcggcgtttctcagcatattcgcagtctccatgatcgccttgaaggatgggtggttggaacaatttctgcaggaactcctcccacagagatgctgtttccagaatccgaagaatatgagtctcgatgcgtacagaggaagctgttgttagaggctctagcaggtgagttgcctgaagagaccatcaggttttcgtctaaggttgttcatattgaattgtctggatgctacaagaaggttcatctctccgacgggaccattctcaaaaccaaggttttggtagggtgcgatggagtgtactcagtggttggtaagtggctaggcttcaaaaatcccgctacaactgcccggttagcaatccgagggctcacacattttccggaaggccatggatttgggaaaaggttcttccagttttatggagacggcgttcgttccggttttatcccatgtgaccacaacactgtctactggttcctaacccacacctccactgatatagatgaggagacaaattcggaaatcctcaaagagtttgtgctgaacaagatcaaagacttgcctgaaaacattaagaatgtggtggagaccactgatcttgatagcatggtgatgtctcaactgaagtaccgacctccatgggaactgctatggtcaaacatcacaaaagacaacgtgtgcgttgcaggagatgcacttcacccaatgactcctgatatcggacaaggaggttgctcagccatggaggatggagttatccttgctcgttgtctaggtgaagcgataaaggcaaagagtctgaaaggtgaaacagaagaaaatgaagaagagggttataagaggattgaagaaggtttgaagaagtatgcaggagaaaggaaatggagaagcattgatcttataacaacggcatatacagtaggattcatacagcagagcagagggaagtggatgaacatgttcagagacaggttcctgtcgtcttacctttctaggatgctgctgaaaaagtcccatttcgattgcggaagccttgtcccatga

SEQ ID NO: 1114 - DNA, 1473 bp, Arabidopsis thaliana
atggagtccaggaaaaactctgatcgtcaaatgcgtagagctaattgcttttcagctggtgagaggatgaagacaaggtcgccctccgtgattgtgatcggaggtggtttcggtgggatttcagctgctcgcactcttcaggatgcttcctttcaggttatggtactggagtcccgtgacagaattggtggacgagttcacactgattactcatttggttttcctgttgatcttggtgcatcatggctgcatggagtatgcaaggagaatcctctcgcaccagttattggaagacttggactgcccttgtatcgtactagcggtgacaattccgtcctgtatgatcatgatctcgagagctatgctctgtttgatatggatggcaaccaagttcctcaagaattggtaactcagattggcgtaacgtttgagcgtattttggaagagatcaataaagtcagggatgagcaggatgctgacatttcaatttctcaggctttctcaattgtcttttctaggaaacccgagctgaggttagaggggcttgcacacaacgtacttcaatggtatgtatgccgcatggaaggatggtttgccgcagatgctgaaaccatctctgcaaagtgttgggaccaggaggaattgttgcctggtggacacggtcttatggttagagggtatcgtcctgtcatcaatactctggcgaaaggtcttgatatccgagtaggccacagggttactaagattgtcaggcggtacaatggagtgaaggtaacgacagaaaacgggcaaacttttgttgcggatgctgcagtcattgctgtccctcttggagttttaaaatcgggaaccataaagttcgaacctaagctacctgagtggaaacaagaagcaatcaacgacctaggagtaggtattgagaacaagatcatactacattttgagaaagtcttttggccgaaagtagagtttctaggagtggtagctgaaacctcctacggttgcagttattttttgaacctgcacaaggccacgggtcatccggttctggtttacatgccggctggtcagcttgccaaagacattgagaaaatgtctgatgaagcagctgcaaatttcgccgtcttgcaactccagagaattcttcccgatgcattgcctccggtacagtatctcgtgtcgaggtggggatctgatgtgaattcaatgggatcttatagctatgatatcgtgggcaaacctcatgatctctacgagaggcttagggttccagtggataacttattctttgccggtgaagcgacgagctcgagcttcccgggctcggttcacggcgcttattcaactggattgatggcagctgaagattgtaggatgcgagttctggagcggtatggtgagttggatctgttccagcctgtgatgggcgaggaaggacctgcctctgtacctcttcttatatctcgtctctaa

SEQ ID NO: 1115 - DNA, 960 bp, Arabidopsis thaliana
atgaagattcagtgtaacgtttgtgaggcggcggaagcgacggttctatgttgcgccgacgaggctgctctttgttgggcttgcgatgagaaaattcacgccgctaataaactcgccggaaaacatcagagagtccctctctctgcctctgcctcttccatacccaaatgtgacatttgtcaggaagcatctggattcttcttttgtctgcaagatagagctttgctatgtaggaaatgtgatgttgcaatccacactgtgaatcctcatgtttcagctcaccagagatttcttctcactggaatcaaagttggtcttgaatctatagacactggtccttctactaaatcctcacctaccaatgatgataaaaccatggagaccaaaccttttgttcaatctatacctgagcctcaaaagatggccttcgatcatcatcatcaccagcagcagcaggaacagcaggaaggagttataccgggaactaaagtcaatgatcagacatcgacaaagcttcctctcgtaagtagcggatcaactactggaagcattcctcagtggcaaatagaggagattttcgggctaaccgactttgatcagagctatgaatacatggagaataatggatcatctaagacagacgttctcaagatgaaacttctagatagtgcttgtcttgggaagaaattggaaaaagcggatactagtagacgaggagattcagacagttcttcgatgatgagatctgcagaagaagatggagaagataacaataactgcttgggaggtgagacatcatgggcggttccacagattcagtctccacctacagcgtctggtctaaactggcctaagcattttcaccaccactctgtgtttgttccggacataacttcttcaactccttataccggttcatccccgaatcaaagggttgggaaacggcggcgacggttctag

SEQ ID NO: 1116 - DNA, 1938 bp, Arabidopsis thaliana
atggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaagcctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaacttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcctgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatga

SEQ ID NO: 1117 - DNA, 2253 bp, Arabidopsis thaliana
atgagtataagagatgttcttcatctgttttcgatgtacgatatcttcaaaaagcgccatgtaagaggcgaccatggtgtcccattaggtggaattgggaatgttgtaaattttacacaaacgcgtatttttagtggaggaagcatcggaaggagttacaaaggtgaatttcagcagtttaagctcttccctaaaatttgtgaagaagctccaatcctcacaaaccagttctctatgagtaaccttggaaaagaagaagcaacggttactttgctctttacttgggagaactcagtgggaggagcttctggtttaactggagaacacttcaactcaacaataatccatttgaagcggggtttagtgccggtttccggaagatttattgcgtcgatatattgcaactgtgatgaaatgaaaacttgcaggacgggcaatggacatccgccagttacttacgctattgcagcgcaagaaacagaggatgttcatgtctctgagtgtccatgcttcttagtttctggtcactctcctaaagaaatcacagcaaaagagatgtgggatgagattaaaaagaacaaatcattcgacgagttaaacagcgaaccaggctcaccttcgagacccggaacatccattggagcagccatagctgctaaagtgaaggttcctccaggttgtgaccgtactgtcacgttttcactctcatgggactgtcctgaggtgcggttcaatgaaaagacttaccacaggtaccgagttactctattcaacgaactatactatttcaactccggaggaactatctggacagatggcttgcctcccaaggaaagcatagaaagaagcaaggttacaaatacagaacagaacgacattgttatagacctcttccagaaaatcaatgcggtttgtgagcagatttattctcctcaatcctcgaactcggaagagaacattggccaattcatctacctagaaggaattgagtatctaatgtacaacacttacgatgtgcacttctattcttcatttgcacttctcagtctctttcctaagctcgcactcagtatccaaagagactttgcagcaacagttctgattcaagatccaaccaagaaaaagatcatgagctccggtgagtgggttacaagaaaacttcttggatctgttcctcatgatataggtctaaacgatccgtggctagaactaaacgaatataacttcttcaacacggatcgttggaaagacttgaacgccaagtttgttcttcaagtctacagagacgtggttgctactaacgatcagagttttgctaaagcggtttggccgtctgtttacacagcagttgcttacttagatcagttcgataaggacgaggacgggatgatcgaaaacgaagggtttccggatcagacatatgatgcttggagtgttacaggggttagtgcttattgtggcggtctttgggtcgctgctctacaagctgcgtctgcatttgctagtattgttggggaaaacgctgttgccatttacttcaatgcaaagtacgaaaaggcgaagattgtttacgagaagctatggaatggttcttacttcaattatgacgatagtggtagtggctcgagctcttcgattcttgctgatcagttggctggacaatggtatgcacgagcgtgtggattgaagccgataacgaaagaagaatggataaagaaagcactagagacgatctatgagttcaatgtgatgaaagttaaaggagggacacgaggcgcagtgaacggaatgtcaacggaaggaaaagtggatacaaattcgttggtttcaaaggaagtttgggctggtactacttactctgttgcagcttgtatgattcaagaagggcaaagagaaaaagggtttcagacagcaagtggaatctacgaggctatttggtctgatcgtggtctcagttgctcgtttcagacaccagaagcgtggaacatgaatgatgaatacagatctctgtgttatatgagacctcttgctatatgggctatacaatgggcattgacacgaacacaatcttttggagaagagaagcaaaagttagtggcaggagatgaagaagaagaaagtaatttgttgttaagacaacacaaagggttcaaagatgtggctcgttttgtgaaaatagtaccaacgagcaatgtgcatagaagccgtctccaacacacgtacgagaccgttctcaagactctccgcttgtaa

SEQ ID NO: 1118 - DNA, 1272 bp, Arabidopsis thaliana
atggcggatgttcttatgaatctgtggaacttatctacttgtctgttttcatttcatgtttactatactatggaccctgagagtatcatggctgctgatgggactgattctgctcctgcaaatggtggtttagcaatggaaaatgtatgtgttaaagaaaatggggctgtttctgtcgaaaccgtggacactacttcagaaagtcagaatgagaattcggcaaacagttccactttggatacaattgaacacgtcaaggaggcagctgagggcacacaagttgaacatgtagatgattcaaagtgtatgaaaggcgaaaaagctcaacggaagccaaggcatgagaaactatcaggtggtaagaataattcatcggttcacatcaaaaagagcaaagagggcaaaagtgcagatgctaaagtggcagcatcaaatggttctgttgctcctaatgtacagacaacaaatcctcttaagagcaaatcattcaatgggcgagaggcacaagtcacaaaggtaatcatccctcacaatttgcttctaggtttcttcgctttagcttatgcatatttggatcaagggaagcatgactctgcacctgctgaaagcgctgatggggagaaggtgaaaccaaagtctcaaaagaaacaagcccatgagacatctgaagatgatactcagtcttctaatccgaaagcagacgatggaaaacctcgtaaagttggtgcacttccaaattatggattcagtttcaaatgtgaccaacgggctgaaaagagaaaagagttctatgttaagcttgaggagaagactcatgcaaaagaagaggaaattaatagcatgcaagccaagtccaagatgcttggcctcctccaaaacaaaattcttggtttctcgcaggaaacacaagaagctgagcttaggatgctaaggaagagtttgaacttcaaagccacacctatgcctagcttttatcaagaacctcagccgcctaaaacagagttaaagaagaaaacagttctccccgatggaaaacccgccccagcaaaagctgccataatcccagcaaaggtaagacctgagaaaaagaaacttgaaaaagatgcagaaaccgtaaaccagacttcacatcccacagaagaggaagcacaagtgacagtatcatccaatgctgatgtagaagattcacatgagactgtatctccaaggatgaatgaagacagagccgacaagtccattgaggtatctgaagcggttgctgttgagcattaa

SEQ ID NO: 1119 - DNA, 1221 bp, Arabidopsis thaliana
atgtcgttgaagcatcatcacagaggattagagctctctgcttcgaagagttttgtctcaaagaaatggactttatttctctgtatcggtttcttctgcgcaggaattctcttctccgacagaatgtggccagagcctgaatccaatgttgtatcaagggacacagtagcatcagatgaacggctgcggttagagtctgaggactgtgattcatcaaaaggtttaaagcgtgaatcgaaagacatccttggagatgtttacaagagtccagatgcaattcaaacgcttgataaaacgatttcaaagctggaaacagaactggccgatgcaagagctgcgcaagaatctatcatgaatggttcaccagtttctgatgactttaagctccctgaaactgtcactaaaagaaagtatctgatggttgttggtgttaatactgcgtttagcagcagaaagcgcagggattcagtccgtgctacttggatgcctcccggtgaggagagaaagaagctcgaggaagagaaagggatcgtgatgcggtttgtgataggccatagttctactcccggtggaattcttgatagagcgattcaggctgaagaaagtaaacatggagacttcttgaggctggatcatgttgaaggttatctcgagctgtcagcaaagactaaaacttactttaccacggcttttgcaatgtgggatgcagacttctacgtcaaagtcgatgatgatgtgcatgtaaatatagccacgcttggagcagaattagcaagataccggatgaagccccgagtgtacattggttgcatgaaatctggacctgttcttgctcagaaaggagtgagatatcatgaacccgaatactggaaatttggagaagagggtaacaaatacttccgccatgccacaggtcagctctatgcaatatccagggagttggcgtcttacatatcgataaaccaaaacgtacttcacaaatatgtgaatgaagatgtctctttaggatcatggtttcttggattagatgtggagcatgtagatgaccgtaggctatgttgtggtacaacagattgtgagtggaaggcgcaggcgggcaacatctgtgttgcctcgttcgattggagctgcagtgggatttgtagatcagcggataggatgaaggatgttcatcgtaggtgtggagaaggtgaaaaggcccttctggctgcatctttctga

SEQ ID NO: 1120 - DNA, 1977 bp, Arabidopsis thaliana
atgtcgacgatttgcagccacagagaacttaaagcttatcgtccgctgcaagataataatctacaggaggtgtatgcttcctcagctgctgcagtgcactacgatccagatctgaaactgttatctcaggatgtgaacatagttgcgacatacagtgaccattacggcaatatacgccttggtagggtgaaaatgggggatctttcaccttcttgggttttggagaatcctgcctatcaagttagccgcaaaacaaaaggttcgcagctagttataccacgggattcatttcaaaatgatactggaatggaagataatgcaagccattctacaactaatcagactgatgaaagcgaaaatcagtttccaaacgtggattttgcaagcccagcaaaactgaagcggcagattttacgtcaggaaaggagaggtcaacgaactttagagctgatccgacaagaaaaggaaactgatgagcagatgcaagaagcagccattcagaagtcaatgagctttgaaaactcagtcatagggaaatacagtatatggaggagagactatgagagcccaaatgctgatgctatcttgaagcttatgagagaccagatcataatggcaaaagcatatgcaaatattgccaaatcaaaaaatgtaaccaatctgtacgttttcttgatgcagcagtgtggagaaaataaacgtgttataggtaaagcaacctctgatgctgaccttccttcaagcgctcttgatcaagcaaaagccatgggccatgcactctctcttgcaaaagacgagttatatgactgccatgaacttgcaaaaaagttccgggccatccttcagtccactgaacgcaaagtagatggactgaagaaaaagggaaccttcttaattcagctagctgccaaaacatttcccaagccattgcattgcctgagtctgcagctagcggcagactattttattctaggtttcaatgaagaggatgcagtgaaagaggatgtcagtcaaaagaagcttgaagatccttcgctctatcactatgcgatcttttcggataacgttctggctacatcagtggtggtgaactccactgtcttgaatgcaaaggaaccgcagaggcatgtgttccatatagtaactgacaaactgaattttggtgcaatgaagatgtggtttcgcatcaatgctcctgctgatgcgacgattcaagttgaaaacataaatgatttcaagtggctgaactcctcttactgctctgttctacggcagcttgaatctgcaaggctgaaagaatactatttcaaagcaaatcatccttcatcaatctcagctggcgcagataatctaaagtaccgcaacccaaagtatctatcgatgctgaatcatctcagattctaccttcctgaggtttatccgaagctggagaagattctgtttctagacgatgacattgtggtgcagaaggacctggcaccactatgggaaatagacatgcaaggaaaagtgaatggtgcggtggagacgtgcaaggagagcttccacagatttgacaagtacctcaacttctcaaatccaaagatttcagagaattttgacgctggtgcttgtgggtgggcatttgggatgaatatgtttgacctgaaagagtggaggaaacggaacattacagggatatatcactattggcaagacttgaatgaagacagaacactgtggaagctgggatcgttgccaccggggctgataacattttacaacctgacgtatgcaatggataggagctggcacgtactagggctgggatatgacccagcgctaaaccaaacagcaatagagaatgcagcggtagtgcattacaatgggaactacaagccatggctgggtttagcattcgccaagtacaaaccgtactggtccaagtacgttgagtacgacaacccttatctccgacggtgcgacatcaatgaatga

SEQ ID NO: 1121 - DNA, 2211 bp, Arabidopsis thaliana
atggtgaggaaacatggttggcaacttcctgctcacaaatttcaggtggttgcgattacggtgttctgcttattgagtgtagcatactatgcgtttttcgctccttttgttggaggacgcatctgggagtatattcttctcggtgtttactctcctgtggctcttattgttttcgttctttatgttcgttgtactgcaatcaatcctgctgatccaggaatcatgtcgaaattcgaaagaggtgcgagtagaggtggtgacttacctactgccaaagatatctcgagaaaatttgatgaaacgggcagccacctgcagtcttccccttcggttgcttccaggacttctactttaccaaactctagtgtgaaaggttctgttggagatgctcaaagagtggaagctgctaaaagaaaatcttgctttaatccgttggcaatatgctgtggcgtgtttgtttatgaagattgtcgtagcaaagaagagacggatgagcagcaaggggatagggaagaagctctgttttgcacgttgtgcaatgctgaggtccgtaagtttagcaagcattgtcgaagttgcgacaaatgtgtagattgtttcgatcatcattgccggtggcttaacaattgtgttggtcgcaagaattatatgacttttatatcgctgatggctgtcagtcttctctggctccttatagaagcaggagttggaattgcagttatagtgcgtgtatttgttaataagaaggacatggaaacagaaatcgtcaatagacttggaaatggattttctcgggcaccttttgccacagttgttgtaagtattcttagtgtaaggggtctctgtactgctgtttccatgctggcattgtttccattaggtgaacttttctttttccacatgctcctcattaaaaaggtgagtatggaagaagtcaatatgcttttatatggcattacaacttatgaatatgttgtggcaatgagagcaatgagcgaggcaccagctggagcttcgattgatgaggaaattcctaacgtgctgtattctccctctggatctgccacgaccggctttagtggtggaagctccctcggtctaccatacaaaggagcatggtgcactcctcctagagtgtttgttgattatcaggacgaagtgattcctcatttggatcctcggatggttccatcaaccgtagatccagatgcagctgaaacagcagagaggggcaacaagattccaaagagacctgtcaaaattagtgcttggaagcttgcaaaactgaattcaaatgaagctacaagagcagcagccagagccagagcatcctcatctgtcctaagaccaatagaaaatcgtcatttacatgatgatgaacttagttccagaagtggcaccatcagtgttgtaagcagtgtaagcacagaagcaaatggagctacgctgagtagagagataagaaacaatgatccaatgttgtctcattgtagaaactcttatgctccaagccaaggtagtcgggacgagtacgacacagggacccatagtatgagcagtctcagcagtccaagtcatgttcatgagaccgtcacacttagtcctctccctcagcatcatacagctggccaccgcttcactgcagcggccgcgtcgaattcttcccggccacctcttaatcaagcaactaatcacatgatccactcaacctttgatgaaaagataatgcagaaaggaaaccatgcagatccactgcttctccctgctcctgctgcttctcttctgagagatgtgagaagaacatcagttgtttgggaccaagaagcaggtagatatatatcagttcctgcaacaacatctgagccaagaaccagattctcctcacagaaccagccaattcctagctcacacatgggtaacactcagaatccaagacccgttggtcatccgcctcaagattcttcatctggaagggctccacctcctacgcagcagcagcaaggagagagactgatgtatacaggtgaatcaatattctttggaggccccctagtaaatatcccaaatagagatggcctaagacacgatggagactcgggaagagagggacaagaccgaatgacattaacactgcctcgggaagctagattcaaaagagacactacctcaaaccaacttccagtgtttgctcctgtaggtacccgcaagtaa

SEQ ID NO: 1122 - DNA, 1032 bp, Arabidopsis thaliana
atggcgtctaattcttctaacgggacgacgacgacaaagccaccacctatgccgtctcctctgcgtaattccaagttttttcagtcgaatatgaggatcttggtgaccggaggagctggattcattggttcacatctcgttgataaattgatgcaaaacgaaaagaatgaagtaatcgttgcggataattacttcacaggatcaaaagacaatctcaagaaatggattggtcatccaagatttgagctaattcgtcatgatgtgactgaacctcttttcgtcgaggttgatcaaatctaccatttagcatgtcccgcttctccaattttctacaaatacaaccccgttaagacgataaaaacaaatgtgattggcacacttaacatgttaggactagctaagcgagttggagcaagaattttacttacttccacatctgaagtgtatggtgatcctttggttcaccctcaaaccgagagctattggggaaatgtaaacccgatcggtgttagaagctgttatgatgaaggaaaacgtgttgccgagactcttatgtttgattaccataggcaacatgggattgagatacgcatagcgaggatattcaacacatatggtcctcgtatgaacattgatgatggtcgcgttgtgagcaacttcattgctcaggctctcaggggagaagctctgactgttcagaaaccgggaacacaaacccgcagtttctgttatgtttcggacatggtggaaggtctaatgcgtttgatggaaggagaccaaaccggaccgataaacataggcaatccaggcgaattcacgatggttgagctcgctgagacggttaaagagcttattaaaccggacgtggagataaagatggtagagaacacacctgatgatccaaggcagaggaaaccagacataagcaaagctaaagaagttcttggttgggaaccaaaggtgaagctacgtgaggggcttcctcttatggaagaagattttcgtctaaggcttggtgttccgaagaagtaa

SEQ ID NO: 1123 - DNA, 2337 bp, Arabidopsis thaliana
atgaacaagacacaaacacaacagaaacttaaccaaagacatatctctctctcctcaaacccacctcttgtctctatgggatcgcaactctcaaacgcaatcgacggtaaagataacaccaaaaccatcggatcagcggatccggaccagcttatggagatcgaatccttggagaagatcttaaattacaagttcaaagacaagagtttgttgctgaaagcgttcacagacgctagttacgttgatgacaagagtgaatcgtacgaactcctagaacttttaggagattcgatcctaaatatgggtataatctatgattttattaagctctaccctaaagaagcacctggtccgttgaccaagctccgagccgtcaacgtagataccgagaaattggcacgggtcgctgtaaatcaccaactctatagctatctccgtcataagaaacccttgcttgaggagcaaatactagaatttgtggaagccatggaaaaatatccattacattcaaatggtcttttaaaagttcctaaagttctagcagacatagtagagtctaccattggagctatcttcatggactgcaactccaccgagaccgtctggaagatttcgaatcatcagaaaatggatttcgagcttagatcagcgaaagagaagcttgaaagagagcagagagagaggaagcaaagagcgaaactgaaactcgaacgcgagaagaaatcaaaggaagctgcgattaagcaacgcgaagccattgaagctgctcaaagagctagaagacttgacgccatcgaagcccagattaaggtcctctatctctattcttactgggctgatcaacatatgcaagagagtttagtatctggagatggaatagtgtttgaacgagtcttccaagctgtttcttttcaaggaaatggagataagattaaactaccaccatcatgttttactgagttgtctgatcaaggagctttcgataaaggtcctttgtattttgagctctctgttgttgaccatgcggataataaaaagacaacacattctggtgttcttgagtttactgctgaagatggcactattggacttcctccacatgtgtggagcaatttgttttcaacgcatgatccaatggatgttcctttggtggaaattcggtatatccgattgcctaaaggcagttacgcgaagcttcaacctgataaccttggtttctcggatttgcctaaccataaagcaatacttgaaactattcttcgtcaacatgctacactttctttagacgatgttctcttggttaattatgggcaggtctcttacaagcttcaggttcttgagttaagacctgccactagcatttcggttctggagactgacattgaggttgatattgttagtccagatatagtttcagatcaaccgaatcagcatgtgctaaagccgcttcaatatgggaaatctgaatctggaacagttgaggaaggtcggtatgattactataagtttgtgattgacgaggctactgtagaaaaagtaatggcaggaagcgtcaaagttattgtaaaggtagatgtggagaaagttggagcggatacggatctctatgtgtcaaagcacccggttctatttccatctcttaatcaacacgagtggtcttcacacgacgtgggttcaaagaccttgatcttggtatcaaaggagagggctttgagctcagggacttacagtataggtgtttacggcttcaaaggaacagtcaagtaccaggtctcagtactggtccaagaaagcattgatggagctaaggttggggaacgggctgtatcatcttcgtcagatgttgatacagtagaatgtaggaactgtaagcattcaattccaagcaggagtatcgcgttgcacgaggtgtactgtagcagacacaacgtggtttgtaaccatcacgggtgtggaatcgttctcagagtcgaagaggcgaaaaaccatttgcactgtgaaaaatgcgggaaagcattgcagccaacagagatggagaaacatttaaaagttttccatgaaccactcacttgtggctgcggaatagtacttgagaaagaacagatggttcaacatcaagggaaagattgtcctcttcgcctaatcgcgtgtagattctgtggagatatggtggaagcgggtaactctgcagctgatactagagacaggatgagaggaatgtctgaacatgagagtacttgtggttcaagaactgcaccatgcgactcatgtggtcgatctgtgatgctcaaagacatggacattcaccagattgctgttcatggcaagagtagctga

SEQ ID NO: 1124 - DNA, 894 bp, Arabidopsis thaliana
atggtacttgccgaggttccaaagcttgcctctgctgctgagtacttcttcaaaaggggtgtgcaaggaaaacagtttcgttcaactattttgctgctgatggcgacagctctgaatgtacgagttccagaagcattgattggggaatcaacagatatagtcacatcagaattacgcgtaaggcaacggggtattgctgaaatcactgaaatgatacacgtcgcaagtctactgcacgatgatgtcttggatgatgccgatacaaggcgtggtgttggttccttaaatgttgtaatgggtaacaaggttgtagcattacttgcaactgctgtagaacatcttgttaccggtgaaaccatggagataactagttcaaccgagcagcgttatagtatggactactacatgcagaagacatattataagacagcatcgctaatctctaacagctgcaaagctgttgccgttctcactggacaaacagcagaagttgccgtgttagcttttgagtatgggaggaatctgggtttagcattccaattaatagacgacattcttgatttcacgggcacatctgcctctctcggaaagggatcgttgtcagatattcgccatggagtcataacagccccaatcctctttgccatggaagagtttcctcaactacgcgaagttgttgatcaagttgaaaaagatcctaggaatgttgacattgctttagagtatcttgggaagagcaagggaatacagagggcaagagaattagccatggaacatgcgaatctagcagcagctgcaatcgggtctctacctgaaacagacaatgaagatgtcaaaagatcgaggcgggcacttattgacttgacccatagagtcatcaccagaaacaagtga

SEQ ID NO: 1125 - DNA, 1092 bp, Arabidopsis thaliana
atgtcgagtgatgcagctcgtacgccattgttacccactgagaagatagataccatggctcaagatttcaacctgaactcaagaacttcttcttcaagaaaacgaagattgcgtcgctctagaagtgctcctcgtggtgattgtatgtacaatgatgatgtcaaaatcgacgaaccacctcctcatccgagtaaaatcccaatgttcagtgatctaaacccgaatctcaggcgagtgatcatgttcttggctttatatcttaccattggtacgctctgtttctacctcgtgagagaccagatctccggtcataaaaccagtggtgtggtagatgctctctatttctgtatagtaacgatgacaactgttggatacggtgaccttgtccctaatagttccgcctcaaggctacttgcttgtgccttcgtcttctcgggaatggtcctcgttggtcacctcttaagtcgagcggcggattatctagtggagaaacaagaggctttgctcgttagggctttccatttgcgtcaaagctttggtccaacagacattctcaaggagttgcatactaacaagttgagatacaaatgctatgctacatgccttgtccttgtagtcctcttcattgttggcacgattttccttgtaatggttgagaaaatgccggttatctcagctttctactgcgtctgctccacggttacaacattgggttatggagataagagctttaactcggaagccggacgcctttttgctgtgttttggatcttgacgagcagcatatgtttggctcagtttttcctttatgtagctgagctaaatacagaaaacaaacagagggcgttggtgaaatgggttttaacgcgaagaatcacaaacaatgatctcgaagcagctgatctcgatgaagatggagttgttggagctgcagagtttattgtgtataaactgaaagaaatgggtaagattgatgagaaagatatttctgggataatggatgagttcgagcaacttgattacgatgaatcaggaactctcacgacttctgacatcgttttagctcagaccacgtctcagattcaaaggtaa

SEQ ID NO: 1126 - DNA, 1569 bp, Arabidopsis thaliana
atgctacggttttaccactggagatttccgccgtccctcgccgtcgttagaatgctctcatcaccaccccctcctcactcacactctccattctccggcggcggcgtgaattcgaactcagtcggtggaaactccaaacccgagttacaattccctcaatcccaaccccataaactctcttcctctccttcctcttctctgaaatccacggtggcttgttcaaacgccggagctatacggagaagcatggctactgtttctcaggcattctcagagagaacagagtctattgattcggatttaggctcgctcgttgtagtttcattctacaaattcgctgattttcctgagcatgctgatttcaggaagcctctcaaggatctctgcgaaaaattgcgtgtttcaggtggaatcattcttgcaccagaagggataaatggaagtatctgtgggattcgtgaatcagtggaggaagtgttggcatttatacagagagatgtccggttaaatggtttgaggcaagtggagacacctattgttacgcttggaattcctagtgtctcgccaattgaaagagttggaacatatgtgagtcccgaagaatggaacgaactgatcagtgatccagaaactgtagtgattgatgtgcgtaatacctatgagactagaattgggaagtttaaaggagctgtggatccatgtaccacagctttcagaaatttcccatcttgggtggagaatcaatttgcattgaagcaagaaggcaatgaaacgcaagcaaaggtggagaaagaggatttttctgaaatcacccataaagaagacaaagctgaaaaaccgaagacgctgccacgaattgctatgtattgcactggaggaatcaggtgtgagaaagcttcaagcctccttcttagccaaggtttcgaagaggtacttaaaagatcaaagcatttttgttatcaggtatatcatctgaaaggtgggatattaaagtaccttgaagaagtccctaaaaccgagagcttatgggaaggggaatgctttgtgttcgacaaacgtgtatctgtggaacatggtctagctcaaggaacacataaactctgctatggatgcaagcaacctataagtgatgaagacatggaagctccagagtacgagtatggagtttcttgcccttactgttactccaagaaatcagaagaggagaaagaaagggcaagagcaaggcagacacagtttgaggaatggggtgtaattggtggtccggacaaaggtcgtcgacccgccactaaacctgatagtccaaggaagaagatcaatgcaaagcttggatctctgtggggtttgatcgaatttcatagcgaaggagagagtgagagagagattgaagcagtaatggcaggaacatctggattgctcaacgcagtgaagccaaagatccaaacgattgatattcaggccgccgctggatggggaatcgccgccgcagccggtgccatctgggtcgtccaaccatttggttggataaagaagacattcattgacccacccccaactgaagagaagtga

SEQ ID NO: 1127 - DNA, 792 bp, Arabidopsis thaliana
atgttcaagttgaagcaatggttgatttatttggtgtgttcgttagtaataatgaacacagaaggactgtttgtcaatattacatttgttcgaaacgcagtcgctaaaggggccggaggatggtgcaataatgtaacaaattgcgttagtcggatgcatactcgattaggttcatcgaagaaaatggtggagaaccttgctttctcagctattcttagcaataagaaacaatataatcctgatttttacaattggaatagagtgaaagttagatactgtgacggggcatcattcacaggagatgtagaagcagtgaaccctgctactaatcttcacttcagaggtgctcgagtttggttagccgttatgcaagagctgctagctaaaggcatgataaacgccgagaatgctgttttgtctggctgttctgctggcgggttagcttcgctgatgcattgtgatagtttccgtgctctattaccgatgggaaccaaagtaaaatgtctttcagatgctggtttttttctcaacacaagagacgtctcaggagttcaatacattaaaacatacttcgaagatgttgttactcttcatggatcagcaaagaacttgccgaggtcatgcacatcaagattaactcctgcaatggtagaaagcattcatacaatagcaaaagctgttggagattgggtttatgacagaacattgtttcagaagatagattgtccttacccttgtaaccctacttgccaccacagggttttcactcctctagatgctcctccaatttaa

SEQ ID NO: 1128 - DNA, 534 bp, Arabidopsis thaliana
atggcttcttcttctcttttggtcaccatcttcctctgcatctctgtcttcttcttttcgtccgtgaatgcaaatgaggttaccgtcggtggaaaatccggtgactggaagatccctccttcctcttctttctcctttaacgaatgggctcaaaaggctcgcttcaaagtcggcgactttatcgtattcaagtacgaagccggtaaagactcggttttgcaagtgacacgagaagcatacgagaaatgcaacaccactagccctaaagccagctacaccgacgggaacacaaaggtgaagcttgaccaagctggtccggtctacttcgtcagtggaacagagggtcattgtcaaaagggtcagaagctacgcctagtcgtcatcactcctcgtaactctgctttctctccaggtccttcgccatctgagttcgacggtccagccgtagctcctactagtggtgccgctaagctcgccggcggatttagtgtcgtatttgggcttgttcttggattatgggccttcttcttttaa

SEQ ID NO: 1129 - DNA, 1077 bp, Arabidopsis thaliana
atgattccgtttcctctgttaccaacgccgattgaaaccaactacagagcttgcaccattccttatagattcccttccgataatctcaagaaagccactcctactgaaatctcctggatcaacgtcttcgccaattccattccttctttcaagaaacgtgcagagagcgataccagtgttccagatgctcctgctagagctaaaatttttgaacaaagatatgcgggatttcttgaaggctggaagaaagatccagagagtaatggtgggccaccagatggtgttattctcggccgagttcgtgagcatttactcagagagttaggatttagggacatattcaagaaagtcaaggatgaggagaatgcaaaggctatatcactatttcctgaagttgtcagtctgagtgatgctattgaagatgacggagaacggttagagaatttggtgagagggatatttgctggaaacatctttgatcttggttctgcacagttgtctctctttggtgctcccacaggaaaagcttgtcctaattacgcgctcttttcttttcgcattttgaagcttgctgaggttttctcaagggatggcatatctttcttggctacctctcaaaacttggttccacgaccatgggtcatcgatgacttgaacaagttccaagccaaatgggtcaagaagccttggaagaaggtcacttgtttacataattttgggtattttgcctttcgcaagagagttgctccgtcgaggaattcagacttaatctaccagttaaaggatggaaatggccaattgataggcgttgatacttcaaagcttctgattgcaaattcagggaacgatttagcggttattgatctctcaagagtatcgcacgagcttgcttacctttcatctgatgcagacttagtcatcctagaaggcatgggtcgcgggatcgagacaaacctttatgctcagttcaagtgtgattctctcaagatcggaatggtgaagcacgttgaagtagcacagtttctcggaggacgactttacgactgtgtctttaaattcaatgaagttcagagttaa

SEQ ID NO: 1130 - DNA, 1119 bp, Arabidopsis thaliana
atggataggcttttgcaacctccttcttctcactcaattgctccctccaaattccaatcaagaccatctcccttattactccaccgtctccactcaacgaatcttagtacttttccctcctctcgccgtctcgagtcacgccgaatcagctccatttcctgcttcttccgtcagaatccatcgccggatacatctccaggattgaatcagagtagtaatttcttgattgcttcttctcaaaccgatgcgtcgaaacctaatccaggatttatccaacggatcgtgagcagttttgagcaacgcaagaccatatcggcaggaatggttatattagtctctgctatagctgcgcttttgcttaatcccattcttgtgccgcctgctttcgctagctttcaaacggctactaattctggtggagctgctgtggttggtggaaaactcctcaggactgaagtattgacaagtgcttggactggtttctttgctggttgcttacacacgttatctggacctgatcaccttgctgctttggctccactttcgattggacggacgagaatggagagtgctgcggttggagctctttggggatgtggtcatgacgctggtcagctcatctttggtttattgtttctgcttctaaaagataggctccacattgaagttataagaacttggggtacaagagttgttggtttgactctccttgtgattggtgctatgggaatcaaagaagcttctgagatgccggaaccatgtgttgttactttggagaatggggaaacagatgagaaaagcttaaagaagaaaaagatagggtttgcgacatttgcgactgggattgttcatggcctgcaaccggatgctctgatgatggtattgcctgcattggctcttccttctcggatagccggtgcttcgtttctcatcatgttcttgattgggacggtgattgcgatgggaagctacacagtttttattgggtcgtgtagcgaagcgttgaaagagaaagttcctaggatcactgagaaactaacgtgggcatcttctcttgtggccattggacttggattggcaattattgtcagccagttctttggattcagcctgtattga

SEQ ID NO: 1131 - DNA, 1086 bp, Arabidopsis thaliana
atgggacttaaaggatatagcgtcggagaaggaggaggagagatagttgaggttcaaggcggtcacataatccgagccactggacgcaaagaccgtcatagcaaagtgttcacatcaaagggtccacgtgaccggcgcgtgagactctcagctcacacggcgattcaattctacgatgtgcaagaccggttaggttatgaccggcctagcaaagccgttgattggctcatcaagaaagccaaaaccgctattgataagcttgaactcggggagactactactactactactcgtcaagaaccggtgaatactaaaccggaatctcccactttggttttccaaagagagaacaatgaccaaacgcagttcgtggcggccaatcttgatcctgaagacgcaatgaaaacgtttttcccggcgacgacaacaacaaacggtggtggtggtacaaacatcaatttccaaaactaccctcatcaggatgacaacaacatggtctcaagaacaacaacaccaccaccaaaccttagccaagatcttggtctctctcttcacccatttcaagggaacaacaacacagtcgtagttcccgagaccaacaatttcaccacgactcatttcgacacgttcgggagaatctctggatggaatcatcacgacttaactatgacgtcatcatcctcatcagaacatcaacaacaagaacaagaagaaaggagtaatggtggtttcatggtgaatcatcatcctcaccatcatcatcatcaaccgtcgatgatgacattgcttaatagtcagcaacaacaagtgtttcttggtggccaacaacaacaacaacaaaggggtacccttcagtccagtttattccctcattcgtttcgttcttgggatcatcatcaaacgacgtcggatcatcatcatcatcagaatcaagcttcttcgatgtttgcttcatcatcacagtatggttctcatgggatgatgatgatgcaaggccttagtttccccaacactacaagactactccacggagaagaagctactcaaccaaactcttcttcttctcctccaaactcacacctctaa

SEQ ID NO: 1132 - DNA, 2079 bp, Arabidopsis thaliana
atgggaacgctacagtcatggcgaagagcttacggagccttaaaagacaccaccaaagtcggccttgtccgagtcaatagcgattacgccgaattagatgttgccatagtgaaggctactaaccatgtcgagtgtcctcccaaagatcgtcatctcaggaaaattttcctcgcaacgtcagcgattaggcctcgagcagatgttgcttactgcattcatgctctctcccgacgattacacaaaaccagaaattggacggttgcattaaaagcactgctagttatacaccggcttctgagggatggtgatccgacatttagagaggagctattgaatttttcgcaaaaaggacgcattatgcaaatttctaatttcaaggatgactctagcccagtcgcatgggattgttcagggtgggtacgcacttatgcgttgtttcttgaggaacggcttgaatgcttcagggttctgaaatatgacatcgaggctgaacgtcttccaaaagtttccccagggcaggagaaggggtatagcaaaacaagggatttagatggtgaaaaactcttggaacagttgccagctttacaacagcttctgcatcgtctcattggttgtaagccagaaggtgctgctaagcacaatcatatcattcaatatgcactctccctggtattgaaggagagttttaaagtgtattgtgccatcaatgaaggaattatcaatctagtagagaagttctttgaaatgccaagacatgaggccatcaaggcccttgaaatatacaagcgtgcgggtttgcaggctggcaacctttctgccttctatgaagtatgcaaaggattagaacttgcaaggaatttccagtttcctgttttaagagagcctccacaatcttttcttacaacaatggaggaatatatgagagacgcacctcagatggtcgacgtcacatctgggccactgcttctgacctatacgcctgatgatggtcttacttctgaagatgttggaccttcacatgaagaacatgaaacatcatcgccttcagatagtgccgttgttccctctgaagaaacgcaactttcttcccagtctcctccttcagtagaaactccacagaacttcattgatactgatgatctattgggtctgcatgatgatacacctgatccgttagcaatcctggaccaaaatgcactagctttggccttagtttccaatgatgttgattcttcgccgtttagttttgggcaagcaagagatttggatccgtcaggatgggagcttgcgttggtcacaacacctagcaatgatatatctgcagccacagagagacagctggcgggtggattagacacgctcaccctgaacagtctatatgacgatggagccttgagagcagcccaacagcctgcctatggcgtcccagcttccaatccgtttgaggtccaagacctgtttgcattttcagacagtgtttcaccgccttcagccgtaaacaacccattcggtctctatgagccaacctatcatcaacaagagcagcagccacagctacaggttgcacccagccctgcaaatccttttggtgattttggggagtttccaatagttccggtttcagaaccacaaagcaccaccagttttggggcatttccagtaccggtttcagagccgtcaaacaccaccggctttggggagattccagtagtcccggttacagaaccgccaaacaccaccgcgtttggggaatttccagtggtgccggtttcagaaccacaaaacatcactgggtttggggcattaccagtaaccccggcttcagaaccatcaaacaccaccggttttggggaatttccagtagtgtcggtttcagcaccacaaaacaccactgggtttggggcattaccagtaatcccggtatcagaaccgtcaaagaccaccggtttgggggaatttccagtagtcccggtttcagaaccgcaaaacaccacgggttttggggagttcccggtaaacgcaggtgctcatgagcaacataacagcaacaaccccttcggcagcacgggcttcttgtga

SEQ ID NO: 1133 - DNA, 1167 bp, Arabidopsis thaliana
atggcgcttctgaggccgcatcttcatcgctttcactccaacactctccgccactcagcctatccttccgccgacgctggcggtggccttgtcgtctatcccacgtatggtcgtcaccgttgctccgcgattgcgatcgacgctccgtcgtctctgactggcgtgacgccgattcgttggggttacacgagtgttcaaggattccgagatgagatggaagacgacatcgtaatccgttctgatgctgtcgatagcttctcctacgcagcggtcttcgacggccacgctgggtcgtcctctgtcaaattcctcagggaagagctgtataaagagtgtgttggtgcattgcaagctggatcgttgttgaatggaggcgatttcgcagcaatcaaggaagctttgattaaggcctttgaaagcgttgaccgcaatttgctcaaatggctagaagctaacggtgacgaagaagatgaatcaggttcaacagccactgtaatgatcatcagaaatgatgtttccttcattgctcatattggtgattcgtgtgcagtcttatctcgatctgggcaaatcgaggaattgactgattatcaccgtccatatggaagcagtagagcagctattcaggaagtgaaaagggtcaaagaagcaggtggatggattgtcaatggaaggatttgtggagacatagctgtatctcgtgcttttggtgacatccggtttaagacaaagaagaatgatatgttaaagaagggtgttgatgaaggaagatggtccgagaagtttgtttccagaatcgagtttaaaggggacatggttgtggcgactccagatatcttccaagtacctctgacatctgatgtggaattcattattttagcttctgatggattatgggactacatgaagagctcagatgtggttagttatgttagggatcagctccggaaacatgggaatgtgcagcttgcttgtgaatctcttgcgcaagtagctttggaccggcgatctcaggacaacattagcatcattattgctgatctaggaagaacagagtggaagaatctccccgcgcagcgacaaaacgtagtggttgaactggttcaggctgcaacgactatcggtttagttactgttggcatatggatgtcttcacatctatcttaa

SEQ ID NO: 1134 - DNA, 1428 bp, Arabidopsis thaliana
atgaagctacgattgagacatcacgagacgagagaaaccctaaaacttgaattggccgatgcagacactctccatgatctccggcgacggatcaaccccacggtgccttcctccgttcatctctcgctcaatcgtaaagacgagctcatcacgccttcgccggaggatacgctccgatctcttggtttaatatccggtgacctaatttacttctctctcgaggctggcgaatcttcgaattggaaattgagagattctgaaaccgtagcttctcaatcggagagtaatcagacgagtgttcatgattcgattgggttcgcagaggttgatgttgtccccgatcaagcgaaatctaatcctaatacctccgtagaagatccagagggagatatttcgggtatggagggtccagagccgatggatgttgagcagcttgacatggagctcgctgcagctggaagcaaaaggctaagtgaaccattcttcttgaaaaatatactgcttgagaaatctggtgatactagtgagttgactactttggctttgtcagtacatgctgttatgttagaatctggattcgtgctgttgaatcatggctctgacaagtttaacttttcaaaggagttacttacagtatccctgaggtatactctacctgagctgattaagtctaaggatacaaatacaatcgagtcagtttctgtgaagtttcagaatttaggccctgtggttgtagtttacggaactgtaggtggatctagtgggcgagtgcatatgaatcttgataagcgtaggtttgttcctgttatcgacttggttatggatacttctacatctgacgaagaaggctcttcgagtatctaccgtgaagtgttcatgttctggagaatggtaaaagatcgccttgttatcccgttgttgattggtatttgcgataaagctggcttggaacctccaccgtgtttgatgcgcttaccaacagagctaaagctgaagatactagagttgcttcctggtgtgagtattggaaatatggcttgtgtttgtacagaaatgcggtatctggcatcagacaatgacttgtggaagcagaagtgcttggaggaagttaataattttgttgtgacagaagcgggtgattcagttaattggaaggcgaggtttgctactttttggaggcaaaaacagcttgctgctgctagtgatactttttggaggcaaaaccagcttggaaggcggaacatttccacgggaagaagcggcatacgattccctcgaatcattggagaccctcctttcacatggtttaatggggatcgcatgcatggatccattggtattcacccgggacaatcagcacgtgggctcggcagacgaacatggggacagctctttactcccagatgcaatcttgggggactcaactag

SEQ ID NO: 1135 - DNA, 483 bp, Arabidopsis thaliana
atgctttcttcttccccaaccttcttcgctactccatttctctcttcttcttcttcttcttctccgtcgttctcttctacttcaccaccgtcacgcatttcccggatctcgccgtcgctttctacaaccaccgcgtcctacacctgcgccgaagatctaccgagattacgccaaatcccgcagcgattttcagcaaccgcgtctctctacgagatccttgaaattcccgtcggctcgacgagtcaagagatcaaatcagcttaccggcgactagccaggatctgtcatcccgatgtagcgagaaatagtcgggataactcgtcggcggacgatttcatgaagatccacgcagcgtattgcacgctttcggatcccgagaaacgcgccgtttatgatcggaggactcttcttcggagccggccgttaacggctggatacggcagttacggtggacggaattgggaaaccgatcagtgctggtag

SEQ ID NO: 1136 - DNA, 531 bp, Arabidopsis thaliana
atggcgagacacacggcggcgctgaagatcgggctagctttactggggctgagcatggctggttacattcttggtccgcctctctactggcatctcactgaggctttggccgccgtttccgcctcctcttgtccttcttgcccctgtgaatgctctacctattccgctgtcaccattcccaaagattgtgcaaagcacgatccagaggtgaacgaagacactgagaagaactatgctgaacttcttaccgaggaactgaagctgcgtgaagcagaatctttagagaaacacaaacgagcagacatggggctattggaggccaagaaggtaacttcttcataccaaaaggaagcagataagtgcaactcgggtatggaaacatgcgaagaagctcgagaaaaagcagaattagcactcgccgagcagaaaaagctaacatctaggtgggaagagagagctcgccaaaaaggatggagagaaggttccaccaagccaaatgttaaatccaaaagcaatgttcaggttgcttag

SEQ ID NO: 1137 - DNA, 849 bp, Arabidopsis thaliana
atgcagattgcattctctaatgcaatatacttggttgatgtcatcgaaggtggagaggtgattatgaaagcgtgtaagcctgcactcgagtctaattacatcacgaaagttattcacgattgcaagcgtgacagtgaggctctatacttccagtttgggataagattgcacaatgttgtggacactcagattgcttattctctgattgaagaacaagaagggcggaggagacctctagatgattacatatcgtttgtttcactccttgctgatccacgttactgcggtatatcctatgaagagaaagaagaagttcgagttctcatgcgccaggacccaaagttttggacatacaggcctatgactgagctcatgatccgcgcagctgctgatgatgtccgcttccttctgtatctctatcacaaaatgatgggaaagctaaatcagcggtcactatggcatcttgcagttcgtggtgctttgtactgtcggtgtctctgctgcatgaatgatgctgattttgctgattggccaaccgttcctccaattccagttttcctcgttaaggtcgtatatgctgtagagacaaagaaaaaaagacgggtgacattagcttcgattgggttactgattgtagttggacttttaaatgtggcagataacctgaagtcagaagatcaatgtcttgaagaagagatcctgtcagtgcttgatgttccaccaggaaagatgggacgtgtgattggaaggaaaggagcatcgatcctcgccattaaggaagcttgcaacgcggaaattctaattggaggggcaaagggtccacctgataaggttagtcttattccatag

SEQ ID NO: 1138 - DNA, 867 bp, Arabidopsis thaliana
atgggattgtggaatggaaaaggcaccggaggatttatcctctaccttctcgtggctttctccgtcgccgtcttctctgtttcttacgtcggagacacaacaaaccctattcatcatcatctctcttctctctctgccaccgaaaaaatttggccggatttgaagtttagctggaaacttgtgttggctacagtgatagcgtttctaggatcagcttgtgggactgttggtggtgttggaggtggtgggatttttgttcctatgctcactcttatactcgggttcgatacaaaatccgcagctgcaatatcaaaatgtatgataatgggagcatcagcatcatcagtttggtacaatgtacgagttcgtcatccgacaaaagaagtaccaatcttagattatgatcttgctcttctctttcaaccaatgcttcttctcggtatcactgttggtgtttctctcagtgttgtgttcccttattggctcattactgtcctcatcatcattcttttcgtcggtacttcttcgagatctttttttaaaggcattgagatgtggaaggaagagacattgttaaagttcccagttgctttagcggtgtttgggtttgaagcaagcaaattgtatacagcgaacaaaaagaggttaaacagtggcaacactgaatgtatctgtgaagctacgattgagtggactcctctgagtctaatcttctgtggtctctgtggtctcattggaggtatcgtaggtggtctccttggatccggtggtggatttgttctcgggcctttgcttcttgagattggagtcatcccacaggtaaacacaccatcttatcagttgctagcgcaacagctacctttgtga

SEQ ID NO: 1139 - DNA, 1167 bp, Arabidopsis thaliana
atggagctaaagagcattaaggatgcgtttgatcgtgttgcgacgaagcagaagctctcttatagcaaaactaatgagattgttcatatgttgtctcaagaaatcgataaggctttgagcatattagaggagacaccatcatcagatactatgcttcttgatcatagatctatcctcgctgatgtgaagaaagtgtttatggagattgctccaatcactcaacttgaagctactgagaaagagctacatgcggctttgaccaagtaccctaaagttcttgagaaacagctgaatccagacatatcaaaggcttatagacacaatgttgagtttgatactcatatcgttaaccagattatcgccaactttttctaccgtcaaggaatgtttgacattggtgactgttttgttgctgaaactggtgaatctgaatgttctacaagacaatctttcgtggagatgtatcggatactagaagctatgaagagacgagatcttgaaccggctcttaattgggctgtttcgaactctgacaaactaaaggaagcaaggtctgatcttgagatgaagcttcatagtctacactttctggaaatagcacgaggcaaaaactccaaagaagctatcgactatgcgagaaagcatatcgccacgtttgcagatagctgcctcccggagatccagaagctcatgtgttctctcttatggaacagaaaactcgataaatcaccatactccgagtttctctcccccgctctgtggaacaatgcagtcaaagagctaacccgacagtactgcaacctactcggtgaatcatctgaaagcccgttgagtataacagtaacagcgggcacacaagcgttaccagtactattgaaatacatgaacgtggtgatggcgaataagaagcttgattggcagaccatggaacaacttcctgttgatgcgcaactatccgaggagtttcagtttcattcggtgtttgtctgtccagtctctaaagaacagtcaagtgatgataaccctccgatgatgatgtcttgtggacatgtgctttgcaagcagacgatcaacaaaatgtcaaagaatggctctaagtcgtcgttcaagtgtccttattgcccaaccgatgtagacatctcaaggtgtaggcagttgcacttttga

SEQ ID NO: 1140 - DNA, 849 bp, Arabidopsis thaliana
atggcttcttctgcaacagcaccaaattcgctatctttcttctcatcttctctctttttatcctcctctcaccaaatccctaaaacctacatttccgtttcaaaactcggctccggcagagtctcgaagccgctttctgtctcttcccagctagcgactctaccgattctatcattcgaaggagagaaggtcggagagacgtatctagacctcaaagcggcgccggaggataccgcgcgtgccgttgtgcaccgagccatcgtgacggacctgaataacaagcggcgaggtactgcttccacactgactcgcggtgaagttcgtggtggtggaattaaaccttactcacagaagaaaactggccacgcgaggcgtggatctcagagaacaccgttacgtcccggtggaggtgtggtgtttgggccaagacctaaggattggtcaattaaaatcaataggaaggagaagaagctagcgatatctacggcgttatcgagtgcggcatctgcggaaggtggtgcgatagtggtggaggaatttggggagaagtttgagaagcccaagactaaagatttcttagctgcgatgcaaaggtggggattggatcccaaggagaaagctatgttcttgatgattgatgtggatgagaatgtggcgaaatcgagtaggaacattggaaccttgaggatgttgacgcctaggacactgaatctgtttgatattttgaacgctgataagcttgttctgactcctgcggctgtggagttcttgaatgcgaggtacggtgttgatgcggtggaggaagaagatgacgatgaagatgagacggaagggtcagaggaagcttaa

SEQ ID NO: 1141 - DNA, 210 bp, Arabidopsis thaliana
atggcagatgatgaagttgttgatccaaagaagtaccttgaggaatcttgcaaaccaaaatgtgtgaagccacttctcgaatatcaggcatgtgtcaagagaatccaaggtgatgattctggccacaagcattgcactggccagtattttgactactggcaatgcattgacaaatgtgttgcaccaaagctgtttgcgaaactaaaatga

SEQ ID NO: 1142 - DNA, 876 bp, Arabidopsis thaliana
atgggtatggacttgagagttgttccggcggaggaatggttgaatcgagggatagattcgagtcacgacggtgaacatgacctaggcctaatggttacagattttctggaaacgggaggtggtagcggtggtgctggttcctggtgcagcagcgacagcgattctggattcccagatccttcttacctttccgataagattcagtatctcaagtactctatggctcaacacgaaaccgaggttctctcggtggttcgtacattgatgcttactattaaggagaaagatctacactctgtgaaatccggtacatgtaacgctagttgcatcaggttttatctcgctaagcttttgagactttctggatatgatgcagctgtatgttcagctagatggcaaggtggtggcaaagttcctggtggagataatgagtatatagatatcatattgagtgatactgaagttggtcaagatgatcgtttgattgttgatattgatttcagaagtcattttgagatcgctagagctgtggattcttaccaacggataatggaatcacttcctgtggtttatgtaggaactgttgcaagattaaaccagttccttcaagtaatggttgatgcagcgaaattctccttaaagcagaattcaatgccgttacctccatggagatctttgaactacctgcgatccaaatggcattcacctcacaaaaggcatctcggtcctatcgatcaacaaggtcctggaatgttctcaccgggattacatggacagtgtgctgagaatttaaagaggcttcagtttgctctccaggttgaacaagaggccgagagattcatgaagaagaagagcggttttagccgcaggaactaa

SEQ ID NO: 1143 - DNA, 1782 bp, Arabidopsis thaliana
atgtctactgttgctcctcctgctgatcaagctgctgatgtattgaagaaactgtctttagattcaaagtctaggactttggagatccctgagcctactaagaagacgggtgtttaccagtatggagctatggattcgaatggtcaagttccttcttttgatcgatctttgtcacctatgctacccagtgatgccttggatccttctgttttctatgttcctaatgtgtatcagcagccctactattatggttatgggagtgactacacaggttataccaattccgagagtgttgatatgacatcaggagcttacggagagaatgcatctcttgtttatccgcagggatacgggtatgctgcctttccttactcaccagcaacaagccctgctccacaacttggtggtgatggacagttgtatggtgctcagcagtaccagtatccttttcctctcacagccagtagtgggcctttcgcttcgtctgttcctgcctctactcagagcaagctctctacaaacaaagcagccaactctgcatctgctggtatccctaaaggaatgaatggatcagctcctgttaaaccattgaatcagagtgcactgtatggaaacagtgctcttggaggtggtcttgctgctggttatcaggaccccaggtatagctatgatgggttttacactcctgtgtcatggcacgatggctctaacttctcagatgtgcagaggtctgtttctggcagtggagttgcatcctcatattctaaggctaacaacaatgtacctgcgactaggaatcaaaactctagctccaattcgcattacacgagtatgtaccagcctgcatccatgacaggttatgcagctcagggttactacgacagagtgtctccaaacaagtcatatggtcagtatggtagcacggtgaggtctggtatgggttatggttcttctggatatggttcaagaacaaatgaaagaggatggctcaatacagacaacaaatatagaagccggggaaggggtaacagttacttctatggaaatgagaacattgatggcttgaatgaactaaacaggggccctagagccaagggcacgaaggccacagaagaggttagctcagaggaggtgaaaaagcagacgtttgatgaatcaaatactgaggagactgtaacatgcgttcttccagatagagaagagtgcaacagagacgattttccagttgagtataaagatgctaagttctttatcatcaagtcgtacagtgaagatgatgtgcataagagcatcaaatataatgtatgggctagcaccccaaatggaaacaagaagcttgatgctgcatatcaagaggctcagcagaaatctagtggctgccctgtgtttctcttcttctcggtcaacgcgagtggacaatttattggccttgcggaaatgaaaggaccagttgatttcaacaaaaatattgagtactggcaacaggataaatggactggctcatttcccctcaagtggcatattctgaaggatgttcccaacagtttgcttaagcatattactctagagtacaatgagaataaacctgttactaacagtagagacacacaagaggttaagttggagcagggtttgaaggttgtaaagattttcaaggagcataacagcaagacatgcattttggatgatttctcgttctacgaggctcgacaaaagactattttggagaagaaagctaagcagcaacaatcccagaagcaggcaagagaagaaaacggttaa

SEQ ID NO: 1144 - DNA, 231 bp, Arabidopsis thaliana
atgagcagtgatggttccgccggaaaggcggttgttgaagccaaaggattgaaccctggattgatagtgctgcttgttattggaggtctgcttgtgacatttctcatagccaattacgttatgtacatgtatgctcagaagaatctacctccaaggaagaagaagcctctttccaaaaagaagctcaagcgtgagaagctgaagcagggagtccctgtgcccggcgaatag

SEQ ID NO: 1145 - DNA, 720 bp, Arabidopsis thaliana
atgacagaatcgagtctggatctgcaggaatctggttgggaagaacttaggcgggaagctcgtaaaattgaaggagatctagacgttaagctctcttcttacgctaagctaggcgccaggtttactcaaggcgggtatgttgacactgggtctccaaccgttggatcggggagatcatggaagtctatggagatggaaattcaatcgttgcttgagaagttgttggatattaatgattccatgagtagatgtgctgcatctgctgcacccacaacatcggttactcaaaaactagcaaggcacagggatatacttcatgaatatacccaggagtttcgaagaataaaaggaaatataaactcgttgagagaacacgctgagcttctgagttctgtcagggatgacataagtgaatataaggcttctggtagtatgtcaccaggtgtgcaagtgttaagggagagagcttcaatccatggaagtatatcccatattgatgatgtgattggtcaagctcaagcgacaagagcagttcttggctctcaacgatctctgttttcagatgttcaagggaaagtaaaaaatctcggagacaaattcccagtgattcgtggcttacttggctcaattaaaaggaaacgttctcgggacacacttatcctctccgctgtcatcgctgcttgtacgttgtttctaatcatctactggctctcaaaataa

SEQ ID NO: 1146 - DNA, 1305 bp, Arabidopsis thaliana
atgtataagaaccagctacaagagttggctcagaggagctgctttaatcttccttcgtatacttgtattagggaaggtcctgaccacgcgccgcgattcaaggctactgttaactttaacggcgagatctttgagagtcctcagtattgttctactcttcgtcaagctgaacactctgctgctgaagttgctctcaatgctctctctaatcgtggtccttctcactctcttgccgccaggatcttggatgagacgggtgtgtataagaatcttttgcaagagatagctcaaagagtgggagctcctttaccgcgatatactactttcaggtcaggtcttggtcaccaacctgtgtttactggtactgtagaattggctggaattacgttcactggagatccagctaagaacaagaagcaagcagagaagaatgctgcaatggctgcttggtcttccctaaaacaattggcaaaagaaacatcaagttcaatgcctgagcctgagaacattgacgaactagaacaggtgattatagcaagagctttgataaactatcgtatcaaggaaaacattggcacaggaagctcctcgagtgccccagttccatttgcaaagaagttctttatgcagaaccttagaccaacaagtccacagccttctcctgcaaccacatcgagaatcttaccctttatttgcccaaaacaaccttccagaagcagcagatcatccttagcagcaacttccggtattgacagaattatggcagcagccttggaaagccgcagctaccagcggcctcagcagagatttgcaaatccgccttatgttcctatgaggcaatttagatcgcaatgccatgggatggctccacctgtcacaatcagaaccgctgtaccggtcttctctgcacctccaatgcctcctccaccatgtacaaacaacactcagctaccttcttctgtgtatgtcccatcgctgatgcgaactgcaccacctgtgaggatcgcgccgcctgtcacaatcagaaccgcggtgcccgtatttgcttctgcgccaccggttagaattagaaccgctgtgaagcccacagttgaggcaggagaaacccgcatatcatcagtccaagaaaaggagagtataccagtcttgcctgatagtcttgaaattggagtagaaggaagtactataacaattacagattgtgagaaaacagcgtcaaaggaaaccgagagagcagagtttaaggattcatcgaaaggagaaccggagacagcaagagagcgactggagaacctaaagatctga

SEQ ID NO: 1147 - DNA, 1419 bp, Arabidopsis thaliana
atggctgcgacgcttactggatcagggattgctctagggttttcgtgctccgcaaagttctctaagagagcttcttcgtcgtccaaccgtcgctgcatcaagatgtcggtttcggtagaggagaagacgaagaaattcactcttcagaaatctgaggaagctttcaatgctgcgaagaacttaatgcctggaggtgtgaactcacctgtacgtgctttcaaatctgttggtggacaaccagtggtgatggattctgcaaagggctcacgaataagagacattgatggaaatgaatacattgactatgttggatcttggggacctgctataattggtcatgctgatgatgaggttcttgctgctttggctgagacaatgaagaaaggaacaagctttggtgctccttgtctcttagagaatgttcttgctgagatggtgatttcagctgttccaagtattgaaatggttcggtttgttaactccggtacagaggcatgtatgggtgtgctacgtcttgctcgtgccttcacagggaaacaaaagttcatcaagtttgaaggttgttatcatggtcatgcaaactctttccttgtcaaagcaggtagtggtgtagctactttgggtctacctgactcgcctggggtccccaaagcagctacttcagatactttaacagctccatacaatgatattgctgctgttgagaagctttttgaggcaaacaaaggagagattgctgccatcattcttgaacctgttgttggtaactcgggttttattacacctaaaccagagttcattgagggaatacgccggatcactaaagacaatggtgctcttcttattttcgatgaagtcatgactggttttcgtttagcctatggtggagctcaagaatactttggaatcacacctgacttaacaactcttgggaaaatcatcggtggtggtcttcctgtgggagcatacggtggaagaagagacatcatggaaatggttgcacccgcaggaccgatgtatcaagctggtacgctaagtggtaatccgttggctatgacagcgggtatacacacgctgaagcggttaagtcagccagggacatatgaatacttagacaagatcacaaaagagcttacaaatgggatactagaagccgggaagaaaaccgggcatgcgatgtgtggcggttacataagcgggatgttcggtttcttcttcacggaaggacccgtctatgatttctcggatgcaaagaagagtgatacagagaagtttggaaagtttttcagaggaatgttggaagaaggtgtctacttggcaccttctcaattcgaggccggttttactagcttggctcacacttcagaagacatccaattcactatcgcagcggccgagaaggttctaagtcggctctaa

SEQ ID NO: 1148 - DNA, 732 bp, Arabidopsis thaliana
atggctaacaatgaggagcatcctcctcgagggaatgaatgggaagtcgtctcgctcacttcatcagcttatgctgctgctcctggtccgtataacgttgaatcaagagatgtgcgcaagtatgatgcttactatggagcggaaacttcacgtgatctgtacatgtctgaacactttgtattcccacctagtgagcatgagaatttacccattgatgaatctttattcgtggcggagcaaagaaaggatggccgagacttgatgctggaaggtcagggattgtctgatcagtttcattatgaagctggaaacaaccaacagagtatctatggtgaatctgcgcttggttcttctagacacatggaatcattcggaagcgaatcagccgtgtatgaacacggattagttgatgcagagggaaacttagatctccattctgatggtgagggtgaaaaggatgtaaaaaaatcaacacacaaccttccttgtgaagcttggtggaaaaggagagctatttctatgtattcacgcacaagagaagcaaatgcgatatggtccttattctttgcagctgcggtcacaggactcgtagttcttggtcaacgctggcaacaagagaggtggcaggttttgcaactcaagtggcaatcaagcatcagtagcgaggtaataatctataaaatcacggaaaaaacttcaattaagaatcgttatgttttttacaaatggtaa

SEQ ID NO: 1149 - DNA, 585 bp, Arabidopsis thaliana
atggctcgagacgtggctatatgtgccaaacacttgaatggccaatcgccgcaccaaccgattctatgcagactactccaagatctaatacacgagaaagcgtgcagggaacacggattctatctcggcatcaccgctctaaaaagcatcggtaacaacaagaacaacaacatcgacaacgaaaacaatcatcaagcaaaaatcctcacattcccggtgtccttcacatgccgcacattcttgcctgcaagaggagatatcttgcaagggactgtaaaaaaagtgttgtggaacggagcttttatcaggtcaggaccactcagatacgcatacctctcactcttgaaaatgccacattatcattatgtccactcaccattgtcggaggacgagaaaccgcattttcagaaagacgacctctcaaagattgctgttggagttgttgtgcggtttcaggtgttggctgtgcggtttaaagagagaccacacaagagaagaaacgactattatgttcttgcaactttggaaggcaatggttcatttggtcccatctctcttacagggtcagatgagccatacatgtaa

SEQ ID NO: 1150 - DNA, 459 bp, Arabidopsis thaliana
atggctgaagcagcgagaagacaaggtggtgggagaccattaccgccacctccgagaggcgttaaccaacaacctcctcgccctaaacctgaacctgtcgatcgtgaaaagacatgtccccttcttcttcgtgttttcaccaagagtggtggtcatcatactagtgaagattatgctgtgagaggcaaagaaccaaaggatgaagttcaaatctacacttggaaagatgccagtcttcgcgagctaacagatttggttaaagaagtttctgtagcagctaggagaaggaatgctagattgtcttttgcgtttgtttatcctaacaataaaggtggctataatgtgagagaggttggggagacgatggcttatccaaaccgaaaacaaccagatgacagtaaaacgctttccgaacttccgtttgagattggagattatctggatgtggcaatttactag

SEQ ID NO: 1151 - DNA, 615 bp, Arabidopsis thaliana
atggagtcacggaagattaacctaatggcgacagcaatagctttaatagtggtggctatggtggtggcagctgctgatgataagacgaaagacaaggaggagtgtacggagcagctggtcggtatggccacgtgtcttccttacgtgcaaggacaagcaaaatctccgacgccagactgttgctccggtctcaaacaagttcttaattcaaacaagaagtgtctttgtgtgatcattcaagacaggaatgatcctgatttgggtctccagatcaacgtctctctagctctcgcacttccttctgtttgtcacgccgctgctgacgtcactaaatgccctgctttgcttcacttggatccgaattctccagatgcccaagtcttctaccagctagctaaaggtttaaacaaaaccggcccagcctctgctcccactggctcgtcccctggacctataagcatttctccgacttcaggatccgatgatggtaacaacagtggtcgaacgacctctgtgccaggcaggaaccacgctcaaagcttctataaacaatggctggggctcgaagttgtgttccatttcttcgtaattttttatattttcatcctcgtatag

SEQ ID NO: 1152 - DNA, 504 bp, Arabidopsis thaliana
atggcgaaatctccggtggaagtgaatctgataccaatcgaagctacacctgagaccttcgcagagtatggtcaagtcatcgaagcctctcgtgatggggccggttacggtcccaacgacgctcaattggatctctctaaaggaatcccacggctctatatacttaggctgaaagaaacacccttagggtttttcaagatcacgcatcacgcaaaggtgacacagtgtctaggatcaataggaggtgatatttggtatatgggagtggctaagccatctcttattgaagatgatgatgatggaaggagagtagatacagtaaaagcaaagtctggtcacttgtacattccacctgaggtggaagagattcgcgtcttcaggttctcgggaccaaagtttgtgaaactgcaccgtggtacatggcatgctggacccttgtttagtggcagctccatcatggatttctacaacttagaactcagcaacacaaatgtgagtcagtga

SEQ ID NO: 1153 - DNA, 1449 bp, Arabidopsis thaliana
atggtggctatgtttcaagaagataatggaacatcttctgtagcttcatcaccacttcaagtcttctcaactatgtcactcaacagaccgactctcctcgcttcttcatctccgtttcattgtctcaaagatctcaaaccagaggagcgtggtctctacttaatccacctcttgctaacttgtgccaaccacgtggcttcaggtagcctccaaaacgctaacgcagcgctcgagcagctctctcacctcgcttctcctgacggcgacacgatgcagcgaatcgctgcttacttcaccgaagcgcttgctaacagaatccttaagtcctggcctggtctttacaaggctcttaacgcaactcagacaagaactaacaatgtctctgaggagattcatgttagaagactcttctttgagatgttcccgatactcaaagtctcttacttgctcactaatcgagctatactcgaggctatggaaggagagaagatggttcatgtgattgatctcgatgcttctgagccagctcaatggcttgctttgcttcaagcttttaactctaggcctgaaggtccacctcatttgagaatcactggtgttcatcaccagaaggaagtgcttgaacaaatggctcatagactcattgaggaagcagagaaactcgatatcccgtttcagtttaatcccgttgtgagtaggttagactgtttaaatgtagaacagttgcgggttaaaacaggagaggccttagccgttagctcggttcttcaattgcataccttcttggcctctgatgatgatctcatgagaaagaactgcgctttacggtttcagaacaaccctagtggagttgacttgcagagagttctaatgatgagccatggctctgcagctgaggcacgtgagaatgatatgagtaacaacaatgggtatagccctagcggtgactcggcctcatctttgcctttaccaagttcaggaaggactgatagcttcctcaatgctatttggggtttgtctccaaaggtcatggtggtcactgagcaagactcagaccacaacggctccacactaatggagaggctattagaatcactttacacctacgcagcattgtttgattgcttggaaacaaaagttccaagaacgtctcaagataggatcaaagtggagaagatgctcttcggggaggagatcaagaacatcatatcctgcgagggatttgagagaagagaaagacacgagaagcttgagaaatggagccagaggatcgatttggctggttttgggaatgttcctcttagctattatgcgatgttgcaggctaggagattgcttcaagggtgcggttttgatgggtatagaatcaaggaagagagcgggtgcgcagtaatttgctggcaagatcgacctctatactcggtatcagcttggagatgcaggaagtga

SEQ ID NO: 1154 - DNA, 720 bp, Arabidopsis thaliana
atgggaatcattggtaagagtgtttctctaactctctttgcacttttgtgcttcacttcctctgttttcaccttaggagtgaatcaacctggttcatcagatcccttccatagccttccccaacaccttcccctacctccaatcaaactaccaactcttccaccggccaaagctcccatcaaactaccagcctacccaccagccaaagctccgatcaagctaccaactctcccaccagccaaagctccgattaagttaccaactctcccaccgatcaaacctcctgttctcccaccagtttaccctcctaagtacaacaagaccctagtggcagttagaggtgtggtctactgcaaagcttgcaagtacgcgggcgtcaacaacgtccaaggcgctaaacccgttaaagatgcggtggtgagacttgtgtgcaagaacaagaagaactcaatatcggagacaaagacggacaagaacggatacttcatgctcctggcccctaagacggtgaccaactacgatatcaaaggttgtcgagctttcctcgtgaagtctccagacaccaagtgcagcaaagtgtcgtcactccacgatggaggcaagggctccgttctaaagccggtcttgaaaccaggattttcctcgaccatcatgagatggttcaagtacagtgtgtacaacgttggtccattcgcattcgaacctacctgccccaaatga

SEQ ID NO: 1155 - DNA, 897 bp, Arabidopsis thaliana
atggcagaggcaagtttctatatcggagtcataggaaatgtaatctccgtactagttttcctctcaccagtattattaatcgatcggtccatattaatataccaaacaaaaatcatcagggagacgttttggaaaatagtgaagcggagatcaacggaggagtacaaaagcttgccgtacatttgcacgttgttaggatcatcgctatggacatattacggcatcgtcactcccggagaatatcttgtctccaccgttaatggctttggtgctcttgttgaaaccatctacgtttcactttttctcttttatgcccctcgacatctcaagctgaaaacagtggatgtggatgcgatgttgaacgtgttttttccaatcgcggcgattgtggcaacgagaagtgcgtttgaagatgagaagatgcgttctcaatcaataggtttcatatctgctggtctaaacattataatgtatggttctccactttcagcaatgctactatactgtaccacgacttggtatggtaggtccatatcttggataaagacatatatacgtaacatttcattttcaatcattcgcaacaaaataaatagaatacgttttgagtttatcacaatatctgttataatatatagactgatcatagtgtctaatttcttaatacaatatgcagaaaacagtagtgacaacaaagagcgtgaaatacatgccgttttggttgtcgtttttcctcttcttaaacggcgcgatttgggctgtctatgctttactccaacacgacgttttcttactcgtaaaaatgccaaaccggttggtttaagcaacggtttaagtgagattgctcaagatgaagaggaaggcctcacatcacgtgttgaacctctcctctcttaa

SEQ ID NO: 1156 - DNA, 720 bp, Arabidopsis thaliana
atggcggattcagctttcaggaaaattcagatccaaagagatgacactacatttgatgcctatgtggtcggtaaagatgatgcgcctgggattgtggtgattcaagaatggtggggtgttgactttgagatcaagaaccatgctattaaaatctcacaacttgagcctggattcaaagcccttatacctgacttgtatcgaggaaaggttggtttggatactgcagaggcacagcatctaatggatggccttgattggccaggtgctatcaaagatatccgcgcttctgttaattggctaaaatccaatggctcaaaaaaggttggtgtcactggaatgtgcatgggaggtgcattagctatagctagctctgtattggttcctgaggtggatgctgttgttggattctatggaaccccttcctcagagctcgcagatccagcacaagctaaggcacctattcaggctcattttggagagctcgacaattttgtcggtttttctgatgtcacggcagcaaagaatctcgaagagaagctgaaagcgtctggagtagcacatgaagttcacatctatccaggtaatggacacgcgttcttgaacaggagtccagaaggagtgagcagaaggaaaagcatgggactttctgatgaagatgaagccgcagtggagcttgcttggtctcgcttcacctcctggatgaaacagtacttggcttaa

SEQ ID NO: 1157 - DNA, 1014 bp, Arabidopsis thaliana
atggcgatgatgacgacgacgacgacaacattcttccatccactacttcctgctaacacttacaaatccggagctgtagcttcttcctttgtctcagttcctcgttcgtcgtctctccaatttcgctcacttgtgtcagattctacgtcgatttgtggtccaagtaagttcaccggaaaaaacagaagagtatcggttaccgtttccgccgccgcaacaactgaacctctcaccgtcctcgttaccggtgccggtggaagaacaggacaaattgtgtataagaaattgaaggagaggtcggagcagttcgtggcaaggggtttagtgaggacaaaggagagtaaggagaagatcaatggagaggatgaagtattcattggagatattagagatactgcatcaattgctcctgctgttgaagggattgatgctttggtcattcttactagcgctgttccgcagatgaagcccggttttgatcctagtaaaggaggaagacctgagttcttctttgatgatggagcttatccagaacaggttgactggattggtcagaagaatcagatagacgctggtgttgatgatgatggattgtcgtttgttgtaacagctaaggctgcaggagttaagcagattgttttggttgggtcgatgggaggaacaaacattaatcaccctctcaatagtattggcaatgctaacattctggtctggaagagaaaggctgagcaatacttggctgattccggtattccatacaccatcatcagggctggaggtctgcaggacaaggacggtggcattcgagaattacttgtgggaaaagatgacgagctacttgagacagaaacaagaacaatcgcaagagctgatgttgcagaagtctgtgttcaggcattgcagcttgaggaggcaaaattcaaagctcttgacctggcctcaaagcccgagggaacaggcaccccaacaaaggatttcaaggcgcttttcactcaagtaaccactaagttctga

SEQ ID NO: 1158 - DNA, 846 bp, Arabidopsis thaliana
atggtgaatgagaagaagatgctcccaaaacgcatcatactaatgcgtcacggtgagtcagccggtaacatcgacgcaggggcttacgcgaccacacccgatcacaagatccctctaacggaagaaggaagagcgcaagcgcgtgaggccgggaagaaaatgagagccctcatatcaacccaaagcggcggtgcgtgtggagagaattggcgcgtgtacttctacgtgtcgccttacgagagaacgaggacgactttgagggaagtaggaaaaggattctcgaggaagcgcgtgataggagtgagggaagagtgtaggatcagagaacaagattttgggaattttcaagtggaagagaggatgagagttgtgaaggagacgagggaacgtttcggtagatttttctatcgttttcccgaaggtgaatccgccgccgacgtctacgatcgtgtttctagttttctggagtctatgtggagagacgtggacatgaacaggcatcaagtggatccatcaagtgaactaaacctagtgattgtgtcccacggactgacatctcgagtgtttctaacaaaatggttcaagtggacggtggcagagttcgagcggttgaataactttgggaactgcgagttcagagtgatggagttgggtgcgagcggagagtacactttcgcgatacaccacagtgaagaagagatgttggattggggcatgtctaaagatatgattgatgatcaaaaggatcgtgttgatgggtgtcgtgtaacaacatcaaacgattcttgttcattgcatctcaatgagtattttgatttgttagatgtcactgatgatgaagaatga

SEQ ID NO: 1159 - DNA, 930 bp, Arabidopsis thaliana
atgtgcttctatttgctttccgaaaaaaaccaaacgcacccatctccttcctcttctccttttctctccgaacaaagaacacaaccaaaacaaaaatctatgttagatatgtcggaatctgtactcacggcgatgtatagttggttcactccgacagttctcttcgtcttcctcaaccttatgattggtaccatcgccattagctcatctttctcttccaaatccaacgacccaaatcaaactcagatccaacgctctccttccatgattcatcgtctcaaatccataaacttctcttctttcacttctccagacaagtctcatctcgagtttcctccttcaacacctgaagacaacagcaacaacaactttcaccaaccagcttcaatcgaacagaatcaaccattcttgtctagatctccttctgttcttcacagaatcaaatctttcaatctttataactacatttctcaagaacccaccaatataatcgaagcttcaccaccgtcggtgaccgtagagacaaaacaagaacaagtacaagaacaagaagtaaaagaagaacaagaagaagaagaacagagtcttgaagaggtttatagtaaacttaatctaaaccatgtcgctaggacaaaatctgacactgaaccagctgctggaattagacctccgaagcttccaaagaagatgaaaaaatctgctagtaccaaatctccgttctctcactttcaagaagatgaaatctccgtggaggctcgccgtcctgcgacggtgaaagtgccgagagttacgacggtggaagaagctgatgaagaagtagatgcaaaagctgatgactttatcaatcgattcaagcatcagttgaagttacagagaattgattccatcactaagtataaggagatggtgaagaaaagaaacgacaagtga

SEQ ID NO: 1160 - DNA, 1707 bp, Arabidopsis thaliana
atgtttggccgatctgcgattcgtggaggaggattccgtgcagagaatctaggtcaaaacgcacttaccttaatcggtaacataggcttctcactcttcgtcttcggagtactaatcttcaccataatcgccgcaacttacgaaccagaagatcctctcttccacccatctgacaaaatcacaactttcctcacttccacatcaaacgctacacttagatccgatgactccgttgttaaaaccggtgaagatttcatgctcgctaaccaaaccgcatttgcagagtttatcaacataaacgatgttgaagccagcaccaatgagactactacagaggaagagggtaacaagttggaatgtgatgtgaatactccaattgattgcaaagatcagcaagtgtttcatcttatgatgagagctactattgacaagtttaaagatattcacttttataagtttggtaagcctgttactggcgaagaaggtgtgaattcttgtgatatggcgtggcgttataggcctagagatgggaagagtgctgctttttataaggattataggaggtttgttgttgctaagtctgagaattgtagtgtgagtgttgttgggattggtgagtatcattcgggtttgaatgcgaggaagaggaagaagaatcagaaagctgggtttgagaaaactggtgggaagaaagatgatttctctttgcctgttgttggtgaacttgtgaatgattctcttcctatggttgagtctgatagtgtgtttaagactggcaagtatttggtttatgttggtggtggagataggtgtaagagtatgaatcattttctgtggagtttcttgtgtgctcttggggaagctcagtatttgaataggactctagtgatggatttgaccttgtgtttgtcttctatctatacttcgtctggtcagaatgaggaaggcaaggatttcaggttttactttgatttcgagcatttgaaagaagctgcttctgtgttggatgaagctcagttttgggctcagtgggggaaattgcgtaagaagagaagaaatagattgaaccttcatctcgtggaggattttagggtcactcccatgaagctcgcggctgtcaaagatacgttgataatgaggaagtttggatctgtagaaccagacaattattggtacagggtttgtgaaggagatgcagaatctgttgttaaacgaccgtggcatctgttatggaaatcaagaaggttgatggaaatcgtctctgctattgcatcaaggttaaactgggactacgatgctgtacacattgagagaggagagaaagcaagaaacaaggaggtttggcctaatcttgaagcggatacttccccgagcgctctcttgtcgaccttgcaggacaaagttgaagaaggaaggcatctctacatcgcaacaaatgaaggagaattatccttcttcaaccctttgaaagataagtacgccactcatttcctttacgactacaaagatctttgggatgagagcagtgagtggtattcagagactactaagcttaatggaggcaacccggtcgaatttgatggttacatgagagcatctgttgacacagaagtattcttgagagggaagaagcagattgaaacattcaacgatcttacaaacgattgtaaagatggagttgggacctgcaatgctgcaacttcctga

SEQ ID NO: 1161 - DNA, 852 bp, Arabidopsis thaliana
atggacgatgatggatttcgcaattggggatactatgaaccagcggctgcttcttcgtttaaaggtaatctcggtttgcagcttatgtctactattgaccggaacactaaaccgtttttacccggtcgtgaatcgaatcttatgatcggttctaacggttcgtatcactctcgagagcaagacatgaactatagctggattaatcaaccaaaggacaacaagttcttcaacatgttgcctataagtacaccgagttatagtaatgtgttgtcggaaacatctggttcgaattcgattcagatgatacatcaaccggttttgaattcatcccggtttgaggagaatccgattcctcctcctgctccttgtgaagagcagactggtaagaagagaaagatgagaggcagcatcgcaacaccaacggtaccgaaagctaagaagatgcgtaaaccgaaagaagagagagatgttactaacaacaatgttcagcagcagcagcagcgtgtgaaaccggttaagaagagtgttgatcttgtgattaacggtgtgagtatggacatttctggtttacctgtaccggtttgtacttgtactggaactcctcaacaatgttaccgttggggttgcggcggatggcaatccgcttgttgtacgactaacatttcggtgtatccattaccgatgagtactaagcgacgcggtgcaaggatttcgggtaggaagatgagtcaaggcgcgtttaagaaggttcttgagaagttatcaacagaaggttatagctttgggaatgcgattgatttgaagtctcattgggctagacatggaaccaataagtttgtcacgatcagataa

SEQ ID NO: 1162 - DNA, 639 bp, Arabidopsis thaliana
atgaatcatcgtcggagctcgatcgtactattgatcctctcaattttatctcccgtgacactctctatacgatacgagctactttctgggcacacgaaatgcatctcagaggagattcacgcaaacgcaatgaccatcggaaaatacagcattataaaccctcacgaggatcatcctcttccttcttcccataaagtcaccgtcagggtcacatcgccacaagggacggcttatcacgaatcggacggagtagaatcgggacaattctcgtttgtagctgtggaaacaggggattacataagttgcttctccgccgtcgatcacaaaccagagacgacgctgatcattgactttgattggaggacgggtattcataccaaggattggtcgaatgtggcaaagaagagccaagtcgaaacgatggagtttgaggttaagaagttatttgaaaccgtgaatggaatccacgatgagatgttctatctccgcgacagggaagaagaaatgcacaatctgaacatagcgacaaattcgaagatggcatggttgagtttcgtgtcgcttgcagtttgtttatcggtcgcaggtcttcagttttggcacttgaagactttcttccagaaaaagaagcttatctga

SEQ ID NO: 1163 - DNA, 528 bp, Arabidopsis thaliana
atgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgggctgaagaagaagacatgtgcaatgagaagagtcacgtgctaacgtacgcagataaggaaggtgactggatgatggttggagatgttccttgggagatgttcttgtctactgtgagaagactgaagatttcaagagctaattaccactactga

SEQ ID NO: 1164 - DNA, 801 bp, Arabidopsis thaliana
atgttgatttcgtatttgttatcaatgcagtatggaatggctttactttccaaccgaaagctctccacttctattttgactcctgatgattcatttccttctgatttacttaccaaaaagactgtgcttacaccagaccgaaccataggacaatatcaagacttggtcattccagtgactaattttcagaacgaggaaaagggtttcatggttttagcaggtgatgtctttgatgttccaataaggaaagatatcattcacaatgtcgtgcgatggcagcttgcgaaacgccagcagggaactcattcgaccaaaacgttaagtgaggttagtggaactggtagaaagccatggaatcagaagggtacaggtcgagctagacatggtacactacgtggtccgcagttccgaggtggttgtgtaatgcatggacccaaaccaagaagccatgccataaaaatgaataagcaggttcgacggcttggactgaaaatagcattgacagctcgagccgcagaaggaaaactcctcgtgtttgatgatttgggattgcctacgcataaaacaaagaacattgtgaactattacaaccaaatggagaacacaaagaaagtccttgttgtagaaggtggtcctattgatgaaaagctgaagctagccacccaaaatctacactatgtcaacataattccatcaatagggctaaatgtttacagcattctgctacacgatacgcttctgatgtcccgtgatgctgtgaataagatcgttgagcgtatgcacactcctattaaccgttga

SEQ ID NO: 1165 - DNA, 2511 bp, Arabidopsis thaliana
atggctaatctcctcagagttcttatggttagtgaactgggttctcctattaatcaatttcgattctacttctcccatcattatttcttcatctcttacaattcttcttttcatcaggtggcggagaagcccagcattgccctctctatagcttcagttctctcacatggccagatgtctacaaggagaggcagtacagaggtgcatgaatttgatggcatgtttcgaggcttcaaagcacattatagagttacatctgttatcggtcatgttttcagtgtagatttcccagaaaaatatcagaattgggcaactattgatccacaagatcttttcgacgctccaattattaaaaaggaatcaaacccaaaggtaaatatcttcaaatctcaggctcatatttgtaggcatttaagtaatgaagctcgtggttgcagttatatggtgttgtggttggattgcgatcgtgaaggagaaaatatatgttttgaagttatcgagtctactggctttgacatgaaagatagtaagagaaaggtttatcgggcacggttttcttctgtgactgagaaagatatatcaaaggccatggacaaccttgttgaaccaaacagagatgaggcactggcagtagatgctcgtcaagagatagatctaaaaatccttttgaatgtttatttcagctatgggccatgccagacacctactcttgggttttgtgtgcaacgctacatgcatattaatactttcaagccagaaaagttttgggctctgcgaccttatataagaaaggatggttatgagctccaactagagtgggagagacgaagattgttcgacctggaagctgctactgtgttccaaaagttggtcgtggaaggaagaactgcaaaagtaatggacgtatcagaaaagcaggaagtcaaaggtcgcccagctggtcttaacacagtgaatttgctaaagtgctctagggtttgggcctcagacggctatgcatcttgcagagcgattgtatactcaaggtttcatcagtcaggaactgacgctggagaccatcctcctatcaccccaatgagagcagcaaccgaggtcatggtcggaggagatgcttggcgactctatcagtatgtctgtcaacattttcttggcactgtttcacctaactgcaaatacataaggactaaagtggaattgtcaattggtggagaaactttccattgtacggggcagcgtgtgacagaaaaggggtttacagctataatgccatggtctgcagtagatgagaaaaaactcccttcttttctcaaaggagagaggattgaagttttaagagtggagctttacgaggggaacactgcgcctccggactaccttactgagagtgagctgatatctctcatggagaagcatggcataggcacagatgcatcaatagctgtacatataaacaacattggtgaacgtaattatgttcaggtccaatctgggaggaaaatggttccaacggcgttaggaatcacgctaataagaggctatcagtgtattgatccagacctttgcttaccagacatccggagttttatcgagcaacaaatcactcttgttgccaagggccaagctgatcattcacacgttgtgcagcatgtgattcagcaattccggcgtaaattcagttattttgttcaacagatcgaacacatggatgccctctttgaagcacagttctctcctctggctgattctggtcgtgctttaagcaaatgtggaaaatgcttgcgttacatgaaacatatcacagcagtcccaccacgtctcttctgcggcacatgcgaagaagtttattatcttcctcaaaagggcacagtcaagctatacaaggaactcacatgtcctttagacaactttgagctcgtgatctattcagttccaggacctgaggggaagtcatttccactatgcccatactgctacaactctcctccatttgaaggcatagacacactttttggagcctctaagacgcccaatgctcctgccaaaaccaaaaccggtgcaggcatgccatgttctctctgtcctcatcccacatgccaacactctgtcagaaaccaaggagtctgcgcttgtccagagtgtgaaggcacgctcgtcttggacccggttagcttccccaagtggaaactcaactgcaacttgtgtagttgtatcgttttgcttccggaaggtgctcatcgcatcaccaccactagtaaccgctgtcccgagtgtgattcagccatcatagagatcgatttcaacaagaaaactactcctctggagaacggagccactctgcatcaaggatgtgttctatgtgacgagttgcttctctcacttgtagaagtgaaacatgggaggtcctttgtgaggcgtggaggaaggggaaggggacgagggagaggccgaggcagaggagggagaagaggctcaaaatctgtcgacccaaaaatgagtttcagagacttttga

SEQ ID NO: 1166 - DNA, 693 bp, Arabidopsis thaliana
atgaagcaattctggagtccaagtagtatcaacaagaacaaagctatggttgagaatctgcaaaatcatggtatagttacttcagatgaagttgctaaagctatggaggctgtggatagaggcgtatttgtaacagatcgttcctctgcttatgttgatagtcccatgtctattggttataatgtgactatatcagctcctcatatgcatgcaatgtgtcttcaacttcttgaaaaacatttgaaaccgggaatgcgtgtacttgatgttggctcggggaccgggtacttaactgcttgctttgcggttatggttggaaccgaagggcgtgctattggtgtggaacatattcctgaattggtggcttcttctgttaagaatattgaagcgagtgctgcttcgccatttctgaaagaaaggtctcttgctgttcatgttggtgatgggaggcaaggatgggctgagtttgctccgtatgatgctattcacgtcggagcagcagcaccggagatcccagaggcgttgattgatcagttgaagcccggtgggagactggtgattccggttgggaacatattccaagatctgcaagtggtggataagaactcagatggttctgttagcatcaaggatgaaacttcagttcgttatgttcctttgactagccgtgaagcccagctgagaggggactga

SEQ ID NO: 1167 - DNA, 2076 bp, Arabidopsis thaliana
atggacgcggagaaggctactgataagactaatgtccatctctcctcggaccatgagcgttgtccggtggaggaagtggctcttgttgtgcctgagacggatgatccaagcctaccggtgatgacattcagagcttgccactcaccatctcagccatccctcatgcagatcgctggtttgcccatcggcaagttcatggctcggactcttcccaccacttctcacaaccttcttgggtggagttttagcctcaatcctggtccttttaacatcaaggagcatgtcattatcaccatctttgctaattgtggcgttgcttacggtggtggtgatgcttactctattggggctatcactgttatgaaagcttactataaacagagccttagcttcatctgtggtctcttcatcgtcttgaccactcagattttgggttatggttgggctgggattctaaggaggtaccttgttgatcctgttgacatgtggtggccttcaaatctcgctcaagtttctctcttcagagcgttgcacgagaaggaaaacaagtctaaaggcttgacgaggatgaagttctttctagtagctcttggtgctagctttatttactatgcacttccaggctatctattcccaatcttgactttctcctcatgggtttgttgggcttggccaaacagcatcacggctcagcaggttggttcagggtaccatggccttggggttggagccttcactcttgactgggctggcatctctgcttaccatggtagtccattggtggctccatggtcctctatcctcaacgttggtgttggtttcatcatgtttatatacatcatcgtccctgtttgttactggaagttcaacactttcgatgccagaaagttccccatttcctccaaccagctattcactactagtggccagaagtatgacacaaccaagatcttgacaccgcagtttgatctggatattggtgcttataacaactacgggaaactttacctcagccctcttttcgcactctctatcggatccgggtttgcgagattcactgcaacactaactcatgtggcattgttcaacggcagggacatatggaagcagacttggtctgcagtgaacaccacgaagctggacatccatggaaaattgatgcaaagctacaaaaaagtgcctgagtggtggttttatatattgctggcaggaagtgtagccatgtctctcctaatgtcttttgtgtggaaggagtcagtgcagcttccatggtggggaatgctctttgcttttgcattggccttcattgtcacactccctatcggtgtcattcaagcaactacaaatcagcaaccaggatatgatataatagggcagttcattatcggttatatcctgcctggaaaacccattgcaaacctgattttcaagatttacgggagaatcagcacagtccatgctctctcatttttggcagaccttaagcttggccattacatgaaaatcccaccgccctgcatgtacacggctcagctggtgggcactgtggtagctggtgtggtgaatctgggagtggcctggtggatgttggagagcattcaagacatatgcgacatcgaaggagaccaccctaatagcccctggacttgccccaagtatagagtgacgttcgatgcttcagttatttgggggttgataggaccaagacggctctttggaccaggaggcatgtaccgtaaccttgttgggttcttcctcattggagctgtcctgcctgttccccgtgtgggcgctgagcaagatcttcccaaacaagaagtggatccctctcatcaacattccagttatctcctacggctttgcagggatgcctccagccactccaaccaacattgccagctggttggtcacaggaaccatcttcaactactttgtgttcaattaccacaagagatggtggcagaagtacaattacgtactctctgcagcgctcgatgcagggaccgcgttcatgggggtgctcttgttcttcgccctgcagaatgctggacacgacctcaaatggtggggcactga

SEQ ID NO: 1168 - DNA, 1839 bp, Arabidopsis thaliana
atgatctcgttttcatttcatctcctcgtcttcatcctcctaagtctctcttccttcgcaacagcacaacagccttatgtcggaatatcaacaactgattgctctgtttccgacaacacaacctctgttttcggctactcttgtaatggtctcaacaaaacttgccaagcttacgtcattttccgatctactccttctttctccaccgtcacctcaatctcttccctcttctctgtcgacccatctctcgtctcctccctcaatgacgcttcaccttcaacttctttcccttctggtcaacaagtcattatccctttaacttgttcttgcaccggtgacgattcacaatccaatattacatacacaatccaaccaaacgattcgtatttcgccattgctaacgacactcttcaggggctttcgacatgtcaagctttggcaaaacagaacaatgtttcttctcaatctttgtttcctggtatgaggatcgttgttccgatccgttgtgcgtgtcccacggctaaacagatcaacgaagatggcgtgaagtatctgatgagttatactgtggtttttgaagacactatcgcgatcatcagcgatagattcggggttgagacgagcaagactttaaaagctaacgaaatgtcttttgagaattctgaagttttccctttcacaacaatcctgatccctttggtgaatcctcctgcaaatactaactctctcattcctcctcctcctcctcctcctccacaatcggtttctcctcctccattgtcgccggatggtaggaaatcgaagaagaaaacatgggtctatgctcttgccggagtactaggaggagcattggttttgagtgtgatcggtgcagccatattttgcctgtctaagaagaaaacgaaaacgcaaacgcaagaggaaacgggaaacctcgatagcttcatgggcaagaaaccaccgatgtctgatcaagaattcgatccgctagatggtttgtcaggtatggtggtagaatccttaaaagtttacaaatttcacgagctgcaatcagctacaagcgatttcacatcgtctagctcgattggaggatcagggtacatcggaaaaatcaacggcgatggcgcaatgatcaagaaaatcgaaggaaacgcatcggaggaagtcaacttattgtctaaactaaaccatcttaacatcatccgtctctctggattctgtttccatgaaggagattggtacttagtctacgaacacgcttcaaacggaagcttaagtgaatggatccacacgacgaaatcgttactaagcttgacacaaaaactacaaatcgctttggatatagcaacagggctaaactatctacacaacttcgctgatcctccatacgttcacagagatttgaacagcaacaatgtgttcctcgacctcgagtttcgagcaaagattggtagtttaggttcagcaagatcaacgactgaagatttcgtgttgaccaagcacgtggaaggaacaagagggtacttagctccggagtatttggaacatggtttagtttcaactaagcttgatgtctatgcttttggagttgtcttgttggagattgttactggtaaagaagcttctgaattgaagaaagagatcgatgaaggtaaagctattgatgagattttgattcatggaagattgttacctgaaggattaacaagttttgttgagagattagtggtggattgtttaaagaaagatcatttgaatcgtccatcgatggatgaaaatgttatgtctttgtctaagatcttggcggctacgcagaactgggaagaatcgtcgtactaa

SEQ ID NO: 1169 - DNA, 831 bp, Arabidopsis thaliana
atgactcttcttgtatacaagggtgccgcaaaggtctctatagtaatgatcgggcaacaagccatcatggattcttatttatgccttttacatctcacagctgggattttagttgaatccctgtttaacgcttttgcaacagctgcgttcttcaaatttgtagtgttttcgatatttgagatgagatatcttctgtccatatggaaagcgaccaggccttcaaccagcggtgagggctgggaaacaatgaggcgtgagctctcctttttgtacagccgtttctatggaatccttcttggaggcatattattaatgtacgagttccacaactacatgcggccgatcctcctactcatgtactcattttggattccccagatagttgcaaacgttgttcgtgattctcgaaagcctctgcacccatattatatactagggatgactgttacacgacttgctataccgttgtatgtttttggttgcccgaagaacttcatgcgtgtagagcccagcaaggcctggtgtgtaagcctgtgtgcattcatggggtttcaagctggtgttcttcttcttcagcattatttcgggtctcgttgctttgtccctcgaaagttgctacctgagaaatacagctactacagaagactcgatcataatgtaaaccgaagcagggactgcgtaatctgcatgaccacgattgatctcagacaccgtattaatgattgcatggtaacgccgtgtgagcatatattccactcgggatgcttacagagatggatggatataaagatggagtgcccaacatgtcgtcgcccacttcctccagcttaa

SEQ ID NO: 1170 - DNA, 1392 bp, Arabidopsis thaliana
atgaggtcagatcactactttagcttgaggtctccgacggaagattttgttggtggttacccttctgatgaagaatggcatggatacattaataacaatgatagagttcttctcaaggttattagttactcctcacctacttctgctggagctgagtgccttgatcatgactgttcttgggttgaacaatggattcaccgtgctggtccgagggagaagatatacttcaggccggaagaagtgaaagctgcgattatcacttgtggtggcctttgccctggtctcaatgatgtcatcagacatattgtcattactcttgagatttatggtgttaagaacattgtggggattcctttcggttatcgaggcttctctgataaagatctaactgaaatgccgttatcaaggaaagtggttcagaatattcatttatctggaggaagtttgcttggagtttcacgtggaggcccgagtgtgagtgaaattgtcgacagcatggaggagagaggaatcaacatgcttttcgtgctcggtggaaacggaactcatgctggcgccaacgctatacacaatgagtgccgcaaaagaaagataaaggtagctgtagttggtgtgccaaaaaccatcgacaatgatattttacatatggataaaacttttgggtttgatactgctgttgaagaagctcaacgagcaattaactctgcttacattgaggcacatagtgcttatcatggcattggcgttgtaaaactgatgggtcgtaacagtggtttcattgctatgcaagcctctctagcaagtggacaagtcgacatctgtttgattcctgaggtacttctttgttattatttcaaattccaaaacatgattgatgagctcgctctaagagatcctatgcatctaaaggttcccttcaatcttcatgggcctaatggtgtattgaagcatttgaagtaccttattgaaacaaaaggctctgctgtgatctgtgtagcagaaggagctggacagaattttcttgagaaaaccaatgccaaagatgcatctggaaacgccgtacttggtgatttcggtgtgtatattcaacaagagactaagaagtatttcaaagaaataagtactccaatagatgtgaagtatattgatccaacatacatgattcgcgctgtacgtgcaaatgcctcggatggtatcctctgcaccgttcttggacaaaacgctgttcatggtgcgtttgctggatacagtggaatcacggtaggcataatcaacactcactatgcatatttgccaatcactgaggtaattgcatatccaaaatcagtggatcctaatagtcgaatgtggcatcgttgcttgacatcaacgggccaacccgatttcatctaa

SEQ ID NO: 1171 - DNA, 639 bp, Arabidopsis thaliana
atggaagctacctctctaagctctgcagcaacaatcatctcctcctcatcttccccactctccatattctctccaaagaagcgaacagactcatcacctcccccgagaatcgtccgtctctcgaacaagaaggaagacaaagattacgatccgcaacattccgaatcgaactcatcaagcctcttccggaatcgaactctctccaatgatgaagcaatgggactggtgttgagtgcagcttcggttaaaggatggacaaccggttccggtatggaaggaccgtctctaccggctaaaaccgatacagacacggtttccacatttccatggtcattattcactaaatcgcctcgtaggcgaatgcgtgttgctttcacttgtaacgtatgtgggcaaagaactacaagagctattaatcctcatgcttacactgatggcactgtcttcgtgcagtgttgtggatgtaatgtgtttcataagctggtcgataatctcaacttgtttcatgaggttaagtattatgtgagcagctcgagcttcgattacaccgatgctaagtgggatgttagcggcttgaatcttttcgatgatgaggatgatgataatgctggtgatagcaatgatgtctttcctttgtaa

SEQ ID NO: 1172 - DNA, 891 bp, Arabidopsis thaliana
atgcctatagctatcaataccgagacggcaaagactcaacactatgaattaccaacagctttcttcgaacatgctcttggaagaaacatcaaatacagctgttgttactattcaaacgattcaagtagcttagaagaggcaggggaagctatgttggctctttcttgtgaaagagctaaagtggaagatggtcaaagtgttcttgatatcggatgtggctggggatctttgactttgtacattgcacgcaagtacagcaaatgcaagttaaccggtatctgcaactccaaaacgcagaaagcatttatcgatgagaaatgccggaaactcgggcttcagaatgtcgaaatcattgctgcggatattagcacttttgagcatgaagggacatacgatcggatattctccatcgaaatgttcgagcatatgaaaaactatggagagctactgaagaagataggaaactggatgaaggaagatagtcttctgtttgttcactatctctgccataagacatatgcttaccactttgaggatgtgaatgacgatgactggatcacaagacacttcttcagcggaggaacaatgccatcagcagatcttctcctatatttccaagtaatatacattataacttgtgaaaatgtttcgattatggatcattggctcgttaacgggacgcattatgcaaagacaagtgaagagtggctgaaaggaatggataaggagatagttgccgtaaaagagataatggaagtgacttatgggaaagaagaagcagtgaagtggacggtttactggagaaccttcttcatcgcgcttgctgagcttttcgcatacaacaatggagacgagtggatgattgcacacttcctcttcaagaagaaatga

SEQ ID NO: 1173 - DNA, 627 bp, Arabidopsis thaliana
atgtcaaaagattgcggtaaccacggtggtggcaaagaagtagtcgtccggaaactctgcgccgccataatcgccttcatcgtaatagttctaatcaccatcttcctagtttgggtcatactcaggcccactaaaccaagattcgtcctccaagacgccaccgtctacgccttcaacctctcgcaaccaaacctccttacttcaaacttccaagtcacaatcgcatctcgtaaccctaactccaagatcggaatctactacgaccgtctccacgtctacgctacatacatgaaccagcagatcactctacgtacggcgattcctccgacgtatcaaggccacaaagaagtcaacgtttggtctcctttcgtctacgggactgcggttcccatcgcaccttacaactccgtcgctttgggagaggagaaagatcgtggatttgtagggttgatgatacgcgccgatgggaccgtgaggtggaaagtgaggactttgatcaccggaaaatatcatatccatgttcggtgtcaggcgttcatcaatcttggaaacaaagctgctggtgttcttgtcggtgataacgccgttaagtacacgttggctaataaatgcagtgtgaacgtttag

SEQ ID NO: 1174 - DNA, 426 bp, Arabidopsis thaliana
atgttgctttacaagaaaaagaatcagattgttaaaggaaacagaatcttgatcagcgtaacgtttcttggtagtgctggtccgatccggttcgttgctaatgaaggtgatcttgttgcatctgtgattgatactgctttgaaatgttatgctcgtgaaggtcgtcttcctattcttggatctgatttcaacgattttgttttttattgtccaatggttggacctggagctttgagtccatgggaagcaattgggtcggtgggagtgaggaactttatgttgtgtaagaagaaaccagaggagaagaaggttgaggaagataagggaagatcgaattttccgattaatggagctagaaaaggagctggtggaagttttaaggcttggattaataaatctttaagacttaaagtgactacccattag

SEQ ID NO: 1175 - DNA, 522 bp, Arabidopsis thaliana
atgggaaattgtcaagcggttgatgcggctgcgttggttctacaacatcctgatggcaagatcgatagatattacggtcctgtatccgttagtgagatcatgcgtatgtatcctggtcactacgtttctcttattattcctttgccggagaagaatattccggcgacaacaacaacaacagatgataagagtgagagaaaggttgtgaggttcacgcgcgtgaaacttctccgaccaacggagaatcttgtacttggtcatgcttatcgtctcatcacttcacaagaggttatgaaggttttaagagccaagaagtacgcgaaaacaaagaaacaccaaagtgaaacgagtaaggagaagaagaagccatcatcggagaagaagattgatgaagaatccgacaagaatcagaatctggaaacgaaagatgagaagcaacgttcagtgttaacgaattcagcttcatcgagatcaaaaacatggaggccatcattgcagagcatctctgaagctacgagttga

SEQ ID NO: 1176 - DNA, 600 bp, Arabidopsis thaliana
atggcgcagcgatctagggttatcaccatgtctcctctcattctcgatcaagaagttgatctcgatctctgggaagttgttaatccttctgatggcgagttctccgacgattctttctccgtcgatagtctttccgacgatgacgtcatatctcttgacgacgcttcctttgtcgcaccctctgtcatttctccgccgcatgagataattcctattgctgacggtggtgatctcgccgtggatctggatggtgatgatgatgttggcgatgatgtcgttcgcgatgaagttgatgagaatgatcttggatggtctcagcagcggatgatgtttctcggtggaggttctggttattctgttggaattacgtacggagatagtgttaatgacgacggcgaagaagatcgcgagtacgacgattcgtatgatcttgacgaagagttggttccgcgtagcgtgagtaagaaggtggggagacaaaggatgaggaaactggggaaaagagcaatcgccaaggtctatgcctcgaagatatctccgtttttgaagcctggtatcgttcgtggtaagcatggtctcggcatgaaattcaagtgctga

SEQ ID NO: 1177 - DNA, 1437 bp, Arabidopsis thaliana
atgaatcgtctcttttctctcttctccatagctctgatcgctttcctctgcctccaccatcatgttctcgcttcttcctcttccgacttcgaaggtttcgatgctgaagacgacgatgtttcagaagattccactgagcttcaccactctctccgtcctcctcttctgactcagtctgagtcaacggttctggatctggacccatctcccgattctgattctactcctgcatctaaatctgatcctcccactcagaccgtgaagccttcgtcctccatctccttcgattactgggatgaagatgagttcgaaggattgccggaggacgagaaatctacggagtctccggttttttccgatgacgcctcctctcctgccgatccacagacgccggatcttgagtctgcttcagaaactccagatactgacattccgaagaagatgcaatcgtacactgtggagatcgtttgcgtctctatattgattggttacgctatcaattacttcactggtaaacgtgaaaatgagaacctcgctttggcttgggcttccaaatttggtcttaaagatacgatttttgagaagaacttcagtttgcttggagttggtgaaggagaagactctcctttgttgctgaaagaagcgacgaatgtgtttaagttctatgccagtgggcgtaggtattgccatgggcttttggcgactttggagcttaagagtagacacgatctgatctcaaggctattcaactctgtcgtgccttgtaaagatgagattagttttgaggtgtatatgaatgatgaagccatggatcacattgtgtttgctatggcgaggaagaaggcggctaaaacgatgcacaaggagctgagggatctgcagagatttggagggatggttcccagtcctggcgggaggaagtgggtaacggaggagttagctgtggtctctgagtctaaggaggtagctggagatatgatcaccgatgttgtacttgatcaggtttttggtgacaagtcttttgaaaagtttgggaagtatttcatctcaatgcatttctcggatcaacatcctggcaaacacaggaagatgctgcttttcaagtttgccttacctgatattaaacacatggatgatatggttcggttgatagcgctaattccgtattacattgacttaattgggcgctacaagctcagctctcaggcaaggaacaaaactgacggtgctaggcaaaaggcggctcaggaagcgtacaaggaacttgagaatgtgagacaagaggcattgcagagaaagaaagccgaaaagaagaaaatattggaggaggcacaggcaaagcttagctccgaggctctaaggaagaaagaagcaaaagaacgtgcacgccagatgaaaaagtcaatgccgaaagttaagatgagtcgtggtcactag

SEQ ID NO: 1178 - DNA, 813 bp, Arabidopsis thaliana
atggctattgcacgaactggagtttatgttgatgattaccttgagtatgcaagcactttccctgcagagctacaaagattactaaacacagttcgcgaactagacgagagatctcaatggcttgcttcacagagttctaaaaagggtaatggtaatcattacaataatggtggtcttgatgaagaggaaacgattgagaaaatgcgtaaagagattgagtctagtcaggaaaatgcgttaagtttgtgtaccgagaaggttttattggcccgacaagcgtatgatcttatagatagtcatgtaaaacgacttgatgaagatctgaataattttgcagaagatttaaagcaagagggaaaaattccaccagacgagccctctgttcttcctccactacctatagttcctaaagcggaaaagcgtaagtccttctatggcacacctcagcccaagaagattgattatagagatagagactgggatcgtgacagggattttgagctcatgcctcctccaggaagcaatcggaaagaccttatgccaattgaagagcagccaatcgatccaaacgaaccaacttactgtgtctgccatcaggtgtcctttggagacatgattgcctgtgacaatgagaattgccaaggaggtgaatggtttcactatacatgcgttggcctcacacctgagaccagattcaaagggaaatggtgccactggcatcttctttggcaccttcccttcatgaccaatgccaccaaactcatctttcttgttacccaacatctagcaagtgcaagtagaagcaaactttag

SEQ ID NO: 1179 - DNA, 504 bp, Arabidopsis thaliana
atgaaacaaaaccagagcaagttcttgagaataatctcaacacctctaagagctttaggcaaggcacgtgatttctacgtgagaagcatcaccggttgcgcagctcgtactcaatattcctcctccgcctccgtctccgctccttttccaagaagccggagctcctcctccgccgccttctcctcctccgcatcatcccggagaaccaccgatttcgggatagatgaagattacagcgagctagtgagagctgcgtcggtgaggagtttagggcacaagaatgagatagacatgttgatacaagagaagctgcaacagcagaagcaacagaagcaaggagggttgcctaagagctcgagtgctgggatggcgaggatagaggaagaggaagaaacagaggaaggatctgtgaatccgaaggtgaagaagactaagaaagtctctgatcttttgtatcctcgtagcaaatcttacgccgttactactagtacccctatcttgtaa

SEQ ID NO: 1180 - DNA, 1044 bp, Arabidopsis thaliana
atgaattgtcttcagaatcttcccagatgttcagtctcacctctgctgggattcgggtgcattcaaagagatcattcttcttcttcttcttctttgaagatgctaatatcgcctccgatcaaagccaatgatccaaaatctcgacttgttttacatgcagtatcagagtcaaaatccagctcagagatgagtggtgttgcaaaggatgaagagaaatctgatgaatatagccaagacatgactcaagctatgggtgctgttctaacttacaggcacgagttaggaatgaactacaactttattcgtccagatctaattgttggatcctgcttacagacccctgaagatgttgacaagcttcgtaaaattggagttaaaaccatattttgcttgcaacaagatccagacctggaatattttggagtagacataagcagcatccaagcctatgctaagaaatatagtgatattcagcatattcgctgtgaaattagagactttgatgcatttgatttgagaatgcgtcttccagccgtggttggtactctttacaaagctgttaagcgaaatggaggagttacatatgtgcactgcactgctggaatgggaagggctcctgctgttgcgttgacatacatgttctgggtgcaaggctataagcttatggaagctcataaattacttatgagcaaaaggtcgtgctttccgaagctggatgctatcagaaatgcaacaattgatattaggatacctctaacactggacaagggaacaggattctggatcctaaagagagaactgcctgaaggacagtttgaatataaatacatcatagatggtgaatggacacacaatgaggccgaaccgtttataggacctaacaaagacggccataccaacaattacgctaaagtagtggacgatccaacaagtgtggatggtacaactcgggagagactatcgagcgaagaccctgagctgttggaggaagaacgctcgaaactaatccagttcttggagacttgttctgaggcagaagtttga

SEQ ID NO: 1181 - DNA, 3591 bp, Arabidopsis thaliana
atgaagactttttcaagcttctttctctctgtaacaactctcttcttcttctccttcttttctctttcatttcaagcttcaccatctcagtctttatacagagaaatccatcagcttataagcttcaaagacgttcttcctgacaagaatcttctcccagactggtcttccaacaaaaacccgtgtactttcgatggcgttacttgcagagacgacaaagttacttcgattgatctcagctccaagcctctcaacgtcggattcagtgccgtgtcctcgtctctcctgtctctcaccggattagagtctctgtttctctcaaactcacacatcaatggctccgtttctggcttcaagtgctctgcttctttaaccagcttggatctatctagaaactctctttcgggtcctgtaacgactctaacaagccttggttcttgctccggtctgaagtttcttaacgtctcttccaatacacttgattttcccgggaaagtttcaggtgggttgaagctaaacagcttggaagttctggatctttctgcgaattcaatctccggtgctaacgtcgttggttgggttctctccgatgggtgtggagagttgaaacatttagcgattagcggaaacaaaatcagtggagacgtcgatgtttctcgctgcgtgaatctcgagtttctcgatgtttcctccaacaatttctccactgggattcctttcctcggagattgctctgctctgcaacatcttgacatctccgggaacaaattatccggcgatttctcccgtgctatctctacttgcacagagctcaagttgttgaacatctctagtaaccaattcgtcggaccaatccctccgctaccgcttaaaagtctccaatacctctctctggccgagaacaaattcaccggcgagatccctgactttctctccggcgcgtgtgatacactcactggtctcgatctctctggaaatcatttctacggtgcggttcctccattcttcggttcatgttctcttctcgaatcactcgcgttgtcgagtaacaacttctctggcgagttaccgatggatacgttgttgaagatgagaggactcaaagtacttgatctgtctttcaacgagttttccggcgaattaccggaatctctgacgaatctatccgcttcgttgctaacgttagatctcagctccaacaatttctccggtccgattctcccaaatctctgccagaaccctaaaaacactctgcaggagctttaccttcagaacaatggcttcaccgggaagattccaccgactttaagcaactgttctgagctggtttcgcttcacttgagcttcaattacctctccgggacaatcccttcgagcttaggctctctatcgaagcttcgagatctgaaactatggctgaatatgttagaaggagagatccctcaggagctcatgtatgtcaagaccttagagactctgatcctcgacttcaacgatttaaccggtgaaatcccttccggtttaagtaactgtaccaatcttaactggatttctctgtcgaataaccggttaaccggtgagattccgaaatggattggccggttagagaatctcgctatcctcaagctaagcaacaattcattctccgggaacattccggctgagctcggcgactgcagaagcttaatctggcttgatctcaacaccaatctcttcaatggaacgattccggcggcgatgtttaaacaatccgggaaaatcgctgccaatttcatcgccggtaagaggtacgtttatatcaaaaacgatgggatgaagaaagagtgtcatggagctggtaatttacttgagtttcaaggaatcagatccgaacaattaaaccggctttcaacgaggaacccttgtaatatcactagcagagtctatggaggtcacacttcgccgacgtttgataacaatggttcgatgatgtttctggacatgtcttacaacatgttgtctggatacataccgaaggagattggttcgatgccttatctgtttattctcaatttgggtcataacgatatctctggttcgattcctgatgaggtaggtgatctaagaggtttaaacattcttgatctttcaagcaataagctcgatgggaggattcctcaggctatgtcagctcttactatgcttacggaaatcgatttgtcgaataataatttgtctggtccgattcctgagatgggtcagtttgagacttttccaccggctaagttcttgaacaatcctggtctctgtggttatcctcttccgcggtgtgatccttcaaatgcagacggttatgctcatcatcagagatctcatggaaggagaccagcgtcccttgctggtagtgtggcgatgggattgttgttctcttttgtgtgtatatttgggctgatccttgttggtagagagatgaggaagagacggagaaagaaagaggcggagttggagatgtatgcggaaggacatggaaactctggcgatagaactgctaacaacaccaattggaagctgactggtgtgaaagaagccttgagtatcaatcttgctgctttcgagaagccattgcggaagctcacgtttgcggatcttcttcaggctaccaatggtttccataatgatagtctgattggttctggtgggtttggagatgtttacaaagcgattttgaaagatggaagcgcggtggctatcaagaaactgattcatgttagcggtcaaggtgatagagagttcatggcggagatggaaaccattgggaagatcaaacatcgaaatcttgtgcctcttcttggttattgcaaagttggagacgagcggcttcttgtgtatgagtttatgaagtatggaagtttagaagatgttttgcacgaccccaagaaagctggggtgaaactaaactggtccacacggcggaagattgcgataggatcagctagagggcttgctttccttcaccacaactgcagtccgcatatcatccacagagacatgaaatccagtaatgtgttgcttgatgagaatttggaagctcgggtttcagattttggcatggcgaggctgatgagtgcgatggatacgcatttaagcgtcagtacattagctggtacaccgggttacgttcctccagagtattaccaaagtttcaggtgttcaacaaaaggagacgtttatagttacggtgtggtcttactcgagctactcacgggtaaacggccaacggattcaccggattttggagataacaaccttgttggatgggtgaaacagcacgcaaaactgcggattagcgatgtgtttgaccccgagcttatgaaggaagatccagcattagagatcgaacttttacaacatttaaaagttgcggttgcgtgtttggatgatcgggcttggagacgaccgacaatggtacaagtcatggccatgtttaaggagatacaagccgggtcagggatagattcacagtcaacgatcagatcaatagaggatggagggttcagtacaatagagatggttgatatgagtataaaagaagttcctgaaggaaaattatga

SEQ ID NO: 1182 - DNA, 3432 bp, Arabidopsis thaliana
atgactacttcaccaatccgggttcggatccggactcggatccaaatctccttcatcttcctccttacccatctctcacaatcttcctcctccgaccaatcttcactcaaaaccgactcattatcactcctctctttcaaaacaatgatccaagatgatccaaacaacattctctcaaactggtcacctcgtaaatccccttgtcaattctccggcgtcacttgtctcggaggaagagtcaccgagattaatctctccggtagtggcctctccggaatcgtctccttcaatgctttcacctctcttgattctctctctgttctcaaactctcagagaacttcttcgtcttaaactcaacctctcttcttcttcttcctttaaccctaactcatctcgaactctcttcctccggtttaatcggaaccctccctgaaaatttcttctccaaatactcaaatcttatttccatcaccctctcttacaataacttcaccggaaagttacctaatgatcttttcttaagcagcaagaaactccaaacccttgatctttcttacaacaacattaccggtccaatctccggtttaaccattcctctttcttcttgcgtctccatgacctatctcgatttctccggtaacagtatctccggctatatctctgactcactcatcaactgcaccaacctcaaaagcttgaatctttcttacaacaacttcgatgggcagattccaaaatctttcggtgagcttaaactcttacaaagtttggatctttctcataaccgactcaccggttggatcccgccggagatcggagatacttgccggtcattacaaaacctccggctttcttacaacaacttcactggtgtgatccctgagtcgttgtcctcatgttcttggctacaaagtcttgacctttcaaacaacaacatctccggtccgtttccgaacactatcctccggagttttggatctcttcaaatcttacttctcagcaacaacttaatctccggtgactttccgacttcaatctctgcttgtaagagcttgagaatcgctgacttcagctcgaatcgattctccggtgtgattccaccggatttatgtcccggagcagcttcattagaagagctaagactcccggataatctcgtcaccggagagattccaccggcgatatctcaatgctctgagctacgaacgattgatctcagtctcaattatctcaacggtacaatcccaccggagatcggaaacctccagaaactcgagcaattcatagcttggtacaacaacatcgccggagaaatcccaccggagatcggaaaactacaaaacctaaaagatttgatcctcaacaacaatcaactcaccggagaaatcccaccggaatttttcaattgcagtaacatcgaatgggtctcattcacaagcaacagattaaccggagaagtgcctaaagatttcggaatcctttcccggttagccgttcttcagctcggtaacaacaatttcaccggagaaatcccaccggagctaggaaaatgcacaactctggtttggcttgatcttaacacaaaccacttaaccggtgaaatccctccccggttaggtcgtcaacccggttcaaaagcactttccggtttactctcaggaaacacaatggcttttgttagaaacgttggaaactcatgtaaaggtgttggaggtttggttgagttctcagggatcagaccagagaggcttcttcagattccatctcttaaaagctgtgacttcacaagaatgtattcaggtccaattttgagtctattcacaagatatcaaaccattgagtatcttgatctttcttataatcagcttagaggtaaaatccctgatgagattggagaaatgattgctcttcaagttcttgagctttctcataatcaactctccggcgagattccgtttacgattggtcagctcaagaatctcggtgttttcgatgcttcggataatcggttgcagggtcaaatccctgaatctttctcgaatttgtctttcttggtgcagattgatttgtcgaataacgagttaactggtccgattcctcagagaggtcagttaagcacgcttccggcgactcagtacgcgaataatccggggctttgcggtgttcctttaccggaatgtaagaatggaaacaatcagcttcctgctggaacagaggaagggaaacgtgctaagcacggaactagggcagcttcttgggcgaatagcattgttttgggagtgttgatttccgctgcttcggtttgtattttaatcgtttgggcgattgcggttcgtgcgaggaggagagatgcggatgatgcgaagatgcttcacagtttgcaggcggttaattccgccactacatggaagatagagaaggagaaagagccgttgagtattaatgtagcgacgtttcagcgacagttgagaaagcttaagttttcgcagcttatcgaggcgacaaacggattctcagccgcgagtatgatcggacacggcggattcggtgaggtttttaaggcgacgcttaaagacgggtcttccgtggcgatcaagaagctcattagacttagttgtcaaggagatcgagagttcatggcagaaatggaaaccttagggaagatcaaacaccgaaacctcgtaccgctcttgggatactgtaaaatcggggaagagagattgcttgtttacgagtttatgcaatacggaagcctcgaggaggtgcttcacggaccaagaacaggcgaaaaacggaggattttaggttgggaagagaggaaaaagattgcaaaaggagcagcaaaaggactttgtttcttgcatcacaattgtatccctcacataatccaccgcgacatgaaatcgagcaacgtgcttctcgatcaagacatggaagcaagagtttcagatttcggaatggcgagactgatcagcgcattagacacacatttgagtgtaagtaccttggcaggcacgccaggttacgtaccaccagagtattaccaaagtttcagatgtaccgcaaaaggcgacgtgtactcaatcggagtagtgatgctcgagatcttaagcgggaaaagaccaacggataaagaagagtttggtgatacgaatttagtaggttggtcgaagatgaaggcaagagaagggaaacacatggaagtgattgatgaagaccttctaaaagaaggttcttcggagtctctgaatgagaaagaaggttttgaaggaggagtgattgtgaaagaaatgttgaggtatttggagatagcgttacggtgcgttgacgatttcccatcaaagagacctaatatgttacaagttgttgcttcgttgagagaacttcgtggaagtgaaaataatagtcacagtcacagtaacagcttgtaa

SEQ ID NO: 1183 - DNA, 2322 bp, Arabidopsis thaliana
atggatgaagatgttgagcaggccagtttgatgtctttcaatgacaggcctagggcttttcccaacatgcgtagtaaaacctatagtccactgatattccggattattaggaaattaaatgtccgtgtcctttcgataattctgcttttctgcttcggagcaatcttttacatgggggcaagtacttctcccatcatcgtgttcgtcttcacagtatgcatcatcagcttccttttgtcaatatatctaaccaagtgggttttagcgaaagatgaaggacctccagagatggttgagatatcagatgctatacgtgatggagctgaaggttttttcagaacgcagtatagcactatatccaagatggccattttgctagcttttgtgattctttgcatatatctattccgtagcttaactccccagcaagaggctgctggtttaggaagggcgatgtctgcttatattactgttgctgcatttcttttgggggctctatgctcaggtattgctggatatgttggaatgtgggtgtcagttcgtgctaatgtgcgggtctccagtgctgccagacgatctgcgagagaagcattgcagatagccgttcgtgctggtgggttttcagccctggttgttgttggtatggctgtgattggtatcgccatcctctattctacattttatgtgtggttgggcgtgggttcaccaggctcaatgaatgttactgacctacctcttcttcttgtcggatatggttttggtgcttcgtttgttgccttatttgctcagttgggtggtggaatatatactaagggagctgatgttggggcagatctcgttgggaaagttgagcagggaattcccgaggatgatcctcgaaatcctgctgttattgctgatttggttggagacaatgtgggggactgtgctgctagaggtgctgatttatttgaaagtatagctgcagaaatcatcagtgcaatgatactaggtggaacaatggctaagaagtgcaaaattgaagatccatcaggctttatcctttttcctctagttgttcattcttttgacttgattatatcctcaattggtattctatcaatcaagggaacacgtgatgctagtgtgaaatctccggtagaggatccaatggctgtacttcagaaaggatattctctgacaattatattagctgttataacatttggcgcgtcgactcgctggctgctttacactgaacaagctccatctgcatggttcaatttcgccctatgtgggttggttggcatcatcacagcctatatctttgtctggatatccaaatattatacagactataagcacgagcctgttcggacgttggctcttgctagctcgactggtcatgggactaatatcattgctggagtaagcttgggcctggaatcaactgctcttccagttttgactataagtgtagctattatttctgcgtattggttgggcaatacctcggccgttgctacaatgggaatgctaagcactgcagcttatgtccttactatggacatgtttggccccatagctgacaacgctggtgggattgtcgagatgagccagcagccagagagtgtccgtgagatcactgatcttcttgatgctgttgggaacaccacaaaagcaacaacgaaagggtttgccattggatctgctgcacttgcatcattccttctctttagtgcgtatatggacgaggttgatattgctatcccagaagtgttcgttggtggattattgggtgccatgcttattttcctctttagtgcttgggcatgcgcggcagttggtcgaactgcacaagaggttgtcaacgaagtaagaaggcaatttattgagaggcctggcataatggagtacaaggagaagccagattatagtcgctgtgtcgccatagtcgcatctgcagctttaagagaaatgataaagccaggagctttagctattgcatcacccattgtagttggtttggtgtttcgaatcttgggttactacacaggacaacctctgctcggagcaaaagttgtagcttctatgctcatgtttgcaacagtttgtggtatcttaatggcacttttcctaaacacggcgggaggtgcttgggacaatgcaaagaaatacatagagaccggggcacttgggggcaaaggaagtgaagctcacaaagcagctgtgactggtgataccgtgggagatccgttcaaggacacagccggtccatccattcacgtcctcataaaaatgcttgcgactataactctcgtcatggctccggttttcctctga

SEQ ID NO: 1184 - DNA, 1953 bp, Arabidopsis thaliana
atgtctgcttatacctcattaaactttctcttccttctaaccttcttcattggaagcttgagagtttctgcacaattacaagaccctacttacgttggccatgtttgtactaacaggatatcaagaaactccatttacttctcaaatctccaaacacttttgacctctctttcttctaacaatgcttacttctctttgggatctcatagtctcacaaagggtcaaaactccgacatggtgttcggactttatctctgcaaaggagatctctcgccagaatcttgccgtgagtgcgtcatctttgctgctaaagacactcggagtcgatgtccagacaggaatatattcatggatactgtaaccacaactacaataatcacttggaacactcagaaagttacggcggaccaatctgaccggtttaatgatgcagtgctttctctgatgaaaaagtctgcagaggaagcggctaatagtacaagcaagaaattcgcggttaagaagtcggatttcagttcgtctcagtcgctttatgcatcggttcagtgcattcctgatctgactagtgaagattgtgtaatgtgtcttcaacaatccatcaaagaattatatttcaacaaagttggaggaagatttcttgtcccaagttgtaactcaaggtacgaggtttaccccttttacaaggaaactatagagggaactgttcttcctccgccggtttcggctcctccactgccactggtttcaactccttcctttccgcctggaaaaggcaaaaattctacagtgataatcatagcaattgttgtgccagtcgctatctcagttcttatttgtgtagctgtttttagcttccatgcatcaaagagagcaaagaagacttatgatacaccaggtgcaaatgatgaagaggatgacatcacaactgcagggtcactgcagtttgatttcaaggttattgaagctgcaacagataagttttcgatgtgtaacaaactcggtcaaggtggatttggacaagtttacaaggtactactaccgggcacacttcctaatggagtacaagttgccgtgaagagactatcgaaaacatcaggacaaggtgagaaagagttcaagaacgaagttgttgttgtggcaaagcttcagcacagaaatctggtcaagcttcttggattttgtttggagagagaagagaaaatacttgtctacgagtttgtgtctaataaaagccttgattacttcttgtttgattctagaatgcagagccagctggattggactacacggtacaagatcataggaggaattgctagaggaattctgtatctccatcaagattcacgactcacaatcatacatcgagacctaaaagcgggtaacatccttttggatgctgatatgaacccgaaagttgcagattttggaatggcgaggatttttgaaatagaccaaacagaagcccatacgagaagagtagttggaacctatggttacatgtctcccgagtatgcgatgtatggccaattttcaatgaaatctgatgtctatagcttcggtgtcttagttcttgagattataagcgggaggaaaaatagcagcctctatcagatggatgctagttttggaaacttggttacatatacttggaggctatggagtgacgggtcaccactagacctcgtggattcttcctttcgagatagttatcaaagaaacgaaataattagatgcatccatattgccttattatgtgtccaagaagatactgaaaatcgtccaaccatgtcagcgatcgtccaaatgcttactactagctcgatcgccctcgctgtacctcaaccacctggatttttcttccggagtaatcatgaacaagcaggtccatcgatggataagtcttctctttgttccattgatgctgcatcgattactattttagctcctcgttaa

SEQ ID NO: 1185 - DNA, 2190 bp, Arabidopsis thaliana
atgcgcatcttctctacattcgtctttcatcgcagacaacaaatcttcaatcttcgtcaattccaaaccaccacaatccttcgcaacccaatctccatcgctccgatccagattccgatggacgccaccgagcagtctctccgtcaatctctttccgagaaatcctcatccgtcgaagctcagggtaacgccgtccgagctctcaaggcttcccgtgcagctaaaccagaaatcgatgctgccattgagcaactcaacaaattgaagctcgagaaatctaccgtcgagaaggagcttcagtctattatcagtagctccggtaatggttcgcttaaccgtgaggcttttcgaaaagctgttgtcaatactctcgagcggcgtttgttctatatcccttcgtttaagatctacagtggcgtcgctggactttttgattatggtcctcctggctgtgctattaaatccaatgttctcagcttttggcgtcaacatttcattcttgaggagaacatgctagaagttgattgtccatgtgtgacaccagaggttgttctcaaggcatctgggcatgtagataagttcactgatcttatggttaaggatgagaaaactggaacatgttaccgtgctgaccacttgctcaaggattattgtaccgagaagctggagaaagatcttaccatctctgctgagaaagctgctgaattgaaggatgttcttgctgttatggaagatttttctcctgaacagctaggtgccaagatcagggagtatgggatcactgctccagacacgaagaatccactctctgatccttacccgtttaatttgatgtttcaaacatccattggcccatctggtttgattcctggttacatgcgtcctgaaactgctcaaggtatttttgtcaactttaaggacttgtactattacaatgggaagaaacttccttttgccgcggctcaaattggtcaagcctttagaaatgagatatctcctcgacaagggcttcttagagttcgtgaattcacgctggcagagattgagcacttcgttgatcctgagaataagtcacatcctaagttctctgacgtagcaaaattggaattccttatgttcccaagggaagaacaaatgtctggccaatctgccaaaaaactttgccttggtgaagctgttgctaaaggtactgtgaacaatgaaactctaggatacttcattgggagagtgtatcttttccttactcgtcttggcattgacaaggaacggctgcgcttccgtcagcatctagcaaatgaaatggcccactatgcagcagattgttgggatgctgaaattgaaagttcatatgggtggattgaatgtgttgggattgcagataggtctgcttacgacttacgtgctcactctgacaaaagtggtactcctcttgtggctgaagagaaatttgcagaacctaaagaagtagagaaacttgtgataactcctgtgaagaaagaactgggtcttgcattcaagggaaatcaaaagaatgtggttgaatctttggaggcgatgaatgaggaagaagctatggagatgaaagcaaccctggaatccaaaggggaagtggagttttacgtgtgtaccctaaagaaaagcgtgaacatcaagaaaaacatggtgtctatatcaaaggagaagaagaaagagcaccagcgggttttcactccatcagtgattgaaccatcgtttgggattggtcggatcatatattgtctgtatgagcattgtttcagcacaaggccaagcaaagcaggggatgagcagttgaacttgttccgtttccctcctcttgtagctcccatcaagtgcacggttttcccgcttgttcagaaccaacaattcgaggaagtagccaaagttatttccaaggaactcgcctctgtcggtatctcccataagattgacatcactggtacatcgatagggaagagatatgcgagaaccgatgagcttggagtgccatttgcaataacagtggactcggatacatcagtgacaatcagagaaagagacagcaaagatcaagtccgagtcaccttgaaggaggcagcttccgttgtgagctcagtctcagaggggaaaatgacgtggcaagacgtctgggcaaccttccctcaccattcttctgctgctgcagacgagtag

SEQ ID NO: 1186 - DNA, 2295 bp, Arabidopsis thaliana
atggcttcctccaccatcgttcttcttctcttcctctcttttccgtttatctctttcgcagcttctcaggccgcgaagactttcattttccgtatcgatggtggatctatgccttctattttcccgacgcactaccattggtatagcaccgagttcgccgaagaatctcgaatcgtccatgtttaccacacagtcttccatggtttctccgccgttgttactccagatgaagcagataatctccgtaaccacccagcagttcttgctgttttcgaagaccgacgtcgagagcttcacaccacacgttctcctcaatttcttggtttacaaaaccaaaaaggactatggtcagaatctgattacggatcagacgtaatcattggcgtttttgacaccggaatttggccggagcggaggagtttctcagatcttaacctcggtccaattccaaaaaggtggagaggcgtttgcgaatccggagccagattcagtcctcggaactgtaaccgtaaaattatcggagcaagattcttcgctaagggacaacaagccgctgtaatcggaggaatcaacaaaaccgttgagtttctatctcctcgtgacgccgatggacacggtactcacacttcctcaaccgccgctggccgtcacgcttttaaagcgagtatgtccggttacgcctccggtgtagccaaaggtgttgctccaaaagctcgtatcgccgcctacaaagtctgttggaaagattccggttgtctcgattccgatattctcgccgcctttgatgccgctgttagagacggtgtcgacgttatatcgatctcaatcggtggtggagacgggattacttcgccgtattacctcgatccaatcgctataggctcgtacggcgccgcgtcgaaaggaatcttcgtctcttcctctgccggaaacgaaggacctaacggtatgtcagttacgaacctcgcgccgtgggtaaccaccgttggtgctagtacaatcgatcggaatttcccagcggatgctattctcggcgacggacatcgtctcagaggagtgtctctttacgctggagtacctttaaacggtcgtatgtttccggtggtttatcccggtaaatcgggaatgtcatcagcgtctctatgtatggagaacacgcttgatccgaagcaagtgaggggtaaaatagtaatctgcgatagaggaagcagtccacgcgtagccaaaggattggttgtgaagaaagcaggtggtgtcggaatgattctcgctaatggagcatctaacggtgaaggattagtcggagatgctcatcttattccagcctgtgccgttggatcaaacgaaggagatagaatcaaagcatatgcttcttcacatccgaatccaattgcttcaattgatttcagaggaactatagttgggattaaaccggctccggttattgcttctttctccggtagaggaccaaacggtttaagcccggagattcttaaaccggatttgattgctcccggagttaacatcctcgccgcatggacagacgctgttggacctacaggtttgccgtcagatccaaggaaaacggaattcaacattctctccggtacttcaatggcatgtcctcacgttagtggtgcggcggcgcttctcaaatccgctcatccagattggagccctgccgtgatacgatcggcaatgatgacaacgactaacctcgtcgataactctaaccgctcgttgatcgatgaatccaccgggaaatcggctacgccttatgattacgggtcgggtcatttaaatttgggccgggctatgaatccgggtcttgtctacgatataactaatgatgattacattacgtttctttgctccatcgggtacggaccaaagacgatccaagtgataacaagaacaccggtgagatgtccgacgaccaggaaaccgtctcccgggaatttgaattatccttcgatcacggcggtgtttcctactaatagaagaggattggtgagtaaaactgttataaggacggcgacgaatgtcgggcaggctgaggcggtttatcgggcgaggatagagtcgccgagaggagtgacggtgacagtgaaaccacctaggcttgtgtttacttcggccgttaagagacggagctatgcggttacagtgacggttaatacaaggaatgttgtgttgggagaaacaggtgctgtgtttgggtcagtcacgtggtttgatggtgggaaacacgtggttcggagccccatcgtggtgacccaaatggatacgttgtga

SEQ ID NO: 1187 - DNA, 3864 bp, Arabidopsis thaliana
atgggtgaggaaggttcaatgtttggtctgggaggtgaatttccggttgatgattgtgatggtggttttgagtttgaagatgatgacgagactattgacatcgaaacgctttatcggattctagatgagaagcctgattctgctgaggtagttttctcggcttttgtgggtagccaagaaaacttatcaccagttggttcatctgctgacgagctcaaggattcacagttgctaaatggttcatttgatgaacatgtgaaaatggaagccgggctgagtccttcacctgctcatacttgctctgcaagtcttaaagattggttttcgttaagtcagggtgagcagcctgtggaaacatgtggagtatctcaatctgagatgactagttgtagtatatcgtctagtttctctgatcctgatggcaatatgatggccttcaatcctgtgaattgtgacgttgacactgtttccaagcaggatgataagataatcgattccaaatctatgttgactccatattttgacaacgtgactggatacggagtggggttgggagccaatcataattcgtctgccatgtctgttttttttaataattccaattccctcagtgacagtgcggataactatgtctcttctgcacaagattgctacaatacaagtggtacatccttgtcagaccatacccccaattctgttcagaatttcgcgtttgagttctttcctaataaagaagaagctgtaaatgatgttgagagtggagtaagtgagtctcagtcggatggtgccagccggatgatttttgatagacatggaagagtggataatggatctttagaaaggaaacctcctattgatttttctagtgcaagagggatcagtttcaagtttgaaagtaatccttcagtttctcctgcctgtgtcaaaccctacaacagttttgacagtcatttagctgatagtgaccttgaccggcctaataattattcatgcagttttcaggataataaaactgttcatgtgaaggttaaaccagaggctgaatcagagaaagttgtctacagttcagttccaggggaatttagtgtcagggatgatgcttatctttctggagaaaccaatcgttggtggtctggtgcatcaagctctgcagtctcctatcaaacagatattgaaaaaggatactcatatatggcaccgcaaacagctctacctagccaagacagtggcaagataagctccaatcatttttacgattcagatacatgtttgcaatatgttgtagaagatcccagcccagtgacacaaaacaatgagtataaagactttcaaattcaacaaggagaccgggaatatattcaaccgaggggcattgattctcaattctcaaatgccagctttgaatcagttcaaagccattcttcagaatgtatatccgatagtgatgatgattctgacgtctgcataatagaaccttatggtcaatctgcaatcccacatcgacctctagctatgaaaatgccggtagtttcttcagaatattctacagttagtcataattttaatcaatctggaggcctgaagcttcagtcaaataaagaaaatatgatctttcaagctgcattgcaggatctcactcagcctaattctgaagcaattctgcctgatggtgtcttgacagtcccgcttctgagacatcagcgaatcgcattgtcatggatggcccagaaggagacaagtggcttcccctgttcgggtggaattcttgctgatgatcagggtcttgggaagacagtttccactatagctcttatactgaaggaaaggtctaaacctgcccaagcatgtgaagaaagtacgaagaaagaaatttttgacctagaaagcgagactggagaatgtgcgcctttaaaacccagtggaagaagcaagcattttgaacactctcaattgctttccaatgaaaacaaagttggtggagacagtgtgggtaaagtgacgggaaggccagctgctggaacgcttgttgtatgtcccactagtgttatgcggcagtgggctgatgaattacataagaaggtgactagtgaagcaaatctctctgttctggtataccatgggtctagcagaacaaaggatcctcatgagttggctaaatatgatgttgttgttaccacattttctattgtaagtatggaagtgccaaagcagcctcttgttgatgatgaggatgaagagaaggatggtgtacatgatggtggaactgcagctactggcttttgctcaaacaagaaaaggaaatatcctcccgattctaaaaagaagggttcaaagaagaagaaagttgagtttctgtctggccctcttgcgaaagtttcatggtttagagttgttctagatgaggcacagagcattaaaaattacaaaacccaagttgcaagagcatgctggggccttcgtgctaaacggaggtggtgtttgtctggcactccaatccagaattcaatcgatgacctttacagctactttcgattcctcaaatatgatccttactcttcctacgtattgttctgtagcacgattaagaaccctataactaggaacccagtgaaaggatatcagaagctgcaggctatccttaaaacagtgatgcttcgccgaactaaaggttcacttcttgatgggaaacccataatctctttacctccgaagtccattgagttgagaaaagtggatttcactgtggaggaacgtgatttctactccaaactagaggctgaatctcgtactcaattcagggaatatgcagaagctggaacagtgaagcaaaattatgtaaatatcttgttgatgctcttgcgccttcgccaagcttgtgatcaccctcttctcgtgaatggtgaatacagttttacctgggaatcttctgttggattagctaagaagcagattcagtcagacgcttcattggcaatttgtggtatctgcaatgatgcacctgaagatgctgttgcttcagtttgcggtcatgttttctgtaaacagtgcatttatgaacgccttactggtgatagtaatcactgtccctttgcaaactgcaatgtcagactcaccatctcatcgttatcttccaaaacgagattggacgatgctatgcctgacatgcaggagcgtgctacttcgaatagccttagcccttgttctgatgaagatcttccatatggttcatctaaaatcaaggctgctctagagatcttacaatcactgcccaaagcacatgatttgacagattcaaatcagatctctgaaaacagagaatactccggtctttctataactcctgtgaagaatgagggtatgagcgttgatgttccgattaaggtagctggagaaaaagccattgttttttcccaatggacaaagatgctaaacctacttgaagcttctcttgtaagttcacatattcagtatagaaggctcgatggaacaatgtcagttgctgctagggataaagcagtgcaggatttcaacactctccctgaggttactgtaatgataatgtctctcaaggctgctagtctcggactgaacatggtggcagcttgtcatgttctgatgctggacttatggtggaacccaacaaccgaggatcaagcaatcgatagagcacatcgtataggacagacacgaccagtaacagtagttcgcttcacagtaaaagatacagtcgaagatcggatattagcccttcagcaaaagaagagaatgatggtagcctctgcatttggagaagatgaaaagggaagccgacagtctcacctcacagtagaggacttgagctatctgtttatggctgattcatga

SEQ ID NO: 1188 - DNA, 1488 bp, Arabidopsis thaliana
atggacctcacccaaatcctactcctctcctttctctttctcactatctccatcaaactcttgctcacaaaatctaaccggaaacctaatcttcctccttctccggcttaccctttaccggttatcggccacctccacctcctcaagcaaccggtccaccgaacattccactccatctctaagtcccttggaaatgctccaatcttccacctccgcctgggaaaccgcctcgtttacgtcatctcctcacactccatagccgaagaatgtttcaccaaaaacgacgtcgttcttgcgaaccgtcctgatatcatcatggccaaacacgtcggctataactttaccaatatgattgcagcatcttacggcgaccactggaggaatctccgccgcatcgccgccgtcgagatattttcttctcatagaatcagtaccttttcttctatccgtaaagacgagatccgacggctcataacacatctctctagagactccttgcacggatttgttgaagtggagttgaaatcgttattaaccaacttggcattcaacaacatcatcatgatggtagccggaaaacgatattacggtaccggtacagaagacaatgatgaagccaagctcgtgagggaacttatagcggagataatggccggcgccggttctggaaatttggctgattatcttccgtccataaattgggtcacaaactttgagaaccagaccaaaatcttggggaatcgactcgatagagtcctgcaaaaactggttgatgagaaacgtgcagagaaagaaaagggtcaaactttgatcgatcatttgctttctttccaagaaaccgaacccgagtactatactgatgtcatcatcaaaggaatcatactggctttggttcttgcggggacagatacatcttcagtgacgttggaatgggcaatgtcaaatttgctgaaccatccagagatacttgagaaagcgagagcggagatcgatgataaaatcggttcagaccggttagttgaagaatcagatattgtaaatctccattatctccaaaacattgtgtcagaaacattacgtttgtatcctgcggttccactactactccctcatttctcatcggatgaatgtaaagtggcgggctacgatatgccacgtcgcacgttgttattaacaaacgtatgggcgatgcatagagatccaggtttatgggaagagccagagaggttcaagccggagaggttcgagaaagaaggagaggctcgaaagctaatgccgtttgggatgggacgacgagcttgtcctggagctgagcttgggaagcggttagtgagccttgctcttgggtgcttgattcagtctttcgagtgggagagagttggtgcagaacttgtggacatgactgaaggcgaagggatcactatgcctaaagctactccgttgcgagctatgtgcaaggcacgtgccattgttggtaaaacgatataa

SEQ ID NO: 1189 - DNA, 1488 bp, Arabidopsis thaliana
atgatattaatcactttgtgcttaactaccctccttgcacttctgctaaaatccatactcaaaagaaccgccacaaaaaactttaatctaccaccgtccccttggcgacttccggtgatcggaaacctccaccagctcagcctccatactcaccgatctcttcgttccctcagtctccgatatggaccactcatgctccttcattttggccgtacaccagtccttatagtctcctccgccgatgttgctcatgacgtcatgaagactcacgatcttgtttgtgccaaccgcccaaaaacaaaagtggtcgataaaattctgagtggtgggagagatgtggcttttgccccttatggtgaatattggagacaaatgaagagtatatgcatccagaatctactcaacaataaaatggtcaggtcgtatgagaagataagagaagaagagatcaaacgaatgattgaaaagctggaaaaagcgagttgttcttcttcaccctcaccggtaaatctaagccaaatcctaatgactttgacaaacgatataatatgtagagttgccttaggaagaaaatatagcggcaagaaagatggaattgatgtggagaatatagtaaggacatttgccgcactcttgggtgaatttcctgttggagaatacattcctagtttgtcgtggatcgataggatacgcggtctggatcataaaatggaggtagtagataaaaggtttgatgagtttctggaaagagtggtgaaagagcatgaagaggcagataaagagactagatccgacttggttgataagttactaacgatccaaagcgataagaccggacaattcgagcttgagaaaagtgccttaaaacttatcatatgggatatgtttttagcaggaacagcgacaactctatcatttcttgaatgggcaatgacagagctaatgagaaatccaaaggttatgaagaaactccaagaagagattcgttcaagttcaccacaagatttatttgtaacggagaaagaagctgagaaaatgaattatttacaagctgttatcaaggaagccttaaggttgcgtccaccagctccactattggttccacgagtacttagtgaagatgtcaagttaaagggatataatattcctgcaggcacacaggttatagtcaatgcttgggcaatccaacgagacactacaacatgggggacagatgcagaagagtttaagccagaaaggcatttagacacaaacttggattttcagggacaagatttcaaatttattccattcgggtcgggaaaaaggatatgtcctgggataggattcacatcggcattgatcggggtgacattggccaatatcgtgaaacggttcaactggagaatggatgtggaaccacaaagggttcaacatgacctaactgaagcaaccggtctcgttgttttccgaaaattccctcttatcgctattccatcttctgcttga

SEQ ID NO: 1190 - DNA, 1239 bp, Arabidopsis thaliana
atggggatttgcttaagtgctcagattaaagctgtgagtccaggtgcaagtccgaagtatatgagctcagaggctaatgattcactgggaagtaaaagctcttctgtgtcaatcagaacaaacccaagaactgaaggagagatcttgcaatctcctaatctcaaaagtttcacttttgctgagcttaaagcagcaactaggaattttagaccagatagtgttcttggtgaaggtggttttggttctgttttcaaaggttggattgatgaacagactcttactgcttctaaaccgggaaccggtgtggttattgctgtcaaaaaacttaaccaagatggttggcaaggtcaccaggaatggctggcggaagtgaattacttggggcagttttcgcatcctaatcttgtgaaactgattggttattgcttagaggatgagcatcgtcttcttgtttatgagttcatgcctcgtggaagcttagagaatcatttgttcagaagaggttcttattttcaacctttatcttggactctccggttgaaagttgctcttggtgcagcgaaaggtcttgcgtttcttcataacgccgagactagtgtcatataccgcgatttcaaaacgtcgaatatactgcttgattcggagtacaatgctaagctttctgatttcgggctagctaaagacggtccaacgggtgataaaagccatgtctctacgcggatcatgggtacttacggatacgcagctcctgaatatcttgcaactggtcatttaacaaccaaaagtgatgtctatagctacggtgttgtgcttttggaggtgttgtctggacggagagctgtagacaagaaccgtccaccaggagagcaaaagctagtggaatgggcaagaccgttacttgctaacaaaaggaagttattccgagttatcgataaccgtctacaagatcaatactcaatggaagaagcttgtaaagtagctactcttgcgctgagatgcctcacattcgagataaagctgagaccaaacatgaacgaggttgtttctcacctcgaacacatccaaactttgaatgaagcaggaggaagaaatattgatatggtccagaggagaatgcgtaggagaagcgatagtgttgctatcaaccaaaaaccaaatgcaggttttgctcgacaaactgctgtaggcgtcatagctactgcttatccacgcccgtctgattcgcctctgtttgtttga

SEQ ID NO: 1191 - DNA, 1434 bp, Arabidopsis thaliana
atgaaggaacgcaaatgttggttcgctgatttcagcggagatcgccggctgcagaatgcggtttccgattgccttgatctgcttgacttttcttcagaggagctcacttggtctgcttctgcttctgagaatccaaaaggtaagggcaacggaacaggggacgttggatcggacacaaggacatggttaagtgctgctctctccaaccaagccacttgtatggaaggcttcgatggtacctctggtctcgtaaaatcccttgtcgctggcagtctcgatcaactatattctatgcttagggaattgttaccacttgtgcaaccagagcagaaacccaaggctgtttctaaacctggccctattgctaaaggaccgaaggcaccacctggccgtaaactcagagacaccgacgaagacgaaagccttcaattcccagactgggtcagaccggacgatcgtaaactattagaatcaaacggtaggacttacgacgttagtgtagcattggatgggacaggcaacttcacaaagataatggacgccataaagaaagctcctgattatagctcgacacgtttcgtcatatacattaaaaaaggtttatatttggagaatgttgagatcaagaagaagaaatggaacattgtaatgttaggtgatggcattgacgtgactgttatttccggtaaccgcagcttcatcgatggttggaccactttccgatcagctacattcgcggtaagcggaagaggattcttagcaagagatataacgttccagaacacagcagggccagagaagcatcaggcggtagcactgagatcagactctgacctctctgtgttcttcagatgtgcgatgaggggttatcaagatacactctacacgcacaccatgcgtcagttctaccgtgagtgcaccatcacgggaacagtagattttatatttggggatgggactgttgtgtttcaaaactgtcaaattttggctaaaagaggactccctaaccaaaagaacaccatcactgcacaaggccggaaagatgtcaaccaaccctcaggattctcaattcaattcagcaatatctcggcggacgcagatttggtcccatacctaaacacgacaaggacgtatctaggaaggccatggaagctatattcgagaacggttttcattaggaacaatatgagcgacgttgtgagacccgaaggatggcttgagtggaacgctgattttgcgttggacacactcttctacggagagttcatgaactacgggcctggttcaggactcagcagccgagtcaaatggcctggttaccacgtctttaacaactcggatcaggctaacaacttcaccgtttctcagttcattaaaggaaatctttggctgccttctacgggagtaacgtttagtgatggcttgtatatctaa

SEQ ID NO: 1192 - DNA, 1977 bp, Arabidopsis thaliana
atggcgtcaatttcatgggttttgaattctctattctcgatattgctactgactcagcgagtcaactcggaatcaaccgcagaaaaacaagcactcctcactttccttcaacaaatacctcacgagaatcgtcttcaatggaacgagtcagactcagcttgtaactgggtcggagtcgaatgcaactcaaaccaatcttcaatccactctctccggttaccaggaaccggtttagtcggtcagatcccatcaggctccttaggtcgactcactgagctccgagttctcagtcttcgttctaatcgtctctctggtcagatcccttcagatttctcaaatcttactcatctgcgaagcttatatcttcaacacaacgaattctccggcgagtttccgacgagttttactcagttaaacaacttgattcgtcttgatatctcatctaacaacttcactggttcgatacctttctcagtcaataatctcactcacttgactggtttgtttctcggtaacaatggtttctcagggaatcttcctagtattagtctcggtttagtcgatttcaatgtctctaacaacaatctaaacggttcgattccgtcttcattatcaagattctcagctgaatcgtttactggaaatgtagatctctgtggtggtccgttaaagccttgtaaatcgttttttgtgtctccctcgccgtctccgtcgttgattaatccttctaatcgtttatccagcaagaaatcaaagctttcgaaagctgcgattgtcgcgataatcgtcgctagcgcgctcgttgcgcttcttttgctagctctgcttttgttcttgtgtttaagaaaaagaagaggaagtaatgaggcgaggacgaagcagccgaaaccggcgggagtagctacaaggaatgtggatcttccaccgggtgcttcgtcctcgaaagaggaagtaacggggacatcatcgggtatgggaggtgaaacagagaggaataagcttgttttcactgaaggaggagtgtatagttttgatttggaagatttgcttagagcttctgctgaggttttaggtaaaggaagtgttggaacatcgtataaggcggtgttagaggaaggtaccacggttgttgttaagcggcttaaagatgtaatggcgtctaagaaagagttcgaaacacaaatggaagttgttggtaaaatcaaacatccaaatgttattccattaagagcttattactactctaaagatgagaaacttctcgttttcgatttcatgcctaccggaagcttatctgctcttctccacgggagccgtggatcagggcgaactccgttagattgggataaccgtatgagaatagcgataactgcagcgagaggtttggcgcatcttcacgtttcagccaaattggtacatggaaacattaaagcttcaaacatcctcctacacccaaaccaagacacttgcgtctctgattatggactgaatcaactgttcagtaactcgagtccaccaaaccgtttggcgggttatcatgctcctgaagttctcgagacacggaaagtaacttttaaatcggatgtgtacagtttcggggtgttgcttcttgaactgttaacaggaaaatcaccaaaccaggcatcacttggggaagaaggtattgatctacctcggtgggtactctccgtggttcgagaagaatggactgctgaagtatttgacgttgagctgatgaggtaccacaacatagaggaagagatggttcagcttcttcaaatcgcaatggcttgtgtatcaacggttcctgatcaacgaccagtaatgcaagaagtactaagaatgatcgaagatgtcaacagaagtgagacaaccgatgacgggttaagacaatcgtctgatgacccgtcaaagggatcagaaggtcagactcctccaggagaatcaaggacgccaccacgatcagtcacaccttag

SEQ ID NO: 1193 - DNA, 945 bp, Arabidopsis thaliana
atggttagggcaaatatagtgagcatggttctgttgatgcatgccatcgttgggtttccttttcatgcgaggggattaagtatgacttactacatgatgagctgtcctttcgctgaacagattgtgaagaacagtgttaacaatgctcttcaagccgatcccactttagccgctggtcttatccgtatgttgttccacgactgtttcatcgagggatgtgatgcgtcaattctgctagattcaacgaaagacaacactgcggaaaaggattcgcctgcgaatctgagtctacgtggctacgagatcatcgatgatgcaaaggagaaaatcgagaatagatgtccaggagttgtatcatgcgcagatatagttgccatggctgctagagatgctgtcttttgggctggtggtccatattatgacataccgaaaggaaggtttgatggtaaaagatcaaagatagaagatacaagaaatctaccttcaccttttcttaatgcctctcaactcattcaaacttttggccaacgtggtttcactccacaagatgttgttgctctctctggagcacataccctaggagttgcacgatgctcctccttcaaggctagacttaccgtcccagactcttcattagactcgacttttgcaaacactctctctaaaacatgcagcgcgggtgacaatgcagagcaaccctttgatgctacgcgcaacgatttcgacaatgcttacttcaatgcgcttcagatgaaatcaggagtcctcttttcagaccaaactttattcaacacaccaaggaccaggaatcttgttaacggctatgcacttaaccaagccaagttcttctttgatttccaacaggccatgcgcaagatgagcaatcttgatgttaaacttggctctcaaggtgaagtccgtcaaaattgtcggagtattaattag

SEQ ID NO: 1194 - DNA, 1581 bp, Arabidopsis thaliana
atggattcgaaggagatggttgtggaagaaatcatgagaattcacagatctctaccattgagaccagagatcgacgatgtagaaacggcaacttctctgatacaaaacgttgaaaaggaagatcggaatcgtttagaagccattgataaacttgttaaaacctcttcctctgaggttcctttagagcttttcaatgtgttcaaggagatgaagaaaagtcttgttcgtttccagagcacagaacagacaagagaagctacgaaaattctcgatctggaatctgtacacgttgtgttcgacgaattgattcagagagcttctttttgcattgcttctcccaacagcaccaccgctttgcctcggtctgttccggtaccggcgccggttgtttcttctgatgagattcctttcaagtcaaaggaaattatctcgcgtgacgatacgtttgtgaagaaagctaaatcttcgttttatagtgatgggttgttagctcctagtaagccccaggttctggattcaacacttcatcaggctaagaacgttgcaggcaatgatggggagaagttgagtctcataaaacttgctagtttgattgaggtatctgccaagaaagctactcaagagctaaatttgcagcacaggctgatggatcagctcgaatggcttccggattctctaggcaagttatcgagtcttgtcaggctagatctgtctgagaattgtatcatggtactaccggcaaccataggagggcttatttctttgacgaggcttgatttgcattcgaatagaattggtcagctccctgagtctataggagatttgctaaacttggtcaacctgaatcttagtggaaaccaattatcatctcttccatcgtcatttaatagattgatacatcttgaggaacttgatttgagctctaacagcctctctattctccctgaatctattggttctctcgtgagcctaaagaagctcgatgttgaaacaaataacatcgaagagattccacatagtatctctggctgttcttccatggaagaactccgtgcagattacaacagacttaaagctcttccagaagctgttgggaagttatctaccttagagattctgactgtccgttataataacattcggcagctacccacaacaatgtcctccatggctaacctcaaagagctagatgtgagtttcaacgagcttgagtcagtaccagagagtttatgttatgccaaaacacttgttaagcttaacatcgggaacaattttgccaacctaagatcactcccgggattaataggcaaccttgagaagctagaagagcttgatatgagcaataaccagatccgtttccttccctactcttttaaaacgctttcaaatctgcgtgttcttcaaacagaacaaaatccacttgaagagcttccaagggatataaccgaaaaaggcgcacaggccgtggttcaatacatgaatgatcttgtggaggcaagaaacaccaaatctcaaagaactaagccgaaaaagagttgggttaacagtatttgcttcttctgcaagtcctctaccaactag

SEQ ID NO: 1195 - DNA, 2070 bp, Arabidopsis thaliana
atggagcctcacagaaaacactcggtcggcgacacaaccctccacacgtgtcatccttgccggcgcaccattccatatagaatctacgccgtatttcacacgtgtggcatcatagccctcatgtatcaccatgtacactcacttctcacagcaaacacaactctaatcacgtctctccttctcctctccgatattgttctcgccttcatgtgggcaaccacaacttccctccggtataaaccggttcgccggaccgagtaccctgagaaatatgcagctgaaccggaggacttcccgaaactggacgtgtttatatgcacggctgatccgtacaaggagcctccgatgatggtggtcaacactgccttatcggtgatggcttacgagtatccgtccgataagatctcagtctacgtatcggacgatggaggttcgtcgttgactttgtttgctcttatggaggcagctaagttctctaagcattggttgcctttttgcaagaagaataatgttcaagatcggtctcctgaagtttatttctcatcaaagttacgttctcggagtgatgaagctgaaaatatcaagatgatgtacgaagacatgaagagtagagtagaacatgtggtggagagtggaaaagttgagactgcatttatcacatgcgatcaatttcgtggggtattcgatttgtggaccgacaaattcactcgtcatgaccatcccacaattattcagctacgagtgtctggagtgatgacgaattcaccgatcattctaacactagactgtgatatgtattccaacgatccagcaacaccagttcgtgccctgtgctatttaacagaccctaaaatcaaaactggtttagggtttgtgcagtttcctcaaacatttcaaggaataagcaagaacgatatatatgcatgcgcgtataagcgtctctttgagatcaatatgattgggtttgatggtttaatgggcccgaatcatgtgggaactggttgtttcttcaatcgacgaggtttttatggagctccatctaatttaattttgcctgagatagatgaacttaagcccaatcgtattgtagataagcctatcaatgctcaagatgttttagcattggctcaccgtgtagcaggatgtatctacgagcttaacaccaattggggatcaaagattggattcagatatgggtctttagtagaagactactacacagggtataggctccattgtgaaggatggagatcagttttttgcagacccaaaagagcagcattttgcggagattccccaaaaagtctaattgatgtagtgagccaacaaaagagatgggccattgggcttcttgaagttgccatctcaaggtatagccccattacctatggtgtcaaatcaatgggtctagtaacgggagtaggctattgtcaatacgcatgttgggccttttggtcacttcctcttatcgtctatggattcttgccccaacttgctctcctttatcaatctagcgtctttcccaagtcatcagatccatggttttggctttacatcgttttgttcctcggtgcatatgggcaagatctactcgactttgtattagaaggaggaacttatggcggatggtggaacgatcaaagaatgtggtcgataagaggattctcttcacacctatttggcttcatagagttcactcttaaaaccctaaacctctccacgcatggattcaacgtcacaagcaaagccaacgatgacgaagaacaaagcaagaggtatgagaaagagatttttgagttcggcccctcttcgtccatgttcttgcccttgactacggttgccatcgttaacctccttgcttttgtctgggggctttatggtcttttcgcttggggagaaggactcgtccttgagctgatgctggcgagtttcgcggtggtgaactgcttgccgatctatgaggctatggtgttgaggatagacgatggaaaattaccaaaaagggtttgtttcgtagctggaatcctcacatttgtgctgattgtgtcaggttacgtcttcctcaagtaa

SEQ ID NO: 1196 - DNA, 612 bp, Arabidopsis thaliana
atgtcgacgcgaagacgaactttactcaaagttataattcttggagacagcggggttggcaaaacatcgttgatgaatcaatatgtgaataacaagtttagtcaacagtacaaagctacgatcggagctgattttgtcactaaggagcttcaaattgatgacaggcttgtcacattgcaaatatgggacactgctgggcaagagaggtttcaaagtcttggtgttgctttctatagaggtgcagattgttgtgttcttgtctatgatgtgaatcacttgaagtcatttgaatctctcgacaattggcacaacgagtttcttacacgggctagtccacgtgacccaatggcattcccttttatacttcttggtaataaggttgatattgatggaggaaatagccgagtggtatctgagaagaaggctagagaatggtgtgctgaaaagggaaacatagtctatttcgagacatcggctaaagaagattacaatgtcgatgactccttcttgtgcatcacaaaacttgcccttgcaaatgaacgcgaccaagatatatatttccagccagatactggttcggtgcctgagcaaagaggaggttgtgcttgctga

SEQ ID NO: 1197 - DNA, 1221 bp, Arabidopsis thaliana
atgtcacttagcccgcgagttcagtccttaaaaccttccaagactatggttataaccgatcttgcagccactcttgttcaatccggtgttccggttattagactagctgcgggagaacccgatttcgacactcccaaagtcgtagctgaggctgggatcaacgcgattcgagaaggttttactaggtatacgttaaatgcaggtattacagaactcagagaagcaatatgtcgaaagctaaaagaggagaatggattgtcttatgcgcctgatcagatcttggttagtaatggagctaaacaaagtctcttacaagcagtgcttgcagtttgttctcctggagatgaagttataattcctgcaccgtattgggtgagttacacagaacaggcgagattggctgatgcaacgcccgtggttattcctaccaagatttctaacaattttttgttggatccaaaggatcttgagtctaaattgactgaaaaatctagacttcttattctctgctctccttccaaccctactggatctgtttaccccaagagtttgctcgaagagattgcacggatcattgctaagcatccaagacttctggtgctttcggatgaaatatatgaacacattatttatgcacctgcaacacacacaagctttgcttctttgcctgacatgtatgaaagaactttgacagtaaacggtttctcaaaggctttcgcaatgacgggttggaggcttggatatcttgctggtcctaaacatattgtggcagcttgcagtaaattacaaggccaggttagttcaggagctagtagcattgctcagaaagcaggtgttgctgcgcttgggttaggcaaagctggaggagaaacggttgcagagatggttaaagcttatagagaaagacgagatttcttggttaaaagcttaggtgatatcaaaggtgttaagatctctgaacctcagggagctttttatctctttattgacttcagtgcttactatggatcagaagctgaaggttttggtttgatcaatgattcgtcgtctcttgcactatactttcttgacaagtttcaggttgcaatggttcctggtgatgcttttggagatgatagttgtatccgaatatcttatgccacatctctcgacgttcttcaagcagctgttgagaagatcaggaaagcccttgagccactccgtgccactgtctccgtttaa

SEQ ID NO: 1198 - DNA, 606 bp, Arabidopsis thaliana
atggcgaaagcaagctttattctactcggaactctcttcctcttcggagccatagcttcaattcaggcaaaagaagatctcaaggaggttactcacaaggtttacttcgatgtagagatcgacggcaaatccgctggtcgcgttgttataggactatttggcaaggcagttcctaaaactgcagaaaacttcagagctttgtgcacaggggagaaaggtgtagggaagagtgggaaacctctacactacaagggaagcaagttccatcgaatcattcccagctttatgatccagggaggtgacttcacgcatgggaacggtatgggtggagaatcaatctatggtcagaagtttgctgatgagaacttcaagctgaagcacactggaccaggtgtactttcaatggcgaactcgggagaagacacaaatggttcgcagttttttatcacaacggtgacaacaagctggttagatggaaggcatgtggtgtttgggaaagtggtgcaaggaatggatgtagtttataagattgaagctgagggcaaacaaagcggaactcctaagagcaaagtcgtaattgcagacagtggagaacttcctctctaa

SEQ ID NO: 1199 - DNA, 762 bp, Arabidopsis thaliana
atgagtagccgatggaatcgtacgatctacgttgggaatttgcctggagatattcgcaagtgtgaggttgaagatctcttctacaagtatggaccaattgtggacattgatttgaagattccaccgagacctcctggttatgcctttgtcgagtttgaagatcctcgtgatgcagacgatgcaatttatggacgtgatggttatgattttgatgggtgtcgacttcgggttgagattgcacatggtggtcgtagattttcaccatcagttgataggtacagcagcagctacagtgcgagccgtgcaccttcaagacgctctgactaccgcgtgcttgtgaccggattaccgccttctgcttcgtggcaggaccttaaggatcacatgcgcaaagctggagatgtctgcttctctgaagttttccctgaccgtaaaggcatgtctggggttgtggattatagcaactatgatgatatgaagtacgcaataaggaaacttgatgccactgaatttcgaaatgctttctctagtgcttatatacgggtgagggaatatgagtcgaggagtgtgagtcgaagcccagatgattctaaaagctatagaagcaggagtcggagccgtgtgtgtcacctgctagatccatttccccgcgttcacggccccttagtcgttctcgctcgctatacagctctgtctcaaggtcccaatcaagatcaaaatcaagatcaagatcaagatcgaattctccagtttcacctgtaa

SEQ ID NO: 1200 - DNA, 405 bp, Arabidopsis thaliana
atgggagacgaagcaaagatcttcactctttcagaagtttcagagcataatcaagctcatgactgttggattgtcatcaatggaaaggtgtacaatgtgaccaagtttcttgaagaccatccaggtggggacgatgttctcttgtcttcaacaggtaaggatgcaacggatgattttgaggacgtgggtcacagcgagagtgcaagagaaatgatggagcagtactacgtaggagagattgatccaacaacaataccaaagaaagtcaaatacacacctcctaaacagcctcactacaatcaagacaagacctctgaattcataatcaagctcctccagttcctcgtaccccttgccattcttggtttagcagtcggaatccgtatctacaccaaatcagggtag

SEQ ID NO: 1201 - DNA, 1632 bp, Arabidopsis thaliana
atggcggtttcaagtgctttcgttggttgtccaaagcttgagactttattgaatcaccataatctatctccttcttcttcttcttcgtcctctgtttcacagacaccattgggtcttaatggggttcgtgttcttccgaagaacaatagaaccagacgaggtttgatccaaaaagctcgttgtgagctctctgcttcttctgattctgcgtctaatgcagctagcatctctgctcttgaacaactcaagaactctgcagctgatcgatatacaaaggaaagaagcagtattgttgtgattggacttagtattcacacagctcctgttgagatgcgtgagaagcttgctatacctgaagctgaatggccaagagctattgctgaattgtgtggtttgaatcatattgaagaagctgctgtgcttagtacttgtaaccgtatggagatttatgttttagctttatctcagcatcgtggagttaaagaagttactgaatggatgtcaaagacgagtgggatcccagtttcagagatttgtcaacaccgttttctgttgtacaacaaggatgctacacagcatatatttgaagtctcagctggtcttgactctcttgtcctaggagaaggtcagatccttgcacaggtgaaacaagttgtgaaagttggtcaaggagtgaatggctttgggaggaatatcagcgggctgtttaaacacgcgataactgttggtaagcgtgttagaacagagacaaatattgcttctggtgcggtttcggttagctcagctgctgttgaacttgctctgatgaagcttccgcagtcttcaaacgtatctgctaggatgtgtgtaattggcgctggaaaaatggggaagcttgtgattaagcatttgatggctaagggttgcacaaaagtggtggtagtcaacagaagtgaagagagggtttcagctatccgtgaggagatgcctggtattgagattatatatcgacctcttgatgagatgctagcttgtgcttcagaagcggatgttgtgtttaccagcacagcctctgagacgccattgttcttaaaggagcatgtagagaatctccctcaagcttctccagaggttggaggactgaggcattttgttgacatctctgttccgagaaatgttggatcttgtgttggtgaagtagaaacagcacgggtttacaatgtggacgatctcaaagaagttgttgctgccaacaaagaagacaggatgaggaaagcaatggaagctcaaaccataatcacagaggaatccacacagtttgaagcatggagggattcattggagacggttccaacgatcaagaagttaagagcttatgcagagagaatcagagtggcagagctcgagaagtgcatgtccaaaatgggagatgatatcaacaagaaaacaacgagagcggttgatgacttaagccgaggtatcgtgaacagattcttacatggtccaatgcagcatttgagatgtgacggaagtgacagtagaacgctgagcgagacccttgagaatatgcatgctttgaacagaatgtacggtcttgagaaagacattttggaggaaaagcttaaggcaatggcggaacaacaacagaagtaa

SEQ ID NO: 1202 - DNA, 633 bp, Arabidopsis thaliana
atggcgagagaaaagattcagatcaggaagatcgacaacgcaacggcgagacaagtgacgttttcgaaacgaagaagagggcttttcaagaaagctgaagaactctccgttctctgcgacgccgatgtcgctctcatcatcttctcttccaccggaaaactgttcgagttctgtagctccagcatgaaggaagtcctagagaggcataacttgcagtcaaagaacttggagaagcttgatcagccatctcttgagttacagctggttgagaacagtgatcacgcccgaatgagtaaagaaattgcggacaagagccaccgactaaggcaaatgagaggagaggaacttcaaggacttgacattgaagagcttcagcagctagagaaggcccttgaaactggtttgacgcgtgtgattgaaacaaagagtgacaagattatgagtgagatcagcgaacttcagaaaaagggaatgcaattgatggatgagaacaagcggttgaggcagcaagtatgtgtcttaccctctctgttgataacaaatccctttcttttgtctaccattaacgtacacacccctaaatttaatccccagttgtctacaacacatatgtttgatcatactgtgagataa

SEQ ID NO: 1203 - DNA, 1506 bp, Arabidopsis thaliana
atgtcttgctcggccaccgatctcgctgtcctgttgggtcctaatgccacggcggcggccaactacatctgtggccagttaggcgacgtcaacaacaaatttatcgacaccgctttcgctatagacaacacttaccttctcttctccgcctaccttgtcttctctatgcagcttggcttcgctatgctctgtgccggttccgtgagagccaagaatactatgaacatcatgcttaccaacgtccttgacgctgcagccggtggtctcttctattatctgtttggctacgcctttgcctttggatctccgtccaatggtttcatcggtaaacactactttggtctcaaagacatccccacggcctctgctgactactccaactttctctaccaatgggcctttgcaatcgctgcggctggaatcacaagtggctcgatcgctgaacggacacagttcgtggcttacctaatctattcctctttcttaaccgggtttgtttacccggtcgtctctcactggttctggtcagttgatggatgggccagcccgttccgtaccgatggagatttgcttttcagcaccggagcgatagatttcgctgggtccggtgttgttcatatggtcggaggtatcgctggactctggggtgcgctcatcgaaggtccacgacttggccggttcgataacggaggccgtgccatcgctcttcgtggccactcggcgtcacttgttgtccttggaacattcctcctctggtttggatggtacggatttaaccccggttccttcaacaagatcctagtcacgtacgagacaggcacatacaacggccagtggagcgcggtcggacggacagctgtcacaacaacgttagctggctgcaccgcggcgctgacaaccctatttgggaaacgtctactctcgggacattggaacgtcactgatgtatgcaacggcctcctcggagggtttgcagccataactggtggctgctctgtcgttgagccatgggctgcgatcatctgcgggttcgtggcggccctagtcctcctcggatgcaacaagctcgctgagaagctcaaatacgacgaccctcttgaggcagcacaactacacggtggttgcggtgcgtggggactaatattcacggctctcttcgctcaagaaaagtacttgaaccagatttacggcaacaaacccggaaggccacacggtttgtttatgggcggtggaggaaaactacttggagctcagctgattcagatcattgtgatcacgggttgggtaagtgcgaccatggggacacttttcttcatcctcaagaaaatgaaattgttgcggatatcgtccgaggatgagatggccggtatggatatgaccaggcacggtggttttgcttatatgtactttgatgatgatgagtctcacaaagccattcagcttaggagagttgagccacgatctccttctccttctggtgctaatactacacctactccggtttga

SEQ ID NO: 1204 - DNA, 2479 bp, Arabidopsis thaliana
ctaactctcaaagaagaagaaaagatctgagaggtggtcgaatgatccaagagaagaagaacaatctctcttagatcgtttgatctgatccaatcgaagaagaagatgggaatcttattcacgcggatgttctcttccgtctttggtaacaaagaagctcgaatcctcgtcctcggtctcgacaatgctggaaaaaccacaatcctctgtaaattcactgcctcaatctttcgcattgtgtaatagatttgatatttagtagctagggtttttgattcgatcgttttttgagttgcgttgatgtttttgattctctgtgattccagatcggcttcagatgggggaagttgtctctacgattccgagtatgtatctaatctctcgattattgtatagattatggatctagtttatgtatcgtgattttacgaattttggttttgatctgatctttgcagctattggatttaacgttgagactgtgcagtacaacaatatcaagtttcaggtctgggatttaggtatgttttcgaagaatgtgttcgaacgcattaaactttgaatttgaagtagtagaaatgatttttggtattatatggaagggatattcgaaatctacaacactatataagcattagattaatccaaatcaaaccattttctgatggattcagttagagattctctgcgttcttctttctaagttgactagctccatggtagtagatcttcagtgtcacttttgtataattggaatgtttgtcttttgtatgaattaacgaattcatgatcagaattttccttgatttggagtccttagataagttgttgtcgtatgtgtcgttatattcgactttcttgttccaagttattaccttttccaactggtcttgatgagatagatgaagttctttgtattcaaatttgggtgataaagagttctgtattatcacatcttcttcctatagtttttattattattattgttttgcacgtgttgtatgtacatctgtcttgttagttatatgcgaatgcttttgcattttacaaaattggttcagcgacacagtacattaacaagaactttcctatgacaggtggacaaacaagcatcaggtagcttaatgacctcgtttctcatttctagatatgatgaacatattgcatctactgtgaaggaatgaagaacagaaatgctccatcaagattatactgtttttgttttgcccaattttctaatggtatttttgacaggccatactggcgatgctatttcccgaatacacaagcagtgatctatgttgttgactcgagtgatacagatagaatcggggtggcgaaagaggagtttcatgcaattttagaggtaaagtactgctgaggcttcctcttcttatactgttgtattattttgtgatggacttcttgcatccaaaagtaattgaggtaaaacgatgatgatgtatatcggtagttgaatggaaatacaatattggttcagtttcttgtttaggacttgttatagatgcttgtaagttgtatatcaagtattgttagccttctaataggtgatactgaaattgaagtatctcggttagtactggacggaaagaacaagtgatcatttctctctgtagatcttgctagctaatcttaaactctcagcaacaatgcttacttgagtttacctctgccactgtcagcatttaactcgcactatcttttcaactatgttttataggaagatgaattgaaaggtgcggtggttctgatatttgcaaacaagcaggttagtagtctctaaatgtttgctcttccgattagtttgggctgattcatctggaaatctgtattggtttctgttgctaaaaagctttagtttgttttgcatgcacaagacacttttttgctgatgaaaaatctataactatttggtctgagtttcattaaatcgacttaatttaggatcttcccggtgcactcgatgatgcggctgttacagaagccttggagttgcataagataaagagtcgtcaatgggcaatcttcaaaacttgtgctgtgaaaggcgagggacttttcgagggattggactggtaagcacattctgaaaccgaaccattttcttggtcccattattgaaacactgaacccatttctttatgcatttcttctcaaatattcttctctcatttccatcttgatcttcaggttgagtaatacattgaagtcgggaagtggctaaaatcatcgtcatacaccaatctgtcacatttctcaagagtgtaactttgatcatttttacttattggtttgtttagtatcttttttttatcttagttcttcatcttaaagagttaatatcaatgacatgttcacttaatattctctttttgttgttttgtttcattctgaaagaaaaaacccaacacagatttttgattgagacccataaggggtaatatcatcactttttaac

SEQ ID NO: 1205 - DNA, 1530 bp, Arabidopsis thaliana
atggatgtagagcaaaagaaaccgttaatcgaatcatcagatcgtaatctacctgatttcaaaaaatcagtgaagcttaaatatgtgaagcttggttaccattaccttatcactcatggaatgtaccttttcctctccccattagtacttgtaatcgctgcacagatttcaactttctctgtcaccgatcttcgtagcctctgggagcatcttcagtacaatcttatctcagtggttgtttgttctatgctgcttgttttcttaatgactatttacttcatgactcgaccacgtcctgtctacttggtgaacttctcgtgctttaaacccgatgagtcacgaaaatgcactaaaaagatctttatggatcgttctaaactcactggctctttcacagaggagaatcttgagttccagcgtaagattctacaacgttcggggctcggggaatcgacttacttacccgaggctgtacttaatgttccgcctaacccgtgtatgaaagaagctcgaaaagaggccgagactgttatgtttggagctattgatgagcttcttgcgaagacgaatgtgaacccgaaggatattgggatcttgattgttaactgtagtttgtttaacccgacaccttcgttatctgctatggttgttaatcactataagctccgcgggaatatacttagttacaacttgggaggaatgggttgcagtgctggtttgatttctattgatcttgctaaacatcttcttcactctattcccaacacttatgcaatggtgattagtatggagaacattacgttgaactggtatttcgggaatgaccggtcgaagcttgtttctaattgtctgtttagaatgggaggtgcagcgattcttctttcgaacaaaagatgggacagaagaagatcgaaatatgagcttgttgatacggttaggactcacaagggagctgatgataagtgttttggttgcataactcaagaagaggattccgcaagtaagattggtgttaccttgtcgaaagaacttatggctgttgcgggtgatgctctaaagacaaatattacgacgttaggaccactggttttaccgacatctgaacagcttctgttctttgcaacgttagtgggaagaaaactcttcaagatgaagatcaagccttacatcccagacttcaaactagcgtttgagcatttctgcatccacgcaggagggagagctgttcttgatgaattggagaagaacttgaaactcacagagtggcatatggagccctcgaggatgacactctaccgttttggtaacacgtccagttcttctttgtggtatgaattagcatatagtgaggccaaaggaaggatcaagaaaggtgatagaatttggcagatagcttttggttcggggttcaagtgcaacagctcggtttggagagcggtaaggtcggtaaaccctaagaaagagaagaacccatggatggatgaaattcatgagttcccagttgaagtccccaaggtctccacaatctag

SEQ ID NO: 1206 - DNA, 906 bp, Arabidopsis thaliana
atgggtcaatctcaagtttctctctttcttcttctaattcttgttttcatctatggagtttcctccaccactttcaccatcgttaaccagtgtagctacaccgtctggcctggacttctctccggcgccggaacctctcctttacctacaaccggattctccttaaaccctaccgagacacgagttatcccgatccccgcagcttggtccggtcgtatttggggtcgtactctctgcacacaagacgcaaccaccggaagattcacttgcatcaccggggactgtggttcttccaccgtagaatgctccggatccggtgctgcacctccggctacactcgctgaattcaccttaaacggagctaatggtctcgatttctacgacgtcagtctcgtcgacggttacaacatcccgatgaccatcgtccctcagggtggaggagatgccggaggcgtcgccggaaactgtacgacaaccggctgcgttgcggagctcaacggtccatgtcctgctcagctgaaagtggcgacgacgggagctgaaggagtagcttgcaaaagcgcgtgtgaagcgtttggaacgccggagtactgctgtagcggcgcgtttggaacgccggacacgtgtaagccaagcgagtactcacagtttttcaaaaacgcgtgcccgagagcttatagttacgcttacgacgacggaactagtaccttcacttgtggcggagctgattacgtcatcactttctgtccttctcctaacccaagtgtgaagagtgcaacgaagggagtccaacccgtagctgttagctactctaaggcatctccaaacgcgtcgccaactctttctgccgtgttttcgattggcgttttggctgtcgcgtcttgggtgatgcaacgcgttttgtga

SEQ ID NO: 1207 - DNA, 1296 bp, Arabidopsis thaliana
atggggaaggagaacactgaagccgagtcctctaatggaaacgagtctcagttaagttctgacttaacgaagagtcttgatctggctgaagtgaaggaagacgaaaaggataataaccaagaagaagaagatggactgaaagctgaggcttcaacgaagaagaagaagaagaaaagtaaaagcaagaagaagaagagttctcttcaacagactgatcctccttcaattcctgttcttgagctcttcccttctggagattttcctcaaggtgaaatccaacagtacaatgatgataatttgtggagaacaacatctgaagagaagagagagatggagaggctgcaaaagccgatatataactctcttcgccaagcagcggaagttcatcgtcaagttaggaagtatatgagaagtatattgaagcctggaatgttgatgattgatctctgtgagactttagagaacactgttcgtaagttgatatcagagaatggtcttcaagctggtatcgcctttcctacaggatgttcactgaataatgttgctgctcattggacaccaaactctggagataagactgtccttcagtatgatgatgtgatgaagctggattttggaacacatattgatgggcacattgttgattctgcttttacagttgcgttcaatcctatgtttgatcctcttttagcagcctcgcgtgacgcaacatatactggtatcaaggaagccggggtagatgtccggctctgtgatgttggtgctgcagttcaggaggtcatggagtcttatgaggttgaaatcaatggaaaagtctaccaagtcaaaagtatcagaaacctgaatgggcacagcattggacgctatcagatacacgctgaaaaatcagttcctaatgttagaggaggcgagcagacgaaaatggaagagggtgaattatatgccattgaaacttttggatcaacagggaaaggatatgtaagagaagacttagaatgtagccattacatgaaaaactatgatgtgggtcatgtacctttgaggttaccaagggcaaaacaactccttgccactattaacaagaacttctccacgctagccttctgcagacgttatttggaccgccttggtgaaacaaaatacttgatggctttaaagaatctttgtgattctggcataattgagccatgtcctccagtgtgtgatgtcaaaggaagctatatttctcagtttgagcatacaatcctgttgcgaccaacttgcaaagagattatttccaaaggagacgattattga

SEQ ID NO: 1208 - DNA, 1179 bp, Arabidopsis thaliana
atggaagaaactagaggaatttctgatccagagaatgggagttcgagttacggcggtaaaccgccgaatccactctccttctcttcttcctccgccgctgctgccgtttacaggcaaaccttcgacggcgagcgatcgttggcgccgtgtaataagaggtcactggttcgacactcatctctcgtgaagacaatggtgtcagatatatctgttgagaatgagtttactatagagaagaacaagtctgagtttgttcctgctacgcgttctggagcttggtctgatattggctccaggtcaagcatggaagatgcttatctatgcgttgataatttcatggatagctttggccttctgaattctgaggctggtccaagtgccttctatggggtatttgatggacatggtgggaagcatgccgctgagtttgcatgtcaccatataccgaggtacattgttgaagatcaagagtttcctagtgaaatcaataaggtgttatcttcagcatttcttcaaacagacactgccttcttagaggcgtgttcattggatgggagccttgcttcaggaactactgctttggcagctattctttttggaaggtcgttggtggtagcaaacgctggagattgcagagcagtcttatcccgtcagggaaaagccattgaaatgtcaagagaccacaaacccatgagcagtaaggaaaggagacgcattgaagcatcgggtggacatgtattcgatggctatctaaatggacaacttaatgtggctcgagcgctaggtgactttcatatggaaggcatgaagaagaagaaagatggttctgattgtggacctctaattgcagagcctgagctcatgacaacaaaactaacagaagaggatgagttccttataattgggtgtgacggggtttgggatgtgttcatgagccagaatgctgtagattttgccagaaggagactacaggagcacaatgacccggtcatgtgtagtaaggagctggttgaggaagctttgaagaggaagagtgctgataatgtgacggcagtggttgtgtgtcttcagccacagccaccaccgaacttggtagcgccgaggttgagagttcacagaagcttctcggcggagggtttaaaagatttacagagctacttggatggcttgggaaactaa

SEQ ID NO: 1209 - DNA, 873 bp, Arabidopsis thaliana
atttctaggtacaagttaattaaagaggttggtgatggaacttttggtagtgtttggcgagctataaataagcagacgggtgaagtcgttgcaattaagaaaatgaaaaagaagtactactcttgggatgaatgtattaatctgagagaagttaagtcgctcaggagaatgaatcatccaaacattgtgaagttgaaggaagtaatccgggaaaatgatatcctatactttgtctttgagtacatggagtgcaatctttaccaacttatgaaggatcgacaaaagctttttgcagaagctgatatcaaaaattggtgctttcaagtcttccaaggcctttcttacatgcatcagcgtggttacttccaccgcgatcttaagccagaaaatctgttagtctctaaagacatcattaagattgctgattttggcctggcacgtgaggttaattcgagtccaccttttaccgagtatgtttctacacgctggtacagggctcctgaagtacttctacagtcatatgtatacacatcgaaagttgatatgtgggcgatgggagctattatggctgagttgttgtctcttcgccccatttttcctggggctagtgaagcagatgaaatctacaaaatctgcagtgtcataggcaccccaactgaggagacctggttggagggacttaatcttgcaaacacaataaactatcaattccctcagcttcctggtgtacctctttctagcttgatgccatctgctagtgaagacgcaattaatcttattgagcgactttgctcgtgggatccatccagcagaccgactgctgcagaggtgctgcagcacccgttcttccaggtacacctagaaagtttttga

SEQ ID NO: 1210 - DNA, 1626 bp, Arabidopsis thaliana
atgttacattgtcattataaccgcagaaaagatggaactccgttcaatacatcgattataacaccaccgcctccgcctgtggttgatcctcctcccgctactcaccgtgctcctcctgttccccgtatccctcctgtttctggtgttcccccagcaccttttgctccttttgctccactgcaaccacaacaacatccaccaccatcaccacctctggtctggtcaccaccttcttctgataatggaggaggagatccctggaactctgtgtcagggcaacctaccttgcaaatatcacctccttcaggttcaggatcaggaaaattctggtccactcaaagaatcattctagtagtttcttcagtggccataattgttcttgtatccggtttgtgtgttacactttggagatgttgcagaagtaaaatatataaccgatattacagtggagctcgtaaagatttacaacgaccatacttcaataagcctccatctcaaccaacccccactatgggaaaagtttctcgggagcctatggttaagcctttcgatggatatggagctggagacaggaaatatgggtatccaatgccacagcgggctgaagagagccggagagcaatgcctcctacttcatattataataaggatgttaatacacctcaaaagccgctgcaacaaccaccgaggcagttccagtccaatgatactgcttcaaagagagcggctcatttccccccgggcttgaattcctcatcttctgctactgttttcaccattgcttcacttcagcaatacacaaataatttctcagaagagaatataatcggggaagggtcgattggtaatgtctacagagctgagcttcgtcatggaaagtttcttgcggtgaagaagctgagcaataccatcaacagaacacagagtgacggcgaattcctcaatctagtctccaatgtgttgaagcttaaacgcggtcatatattggagcttcttggttactgtaacgagtttggtcaaaggttacttgtgtatgagtactgtcctaatggatcacttcaagatgcactacatttggatcgcaagttgcacaagaagctcacttggaatgtacgtataaatattgcattaggagcttcaaaggcattgcagtttcttcatgaggtatgtcaaccgccggttgttcaccagaatttcaagtcttccaaggttcttcttgatggaaagctctcagtacgtgttgcagacagcggtttggcttatatgttaccaccacgcccaacgagtcagatggcgggttatgccgctcctgaggttgagtatggaagctacacttgtcagagcgacgtatttagccttggggttgtaatgttagaactgctcactggacgcagaccatttgacaggacaaggccgaggggacatcaaacactagctcagtgggcgattcctcggcttcatgacatcgatgcgttgacaagaatggttgatccgtcattacacggagcgtatccaatgaaatcattgtcacgttttgcagatatcatatcacgttcactgcagatggaaccaggatttagaccgccgatatcagaaatagtccaagatcttcaacatatgatctaa

SEQ ID NO: 1211 - DNA, 411 bp, Arabidopsis thaliana
atgttatcccgatcggtggtcaagcatgcgaacaatctcggtcaaattcaagctagacatttcacgacaacgcttatgaaatcgggaccaaagcatagtggtacagagcaaggcgtgaagcgaaacagtgcagatcacagacgtagattgctcgcggctagatttgaactgagaagaaagctatacaaagcgttttgcaaagatccagatcttcccagcgaaatgcgagacaagaatcgttataagctctcgaaattgccgagaaacagtgcctttgcgagaatcaggaacagatgtgtgttcactggtcgatctcgttctgtgactgagctgttccgtgtttctcgaatcgttttccgtggattagcatctaaaggtgctttgatggggataacgaaatcgtcttggtag

SEQ ID NO: 1212 - DNA, 522 bp, Arabidopsis thaliana
atggcggatacagctagaggaacccatcacgatatcatcggcagagaccagtacccgatgatgggccgagaccgagaccagtaccagatgtccggacgaggatctgactactccaagtctaggcagattgctaaagctgcaactgctgtcacagctggtggttccctccttgttctctccagccttacccttgttggaactgtcatagctttgactgttgcaacacctctgctcgttatcttcagcccaatccttgtcccggctctcatcacagttgcactcctcatcaccggttttctttcctctggagggtttggcattgccgctataaccgttttctcttggatttacaagtacgcaacgggagagcacccacagggatcagacaagttggacagtgcaaggatgaagttgggaagcaaagctcaggatctgaaagacagagctcagtactacggacagcaacatactggtggggaacatgaccgtgaccgtactcgtggtggccagcacactacttaa

SEQ ID NO: 1213 - DNA, 741 bp, Arabidopsis thaliana
atgtcttcatccaacgcctgcgcctctccgtcaccgttccccgccgtcacgaagcttcatgtagactccgtcacgtttgtaccgtccgtcaagtcaccggcctcctccaatccattattcctcggcggcgccggtgtccgaggccttgatatccaaggtaaattcgtgatcttcaccgtcattggagtatacctagagggtaacgccgttccttctctatctgtcaagtggaagggaaaaactacggaggagctaacagaatctatcccgttcttccgtgaaatagtcaccggtgcgtttgagaagtttatcaaggtgacaatgaaactgccgttaacgggacaacaatattcggagaaagtgacggagaattgtgtggctatatggaaacaattagggctttatacggactgtgaagctaaagctgtggagaagttcttggagatcttcaaggaagaaacattccctcccggttcatcgatcctcttcgctctctcccctaccggctctcttacggttgcgttttcgaaagatgatagtatccctgaaaccgggatcgctgtgatcgagaacaaattgttggcggaggcggttctggaatctatcatcgggaagaacggtgtgtcacctggcactaggttaagtgttgcagaaagattatctcagctaatgatgaagaacaaggacgaaaaggaagttagtgatcactctgttgaggaaaaactagccaaagagaactga

SEQ ID NO: 1214 - DNA, 252 bp, Arabidopsis thaliana
atgggtcagatccagtactccgacaaatatttcgatgatactttcgaatacaggcacgttgtacttcctccggaagttgctaagcttttacctaagaatcgtattctttcggaaagtgaatggagagccatcggagtgcagcaaagtcgtggatgggttcattacgcgattcatcgtcctgagccacatatcatgctctttaggaggcctcttaactaccagcaggagcaccaagctcagattgctaagtag

SEQ ID NO: 1215 - DNA, 972 bp, Arabidopsis thaliana
atgttaaaaggttcgtatggctcaacattcacattcgctaatcggtgcggctacaccgtatggcctggaatcctatcgaatgctggctcacctactctctccaccaccggatttgagctccctaaaggcacctctcgctctctccaagctcccaccggttggtccggtcgattctgggctcgtaccggttgcaagttcgacagttctggctccggtacatgcaaaaccggtgactgcggctccaacgctgtcgaatgcgccgggcttggtgccgcaccgcctgtaactctcgcggagttcactctaggcactggcggcgatgatttctacgacgttagtctcgtcgacggttacaacattccgatgatagttgaagtcgccggtggatctgggcagtgcgcttctaccggatgcactacggatcttaacattcagtgccctgctgagctgcgtttcggcgacggagacgcttgcaaaagcgcgtgtttagcgtttcggagtcctgaatactgttgcagcggcgcgtatgctacaccttctagttgtcggccttccgtgtattcggagatgtttaaagccgcgtgtcctcgctcctatagctacgcttacgacgatgctacgagcactttcacttgcgccggtggagattatacggtgacgttttgcccttcttcccctagtcaaaaatcgactagctactcccctccagtgacagactcgtcgtcgacctcacaaggttccgatcctgtgcctggttctgatactggttacgctggtcagggtcaacagactccaggtcaaggtaatgtgtacgggtcacaggggactgggtcggagatgggtacgggtgagaccatgttacaagacggatcatggatggctggtttggccatgggagaggcaagcagaccagccggcgtttcattgacagtgctgcttgctgcatttacttttccgtttattttctcgtag

SEQ ID NO: 1216 - DNA, 1722 bp, Arabidopsis thaliana
atgactgttgaacaaaatttagaagctttggatcagtttcctgtaggaatgagagttcttgctgttgatgatgaccaaacttgtctcaaaatccttgaatctctccttcgtcactgccaataccatgtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataatgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatccgaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagaaggctatgcctaaaaagattttggatctgatgaatgttgagaagctcactagagaaaatgtggccagtcatcttcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatagctcttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtga

SEQ ID NO: 1217 - DNA, 1650 bp, Arabidopsis thaliana
atgagcattgtacctaaggaaacggttgaggtaatagctcaaagtattgggattaccaacttgttacctgaagctgctcttatgcttgctcctgatgttgagtatcgtgtccgagagatcatgcaggaagctatcaaatgcatgcgtcactcaaagagaacgactttaacagcttcggatgtagatggtgctctcaacttaaggaacgttgagccgatatatggatttgcctcaggagggccatttcgttttagaaaagctattggacatcgcgatttgttctacactgatgacagagaagtggatttcaaagatgtgatcgaagccccgctgccaaaagctccccttgatactgaaattgtttgtcactggctggctattgaaggagtgcaaccagctataccagaaaatgctcctttagaagtcattagagcacctgcagaaaccaaaatccatgaacaaaaagacggacctcttattgacgttaggctaccagtgaagcatgtactatctagggaacttcagttatacttccaaaagattgctgaacttgcaatgagcaagtcaaatcctcctctgtataaagaagcattagtgagcttggcctcagactcaggacttcatcctctagttccatattttacaaatttcattgctgatgaggtttcaaatggcttaaatgacttccgactcctgtttaatctaatgcacattgttagaagtcttctacagaatcctcacatacacatagaaccttatctgcaccagttgatgccatctgttgtaacatgccttgtatcaagaaagcttggaaatagatttgctgacaaccactgggaactcagagattttgcggcaaatctggtttcactgatatgtaaaaggtatggaaccgtttatataactcttcagtctcgtcttaccagaactttagtcaatgcactgctggacccaaagaaggctttgactcagcactatggtgcgattcaaggattagcagctttggggcacactgttgtacgccttcttattctatcaaatctcgaaccatatctaagtcttctcgaacctgaattgaatgctgagaagcaaaaaaatcagatgaagatctacgaagcttggcgtgtatatggagccttgctgcgtgctgcaggcttgtgtatacatggccggcttaaaatcttcccacctttaccatctccgtcaccaagttttctccataagggaaagggaaagggaaagataatcagtactgatccccacaagcggaagctgagtgtagattcttcagaaaaccaatcaccgcagaaaagattgataaccatggatgggccagatggtgtacattcacaagatcaatctggctcagctccaatgcaagtagataatccagtggaaaatgacaatccgccacaaaactctgttcagccatcctcatcagaacaagcctctgatgctaacgaatctgaaagcagaaatggaaaggtgaaagaaagcggcaggagtcgggctattaccatgaaagcaatccttgatcagatatggaaagatgatcttgattccggacggctattggtgaaactgcacgaactctatggtgataggattcttccctttatcccttctacagagatgtcagtattcctctaa

SEQ ID NO: 1218 - DNA, 1773 bp, Arabidopsis thaliana
atgggacacgtgaatctacctgcatcaaagcgtggtaaccctcgtcaatggcgtctcctcgacatcgtaaccgctgctttcttcggtatcgtacttctcttcttcatccttttattcactcctcttggtgattccatggcggcttctggtcggcaaacgctgcttctctctacggcgtcagatccgaggcaacggcagcgattagtgactttggttgaagctggtcagcatttgcaaccgatcgagtattgtcctgcggaagctgttgctcatatgccttgtgaggatccgagaaggaatagtcagcttagtagagagatgaatttctatagggagagacattgtcctttgcctgaggagactccgctctgtttgattcctccgccttctggttataaaattcctgttccgtggcctgagagtcttcacaaggtatattggattctagctcctattaccatgatttggcatgcaaacatgccatataacaaaattgctgaccggaaaggtcatcaaggatggatgaaaagggaaggggaatactttactttcccaggcggtggcacgatgtttcctggcggagctggccaatacattgaaaagcttgcacagtatattccgcttaatggtggaactttgagaactgctcttgacatgggatgcggggtagctagttttggaggtactctactatctcaaggcattctagccctctcatttgctccaagagattcacataaatctcaaattcagttcgctttggaaagaggagtgcctgcatttgttgccatgcttggcactcgtagactcccctttcctgcatactcctttgacctgatgcactgttcccgatgtttgattccttttacggcttacagtgagtcccttgggttatatacctctacttatgtacatgcaacttacttcatcgaagtagataggttactgcgccctggaggatatcttgtaatctctggcccacctgtacaatggcctaaacaagacaaagaatgggctgatcttcaggcggtggctagagctttgtgctatgagctaattgcggttgatggaaacactgtcatctggaagaagcctgttggagattcatgtctacctagccagaatgagtttgggcttgagttgtgtgatgagtctgttccgccaagtgatgcatggtattttaaattgaagaggtgtgttaccaggccatcatccgtcaaaggagaacacgctttgggaactatatccaagtggccggagaggcttactaaagttccttctagggccattgtcatgaaaaacggattggatgtgtttgaagcagatgcaaggcggtgggcaagacgcgttgcttattacagggattctcttaacttgaagctgaaatctccaactgtccgcaatgtcatggacatgaacgcattcttcggaggctttgcagcaacccttgcatctgatcctgtgtgggttatgaatgtcattccagctcggaagccattaactcttgacgtgatttatgacagaggtctcatcggtgtttaccatgattggtgtagcctagtagatctaatggtagagatggacagaatattacgtccagaaggaaaggttgtgatccgagactctcctgaggtgctagataaagtcgcacgaatggctcatgctgtaagatggtcttcttccatacacgagaaagaacctgaatcccatggaagagagaagattcttatcgcaaccaaatctctctggaaattgccatcaaactcccactga

SEQ ID NO: 1219 - DNA, 531 bp, Arabidopsis thaliana
atggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatag

SEQ ID NO: 1220 - DNA, 3495 bp, Arabidopsis thaliana
atgaaacaacaatggcagttcttgatcctctgtttgctcgtcttgtttctaacggtggactctcgtggcagacggctactcagcgacgacgttaacgacacagctctgctaacggcgtttaagcaaacctctatcaagtcggatcctaccaactttttaggtaactggagatacgggtcgggtcgtgacccatgtacttggcgaggcgtctcttgttctagcgatggtagagtcattggacttgatctacgaaacggtggtcttaccggaaccctaaatctcaataatctcacggcgttgtctaatctccggagtctttatttgcaaggaaacaacttctcctccggagattcttcttcttcttcaggatgttctctcgaggttctggatttatcttcaaactcgcttacggactcttcaatagtggattacgttttctccacctgtttaaatctggtttctgtcaatttctcgcacaacaagctcgccgggaaattgaagtcttctccttcggcgagtaacaagagaatcacaaccgttgatctctcgaacaatcgcttctccgatgagattccggagactttcatcgccgattttccgaattctctgaaacacctcgacttatccggcaacaatgtcaccggcgacttctctcgtctcagctttggtctctgtgagaacctcaccgtattcagcttatcacagaacagcatctccggcgacagatttccggttagtctctcaaattgtaagctcctcgaaacgttaaacctctctcggaacagtctcatcggaaaaatccccggagatgactattggggaaattttcagaacctgaggcagctctctcttgcacacaacctttactccggtgagattccaccggagctttctctgctctgtcgaactctagaggttctcgatctctccggcaacagtctcaccggtcagcttccgcaatcattcacctcttgtggctcattacaaagcctaaatcttggaaacaacaagctctccggtgatttcttaagcaccgtcgtgagtaaactctctagaatcactaatctttacttaccattcaacaacatctcaggctctgttccgatttcgctcaccaactgtagtaatctgcgagttcttgatctgagctcaaacgagttcactggagaagtaccatctggtttctgctctcttcaaagctcttcggttttggaaaagttgcttattgccaacaattacctctcaggaactgtccctgtagagcttggtaaatgtaagagcttgaagactatagatcttagcttcaatgctctcactggtctgattcctaaggagatatggacattgcctaagctctccgacttagttatgtgggcgaacaatctcactggtggaatcccggagagcatttgtgttgatggaggaaacttggaaacgttaatcttaaacaacaatctcttaaccggttctcttccagaatcaatctccaaatgcaccaacatgctttggatctccctttctagtaacctgcttaccggtgaaatccctgtaggaatcggaaagcttgagaagttagcgattctgcaactcgggaacaattctttaactgggaacattccaagtgagcttggaaactgcaagaaccttatctggcttgatcttaacagcaataatctaactgggaatctcccaggtgaacttgcaagtcaggccggactggtaatgcccggaagcgtctctggtaaacagtttgcgtttgtgaggaatgaaggtgggacggattgcagaggtgcagggggtttggttgagtttgaaggaattcgtgctgagcggttagagcattttccaatggttcattcatgtcccaagactcggatatactcaggcatgaccatgtacatgttctccagtaacgggagcatgatctacttggacctttcctacaatgcggtttcaggttctattcctttgggttatggtgcaatgggatatcttcaggtcttgaatttgggacataacttgttaactggaaccataccggatagcttcggaggattgaaagcaattggagttcttgatctatctcacaatgatctccaaggattcttacctggatcactaggaggactctcttttctaagcgacttagacgtctctaacaacaatctaaccggaccaatcccattcggaggccaacttacgacgttcccactcacaagatacgccaacaactctggcctctgcggggttcctctaccaccttgtagctctggttcccggcccacgagatctcatgctcaccctaaaaaacagagcattgcgactgggatgagtgcggggattgtgttttctttcatgtgtattgtgatgcttattatggcgctttatagagcaaggaaggttcagaagaaggaaaaacagagagagaagtacattgagagccttccgacatctggtagcagcagctggaagctctctagtgttcatgaaccgttgagcatcaacgttgcaacatttgagaagccgctgcgaaaacttacttttgcacaccttttagaagccacaaacgggtttagtgctgatagtatgatcggatcaggtggatttggagatgtctacaaggctaaactggctgatggatctgttgtagcgatcaagaagttgattcaagtcacgggacaaggtgatagagagttcatggcagagatggaaacgattggtaaaatcaaacatcgaaatttggtacctcttcttggatattgcaagattggtgaagagagacttcttgtctatgagtacatgaaatacggaagcttagagacagttctgcacgaaaagaccaagaagggtggaatctttcttgattggtcagcgagaaagaagattgcaataggagctgcgcgtgggctagcttttctgcaccatagctgcattcctcatattatccacagggatatgaaatcaagcaacgttcttctagaccaagattttgttgcccgtgtctcagattttggtatggcaaggctggtgagcgctctggacacacacttgagcgtgagcacgctcgcaggtactcccgggtatgtcccaccagagtattaccagagtttccgatgtacagccaaaggagatgtgtatagctacggagttatacttctggagctcctctcaggcaagaaaccgatcgatccagaggagtttggtgaagacaacaaccttgtgggatgggctaaacagctctacagagagaagagaggagctgagatacttgacccagagttagtaacagacaaatctggcgatgttgagctacttcattacttgaagattgcgtctcaatgtttggacgatcggccattcaaaagaccaactatgattcaagtcatgacgatgttcaaagagctcgttcaggttgatacagagaacgacagtcttgatgagtttttgctaaaggaaacgccgttggtcgaagaatcacgagataaggagccttaa

SEQ ID NO: 1221 - DNA, 555 bp, Arabidopsis thaliana
atggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaa

SEQ ID NO: 1222 - DNA, 1836 bp, Arabidopsis thaliana
atggcctctctctcaggcctatactcttcttctccatctctcaaacctgccaaaaaccattcctttaaagcattgccggcgcaatctcgagattccttctctttcccacatacctccaaacccaccaatctaccgttgactctctcctcggctcgttctgtggcacgcgacatttctcatgcggattcgaagaaagagcttcttaaggatccggatgcgttgtggaagcgatacctcgattggttttatcagcagaaagagcttgggttgtatctggatattagtcgggtcggatttaccgatgagtttgtggctgaaatggagccaaggtttcaagctgcgtttaaggctatggaggatcttgaaaaagggtctatagcgaatcctgatgaaggaagaatggttggacattactggcttaggaactctaagctcgcacctaagcctactttaaagaccttgatcgagaacacacttgattctatttgcgctttctccgacgacataatctctggaaagccaccatcttctcctgagggtcgttttactcagatactttctgttggcattggaggctcggctcttggacctcaatttgtcgctgaggccttggctcctgataatcctccattgaagataagattcattgacaacaccgaccctgctggaattgatcatcagattgcacaacttgggccagagctggcctcgactttagtagttgtcatctcaaagagtggaggtactcctgaaactagaaatggactactggaagtgcagaaagcattccgtgaagctggtctgaatttcgcaaaacagggtgttgcaataacccaagagaactcattactggataatacggcaagaattgaaggttggctagctagatttcctatgtacgactgggtgggtggaagaacatcaataatgtctgcagttggtctgcttccagcagcactacaggggattaatgttagggagatgcttactggtgctgctttaatggatgaggctactaggacaacttcgatcaagaataaccctgcagcgctcttagctatgtgttggtactgggcttccaatggcgttggttccaaggatatggttgtccttccttacaaggatagcttattgctatttagtcggtatctgcagcagctggtcatggaatcactaggaaaggagtttgatcttgacggtaacactgttaatcaagggttaactgtgtatggaaataagggaagcacagatcagcacgcctacattcaacagctgagagatggtgtgcacaatttctttgcaaccttcatagaagtgttacgggacagaccccctggtcacgattgggagcttgagccaggtgtcacttgtggagactatctctttgggatgctacagggaactagatctgctttatatgcaaacggtagagaatccatcagtgttacaatccaggaagtgacaccaacatctgttggggctattatagctctttatgaaagagctgttggtttatatgcctcaattgtgaacataaatgcttaccaccaacccggtgtggaagctgggaaaaaggcagcagcagaagttctcgccctgcaaaagcgggtattgtcagttcttaatgaagccacttgtaaagatccggtagagccattgacactggaagagatagctgatcgttgtcatgctcctgaggaaatagaaatgatatacaagatcatagcgcacatgtctgcaaacgacagagttctgatagcagaaggaaactgtggatcgccacgaagtatcaaagtgtatttgggcgagtgcaatgtggatgacctgtacgcataa

SEQ ID NO: 1223 - DNA, 1527 bp, Arabidopsis thaliana
atggaagtgcctagtgaaaccacgaatttagccgatctccggcgaccattggtggttccggttgtctcggagcgtaaacctccggcagacgtcggactcggactagagagtgttttaacggagcgtagccttccgtaccggaggcgcgtgtacttaggggcatgcatagagatgaagctacttttccggttggcacttccggcgatacttgtctatttagtcaacagcggaatgggtatttccgctcggatcttcgccggacatctcggtaaaaatgagctcgccgccgcgtccatcggaaacagctgcttcagtctcgtctatggcctcatgttaggtatgggcagtgcagtcgaaacactatgtggacaagcctatggagcccatcgttacgagatgcttgggatctatctccaaagagcaacaatagtcctcgctctagttggcttgcccatgacattactatacaccttctcgtaccctattctaatcctactaggggaacccaaaacggtgtcgtacatgggatccaaatacatcgccgggctcatccctcaaatcttcgcttacgccgtcaacttcacggcccaaaagttcctccaggcccaaagcgtggttgccccgagcgccttcatctcagccgccgccctcatcctccagatattgttgacgtggatcaccgtttatgtaatggacatgggctttatgggcatagcttatgttcttacaatttcttggtgggtcattgttggatcccagtgtttttacattgcggttagtcccaagtttagacacacgtggactggtcttagctggagatcgctccaaggtctttggagcttctttaaactctctgctggctcagctgttatgatttgtctggaaatgtggtattcgcagattcttgttcttcttgctggtttgctcgaaaatcctgctcgctctctagattctctttccatctgtatgtcaatttcagcattatcattcatggtctctgtcggctttaatgctgctgtaagtgtacggacaagtaatgagcttggagcaggaaatccgaaatcagcatggttctctacatggacggcgacttttgtatccttcgtgatctccgtgacggaagccctcgccgtgatttggtttcgtgattacgttagctacattttcacggaggatgctgacgtggctaaagccgtctctgacctctgtccttttcttgccatcaccatcattctcaacggaattcaacctgtcttgtccggtataagttcatttagatttaaactagaaaacttaactggagtggcagtgggatgtggatggcaaacatacgtggcatatgtgaatgttggttgttactacgttgttggtattccggttgggtgtattctcggcttcactttcgattttcaagccaagggaatatggaccgggatgattggaggtggaaaaagcgaggaaacgtttggatctgtgggacgacaagaaggagcctctccaaaactagtaatggattttacagaataa

SEQ ID NO: 1224 - DNA, 807 bp, Arabidopsis thaliana
atggagaagaggagctctattaaaaacagaggagtacttagattaccaccagggttccgatttcacccgaccgatgaagagctagtggttcaatatttacgtcgaaaagtaaccggtttacccttaccagcttctgtaataccggaaaccgatgtttgtaaatccgatccatgggatttaccaggtgattgtgaatcagagatgtatttttttagcacgagggaagctaaatacccgaacggaaaccggtcgaaccggtctaccggttcgggttattggaaagcgactggtctcgataagcagatcggtaagaagaagcttgtcgtggggatgaagaaaactcttgttttctacaaaggtaaaccaccaaacggaacaagaactaactgggttcttcatgaatatcgtcttgttgattcacaacaagattcattatatggacagaacatgaattgggttttgtgtagagtgttcttgaagaagagaagcaatagtaatagtaagaggaaagaagatgagaaagaagaggtggagaatgagaaagagacagagacagagagagaacgtgaggaggagaacaagaagagtacttgtcccatattttatgactttatgagaaaagacacgaagaaaaagagaaggagaagaagatgctgtgatttgaatttgactcctgctacttgttgttgttgctcttcttcgacttcttcgtcgtctgtttgctcaagtgctttaactcacacatcttctaatgataatcgtcaagaaatcagttatcgggaaaataagttttgtttgtttctatag

SEQ ID NO: 1225 - DNA, 3654 bp, Arabidopsis thaliana
atggcgaacttacaagtttctgggatactcgaaaagatgacgggtaaagataaagattacagatacatggcaacctctgatttgcttaatgagttgaataaggattcctttaaaatcgacctggacttggaggtgagattgtcgagtatcatattgcaacagctcgatgatgtggctggtgatgtttctggattggctgttaaatgtcttgctccattggtgaagaaggttggagaagaacgaattgttgaaatgaccaacaagttatgtgataaactgctgcatgggaaagaccagcatcgtgataccgcaagcatagctctcaggactgttgtcgctcaaattgctcctacgcttgctccatctattcttgttactctaacaccacaaatgataggaggaataagtggccagggaatgagctcagggatcaagtgtgaatgtcttgagatcatgtgtgatgttgttcaaaaatatggaagtttaatgacggatgatcacgagaagctattgaatacattgttattgcaattgggctgtaaccaagccacagtcaggaagaagactgttacatgcattgcttctcttgcttccagtctgtctgatgatttgctcgcgaaggcgactgttgaagttgtgaaaaatctaagtaacaggaatgcaaaatcggagattacacgtaccaatattcaaatgattggagctttatgccgtgctgttggttaccggtttggcactcatctaggtaacactgtgccagtattaatcaattactgcactagcgcttcagaaaatgacgaggagcttcgcgagtatagcttacaggcacttgaaagtttcttgctacgatgtcccagggacatctcaccatattgtgatgaaattttaaatcttactttagaatatattagttatgacccgaattttacggacaatatggaggaagatactgataatgagactcttgaagatgaagaagatgacgagagtgcaaatgagtacacagatgatgaagatgccagctggaaagttaggagagcagcggccaaatgcctagcaggattaatcgtttcgcgttctgagatgctcactaaagtatatcaagaggcctgcccgaaactaattgatagatttaaggaaagggaggaaaatgtgaagatggatgtattcaacacattcattgatctgttgcggcaaacgggaaatgttacaaaaggtcaaactgacaccgatgaatcaagtccaaaatggctactgaagcaagaagtctcaaagattgtgaaatccataaataggcaactgcgcgaaaagtctgttaagacaaaggttggagcattctctgttttgagagaacttgtggttgtcctgcctgactgtcttgctgatcatattggttcacttgttcctggaattgaaagggcgctaaatgataaatcttctacatcaaacttgaaaattgaagctcttgtcttcaccaaattagtcttggcatcacatgcgcctcctgtttttcacccttacattaaggctctttcaagtcctgttttagctgctgttggtgaacgctattataaggtgactgctgaggcattaagggtttgtggggaacttgtcagagtagtacgcccaagtactgcgggaatgggctttgattttaaaccgtttgttcatccaatctacaatgcgataatgtcccgcttgacaaatcaagatcaggaccaggaggtcaaggagtgtgctatcacctgcatgggtcttgtgatttcaacatttggtgatcaactgagggcagagttaccttcatgccttcctgtgcttgttgatcgaatgggaaacgaaatcactcgcctcactgcagtaaaggcattttctgtcattgccacttctccgcttcacattaatctatcatgtgtcttggaccatttgattgcagaactaacaggattcttacggaaggctaatcgggttctaaggcaagcaacactgattactatgaataccttggtaacagcctatggtgataaaattggttcagaagcttatgaagttattcttgtggagctttcatctctgataagtgtttcagacctgcacatgacagctcttgcactcgaactctgctgcactctgatgactggaaagagttgtagtgaaaatatcagtttggcggtccgcaacaaagttcttccgcaggcactaactttagttaaaagcccattgctccagggtcaagcacttttggatctgcaaaaattctttgaagctctggtgtatcatgcaaatacgagtttctacaccttgctggaatcattgctatcttgtgctaagccttctcctcagtctggaggtgtcccaaagcaagcactatattcaattgcacagtgtgtggcggttctttgtctcgcagcgggtgataagaattgttcgtctacagttaaaatgctcatggaaatccttaaagatgacagcggcacaaattcagcaaaacaacatcttgccctgttatctcttggtgagattgggagaaggaaagatctcagcgcacatgctggcattgaaacaatcgtcattgagtctttccaatctccttttgaagaaataaagtccgcagcttcatatgctcttggaaacattgccgttggcaatctatccaattatctaccgtttatattggaccagatcgataatcaacagaaaaaacaatatattctccttcattcactcaaggaggttattgtgagacagtctgttgataaagcggatttccagaattccagcgttgagaaaatacttgctttactgttcaaccactgtgaaagcgaggaagaaggtgtaaggaatgttgttgctgaatgcttgggaaaaatggctttgatagagcctgagaaacttgttccagcacttcaggtcaggacaacgagcccagctgcttttacccgtgcaactgttgttactgctgtgaaatattcagtagtggaacgacctgagaaattagatgaaatcatcttccctcagatttcttctttcctcatgctaatcaaagatggtgaccgtcatgttaggcgtgcagctgtctcagctctgagtacttttgctcattataaaccaaaccttattaaaggacttctccctgagttgttaccacttctttatgatcagaccgttattaagaaagaattaatcaggacggttgatcttggtccattcaagcatgttgtggatgacgggctcgagctgaggaaagcagcttttgagtgtgtgtttactctggtggacagctgccttgatcaagttaatccgtcttctttcattgttcctttcctcaaatccggattagaagatcattatgacctgaagatgctttgtcatcttatactctccttactagcagataaatgcccatcagccgtacttgcagtactggattctcttgtggaaccactgcataaaacaataagcttcaagccaaagcaagatgcagtgaagcaagagcatgatcgtaatgaagatatgatcagaagcgctcttcgtgctatatcgtcactggatcgtatcaatggggtggactatagccacaagttcaagggcttaatgggtgatatgaagaggtctgtaccattgtgggagaagtttcagacaatccggaatgagtaa

SEQ ID NO: 1226 - DNA, 1614 bp, Arabidopsis thaliana
atggggaagaacgagaaaacatctctaggtcgagccttagtgaagcaccataaccatatgatccaggaaaccaaggaaaaaggcaaatcctacaaagatcaacacaagaaggttctagaatccgtgaccgaagtcagcgacatcgatgccatcatcgaacaagccgaagaagctgaacgtcttttcgcgattcatcacgattccgcaactcctgttcctatcaatatggatacaggttcgagttcgagtggcataacagctaaagaatggaaagagcaaaggatgagagaagaggctttacatgctagtagtcttcaagttcctcgtagacctcattggacacctaaaatgaatgtggagaaacttgatgctaatgaaaaacaagcttttctcacttggcgacggaaacttgcgagcctcgaggaaaatgaaaagcttgtgttgacaccattcgagaagaaccttgatatctggagacaactttggcgagtgcttgaacgtagtgatttgattgttatggttgttgatgctagagatcctctgttttaccgctgccctgatcttgaggcatatgcacaagaaattgatgagcataaaaaaacaatgcttctggtcaacaaggcagatctgttaccttcttatgtcagggagaaatgggcggaatacttctcccgcaacaatattctgtttgtcttctggtcagccaaagctgctacggctaccctagaaggtaaacccctgaaagaacagtggagagcacctgataccacacagaagacagataacccagctgtgaaagtatatggaagggacgaccttttggatcgattaaaacttgaggctctagagatagtaaaaatgaggaaatctagaggagtttccgcaacttctactgaatcacactgcgaacaagttgtggttggctttgttgggtacccgaatgtggggaagagttcgacaatcaacgcattggtaggtcagaagcgaactggtgtcacatctacccccgggaaaacaaagcatttccagacattgataatctctgaggatctaatgctctgcgattgccctggtttagtcttcccttcattctcaagctcaagatatgaaatggttgcttctggagttcttccaatagaccggatgaccgagcaccttgaagctattaaggttgtggctgaacttgttcctcgacatgccattgaggatgtgtacaacatctctctacctaaacccaaatcctatgaacctcagtcccgcccacctcttgcctcagagcttctaagaacttactgcctctctcgtggttatgttgcctctagtggactacctgatgagactagagcagctaggcagattctgaaagattacattgaaggtaagcttccacattttgcaatgcctccagagataacccgagatgatgaaaacgagacagcggatgacactttgggagccgaaacaagagaaggttcacagactgagaagaaaggtgaagaagctcctagtcttggtcttgatcaagttctagatgatcttagctcgtttgatcttgcaaatggacttgtgtcttccaaaacgaaacagcacaagaagtcacataggaaacaatga

SEQ ID NO: 1227 - DNA, 1197 bp, Arabidopsis thaliana
atggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcaaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactga

SEQ ID NO: 1228 - DNA, 960 bp, Arabidopsis thaliana
atggacggagaagagcttaccgagcaggagactgccttgtacgaccgccagattagggtttggggcgctaatgctcagagaagattgaccaaagctcatatcttggtatctggaattaaggggactgttgctgagttttgcaagaacattgtgctggcaggagttggttcagtgactttaatggatgatcgtttagcaaacatggaggccttgaacgctaactttttgattccgcctgatgaaaatgtttacagtggcaaaactgtggctgagatttgtagtgattcactcaaggatttcaaccctatggtccgtgtttccgtagagaaaggtgatttgtcaatgcttggcactgatttttttgagcagtttgatgtcgtagttataggctatggttctcgtgctaccaaaaaatatgtcaatgaaaaatgtcggaagttaaagaaacgtgtcgcattctatacagtcgattgtagagactcatgtggtgaaatctttgtggacctccaagattacaagtacacaaagcttgaagagatggtggaatgcgaactaaattttccaagttttcaggaagctatatcggtaccatggaaaccgattcctcggagaacagcaaagctctactttgctatgagagtaatagaagtgtttgaagagagtgaagggcgtaaacatggagaatgttcgctactcgatcttgccagagtcttggaaatcaaaaagcaactctgtgaggcaaactctgtgagcgagagccatataccagatattctcttggagagacttatcactggtactactgaattcccgccagtttgtgccattgtgggaggaatattagcacaggtgatcaaagcagtatcaggcaaaggagacccgttgaaaaacttcttctactatgatggtgaagatgggaaaggtgtgatggaagacatttccgactcttttacctcttaa

SEQ ID NO: 1229 - DNA, 1737 bp, Arabidopsis thaliana
atggtgtcgcataagtgtgtagaagaatttggatacgcaagctacctggtaccttccaatgcaagagcacccagatccgcccggaagaggcgcagtatcgagaagaggataagtaaagaagatgataatatgtgtgcaattgatctattggccaccgtagctggacacttgtcatttgagagtgggagttctctcatgtctattgacaaactgattgaagatcatcgtgtaaaggaggaattcccggaggaagaaaaacctctaatgccagtagctttatccccttatcggggatctttgagtccctgcggattcagttctgtgataaatggcaaagtagagaatgaggtagatggttttagttactctggtggtagtgatgcttgtcaagtcgggaacttcagtcaagatgtaaaaccggatatcgatggtgatgcagtagttctggatgcgagacctaatgttgtagttagtttaggtagtagtagtagaaccgaagtgccatcaattgggaactgtgtttcccatggcgttcgggatgatgtaaatttgtttagtagagatgatgatgaaaacttttccaagtacattcacccgcgtgttacaaaacattcacctaggactgtacctcgtattggggacagaagaatcaggaagatattggcttctagacattggaaaggaggttcaaggcattcagatacgaaaccgtggagaaattattacttgcaccagcagaggagctatcctatcaagaaaaggaaaaactttgaccacatatctgattccgttactgatgattaccgtatgcgtactaagatgcatagaggtagtagaaaaggtcaaggggcatcctttgtggcaagcgactcccatgtgaaactacggatcaagtcgttcagggtgcctgagcttttcatagagattccagaaactgctactgttggctcattgaagagaatggtgatggaagcagtgagcactttactgagtgatggacaccgagttggtctgatggttcaggggaagaaagtccgtgacgataacaaaacccttcatcagactggtatctctcaggataactcccacctggactctcttgattttagccttgaacccagctcagaaatgcctcaactgttaactagtcacccgttgggacatgcttgtgaggagctgctacctgtgtgccaagctactaaaatagacaatgtgttggaatctgaccatcatgactcagcattattcccatctgactcattaggcaacaataatgtgacagaagattctaaagctatgatttctgtggcgctcaacgaattgtcttctcaatcacaaccaccttcccggaaatctagaagaagtgaacagcagcagcagcaggctgcacaacgcagaattcgtcgacctttctcagttgctgaagtagaagcacttgttcaagcagttgagaaactcggtactggaaggtggagagatgttaagctttgtgctttcgaggatgctgaccaccgcacttacgtagatctcaaggataaatggaaaacgctggtccacacggctaagatatctccacaacagaggagaggagagccagtgccgcaggaacttctaaaccgagtcttgaacgcccatggctactggacgcagcaacagatgcagcagctgcagcagaatgtgaacaagctggagcaggagacacagtctcaaacgacagagggtctgttacttctctaa

SEQ ID NO: 1230 - DNA, 1155 bp, Arabidopsis thaliana
atggctcttcgtcgctgcttacctcaatattcaacaacttcatcttatctctccaagatctggggatttcgtatgcatgggaccaaggcagcagcttctgttgtagaagaacatgtctcgggggcagaacgtgaggatgaagaatatgctgatgtagattgggacaaccttggattcagtcttgtacggacagatttcatgttcgccaccaaaagttgcagagacggaaacttcgaacagggttaccttagccgttacggcaacatcgagctcaaccctgctgctggaattctcaactatggccagggactaatagaggggatgaaagcgtacagaggagaagacggtagggttcttctcttccgtccagagctaaacgcgatgcgtatgaagataggagctgagagaatgtgtatgcattctccttctgttcatcagtttattgaaggtgttaagcagaccgttcttgcaaacaggcgttgggttcctcctccgggcaaaggctcgttgtatctcagaccgttgttgttcggaagtggagcaagcttgggtgtggctgcagcatcagagtacacgtttcttgtgtttggctctcctgttcaaaactacttcaaggaaggcacagcggcgttgaacctgtatgtggaggaggtgattccacgcgcttatcttggaggaactggtggtgtaaaggcaatatccaattacggtccagtgcttgaagtgatgagaagagcaaaatcaagagggttttcggatgttttgtatcttgatgcagatactgggaagaacatagaagaagtctctgctgctaatatattccttgtgaagggcaatacaatagtgacaccagctacgagcggaacgattctcggagggatcacacgtaagagcataatcgaaatcgcccttgatcttggttacaaagtggaagaacgaagtgttccggtagaagaactgaaggaagctgaagaagttttctgcactggaactgccgctggagttgcttctgttggaagcatcacttttaagaacacaaggactgagtacaaagttggagatgggattgttacacagcaacttcgatctattcttgtcggaatacaaactggttctatccaagacactaaagattgggttttgcagattgcctaa

SEQ ID NO: 1231 - DNA, 1137 bp, Arabidopsis thaliana
atggaagtgaaagctagagctcctgggaagatcatacttgcaggggaacacgctgttgttcatggatccaccgctgtagctgccgccattgatctctacacttacgttactctccgctttcctcttccatcagctgagaacaatgataggcttacacttcagctcaaggacatttccttggagttttcatggtccttagccagaatcaaagaagcgattccttatgattcaagcactctctgccgttctacgccggcttcatgttcagaggagacccttaaatcaattgcagttttggttgaagagcaaaatcttccaaaggaaaagatgtggctctcctctgggatctccacgtttctctggttatacaccagaattatagggttcaatccggctacagtagtcattaactctgagcttccatacgggtctggcctcggttcatcagcagctttatgtgtagctctcacagctgctctccttgcttcttctatttcagagaaaacccgtggtaacggttggtcatctctcgatgaaaccaatcttgagttgctaaataaatgggctttcgaaggcgaaaagatcatccatgggaaaccttctgggatagacaacaccgtcagtgcatacggcaacatgatcaagttctgctcaggcgagataactcggttacaatccaacatgcctctgagaatgctaattaccaacactagagttgggcgaaacacaaaagctctggtctctggtgtgtcacagagagcggtaagacatcctgatgcgatgaagtcagtgttcaacgccgtggattctataagcaaagagctcgctgcgatcattcagtctaaagacgagacctcagttacagaaaaagaagagagaataaaagaactcatggagatgaaccaaggtctgctcctgtcaatgggggttagccacagctcaatcgaggctgtgattctaaccacggtcaagcacaagcttgtctccaaacttacaggagctggtggcggcggctgcgtcctcactctattaccaaccgggacggtggtggacaaagtggtggaggagctcgagtccagcggttttcagtgtttcacggcattgattggtggtaacggagctcagatttgctattga

SEQ ID NO: 1232 - DNA, 1125 bp, Arabidopsis thaliana
atgggtgatgaggcagagatcaaggaacatttaaagccacaagcttcatctgaaacaatagacaagaaacataatgtgaaagggaagaggttatggcagaaagtcaagtatcaattggtggagtttcattcattgcctgcttatttaagagacaatgagtacatcattggtcattaccgatccgaatggccgatcaaacagattcttctcagcatctttaccattcataatgagactttgaatgtttggacgcatttgattgggtttttcctgtttttggcactcactatatacactgcaacgaaagtaccgagtgtcgtggatcttcattcgcttcaacaccgtttacccgatttgttgaggaaaacagatctccacaaacttcattctgagctcatgtctcgccttccttctagtccatctagttggcatgtgatggaccttctttataactgtttgcctgaaagattttctcatggcaactacactgacatgtgtgttctgcattctgtgagggaagatcttgcaaacttgatagctcctttgatcttcaggccaattactcgatggccgttttatgcatttctaggtggtgctatattctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcctggagtttcgggtggtgagggcgtctctgttctttggaatgggattctctggcttagctccgattcttcacaagctgatcatcttttgggaccaacctgaagcccttcacatgacaggttatgagattttgatgggtttgctttatgggttaggagctgtggtttatgcaactaggatcccagagagatggatgccgggtaaattcgatatagcaggacatagccatcagttgtttcatgttctggttgttgctggtgcgttaacgcactatagagctgggctatga

SEQ ID NO: 1233 - DNA, 1227 bp, Arabidopsis thaliana
atgcatccgattaatgcggtggttgcggcgaggatgttagccggaatcagtcaatctaacgccttacaaagcgaggcgattccgtttggatcgcttgagtggatcacttacgccggaatctcttgtttccttgttctcttcgccggaattatgtctggtctcactttagggcttatgtctctcggtctcgttgagctcgagattctccaacggagtggtactccaaaagagaagaaacaatctgctgcgatttttccggttgttcagaaacagcatcagcttttagtgactctgcttctgtttaatgctcttgctatggaggggcttcctatatacttggataagatattcaatgagtatgttgctattattctatccgtcactttcgttctattcgttggagaggttattcctcaagctatatgtactagatatggactagcagtgggagctaatttggtctggcttatgttggattgggtgttgggacacaatgaccctttatttaggcgagctcagttaaaagctcttgtgtccattcacggtgaagctgctggaaagggaggtgaacttacacatgatgagactacaattataagtggagcacttgatttgactgaaaagaccgctcaagaagccatgacaccaattgaatcaacgttttccttggatgtaaattcaaagttggaccgggttccggctaatatgcctctgtatgatattctgaatgagtttcaaaaagggagcagtcacatggctgcagttgtgaaggttaaggggaaaagcaaaggtcatccttcaactttgcatgaagaaaatagcggtgaaagcaacgtctcaagtaacaactccgagttgactgcacctcttttactaaagcgagaaggaaaccacgacagtgtcattgtccgcatcgacaaggctaatggacaatcgttcatcagcgaggccggcagacaggggttctcacatacttcagaggagattgaggatggagacgaggagattgtggatgaaacagatgagtatatagacgtgcataaaaggattcgtgtggcaactgtagcagcagtggccatttcatcattagcgagagcaccttcaggccggaggttacttggcccaaaaggaagtggaggaccaaaaacgccaaaggcatcttctactcccaaaccggatgataaactgatgggaaccatgaccggtcctcctcaaggaaacaactga

SEQ ID NO: 1234 - DNA, 3771 bp, Arabidopsis thaliana
atggcttcttcttcttcttctcctagtagccggagatacgacgttttcccaagcttcagtggggtagatgttcgcaaaacgttcctcagccatctaatcgaggcgctcgaccgcagatcaatcaatacattcatggatcacggcatcgtgagaagctgcataatcgccgatgcgcttataacggccattagagaagcgaggatctcaatagtcatcttctctgagaactatgcttcttcaacgtggtgcttgaatgaattggtggagatccacaagtgttacaagaaaggggaacaaatggtgattccggttttctacggcgttgatccttctcatgttagaaaacagatcggtggctttggcgatgtctttaaaaagacatgcgaggacaaaccagaggatcagaaacaaagatgggttaaagctctcacagatatatcaaatttagccggggaggatcttcggaacgggcctactgaagcgtttatggttaaaaagatagccaatgatgtttcgaataaactttttcctctgccaaagggttttggtgacttcgtcggaattgaagatcatataaaggcaataaaatcaatactttgcttggaatccaaggaagctagaataatggtcgggatttggggacagtcagggattggtaagagtaccataggaagagctcttttcagtcaactctctagccagttccaccatcgcgctttcataacttataaaagcaccagtggtagtgacgtctctggcatgaagttgagttgggaaaaagaacttctctcggaaatcttaggtcaaaaggacataaagatagatcattttggtgtggtggagcaaaggttaaagcacaagaaagttcttatccttcttgatgatgtggataatctagagtttcttaagaccttggtgggaaaagctgaatggtttggttctggaagcagaataattgtgatcactcaagataagcaacttctcaaggctcatgagattgaccttgtatatgaggtggagctgccatctcaaggtcttgctcttaagatgatatcccaatatgcttttgggaaagactctccacctgatgattttaaggaactagcatttgaagttgccgagcttgtcggtagtcttcctttgggtctcagtgtcttgggttcatctttaaaaggaagggacaaagatgagtgggtgaagatgatgcctaggcttcgaaatgattcagatgataaaattgaggaaacactaagagtcggctacgataggttaaataaaaaaaatagagagttatttaagtgcattgcatgttttttcaatggttttaaagtcagtaacgtcaaagaattacttgaagatgatgttgggcttacaatgttggctgataagtccctcatacgtattacaccggatggagatatagagatgcacaatttgctagagaaattgggtagagaaattgatcgtgcaaagtccaagggtaatcctgcaaaacgtcaatttctgacgaattttgaggatattcaagaagtagtgaccgagaaaactgggacagaaactgttcttggaatacgtgtgccacccacggtattattttcgacaaggccgttattagtaataaacgaagaatcgttcaaaggcatgcgtaatctccaatatctagaaattggtcattggtcagaaattgatctacctcagggcctcgtttatttgccccttaaactcaaattgctaaaatggaattattgtccattgaagtctttgccatctacttttaaggcggaatatctagttaacctcataatgaagtatagtaagcttgagaaactgtgggaaggaactctgccccttggaagtctcaagaagatggatttggggtgttccaacaatttgaaagaaattccagatctttctttagccataaacctcgaggaattaaatctttctaaatgcgaatctttggtgacacttccttcctcgattcagaatgccattaaactgaggacgttatattgttcgggggtgctattaatagatttaaaatcattagaaggcatgtgtaatctcgaatatctatcagttgattggtcaagtatggaaggcactcaaggcctcatttacttgccacgtaaactcaaaaggctatggtgggattattgtccagtgaagcgtttgccttctaattttaaggctgagtatctagttgaactcagaatggagaatagtgaccttgagaagctgtgggatggaactcagccacttggaagcctcaaggagatgtatctgcatggttccaaatatttgaaagaaattccagatctttctttagccataaacctggagagactatatctttttggatgcgaatctttggtgacacttccttcctcgattcagaatgccactaaattgatcaatttagatatgagagattgcaaaaagctagagagttttccaaccgatctcaacttggaatctctcgagtacctcaatctcactggatgcccgaatttgagaaatttcccagcaatcaaaatgggatgttcatactttgaaattctgcaagatagaaatgagatcgaggtagaagattgtttctggaacaagaatctccctgctggactagattatctcgactgccttatgaggtgtatgccttgtgaatttcgcccagaatatctcacttttctcgatgtgagcggctgcaagcatgagaagctatgggaaggcatccagtcgcttggaagtctcaagaggatggatctgtcagaatctgaaaacctgacagaaattccagatctttcgaaggccaccaatctgaagcgtttatatctcaacgggtgcaaaagtttggtgacacttccttctacaattgggaatcttcatagattggtgaggttggaaatgaaagaatgcacagggctggagcttcttccaaccgatgtcaacttgtcatctcttatcatcctcgatctcagtggttgctcaagtctgagaacttttcctctgatttcaactagaatcgaatgtctctatctagaaaacaccgccattgaagaagttccctgctgcattgaggatttaacgaggctcagtgtactactgatgtattgttgccagaggttgaaaaacatctccccaaacattttcagactgacaagtctaatggtcgccgactttacagactgtagaggtgtcatcaaggcgttgagtgatgcaactgtggtagcgacaatggaagatcatgtttcttgtgtaccattatctgaaaacattgaatatacatgtgaacgtttctgggatgagttgtatgaaagaaattccagatctatctttagctataaagatgaggatggcgaccctgaagaccttccatctaaattgactttcaacgatgtggagtttaagttttgttgctccaataggatcaaagaatgcggtgtacgactcttgtatgtctctcaagaaacagagtacaaccaacagactacgagaagcaagaagcggatgcggatgacatcgggaacatctgaagaatatatcaacttagccggtgaccaaattgtagccgacacaggattggccgctctaaatttggagctttcgttagggcagggagaaccatcatcatcgacatctctagagggggaagctttgtgtgttgattacatgataactgaagaacaagataaatgtatcctgttcctggtaactgaagcatcttatcattcttttttggtctgttttaggataacttgggatcgaccataa

SEQ ID NO: 1235 - DNA, 1125 bp, Arabidopsis thaliana
atggtgtctttaggttactgcttgaaggagaagaagacatgcgtgagatgggtagagatatacttcgatgactgtctctgtaacttaaacgacgacgtttcattcgcacttggaatcgctagcctcctctgttggggagtcgcagagattcctcaggtcatcactaacttccgtacaaagtcaagtaacggtgtctctctctccttcctcctcgcttgggtcgccggtgatatcttcaatctcgtcggttgtcttcttgaaccagctactttgccgactcagttctacacagccttgctttacacagtgagcactgtagtattggtgatccagactatttactacgattacatctacaaactttgtagacatagacgtaccaagatttgtcaaaaggatgaggaagatgaagagaagagaccattgaaaccaccaaagacgatgggatctgctatttccatcccaggaggatcttacaaagattcttctcggagagagttctattacacgtcggcgagatcgttggccggaagtggcacacctcccttaagaacatcgtattttcgagtggctaagagtggccttcggctctggcaatcgacaatgatggttcgtcatcggacgaagatgagacaatgtcgacgtgcaggttttggaacgtttttggctgcatcggctagtcttccgcttcaggcaaagagcttagcggaaaaatatgcacatgcttcaagcagacggcttctaaacgaaagaatagtagagcatagcgcgttgggacaatggttgggatggctaatggccgccatttacatgggcggtcgcattcctcagatttggctcaacatcaaaagaggaagcgtcgagggtttgaatccactgatgttcatcttcgcgctagtagccaatgcaacatatgttggtagtattcttgtccgaacaactgaatgggacaacatcaaaccaaaccttccttggttgcttgatgctattgtctgcgtcgtactagatctatttataatactgcagtatatctactacaagtattgcaggataaagagcttggaaagcagagaagaagacgcctatggagactatgtggaagcaagcaaaacttttgtttcgtga

SEQ ID NO: 1236 - DNA, 1251 bp, Arabidopsis thaliana
atgaagagtgtgttgcgtattgcggcggcgatattctggctttggctgtttatcgtgttaggtgtgattgggagtgggaatgtgagagatacagacgatgagatctcgttactcgaaagtcaattggtggtgacatctccgtcgcagcttcttatggtgcctctcactttgattcaggctgctgcctccaaaggagctgtgtgcctggatggaacactacctggttatcatctacaccctggttctggatcaggagctaaccggtggctcatccaactcgagggtggaggatggtgcaacacacgtaggagctgtatcttccggaaaaccactcgccgtggttcatcaaatcatatggagaaagttttggccttcactggaatattgagcaataaatctaatgagaatcctgacttcttcaactggaacagagtcaaattgcgttactgcgatggtgcctctttcaccggcgatagtcaggatgagagctcacaactttactatagaggacaacgaatctggcattcagctatggaagaactactctctaaaggcatgcaaaaagcagaacaggctctactttctggatgttcagctgggggattagcttccatcctacactgcgatcagttcaaggaactatttccgggcactacgacagtgaaatgcttaagtgatgctggaatgtttatggatgcagtggatgtctctgggggccactcgctccggaaaatgttccaaggtgttgttacagtacagaacctccaaaaggaactgtccactgcttgtacaaagcatttggatccaacttcgtgcttctttccccagaacttggtttcaggcattaagactccaatgtttcttctcaatgcagcatatgacgcttggcaggtacaagagagtttagctccaccatcagttgacctaagcggctcttggaaggcatgcaaatctgatcactcgcattgtaattcatctcagatccagttcttccaagacttcaggactcatatggtagatgctgtaaagtctttcgcgacatcgacacataacggtgtgttcataaactcatgcttcgctcactgccaatctgaaagacaggacacttggtatgcaccagattctcctactcttcatggcaagaccgttgctgaatctgttggtgattggtactttgacagaacaacagtgaaagccattgactgtccttacccctgtgacaaaacatgtcacaatctcatcttcaagtga

SEQ ID NO: 1237 - DNA, 1026 bp, Arabidopsis thaliana
atggataattcagctccagattcgttatccagatcggaaaccgccgtcacatacgactcaccatatccactctacgccatggctttctcttctctccgctcatcctccggtcacagaatcgccgtcggaagcttcctcgaagattacaacaaccgcatcgacattctctctttcgattccgattcaatgaccgttaagcctctcccgaatctctccttcgagcatccttatcctccaacaaagctaatgttcagtcctccttctctccgtcgtccttcctccggagatctcctcgcttcctccggcgatttcctccgtctttgggaaattaacgaagattcatcaaccgtcgagccaatctcggttctcaacaacagcaaaacgagcgagttttgtgcgccgttgacttccttcgattggaacgatgtagagccgaaacgtctcggaacttgtagtattgatacgacgtgtacgatttgggatattgagaagtctgttgttgagactcagcttatagctcatgataaagaggttcatgacattgcttggggagaagctagggttttcgcatcagtctctgctgatggatccgttaggatctttgatttacgtgataaggaacattctacaatcatttacgagagtcctcagcctgatacgcctttgttaagacttgcttggaacaaacaagatcttagatatatggctacgattttgatggattctaataaggttgtgattctcgatattcgttcgccgactatgcctgttgctgagcttgaaagacatcaggctagtgtgaatgctatagcttgggcgcctcagagctgtaaacatatttgttctggtggtgatgatacacaggctcttatttgggagcttcctactgttgctggacccaatgggattgatccgatgtcggtttattcggctggttcggagattaatcagttgcagtggtcttcttcgcagcctgattggattggtattgcttttgctaacaaaatgcagctccttagagtttga

SEQ ID NO: 1238 - DNA, 1323 bp, Arabidopsis thaliana
atggagcgagacgaagaagcgagtggaccgatgatggagatgtgcactaacggcggcgaagagacgtctaatcgaagacctatcataagtggcgaaccgctcgacatcgaggcctacgcggctctctacaaaggtcgcacgaagatcatgcggcttctcttcatcgctaaccactgcggaggaaaccacgcgcttcagtttgacgcgttgaggatggcttacgatgagatcaaaaagggtgagaatacgcagttgttcagagaagtggtcaataagattggcaacaggcttggggaaaagtatgggatggatcttgcttggtgtgaggccgtcgatcgtcgtgctgaacagaagaaagtaaagctggagaatgagctcagttcttatcggacaaatttgatcaaggaaagcatcagaatgggttacaatgactttggagatttctattacgcatgtggtatgctcggagatgctttcaagaactatatccgaacacgcgactactgcactacgacaaagcacatcattcacatgtgtatgaatgcgattcttgtcagcatcgaaatgggtcagtttactcatgttacaagctatgtgaacaaggcagagcagaatcctgaaacccttgaacctatggttaatgcaaaactgcgatgtgcatctggattggctcatttggagttgaagaagtacaagctagctgctcgtaagttcttagatgttaacccagaacttggaaattcctataatgaagtcattgctcctcaagatattgccacctatggtggactctgtgccctggcaagctttgatcgatcagaattgaaggcattcattgacaatatcaacttccggaatttcttggagctagtgcctgatgtgagggaacttatcaacgatttctattcaagccgctatgcttcctgcctggaatatcttgcaagtctcaaatcgaatctgctgctggacatccatcttcatgatcacgttgacacactatatgatcagataaggaagaaggcactgatccagtacacattgccatttgtctctgttgatttgagcaggatggccgatgcattcaagactagcgtctctggtctagagaaagaacttgaagccttgatcacagacaaccagattcaggcaaggattgattcacacaacaaaatcctctatgcaagacacgcggatcagaggaatgcaactttccaaaaggtacttcagatgggaaacgaattcgatagagatgtcagggcgatgctgttaagagccaacctcctgaaacatgagtatcatgccagatcggcaaggaaactttga

SEQ ID NO: 1239 - DNA, 1617 bp, Arabidopsis thaliana
atgttggattctctagtgtcgaaactgccttcgttatcgacatctgatcacgcttctgtggttgcgttgaatctctttgttgcacttctttgtgcttgtattgttcttggtcatcttttggaagagaatagatggatgaacgaatccatcaccgccttgttgattgggctaggcactggtgttaccattttgttgattagtaaaggaaaaagctcgcatcttctcgtctttagtgaagatcttttcttcatatatcttttgccacccattatattcaatgcagggtttcaagtaaaaaagaagcagtttttccgcaatttcgtgactattatgctttttggtgctgttgggactattatttcttgcacaatcatatctctaggtgtaacacagttctttaagaagttggacattggaacctttgacttgggtgattatcttgctattggtgccatatttgctgcaacagattcagtatgtacactgcaggttctgaatcaagacgagacacctttgctttacagtcttgtattcggagagggtgttgtgaatgatgcaacgtcagttgtggtcttcaacgcgattcagagctttgatctcactcacctaaaccacgaagctgcttttcatcttcttggaaacttcttgtatttgtttctcctaagtaccttgcttggtgctgcaaccggtctgataagtgcgtatgttatcaagaagctatactttggaaggcactcaactgaccgagaggttgcccttatgatgcttatggcgtatctttcttatatgcttgctgagcttttcgacttgagcggtatcctcactgtgtttttctgtggtattgtgatgtcccattacacatggcacaatgtaacggagagctcaagaataacaacaaagcatacctttgcaactttgtcatttcttgcggagacatttattttcttgtatgttggaatggatgccttggacattgacaagtggagatccgtgagtgacacaccgggaacatcgatcgcagtgagctcaatcctaatgggtctggtcatggttggaagagcagcgttcgtctttccgttatcgtttctatctaacttagccaagaagaatcaaagcgagaaaatcaactttaacatgcaggttgtgatttggtggtctggtctcatgagaggtgctgtatctatggctcttgcatacaacaagtttacaagggccgggcacacagatgtacgcgggaatgcaatcatgatcacgagtacgataactgtctgtctttttagcacagtggtgtttggtatgctgaccaaaccactcataagctacctattaccgcaccagaacgccaccacgagcatgttatctgatgacaacaccccaaaatccatacatatccctttgttggaccaagactcgttcattgagccttcagggaaccacaatgtgcctcggcctgacagtatacgtggcttcttgacacggcccactcgaaccgtgcattactactggagacaatttgatgactccttcatgcgacccgtctttggaggtcgtggctttgtaccctttgttccaggttctccaactgagagaaaccctcctgatcttagtaaggcttga

SEQ ID NO: 1240 - DNA, 492 bp, Arabidopsis thaliana
atggcggaagaacacagacttcaagaaccacgattatgtgctaacaattgtggcttcttcggaagcacagctacacaaaatctctgttccaaatgttttcgagatcttcaacatcaagaacaaaactcttccaccgccaaacatgctcttacccaatccttagccgccgttggcgctgctgcgtcttcctccgtgtcgccaccgcctccgcctccagctgattcgaaagaaatcgttgaagcgaaatcagagaaacgagcggcggctgaaccggaggaggcggatggtccgccgcaagatccgaagcggtgtttgacttgtcggcggcgcgtgggaatcacggggtttcggtgtaggtgtggtttcgttttctgcgggacgcataggtacgcggagcaacatgaatgttcgtttgatttcaagcggatggggaaggataagatcgctaaagcgaatccgattgtgaaagctgataagcttgagaagatttga

SEQ ID NO: 1241 - DNA, 1929 bp, Arabidopsis thaliana
atggacttcttcacttcaagcaaagctaagaaagatagcaaaaaatcatcaggactctttggcaagaaaactgtcagcaagagcactccgggcagccctgctcatccccccggcgctagatccccgcccccatcgtatctttcaaacaaaagagccgaaacagagtacgatttccccatgtccaatgaacaaagaccatactggaaacagcctgcctctgaacgcgtccccaactcccaccctaggcctcccgtgtatggatacggcacgcccgaccatcgtcgagaccacggtagagaaagaatggaggccatgagttatgagccagagaccaacgctccttccagcccatatcatccagctggaaaccgcacgcctgaacgtcctaggaaatcaaccgagtatcgtcgagaacaccaggatcgaatgtatgaagcagatacccgaagcaatgcgagcccatttcacccattcagaagcccttctccatctccattccacacgcctgatcgccgcagagaccactacgacatgtatgagcctgaggccaacaccatgctgcagaatagcgctccagggagcccattccatccagctggaagccgctctccaccaccatacagaacgcctgatcgtcgtagtaactatgataaagagcaatttgaggacctgtacgagcaagatggtgatgtcacaccgcgaaacagctctccaccgagcccgtttcatccagcagcatacaaaacggtcggtactcaaaaactcgatactggcttctttttggggataagtaaatcaaattctctttctagtgagtcacttagactgacaatagaatatgttcttgttatgctgcagtctgatcaacgtagtaaccatggtaaagagcaaattgaggacttttatgagcaagatgacgatgtaacaccacgaaacagctctccacctagcccattgcatccagcagcaagccattcaccaccaccaccacaaccatacagaacgcctgaccatcgtagaagccaccaggataacgaggatttcgaggcaatgtatgagctagatggcgacttaatacaccagaagagcgctcctccgagtcccgttcatggaccatactattcatccagcgacgacgataatcactccacctacctctatccagaaatccgcagcccacttcgttccaggatcgtatccgagaacagcacgatagttgcggccgagacctatgagcaagacaagcagttcgagccgccggagctgcctgacgagtcacaaagcttcacaatgcaggagattaccaaaatgcgaggactcaagaactacgaaagcggcaaggaagagagtcaatcaatgatatccgaggcttacgtatccgtcgcgaattacagagtgaggcagagcgtgtcggaaaccctgcaggcgatcatcgacaagcacggcgacatcgcagcctcctcgaagctgcaagcaatggcaactcggtcttattacctggaatccctagccgctgtggtgatggagctgaaaaagacggttctgagggatttgacgaaaacgcgcgtggcggagatcgcggcggtggtgaaagacatggagtcggtgaaaatcaacgtgtcgtggctaaagacagcggtaacggaactggcggaggcggtggagtatttcgggcagtacgacacggcgaaggtggagaaagaggtgtgcgagagagatctgacggcgaaaaagggggagatggaggagatgacggcggagctggtgaagagggagaaggaaatcaaagaatgcagagagaaggtgacggtggtcgcagggaggctagggcagctggagatgaaaggttcgaaattgaacaagaatctcgacctcttccagtccaaagtccacaaattccaaggagaagccgtccttctccacctttag

SEQ ID NO: 1242 - DNA, 2526 bp, Arabidopsis thaliana
atggaagaagcaacaaaagtgagttcagacgtccctcaagctaagttcttggagaagattaagtattgtgacgatttgttacaggaagtgacaaaggaagatactgtcatggagaaagaagaggaggatacaatatttgatggtggatttgtaaaagttgagaaagaagggatcaacaaaaagtatgatgatgatgatgatgagaaagcagagaagcagttgaagtctttagaagatgctttgcagttacatgatgttaaacataaggaactaactgaagttaaggaagcttttgatgggttaggtctcgagcttgagaactcgagaaagaagatgatagagttggaggacaggataagaatttctgctttagaggcagagaaacttgaagagcttcaaaagcaaagtgcatcagaacttgaagagaaactaaagatttcagatgaaagatactccaaaacagatgctcttttatctcaagctttgtcccaaaactctgttcttgagcagaaactgaaatctttggaggaattatccgagaaagtatctgaattaaaatctgctttgatagtggctgaagaggaaggaaagaagtcgagcattcagatgcaggaataccaagaaaaggtaagtaaattggagtcatctttgaaccaatcatcggcgagaaactcagagcttgaagaagatttgagaattgctttgcagaaaggtgcagagcatgaagatattggaaatgtgagtactaagcgcagcgttgaactacaaggtctattccaaacatctcagttaaaactagagaaagcagaggaaaaattgaaagacttggaagcaatacaagtgaaaaactcgagccttgaagctactttaagcgttgcaatggagaaagagagggacttgtcagaaaatcttaatgctgtgatggagaagctgaaatcctctgaagagagacttgagaagcaagcaagagaaatagacgaagctaccacaagaagcatagagcttgaagctttgcataaacactcagagcttaaagttcaaaagacaatggaggattttagtagcagagatacagaggccaagtctttgactgagaaatcaaaagatctcgaggagaaaataagagtatatgaagggaaattggctgaagcatgtggtcaatcactgtctttgcaagaagaacttgatcagtcgtctgcggagaatgagttactagcagatacaaacaaccagctcaagatcaagattcaagaacttgaaggatatctggattctgagaaggaaaccgcaatcgaaaagttaaaccagaaagacacagaagctaaagacttgattacaaagttgaaatcccatgaaaacgtaatcgaggagcacaaaaggcaggttcttgaagcatctggagttgctgatactagaaaagtggaggtagaagaggctttgttgaaacttaacactcttgagtctacaatcgaagagcttgagaaagagaatggagatttggctgaagtgaatataaagctgaaccagaaactagcaaatcaagggtcagagaccgacgattttcaggctaagctctctgttttagaggctgagaaatatcaacaagctaaagaacttcagataaccatagaagatctaacaaaacagcttacttctgaaagagaaagactacgatcacagatctcttcccttgaagaagagaaaaaccaagtcaatgagatatatcagagcacaaagaatgagctcgtaaagcttcaagcacaactccaagtagacaagtctaaatccgatgatatggtatcccaaatcgagaagctcagtgccttggttgctgaaaagtcggtgttggagtcaaaatttgaacaagtagaaatacatttgaaagaagaggtggaaaaagtagcagaattgacctcaaaattgcaggaacataaacataaggcgagtgaccgagatgtgcttgaagagaaagcaattcagcttcataaagagcttcaagcttctcacacagccatttctgaacagaaagaagccttgtctcataagcattcagagttggaagctactttaaagaaatcacaagaagagcttgatgctaaaaaatctgtgatcgttcatctcgaatcgaagttgaatgagcttgaacagaaagtgaagcttgcagatgctaaatctaaggttagccatataaaacataaccacatcttcaaaccaaatttgcaggaaactgagtctacgggaaaagaggaagaagtagaagtgaaatctcgagacagtgacttatctttttcaaatccaaagcaaactaagatcaagaagaacttggatgctgcttcgtcttcagggcacgttatgattcagaaagctgaaacatggcatctcatgacattgaagatcgcacttggagtggctcttgtctctgtcattctaggtatcattatttgtttgtttgattgtttcgtggttctaagaatttttgcttctaccatacttttatttcttattgaccaagcaagaccacactag

SEQ ID NO: 1243 - DNA, 1251 bp, Arabidopsis thaliana
atgggattaaacgagcaacaaaatgttccaagtcagaggaagatcatagtttttatagtcttagcttttataccaatagctctgtttcgactctgttttaataatccattctcctccattaaagacacctctcttcaagactctgcagctaacgttgtgatcactagcttctcttcatcttctcaagaagaagaaagccaagagagttttgatcatatacaagatgaacctttatgcgattatacgcaagggaactgggtcagagacgagattggtccactctacaatggttcaacatgtggaacaatcaaggatggtcagaattgtttccgccatggtagacctgattccggttatctttactggaaatggaaaccaaacgaatgcgatataccgagattcgactcgaaccggtttcttgatcttatgagagataagcatctagcttttatcggtgattccatggctagaaatcagcttgagtctcttttatgcttgctctctaccgtctctagccctgatctcgtctatagaaacggagaagacaataaattcagaagatggcgtttcgagtcacacaacgtcactgtctcggtttactggtccccgtttttggtggccggtttagagaaatcgggaaacttggaccacaatgtattgcacatagaccgcgtggatgagagatggggcaatgatttagaacgttttgatacggtcgtagtctctgtgggacattggtttctgcatccagcggtttactacgagtctggttcggttttgggatgtcattcttgtgaaacaagtaactgtaccgaggtagggttttatgatgtatttagaaaagcgataagaacaacgttgagagcggttgctggaagtggtcgtgaggtgatcttgacgacattttcgccatcacattttgaaggacggccttgggacagtctcggcgcatgtaacatgaccaagccgtacgaagggaaggttttagaaggtctggacttggacatgcgcaaaatagaaattgaggaatatacggcggctgcggctgaggtgaggttagaggtgttggacgtgacggctatgtcggtactgagaccagacggacatcctggtccgtacatgtacgcggacccgttcaagaacggtgtaccggagagaattcctaatgattgtttgcattggtgtctacctggtcctgtcgacacgtggaacgagatcatgatcgagatgttgcggcgatggaaggtttaa

SEQ ID NO: 1244 - DNA, 630 bp, Arabidopsis thaliana
atggcttcaaaaaaacctgttaatcgcccatccgtgaggcatgcgagtcataaccatccgctgcgtgtctttaaagctcgagacgaagatgaggtcgtctgctctggatgtgagctcgatctaacgggacaagctttcaagtgtataaatgagacttacacgtgtgatgcatgcggtgagtacggatccggattcacttacaattgttctgaatgtcaatatgatcttcatgtcggatgtgcgtttatcccggagaccgtggagcgggaagatcacgaacacccactcactcttctctacaatacaccatgcaaaggctgtgaggacggtgcgatgttcatatgtaatgtttgtgaagaagatatgtcggagaatctatgggtttattattgcaaagaatgtgattatgggacgcatgtgcattcttgcgcggtttatgaagacgatgagccaaataatagaggaggagaagaaggagaagcgatgagctcggcggtttcgaggatgaagtcgttgatgaaggctgaggatgagttggcggcggtacagctcgaggcacgtatgaagcgagacgctaataatgctatactcggtttatatgctgaaccaaagcggagatattattggtga

SEQ ID NO: 1245 - DNA, 1452 bp, Arabidopsis thaliana
atggagaacggtgagaaagcagctgagactgtcgttgttgggaactatgttgagatggagaaggatggtaaagctttagacatcaaatctaagctatctgacatgttttggcatggtggctctgcttatgatgcttggttcagctgtgcttccaatcaggtggcacaagtgctgttgacactgccatactcgttctcacagctggggatgctctcagggattctgtttcagctcttttatggcatcttaggtagttggactgcttacctcatcagtattctctatgttgaatacagaaccagaaaggaaagagagaaagttaacttcagaaaccatgtcattcagtggtttgaggttcttgatggattgcttgggaagcattggaggaatgttggtttagcctttaactgcaccttccttctctttggatctgtcattcaactcatagcttgtgccagcaacatatattacataaatgataatctggacaagaggacatggacatacatatttggagcatgttgtgcaaccacagtctttattccttccttccacaactacaggatctggtcttttcttggactcttgatgaccacttacactgcttggtacctcaccattgcctctatcctccatggacaggtagaaggagtgaagcattcaggaccaagcaagctggttttatacttcacaggggccacaaacattctttacacattcggtggacatgctgttactgtagagataatgcatgctatgtggaaacctcagaagttcaagtccatatacctgtttgcaacactctacgtgctgacgctaacgctgccttctgcgtctgcggtttattgggcgtttggtgatttgcttctaaaccattcaaacgcatttgctcttctcccaaagaatctttaccgtgactttgcagttgtgcttatgctcatccatcagttcatcacctttggttttgcttgcacgccactctactttgtgtgggagaagctaatagggatgcatgagtgcagaagcatgtgtaaacgagccgctgcgaggctccctgtcgttatacccatttggtttcttgctatcatattcccgttctttggtcccattaactcaaccgtaggatctcttctcgtcagcttcactgtctacatcatcccagcactagctcacatcttcaccttccgctcatccgccgcacgtgaaaacgctgtggagcagccaccaaggtttctaggacgatggactggggcattcacgatcaatgccttcatagttgtgtgggtgttcattgttggattcgggttcggtggttgggctagtatgatcaattttgtacaccagattgacacctttggcctcttcaccaaatgctaccaatgcccaccaccggttatggtctcacctcctccaatcagccatcctcacttcaatcacactcacggcctttga

SEQ ID NO: 1246 - DNA, 687 bp, Arabidopsis thaliana
atgtcggttcttgacctccctgagctggctcttgactgcattcttgaccttcttccaccctctggactctgcagcatggctagggtttgtagctccttgagggagagatgtgttagtgatcatctatgggagaaacatttgaagaccaaatggggcaaaatccttggccctgctgctcacagagagtggcaatgctatatctcctcttccacatatcatcttgattctcctcatcatcaaactgggaatcttggttttgccaaaatcatctctctgatccgatctctttcatccgttttccgagaggataaacaaaggaggggatatgcatcttctctgccacttgattccagcatgagctgctacctctcccttgaaacaggtcgtttttggttcccagctcaagtttacaaccgtgagaatggacatgtagggttcatgttgtcatgctatgatgcggagctcagctatgatactcacacggatacgttccaagccaggtatccaccacatggtagacgagcatctgcgattgaaaagggtgtgacatgggatagaataagagcagctcccattgatgcatcacctcatcttctccatgtatcagattctttaaaagagttgaaacctggagatcacatcgaaatccagtggagaaggaacaaagagttcccatatggtaaataa

SEQ ID NO: 1247 - DNA, 537 bp, Arabidopsis thaliana
atgaagagagaaagatctgatttcgaagaatccctcaagaatattgacattgctaaatgtctgatgatactagcacaaacctccatggtcaaacagatcggtttgaaccaacataccgagagccatacaagcaaccaattcgaatgcaaaacatgtaacaagagattttcttcgtttcaagcccttggtggccaccgggcaagccataagaagccaaagctcaccgttgagcagaaagatgtgaaacatcttagcaacgattataaaggaaatcattttcacaagtgttccatatgcagtcagagttttgggaccggacaggctttaggtggtcacatgagacggcataggtcaagcatgacggtcgagccatcgttcatctctccgatgattccatccatgccggttttgaaacgatgcggtagtagtaagaggattttgagtttggatttgaatctgactccgttagagaatgatcttgaatatatctttgggaagacatttgtcccaaaaatagatatgaagttcgttctttag

SEQ ID NO: 1248 - DNA, 1434 bp, Arabidopsis thaliana
atgttagtttttgattcgacggaaacagggaggaatcgatctctggttcgagctctagttagtcggcgttacttcgcttcatcgccggaggaaatcgcaaagagaaattacgccaacgatctgtcggaatacaacaccgctgtcaactccgtcacagctcagcgcaggcactatttgctgagggatgtttatgatgatatgaagcttgatggtgtgcagcctacagctgatatcttccattcatttgtcgtgggaacgatgaagggtgctcggttaagcgatgcgttctttttccgggaagaaatgaaagccatggggattgctccagatgtgaacttgtacaactttttaatttccacatgtgggaaatgcaagaatggaaaggaggcaatccgagtctatgacgagatgaagagatatgatgtaaaaccaaatggacagacctttgtctgcctgctcaatgcctgcgctgtttctggccagttagatcttgtatatgcgatagttcgggatatgactgctgctggtgttggtttgaaccagttctgctatgcgggactcataactgcacacttaaacaagcagcccagaccagataatctttctactaagattctcgagtttgtggagcagtcaaaaggctggtcagcaattgattcatcaaggaagagtgcagaagatgtgatgtttagcatcagtgaagaagagctgtacaatattccaaccgctgattattcccacaggaccaggtttctgcagaggaatttgactgtgtatcacgtagcattcagtgctctcgctgatctgaaggatgtaaaaattccaaaatgtcctgaacttagtgggaataaagataaagataagaaaagccagtttcggagtttatttttgcatcttaccagcaattcctcatggcaggcaacggaagctcttcttgagatgcttaagaaagacggaaaagatactgacacttactgcatgctacaaatcatgaggtgctatctacattcgcaagactttgagaatggtctcaaactgtttcaagattacatgagcgcagacaaaatccctgccatggaactatacacgacgcttatagaaggagctatgacaggatacaccgataatggaatgaagattgctcaggacactctgatccaaatgaacgaacgcaatttcttcttagacccaagaactggaagcaatctgttactcaaagccgctggtgaaaagacgggagggtacacagttgcaaatatgatatgggatctgatgctagctcggaatattctaccaacactagctgctgttgaagcttactacaagggcttgaaagaacgcgaaataccagaggatgatccgagactgatgttagtgacgcgaacatacaataacttgcggcttagggaagggacattacctaataggcgttaa

SEQ ID NO: 1249 - DNA, 1095 bp, Arabidopsis thaliana
atgtgttttttgatgcaggaatttgatttggtggttagattttgcaaggatgtggaaacaagagggcaggcgggatatgttgattttggacgatttgacccgttaagctactttgtttctagttctgaaaatttcgatttcgtgcaagttaatattatttgtgggaactgtagtgatggacggtgtaaaggtggacttggatgcatatgtagtgtcacccaagattcaacttgtagagttactgtcgacttggctattccatgtgagaaacctggtccgcgggtgtttaagggatttacagtcggtttgcatcctcgctcatgggaaattatctataatgggatgacacagtttggatttgataagccccgtcgtgagtttagcttcaagaccgagcagactcatctcactctctatatgactgcaattgcttctctttcaacattggtagggaagcctatcatcaaggtttccccagagaatggtcttgatgttaagatagctggttcttccttgactgggaatcatccaacaactttatcaccgtcaactttagtactggattggaattgtgagaaatctcggcgaactccatatgaagtcaatgtcaccatcccagtggatggttatgatcctgttcagtttttccttacaaaactctgcgaatacaatcaaggtaacgaaggaggatcagcgaaaggatgggctatatttggagttttttcctgcgtattcctcgttgcatctgcacttttctgctgtgggggctttatttataaaacaagagtagagcgtgtgcgtggaactgatgcattgccggggatgtcacttctatcgggcttactagaaactgtgagtggaagtggacaaagctactcaagaactgaagacatcaacaatgcttttgccaatgaagtctcatgggaccgctcttccgcatcttctactcaagcgacaacaacacagagaccaagtgaaagaacatatgaaagaggtcaaaaagttaatagcttcaccgtgagaatgttgttttcaccagattcatgtgctatgatagaaaaagacaaagcaaacaagagttctttctttgcttag

SEQ ID NO: 1250 - DNA, 1503 bp, Arabidopsis thaliana
atgtctgtcatgttcttcgttgaggttatgtacatgggaatcgttgttttgtatgtcaagctgttcaagagaaagccagagaaattttacaaatgggaagccatggaggatgatgttgagtgtggcagtgcaagctaccctatggttcttgtgcagatacctatgtacaatgaaaaagaggtttgtgagcaatctattgcagctgcttgcaaaatctcatggccatcgaatcgtataataattcaagtgcttgatgattccacggatccagccagtaagactcatgattgtgttgtgttaaagaaacaggagttggtgaaaaaggagtgtgacagatggtctaaagaaggtgtcaacataacgtttgagataagggacaacaggaacggatacaaagctggtgcgttgagagaaggaatgaggcatagctatgtgaagcagtgtgattatgttgctatctttgatgctgatttccagcctgatcctgacttcctccaccgcactgttccattcttaattcacaatcccaagttagcacttgtacaaggccgtgaacgcgggtcaatgcatgatgacgagattacaggagatgtctctaagttaccactttacaatagagcagcaagttggatcttcaacatttgccttctttgggttcaacgctttttcttattctctgaaactattgcaggaactgctggcgtctggagaatctcagcattgaatgagtccgggggatggaatgaccagacaacagtagaagacatggatttagctgtacgagctacactgagaggctggaagtttctatatatcgatgatctcaaggtaaaaagtgagttaccttgttccttcaaagctctgcgtagccagcagcatcgatggacttgcggccctgccaatcttttaaggaaaatggctggacaaataataagaagcgagaatgtatctctatggaagaagtggtatatgttgtacagcttcttcttcatgcgcaagatcgtggctcacatcctcacattctgcttctactgtgttatcttgccagcaactgtattgttcccagaagtcacagttccgaaatgggctgcattttatctcccttctttgatcactctcttaatcgcaattggtagactaagatcaatccaccttttggctttctgggttctatttgagaatgcaatgtccctgctaagagcaaaggctctggtcatgggcttgttcgaaacaggaagagtacaagaatgggttgtgacggagaagttaggtgatactctcaagacgaagctgattccacaagttcctaacgtcagattcagagagagggtgcatttgctggagctattggttggagcgtacctgttattctgcggaatctacgacatcgtctatgggaagaacacactctatgtgtaccttctgtttcagtcagtggccttcttcgttgttggttttggatttgtaggaaaatatgttcctgcttcctcttacttagcatag

SEQ ID NO: 1251 - DNA, 1422 bp, Arabidopsis thaliana
atgattaagttgtggatgatgacttctctccaactcgcggagctcttcgtgagctctattgtgcatttgctttatgggttttatatatttagctccgccgttgccggagatatctctcagacgttgaatgattacttgtttaagtccaatgtcgctttcggagaaaccggtcaaaatcaaaccaatgttgagggtttgcctcctattgtattggttcatggcatctttggatttggcaaagggagattaggaggcttatcttactttggcggtgctgagaagaaagatgagagggttcttgttcctgatttgggttccttaacaagcatctatgacagggcaagggaattgttctattatttgaaaggaggggtagttgattttggcgaagagcatagcgaggcttgtggacattctcggtttggaagaagatacgaacaagggcaataccctgaatgggatgaggatcatcctattcattttgtggggcattcagcgggtgcgcaagttgtgcgtgtattgcagcaaatgcttgcagatcaggcatttgaagggtttgaagaaacgaatgagaattgggttctgagtgtgacatcgttatccggggcattcaatggaactaccaggacctacttagatggcatgcggacagatgatggagtgagcatgaaaccgatatgtttgttgcagctgtgtcgtataggcgtgataatgtacgattggttggacatttcatggctaaagacttattacaatttcgggttcgatcacttcaacatttcttggaagaagaccggtgtgagaggtctcgttgattgcctaatgggaaacgcaggtccttttgcttctggcgattggatcttacctgatctcacaatccaaggctcaacaagtattaactccaatctccagacgttcccaaacacttactacttcagctacgcgactaaacgcacccgcagagtcatgggtatgacaatcccttcaggtgttcttggaatccacccgatgctcttcctccgcgtctttcagatgagccaatggaaattcccacaagatgtctctcctccttataaaggctacagggatgaggactggcaagagaacgacggggcattgaacacaatatcaatgacacatccgaggctacctgttgagcatccgagccggttcataaggagcgattcggaatgtcaaacattacaacccgggatctggtattataagatagtggaagcagatcacataatgttcatagtgaacagagagagagctggtgttcagtttgatctgatatacgacagcatcttccaacgttgcaggaaacatgtttttagaaagattcctcagactctccccaatcaatctccttcttctcctcgttcatcatcatcacccagaataaacaactttgtacattga

SEQ ID NO: 1252 - DNA, 1584 bp, Arabidopsis thaliana
atggatgatactggtggcgacgatatggattcaagctttcaccgggacgaatttcgatttctcagcttactcgtcagatttgaaatcggttctagggatttcacaggtgcagctaaactacctcgccgtggcttcggatctcggaaaagtattcggatggtcgtcgggactagcgcttatgtatttcccgctttggacggtgcttttcgcggcggcgtttatgggattcgtcggttatggagttcagtggcttgtcatcactcatttcatctctttgccttatatcatgtgagtttcaatggtgtaagcgctgctttatatactcttgcttacaacgcaatcaatccaacttctccagagctatatcttcttttgaacgctcttataccgctcattgtctctttcactgctatcatcccgattcttcgtcaaccgccttttgagcctcttccaccagatggagttcgtcgtgactctctcatgtttctattgctcaacatactcgctgctttaaacggtgtttatctccttctctttggatcaaactcctctgatttaacctctgctcgtctactctttggtggagcaatcctcctcttggtattccctttatgtattcccggtttagtcatcgcccggaattggtataaccgcacaatccacactagtttccgtctagaaggttctggtttcattcttgttgatcctgatgagcttgagttgcataaagggatgcttgcacatgaagcaaaccgtgaaggttaccaattgctgagtgacgatgtggtgcaaaacccggttaagtccgtagctgttgaggaagaggatagtgatgagtcatgttgcaagaaacttatcacaagagatcagcttgaaggtttggggattgaacattctttgtcgctgctcttaaccagatcagatttttggttatactatatcacgtacttctgcggtggaaccattggacttgtgtacagcaacaaccttggacagattgctcaatctttaggacaaagctcaaataccacaactcttgtcacactttattctgctttctcattctttggaagattgctttctgcaacaccagattatatccgagcgaaggtttattttgccagaaccgggtggttagcaatcgcgctattaccaacccccttcgcacttttcttgcttgcatcatcaggaactgcatcagcattacaagctggaacagcgctgatgggtttaagctccgggtttatctttgcagcagcggtttccatcacatcagagctttttggaccaaacagtgttggagttaaccacaatatcttaatcacaaacataccgataggatcattgatctatggattcttggctgcattggtctatgactcacatggtttcaccgggaccaaatcaatgacctcggagtcggtggtgtgtatgggacgagattgttattacttgacctttgtgtggtggggttgcttgtctcttcttgggctaggttcgagtcttgtgttgtttattagaactagacgagcttatcaacggtttgaacaagctcgtataagttcgaacatcaacgactcttag

SEQ ID NO: 1253 - DNA, 585 bp, Arabidopsis thaliana
atgaagggaaattggtcgatcgtacgaaaggttcttcatcgccagttctccactctccgttcctcgacaccatcgtcgcgattatctacttccatccgaccgcttgttctggccccaaactcgatatcgtcgctaatcgctagaaattcgttgttcactgcctccaacattggtccatccatcgattttaacttctccaacacttcgcttcctcatcggagaagcctctgttcggaagctggaggtgaaaatggtgttgttctagtgaaatcagaggaagagttcatcaatgcaatgagcaaagctcaagatggatctttaccatcggtcttctatttcactgccgcctggtgtggaccatgcaggtttatctctcctgtaatcgtggagcttagtaaacaatatcccgatgtaactacgtataaagtcgacattgatgagggcgggatttcgaacactatcagcaagttgaatatcacggctgtgccaacactgcatttcttcaaaggaggctcgaagaaaggggaggttgtgggtgcagatgtcacgaagctgaagaatctcatggaacagctctacaagtga

SEQ ID NO: 1254 - DNA, 519 bp, Arabidopsis thaliana
atgagtatgttgtcagggaaagctgcttacgatctctttgtctatggcagtctccaggaacccgaagtcgtatacgtgcttcttaatcgcgtccctgaccatgtctccgccgtactctccggcttgtttagactcaaaggccgtgtctatccaacaattctaccggacggtaccggaaaagtcaacggaaaggtgctaaagggcataacagatgatgaactgaagatgttagatgagtttgaagatgttgaatatgacagaaagactgttgaagtaatgctgacggatacttcagagaagctgcaagtcgaaacatatgtatggaagaacaaagatgatccggatctttatggagaatgggatttcgaggaatggagacaacatgacaaggaagatttcgtaacagcgaccaagaagtttctggaaaataggagattaccagaagcaaagacgaggatggacacattcaaaacattctttaagcaggatcttgagaatgggaaacctctggactcttga

SEQ ID NO: 1255 - DNA, 792 bp, Arabidopsis thaliana
atggagaataatccaagaagctcatcgtctctccctctagccgggcgtgtagctatagtgaccggagccaccagaggcatgggccgtgaaatcgcgattcacctccactctcttggtgcaagagtcaccatcaattatgtctcgagctcatcaaaagctgaactcttggtttcagaactaaacgactcatctcaattaaagtcagcgatcgcagttaaagcagatgtgtcagacccggaccagatcaacaacttgtttgatcaaacagaacaagagttcggatctaaagttcacatcgtcgtgaattgtgcaggtgttttggatccaaagtatccatctttatccgagacgacactagaagatttcgataacacattcacaataaacacaagagggtctttcttgtgttgcaaggaagcagctaaaagggttatgagaggaggtggtggaagaatcattatgatgtctacatcaatggttggtggtctcgccccgggttatggagtttacgcagcatcaaaggccgccgttgagacaatggtgaaagtgttggcgaaggagcttaagggaagccggataaccgcgaattgcgtggcgccagggccggttgcgacggagatgttttatgctggaaagagtgatgaaacggtgaaaatgcttgcaggggcttgtcctatggggaggatcggtgagtcaaaggatataaccgagattgtagggtttttggccggtgatggtggtgaatggattaacggtcaagttattagagccaatggaggctttgttgtctaa

SEQ ID NO: 1256 - DNA, 1605 bp, Arabidopsis thaliana
atgaagaatcgttctttagggttttgggcgatcggggttttgctcatcggaagcttgatcggagctacggaaggctcgattcatgagtacaacaacgaaaagttcactgcaaaattcaatgctcgcttcttccatggtggtagcgaaggtctttacgcttccaaatctcaagatctaaactcttcttcttcttctgataattcttttaaaggcaagtcctttataaggtttgatgatgtaacatttgtgaggacaaaggaatctgctagtaaacagaatgcaatgcagtcaacttcaggattagtggaagcaattatacttgaggtaaaagaccgtgatagaatcggtggtacttttctcaaatccgaagtgatttgttgcacgccggagctagctgatactggatcttgtagtcttggggaagttatcattaagagagagtctaatgatgttgagtggccaagacagatcaagacattctttaaagggaataagactgaagttaacatgtcccctgaaactgtggttatcaataagactgggatgtattatctttatttcatgatatgtgacccggaattggatggtactaggatcaaggggagaacagtttggaagaaccctgatggttatttacctggaaaggttgctcctttaatgaacgtttttggctttatgtcgttagcgtatattttgcttggtctagtttggtttgtgaggtttgttcagttttggaaggatataattcagttgcattatcatatcactttggttattgctcttggtatgtgtgaaatggctgttcgatactttgagtatgttaattttaactccactgggatgaggccaatggatgttaccctatgggcggtgaccttttcttctataaagaagacgctttctaggcttcttcttctggtagtctctatgggttatggtgttgtaaagcctacccttggtggtataacctcgaggatacttctacttggagtcatatattttgttgcaacagaggctcttgagttggttgagcatttgggaaacatcaatgacttttcgggaaagacgatgatagttttggttattcccgtggcattactggatgcttgctttattctgtggattttctcatcattggcaagaacacttgagaaacttcagattaagagaaacatggccaagcttgagctttataggaacttcaccaatgcactcgctatctctgttctgctctctatcgcttggattggttttgagtcatatgcatcctttgggctccatcaaataatcctacaaggttctaatacttccattagcgtttactcaaatgttttggactccgatggtcccaatgggtcaactgccaaagatgtcaagattcaagacacttatttgctcttcaccgagagattatcattttgcactcagcttacctctaattggtttaaacctttcaggtactcatacttagcggaaacaggggatgagtttgaagaggaaggtatctcattgacaggtagtggaattaagagtacagaagatgttgaaaggaatgaacttctatttgggcttccagacgacgttgaagagggcaaacgtgagtaa

SEQ ID NO: 1257 - DNA, 654 bp, Arabidopsis thaliana
atggcgactgagaaaccgattactacggagactgttgctctcactgagaagaaaatggacatgtctttagatgagattatcaagatggaaaagagcaataccaatgtgaataagggcaagaaacagagagtattgaataaaaaggagaaatttagtggtgctgcgaagaatagtgcggtgaaagcacagcgttatatggactctcggtctgatgttagacagggtgcttttgctaagaagaggtctaatttccaaggaaaccagtttcctgtaacaacaaccgttgctcgtaaagccgcttctgctactccgcgtggtagaccttataatggtggaaggatgactaatacgaatcaatcaaggtttattgctccaccagctcagaatagagcttcacaaagagggtttgtcggaaagcagcagcagcagcaaagggagaagatagtgcagcagcaggcaaatggaggaggaggagggcaaaggcaatggcctcagacactggattctcggtttgcaaacatgaaggaagagagaatgagaatgagaaggtttgcagacaatagaagcaatgtaggcaacaatggagctggatctcatcagcagcagcgttcgatggtcccgtgggtgagaagagctacaagattccccaactga

SEQ ID NO: 1258 - DNA, 783 bp, Arabidopsis thaliana
atggagtctctatctcttcccgttctaaatcctctgttagcttctggttctaatctttttagaaaccagcactcgaggatgacctcttcaatggtatcttcacttaaatcccccattggaggcacatcgctctccactgttcgtcgctttggagtaggtgttgttaggatgcaagctgttgatgaagatattgatttgaagcaaatgagagacatagctgctgctaaaaagcgttgggatggtttgttaagggaaggaaaagtgaagcttcttacaccaagagaagcaggctatgctatttctctttcaaacaaacctctccttgatgttcgtccctctagcgagcgcaacaaggcatggattaaaggctccacttgggttcctatcttcgacaatgatgacaaccttgacgctggaactctttccaaaaaagtcactagttttgctatggggggatggtggagtggagcacctacactatcttttaataggtatgtctgcgagaggtatgagaatctgttctgggtacaaggtggtttagaatctgctcaagacgaggatctagtgacagaaggtgtccaacccttgaagcttgctggtattggaggtttttcagagttcctcggttggacagaccagcaaagagctcaagctgcgaaagaaggttgggggtaccgtttggtatatactgctcgtctgtttggagttgttctggctgctgatgctttgttcgttggggctcagcaactaggccattatattcaggagttaagaggccattag

SEQ ID NO: 1259 - DNA, 693 bp, Arabidopsis thaliana
atggctttctcttacgcatcattctctacacccttcaatggtttcgctgcaaatccgtctccgattacttccgcttttctcggcccatcattgagattctccaccagaacatcaaaaactcggaatccgagtaatggggtttcagtgaaatcgtcaaatagtcataggtttctagtcaaatctaaaaatttcagtgtctatgcaagggctgcagcagagaagtctgttcacgatttcactgtaaaggacatcgatggtaatgatgtttctctggacaaattcaaaggaaaacctttgttgatcgttaacgttgcgtcaagatgtggtttgacatcatcaaattactcagagctttctcaactgtacgaaaaatacaagaaccaaggatttgagattcttgctttcccttgcaatcaatttggaggtcaagaacccggttcaaaccctgagatcaagcaatttgcttgcacccggttcaaagcagagttccctatattcgacaaggttgatgtgaatggaccaagcacagctccaatctacaagttcttgaaatccaatgctggtggtttccttggtgatatcatcaaatggaactttgagaaattcttggttgataaaaagggcaaagttgtcgagagataccctcccacaacttctcctttccaaatcgaggtaccaaattcaaaactctaa

SEQ ID NO: 1260 - DNA, 2076 bp, Arabidopsis thaliana
atgcagggggagagggccagtcttggctatttatcagaggccttgaactttgagcatggttcttcttcaagtaatggtgtgatagatcattgggagaatattcacagtcttggtgataatgacttgcaggattacatgattgcaaattctgaatcaaatacttcgcttgcaaactcagtttatcacgagcaacagggtttacgcagatttagccttggtgaggctagctctagtggcacgaaggatgaagcttccagtcacaatgagcaacgaatggaaacaagatgctttgacggacgaggaaatgaaataattgatttagacccagtgtttgcgcagccatcaggcacaaatcaacctgttcagaatgtcaatctgaatgcagagtatatagaaattcacgaggatattaatccatatagaggtcggtctggcttcatagaagctaatggaccagggaccagggtctcacaacctggcagatcttttgaagagaacggtgttggaacaggttcttctgtagagggacgtcgtgcatcctgcaaaagaaaagctcttgaaggcagtattagtcaatcttcttcaggaggttatcatgatttccagcgtggagaaagcagttcgtggaccccaggttctacggtttttaggccaggaaatggtttaaacatatctggctcccttgacaatggaccaagaggaatggtctccggtactgtaccaaattttcctgtttctgcaccaaattttcctgtttctgccattgcagagagctccagtagaaatatatgcgtcaggagtaatccctcagatcatcaagaaactgtaaacccatctacctttgctgcgggaactgttgtcaggcggcctgtccctccatcccagttgaacttgtcaagacacttaccagcagatcagcattcattggacttgagacctggacagtcttttgtcgtttctcgtaacccaaattctactcctgtgagcataccacctggttcaaggactatgctaccaccatttcggtggactgggagctcactagtgggtggaacatcgaactctactgcgcccgttgagagaaatcttcatctagatgaaaccaggtcaagaagcatacccgggaatactcttgagattcccatgtttgcagctcctgaggtaggaaattttgcccgtagtcagagtagcagaaatgtaacaaatggaaacctgaatagtgcatcatcagtgtccaggacaggctcaacaacaagtgttccaccaccaccaccaccatcttctaatctagcgtggacttcttaccagaattcaccacattatcaaagaagaaggactgaaaggtctgaacttgcacgtaggtccttgctttcttcccttgcagcagatgctacaaaccagagatctggtgatcatccaacacttcgttcgttggcccctcctgcctcttcggatgggcttgtgcttcagcctggtggtgataatagtcagatgcataatcgggcttactcgagagcaggtccgttgtttgataggcaaggggatagtgtggttggtattcctcatcctttgcgggccttggcagctgcaagcagaggaagaagcagacttatggtgtcccagatgcagaatgtcttggatgtcatgcgtagggatgctaataataacaacttgcggcttgaggacgttatgcttctaaatcactcagtactatttgatggggctactggtcatgaccggtatagagacatgcgacttgatgtggacaacatgtcatatgaggaattgttggcactagaagagcggattggagatgtttgtaccggtgtaaacgaggaaaccatatcaaaccggttaaagcaacgaaaatacaaaagcaacacaaaatctccacaagatgcagagccatgctgtgtttgtcaggaggaatacaccgaaggagaagacatggggacactagaatgtgggcatgaattccatagccaatgcattaaagaatggctgaaacagaagaatctttgcccaatctgcaagactacaggcttgaacaccgcgaagaagcggaggatagcatga

SEQ ID NO: 1261 - DNA, 555 bp, Arabidopsis thaliana
atggcaaaccaaatctacataatctccttgatcttcttgtctgtgttactttatcaatccactaccgtcttatctttccgacaaccattcaacctagcgaaaccatgcaagcgtttcgtcttctacctccataatgttgcctacgacggtgataacacggataatgctacatcagcagcaattgttaaccctttaggtctaggagacttcagttttgggaagtttgtgatcatggacaaccctgtgacaatggaccagaacatgctctcggaacaggtggctcgtgttcaaggcttcttcttctatcacggtaagacgaaatacgacacttggctctcttggtcagtagtattcaattcaacacaacacaagggggcattgaacataatgggtgaaaacgcgtttatggagccgacaagagacctaccggtcgttggtgggactggtgatttcgtcatgactcgtgggatcgctacgttcatgactgatctcgttgaaggcagtaagtatttccgtgtcaaaatggatattaaactctatgaatgttactattag

SEQ ID NO: 1262 - DNA, 462 bp, Arabidopsis thaliana
atgggtgttcttgatcacgtctctgaatatttcgattgttctcatggaagctccaagagacacaaaagtctacagacggtggatgtgagggttttgatagattgtgaaggatgcgagaggaaagtaaggagagctttagaaggaatgagaggaataagagatgtaaccatcgagccaaatgctcagaaagtgacagtggttgggtacgttgaaccaaacaaagtggtggctcgtatcattcaccgaaccggtaaaagagcagagctatatcctttcgttccttacgacgttgtggctcatccttacgcgtctggtgtttacgataacagagccccgactgggtacgttaggaacaccgagtatgatccacatgtgtcacgtctcgcacgtgctagctccactgaggttcgttatactacggcgtttagcgacgagaacgcctccgcttgtgttgttatgtga

SEQ ID NO: 1263 - DNA, 879 bp, Arabidopsis thaliana
atgggagtcatgatcaatcaccatttcctcgcttttatcttcggcatcttaggaaacgtgatatccttccttgtattcctcgctccagtgccaactttttatagaatatacaagagaaaatcgacggaaagtttccagtcgctaccgtaccaagtgtcgctatttagctgcatgctatggctctactacgcattgattaagaaagacgcttttctcctaattaccatcaactcctttggctgcgtcgtggagactctctacatagccatgttcttcgcttacgccaccagggagaaaaggatatcggctatgaagttgttcatagcaatgaacgttgccttcttctcgttgattctaatggtaacacatttcgtggttaaaactcctcccctccaagtctctgtactcggctggatttgtgttgccatttctgtttctgttttcgctgcccctctaatgatcgtggctcgtgtgataaagacaaagagtgtggagtacatgcccttcacgctttctttcttcctcactataagcgccgttatgtggttcgcttatggtttattcctcaatgacatatgcatagcgattccaaacgtggtgggattcgtactagggctgttgcaaatggttttgtacttggtttacaggaactcaaatgagaaaccagagaagattaattcgtcagaacaacaacttaagagtattgtcgtgatgagtccgttaggtgtgtcggaagtgcacccagttgtgacggaatcggtggacccactctctgaagccgttcatcatgaggatctgtccaaagttactaaagtggaggagccgtcaattgaaaacggcaagtgctacgtggaggctactcgtcctgaaaccgtttga

SEQ ID NO: 1264 - DNA, 1104 bp, Arabidopsis thaliana
atggagatcactaacgttaccgagtatgatgcaatcgcaaagcagaagctgcctaagatggtgtacgactactatgcatctggtgcagaagaccaatggactcttcaagagaacagaaacgcttttgcaaggatcctctttcggcctcggattctgattgatgtgagcaagattgacatgacaaccaccgtcttggggttcaagatctcgatgcccatcatggttgctccaactgccatgcaaaagatggctcaccctgatggggaatatgctactgctagagctgcatctgcagctggaactatcatgacactatcttcatgggctacttccagcgttgaagaagttgcgtctacagggccagggatccgattcttccagctctatgtatacaagaacaggaatgtggttgagcagctcgtgagaagagctgagagggctgggttcaaagccattgctctcactgtagacaccccaaggctaggccgcagagagtctgatatcaagaacagattcactttgcctccaaacctgacattgaagaactttgaaggacttgacctcggaaagatggacgaggccaatgactctggcttggcttcatatgttgctggtcaaattgaccgtaccttaagctggaaggatgtccagtggctccagacaatcaccaagttgcccattcttgtcaaaggtgttcttacaggagaggatgcaaggatagcgattcaagctggtgcagccggaatcattgtatcaaaccatggagctcgccagcttgactatgtcccagcaaccatctcggcccttgaagaggttgtcaaagcgacacaaggacgaattcctgtcttcttggatggtggtgttcgacgtggcactgatgtcttcaaagcacttgcacttggagcctccgggatatttattggaagaccagtggtattctcattggcagctgaaggagaggctggagttagaaaggtgcttcaaatgctacgtgatgagttcgagctgaccatggcactgagtgggtgtcggtccctaaaggaaatctcccgtaaccacattaccaccgaatgggacactccacgtccttcagccaggttatag

SEQ ID NO: 1265 - DNA, 1140 bp, Arabidopsis thaliana
atgcaatcaagaatggcctcaactactataatccttttcctctcattcagcatcattccattactcaccatcgttagagcagataaccattccgtttactgccctccaccaccaccttgtatttgtatttgtaatccgggaccacctccgccgcaacccgatccccaaccgccaactccaccaacatttcaaccagcaccgccagccaatgaccaaccaccgcctccaccacagagcacatcaccacctccagtagcgaccacaccaccagcacttcctccaaaacccttaccgccaccgttgtctcctccgcaaaccacaccacctcctccaccagctattacaccaccacctccaccagctattacacctccactatcacctcctccaccagctattacaccaccacctccactagcgaccacaccaccggcacttcctccaaaacccttaccgccaccgttgtctcctccacaaaccacgccacctcctccaccagcaatcacaccaccactatcacctcctctggttggaatatgttccaagaatgataccgaactaaagatatgtgccggaattctagcaattagtgacggtcttctaaccactggaagagcagaaccatgttgttccatcatccgaaatgtgtctgatcttgatgcagttacttgtttttgtaaatcggtaggagcaccacgtttttccctctctcccaatttcggcatcttctttaaagtttgtggtcgtaggattccacaaggctttagctgtcccggtccatcaccaacaatctcaccaccaccacttcctccacaaactttaaaaccgcctccgccacaaacaacaccacctcctccaccagctattacaccaccactatcacctcctctagttggcatatgctccaagaatgataccgaactaaagatatgtgccggaattctagcaattagtgacggccttctaaccactggtagggcagagccatgttgttccatcgtacgtaatgtgtctgatcttgatgcagttacttgtttttgtaagtcggtaggagcaagacgtttttccctctctcccaattttggcatcttctttaaggtttgtggtcgcaggattccacaaggctttagctgcccatga

SEQ ID NO: 1266 - DNA, 1356 bp, Arabidopsis thaliana
atgtctccactcaagtacttgtgttttagaaaggtactcttgttgttgctctattccagtctcttcctattctcttcttcttctttctttgcctcatcagttgatgatcatgagctacaacgaatagatcctcatttccgagtgagaagattgttggtgaaagatctggattcaactggtgatgatgatgaaaccaatcttcctcctcctcctaagaagaagaagcttcttactgattctgtttcatcatcatcatcatcatctggtactaagaagaatcaaaccaagctccttaaacccatctcttcttcttcttccaccaagaaccaaactaaactcgccaagaccaccaccatgggtacgtctcacaaacttaactccacaaaatcttcttctaacacaaccaagaccagctctgagctcaagaagctcaattccggaacaaaatccacaaattctacttcttcgatcaagaaatcagcagatctgtccaaatcaagctcatccaaaaacaaaaccaccataaaacccccaagttccaaactttcttcacctccatcagagaagaaatcacaaccctcctcaaaaccagtgaccaaatcgaaacaatccgagaaagaaatcaaaccattctggctagacgacgaagaagacgaagatttcgtaagcgaattcagagatctaccaacaagattccaaagatccctaatcccagacctagagcgaatctcaacaacatccaaaaactacatcaacaaagccaacaaacagatcaccaaaaacttcaaaccctatttcggcaacaaatacgcaccaaccatagcttccgtagtctctttcgtcttcatcctcgtccctctactcttagtctcactcattttcaacagattcaaagcttatttctcactccagaagatcctaatcttcatccaaatctacctctcgatctacttctcaatcctatgcctctcatcgctcgtcaccggaatcgaaccactcaagtttctctacgcaacatcgagctcaacatacgtttgcttgcagatcctgcaaaccctaggctacgtcttctacctcttgcttcttctcatgtacctcgttctcgtcttctccacggattgtggtttgggccttaaggtattgggcttggcgcagacctttgtgggctttgctgtaggtctgcattattacgtggcggtgtttcatagggtggtgcttcgtcagcctccgaagacgaactggaagatacacggtgtgtatgccacgtgtttccttttgatttgtctgttatctaatgctgagaggaggaagaaagagtacttggaagaaggcggtgacgaagggaagaaaaattga

SEQ ID NO: 1267 - DNA, 336 bp, Arabidopsis thaliana
atggacgtgagaggagatcataaccggaaaaacacgagttttcgtggttcagctccagctccgattatggggaagcaagaattgtttcggacattgtcgtcgcagaacagtccaaggaggctaatatcagcgagttacttcagtttagaatcaatggttgtgcttgttggtctcacagcatctctcttgatcttaccgttgattcttccaccattgcctcctcctccttttatgctgcttttgattcctattgggattatggttttgcttatggttcttgctttcatgccttcttctaattccaaacatgtttcttcttcttccacttttatgtaa

SEQ ID NO: 1268 - DNA, 2718 bp, Arabidopsis thaliana
atggacctcaagctaaggcctagcttcttcatctcttttctgattctcattttacttctcaaaaatcttaattacggatctgcagctagtccgaaatgcatatccaccgagcggcaagctcttctcaccttcagagcagcactaactgatctttcgagtaggctcttttcttggtccggacctgactgctgcaactggcccggtgttctttgcgatgctcggaccagccacgttgtcaagattgatctcagaaacccgagtcaagatgttcgctctgatgagtataaaagaggttccttgcgagggaagatacatccgtctttgactcaactcaagttcttgagctatctggacttgagttcaaatgatttcaatgaactagagattcctgagtttattggccaaattgttagtctaaggtacctgaatctttcttcctcatcgttttccggcgaaatcccaacgagtcttggaaatttgtcgaagctggagtctcttgatctgtatgcagagtcgtttggtgactctggtacattatcattgcgcgcaagcaatctccggtggctttcaagtctgtcttcttccctgaagtatctcaacatggggtatgtaaatctaagtggtgcgggtgaaacctggttacaggatttcagcagaatctcggcgctaaaggagttgcatttgttcaatagtgagctcaagaacttacctcccaccttgtcttcgtctgcggatctgaagctccttgaagttcttgatttgtctgaaaactctctcaattcgccgatacctaactggctatttggtcttaccaacctcagaaagctattcctcagatgggattttctccagggttcgattcctacggggttcaagaacttgaagcttctagagacacttgatctgtcgaataatctggcactacaaggcgagattccatcggttcttggagaccttcctcaactgaagtttcttgacctttctgcaaacgaactcaacggtcaaatccatgggtttctagacgccttctccagaaacaaaggaaacagcttggtctttctcgatctcagttccaacaagttagctgggacattgcccgagtcacttggatcgttgaggaatctgcagactctggatctttcatcgaattccttcacgggttcggtcccttcctcgataggaaacatggcgtcactgaagaaacttgatctttctaacaatgccatgaacgggacaattgcggaaagcttggggcagcttgcagagcttgtggatctgaacttgatggcgaatacatggggaggcgttctgcaaaagtcacatttcgtgaatctcagaagcttgaaaagcatccgtctaacaactgaaccatacagatctcttgtcttcaagttaccatctacttggattcctcctttcagactggagttgatccaaatcgagaactgtcggatcggtctgtttccaatgtggctccaagtacaaaccaagctcaactttgtcacactcagaaacactggtattgaagatacaataccggatagctggttctctggaatctcttctaaagttacttacctaattctagcaaacaacagaatcaaaggtagattacctcaaaagcttgcgttcccaaagttaaacaccattgatttgagctccaacaactttgaaggcacttttcctctctggtctacaaacgcaacagagctgcgtctttacgagaacaacttctcgggttctcttccacaaaacattgacgtcttgatgccaagaatggagaagatctacctctttagcaacagcttcacaggcaacatcccatcgtctctatgtgaagtctccggactgcaaattctgtcactgaggaagaaccatttctctggtagttttccaaaatgttggcaccgtcagttcatgctttggggaattgacgtgtctgagaataacttatcaggcgaaataccagagtctcttggtatgttaccttctctcagcgtcttgcttctgaaccaaaattcgttggaaggtaaaatcccagagagtcttcggaattgttctggccttacgaacatagatctcggaggaaacaagctgaccgggaagcttccttcatgggtaggaaagctgtcttctctattcatgcttcgtctgcaaagtaactccttcactggtcaaatcccagatgatctctgcaacgttccaaatctacgcattctggacctctccggaaacaaaatctcgggccctattccaaaatgcatcagcaatctcacagccattgctcgaggtacaaacaatgaggtgttccagaatctagtcttcattgtgaccagagctcgtgaatacgaagccatagccaatagcataaatctttcagggaacaacataagcggagagatcccaagagaaatcttaggcctcttgtatctccgaatcctgaatttatcaagaaactccatggcaggaagcattcccgagaaaatatcagaactgagtcgcttggagacgcttgatctatcaaaaaacaagttttctggagccatacctcagagcttcgcagcaatatcttctctgcaaaggctgaatctttcgttcaataaactggaggggagcatacctaagcttctcaagtttcaagatccatccatttacattggaaatgaattactctgtgggaaaccacttcctaaaaaatgtccaaaagacattaaatag

SEQ ID NO: 1269 - DNA, 2607 bp, Arabidopsis thaliana
atggagactcgtaacaagtttatgctactcgcttgtgccactttctccattatgtctcttgttaagtctcaaaatcaacaaggattcatcagtttggattgcggattaccgtctaaagaatcttatatcgaaccatcgagtaatttaacattcatatcagatgtcaatttcatccgaggaggaaaaactggtaatatccaaaataactcacgtacaaactttatctttaagccattcaaggttttgagatactttccggatggaattagaaactgctacagtttgagtgtgaagcaaggcacaaagtatctaatcaggactcttttctattatggaaactatgacggtcttaatacttctccgcgatttgacctctttctcggtccaaatatttggacaagcgtagatgtgctaatagcggatgtaggtgatggagttgtcgaggagatcgttcacgtcacaaggtctaacatcttggacatatgtctcgtcaaaacagggacaagtacaccaatgatatcagccatagaactaagacctttgcgatatgatacttatactgctcgaaccggttccttaaagagtatggcgcacttctacttcaccaattcagacgaggcaatacgttatcccgaagatgtctatgatcgtgtttggatgccatattcacaaccggaatggactcaaataaacacaacccggaatgtaagtggcttttcggatggctacaatccgccacaaggtgtaattcagaccgcctccatacccactaatggcagcgagccattgacctttacatggaatttggaatcctctgatgacgaaacttatgcttaccttttctttgctgagatccaacaattaaaggtcaatgaaactagggaattcaaaattttggcgaatggtgttgattacattgattatactccatggaagtttgaagcaagaaccttatccaaccctgcaccactaaaatgcgagggaggggtatgtcgtgtgcagctgtcaaaaacaccgaagtcgactctaccaccactaatgaatgctatagagatttttagcgtcatacaatttccacaatcggacacaaatacggatgaagtcattgctatcaagaaaattcaatcaacttatcaattgagtagaatcagctggcagggcgatccatgtgtacctaaacagttttcatggatgggtgtaagctgcaacgttatagatatctccacaccaccaagaatcatctcattagatttgtctttgagtggattaactggagttatatcgcctagcatacagaacctaactatgcttcgagaattggatttatcaaataacaacttgactggagaagtgcctgaatttctagccactatcaaaccgttgttggtcatacacttaagaggaaacaatcttagaggttctgttcctcaagcccttcaagatagagaaaagaatgatggtttaaaactatttgttgatccaaatataacgcggcgcgggaaacaccaaccaaaatcctggctggtggcgattgttgcatctatatcttgtgtggccgttactataatcgtgttggttctcatcttcattttcagaaggaggaagtcatcaacacgcaaagttatacgtccatcattggaaatgaaaaatagaagatttaagtattcagaggtcaaagaaatgactaacaactttgaagttgttctcggtaaaggaggctttggtgttgtttatcatggttttctcaataatgaacaagtagccgtcaaagttctctctcaatcatcaactcaaggctacaaggaattcaaaacagaagtcgaactacttctaagagttcaccatgtgaatttagtaagccttgtcggatactgtgatgaaggaattgacttggctctcatctacgagttcatggaaaatggaaacttaaaggagcatctttcgggaaaacgtggtggctctgtcttgaattggtcgagtagacttaaaatagctattgagtctgcactaggaattgagtacttgcatattggatgtcagccgccaatggtacatagagatgtaaaaagtaccaatatactgttaggtctacggtttgaagccaaacttgccgatttcggactttcaagatcttttctagtgggaagtcaagctcatgtatcaacaaatgttgctggaactcttggatatcttgatcccgaatattatctaaagaattggttaacagagaagagtgatgtttatagctttggaattgtgttacttgaaagtatcactggtcaacctgtgattgaacaatcgcgtgataagtcttacatagtagaatgggccaagtctatgcttgcaaatggtgatattgaaagtattatggatccgaatctccatcaagattacgactcaagttcatcttggaaagctcttgaattagcgatgttgtgcattaacccttcttccacacagagaccaaacatgactcgggttgctcatgagcttaatgaatgtttggaaatatataaccttactaaaataaggagccaagatcaaaattcaagcaagtccttgggacataccgtaactttcatcagtgatatcccttcagctcgttaa

SEQ ID NO: 1270 - DNA, 2640 bp, Arabidopsis thaliana
atggaaggtcgtcgtcaacgtttactggtgttcatctttggggctttggccattacacatcttgttcaagctcagccgcctgatcaacgaggattcatcagtttggattgcggtttacccgttaatgagtctccttataccgacccacgaaccggattaacattctcatctgatgctgattttattttaagtggtttacgtggtgaagctggggatgataacacatatatctacaggcagtacaaggatttgagatattttcccgatggaatacgaaactgctataatctgaaagtagagcaaggcatcaactatttgataagagcagggttcggatatggaaattatgatggtcttaatgtatatcccaaatttgatttacatgttgggcctaacatgtggattgcggttgatttggaattcggaaaagatcgtgagatcatttacatgacaacgtcgaacttattgcagatttgtcttgtcaaaacaggatcaactataccaatgatatcaaccttggaactacggccactaagaaatgattcatatttgactcaattcggtcccttagacctcatctaccggcgggcctatagtagcaattctaccggttttatacggtatcctgatgatatttttgatcgcaaatgggaccgatataatgaatttgaaacggatgtgaacaccaccctcaacgtgagatcctcgagtccctttcaagtaccagaagctgtaagtaggatgggaatcacgcccgaaaatgccagcttgccattgagattttacgtgtctctagatgacgacagtgacaaggttaacgtgtactttcactttgccgaaatccaagctttgaggggcaatgagactagagaattcgacattgaattggaagaagatattattcagtcagcatatagtcctacgatgttacaatcagataccaaatataacctatcacctcacaaatgtagctccgggttgtgctacttgaaactcgttagaactccaaggtcaactcttccaccgctgattagtgctattgaggctttcaaggttgtggactttccatacgctgaaacaaatccaaatgacgtcgctgctatgaaggatatcgaagcattttatggattgaagatgattagttggcaaggagatccttgtgtccctgaactattaaagtgggaagatctaaaatgcagctacacaaataagtctactcctccaagaattatttctttagatttgtcatcacgagggttaaaaggggtcattgcgcctgccttccaaaatttgaccgagcttcgaaaactagacttgtcaaataatagttttactggaggagtgcccgagtttctagccagcatgaagtcattatcgatcataaatttaaattggaatgaccttacgggtcctcttcctaaattgcttcttgatagagaaaagaatgggcttaagctaacgatccaaggaaacccaaagttgtgtaacgatgcgtcatgcaaaaataataacaatcaaacgtacattgtaccagttgttgcgtcagtagcttctgtgctcatcattatagccgtactgattctcattcttgttttcaaaaagagaaggccaacgcaagttgattcattacctacagtgcaacatgggttaccaaatagaccgtctatatttactcaaacgaaaaggttcacttattcagaggtagaagcattaacagataattttgaaagagttcttggagaaggagggtttggggtagtgtatcatggtattttaaatggtacgcaaccaatagctgttaaactactctctcaatcatcagtacaaggctataaggaattcaaagctgaggttgaacttcttttgagagtgcaccacgtcaatttggttagtttggttggatattgtgatgaagaaagcaacttggccctgctttatgagtatgcaccgaacggagacttaaaacaacatctatcagaacggggtggctctccattgaagtggtcaagtagactaaaaattgtcgtcgaaactgcgcaaggattagaatacttgcatacgggttgcaaacctccaatggtacatcgtgatgtaaaaacaacaaatatacttttagacgaacacttccaagcaaaactcgccgattttggcctttcaagatcatttccagttggaggtgaaactcatgtttcaacagctgttgctggaactcctggatatttggatcccgaatattatcgaacaaataggttgaacgaaaagagtgatgtatatagctttgggattgtattattggagatcatcacaagtcgacctgtgattcagcaaacccgagagaagccgcacatagcagcatgggtgggatacatgcttactaagggagatattgagaacgttgtggatccaagactcaatagagattatgagcctacttctgtttggaaggctcttgagatagcaatgtcttgcgtgaatccttcttcggagaaaagaccaaccatgtctcaagttactaatgaactaaagcaatgtctaacattagaaaactcaaagcgaggagtgagagaagacatgggatcaagaagttctgttgaaatgagcacaagctttacaaccgaaattaacccaaaagcacgataa

SEQ ID NO: 1271 - DNA, 1008 bp, Arabidopsis thaliana
atgcctccacaaaaagaaaaccatagaacattgaacaaaatgaagactaatctttttctctttctcatcttttcacttctcctatcattatcctcggccgagcaatgtggtcgccaagctggaggagcactctgccccaacggtctatgctgcagcgagttcggctggtgcggtaacaccgaaccatactgtaagcagcctggctgccaaagccagtgcactcccggtggtactcctcctggacccaccggcgatctttcgggcatcatttcaagttctcagttcgatgatatgcttaagcataggaatgatgccgcttgtcctgctagaggtttctacacttacaacgcctttatcaccgctgcaaagtccttccccggttttggcaccaccggagacaccgccacgaggaagaaggaggtcgccgccttcttcggccagacttcccatgaaactacaggtggatgggctacagcaccagacggaccatattcatggggctactgtttcaagcaagaacagaatcctgcttcagactactgtgaaccgagcgccacgtggccatgcgcatctggcaaacgctactacggaagaggaccaatgcaactgtcgtggaactacaattacggtctatgcggtagagcaataggagttgacttactcaacaaccctgaccttgttgccaacgacgcagtgatcgctttcaaagccgcgatttggttctggatgactgctcagcctcccaaaccgtcttgccatgccgtgatagccggccagtggcagccttcagacgccgaccgtgccgccgggagattaccgggttatggagtgattacgaacatcattaacggtggattggagtgtggacgtggccaagacgggagagtcgccgatcgtatagggttttatcagaggtattgtaacatatttggtgttaatcctggtggtaatcttgattgttacaaccaaagatccttcgttaacggcctcctcgaagctgctatttag

SEQ ID NO: 1272 - DNA, 1779 bp, Arabidopsis thaliana
atggcaccatcaatgaaagaaattttttctaaagataatttcaagaaaaacaagaaacttgttttgctatccgccgccgtagctttgctcttcgtagccgccgtcgccggaatctctgccggagcttcaaaagccaacgaaaaacgaactctatccccgtcgtctcacgccgtgctaagatcctcatgcagctccacgcgttaccctgagctctgtatctctgccgtggtaactgccggcggcgtcgagctaacgtcgcaaaaagatgtcatcgaggcatcggtgaacctaacaataaccgccgtggagcacaattacttcaccgtgaagaagctgatcaagaagaggaaaggactgacgccgcgcgagaagacggcgcttcatgactgtttggagactattgatgagacgctggacgagctccatgaaacggtggaagatctccatttgtatccaaccaaaaaaactctccgggaacacgccggagatctcaaaacactaattagctccgccattaccaaccaggagacttgtctcgacggcttctctcatgacgacgccgataagcaagttcgtaaagccttgttgaaggggcagatacacgtagagcacatgtgcagcaacgctctagcaatgatcaagaacatgactgatactgacatagccaacttcgagcaaaaagctaaaataacctcaaacaaccgtaagctcaaggaggagaatcaggaaactacggtggctgtagatatcgccggagccggagaactagactcggagggatggccaacttggttatccgctggagataggaggcttcttcagggttcaggtgtgaaagctgacgccaccgtggcagctgacggtagcggtacatttaaaactgtggctgctgcggttgccgcggcccctgaaaatagtaataagaggtatgtgatacatataaaagccggagtttacagagagaatgtggaggttgctaagaagaaaaagaatataatgtttatgggagatggtcggacgagaactattatcaccggaagtcgaaacgttgtagacggtagcaccactttccactccgccaccgttgctgctgtcggcgagagattcttagctcgtgacatcactttccaaaacacggcgggtccgtcgaagcaccaagcggtggctctccgtgtgggttctgatttctccgccttctacaattgcgacatgttagcttatcaagacactctatacgtccactctaaccgtcaattcttcgtcaaatgtctcatcgccggaaccgttgacttcatcttcggaaacgccgccgtcgtgctccaagactgtgacatccacgctcgccgccctaattccggtcagaaaaacatggtcacagctcagggaagaacggatcctaaccagaacacagggatcgttatccagaaatgtaggatcggtgccacgtcggatttacagtcggtgaaaggtagttttccgacgtacttgggtcggccatggaaggaatattcacaaacggtgataatgcagtcggctatctccgacgtgatccgacccgaagggtggtccgagtggaccgggacttttgcgttgaacactctgacttacagagagtattcgaacacaggagcaggggctggaactgcaaatagagtgaagtggaggggctttaaggtaattacggctgctgctgaagctcaaaaatatacggctggtcagtttattggtggtggaggctggttatcgtcgaccggtttccccttctcgctcggtctttga

SEQ ID NO: 1273 - DNA, 966 bp, Arabidopsis thaliana
atgggaggacatgtcttgcttactgttttcactctttgtatgctttgttcaggggttagggcacagctaagccctgacatttatgctaaatcgtgccccaatctagttcaaattgtccgtaaacaagttgccatcgccctgaaggccgagatacggatggctgcttctctcattcgtcttcatttccacgactgctttgttaatgggtgtgatgcgtcgttattgttggatggagctgacagcgagaaactcgcgatcccaaacattaactctgctagaggatttgaagtaattgatacaatcaaagccgctgtggaaaacgcatgtcctggtgttgtttcttgtgctgatatcctcactttggccgctcgtgactccgttgtattgagtggagggcctgggtggagagtggcattaggaagaaaagatggattggtggcaaatcagaacagtgcaaacaatctaccatctccttttgaacctttagacgccattatcgccaaatttgtagccgtaaaccttaacatcaccgacgtcgtagctttatcaggagctcacacctttggacaagcgaagtgtgctgtcttcagcaaccgtctgttcaactttaccggcttgggaaatcccgacgcaacacttgagacatcactcttgtctaatctgcaaacagtttgtccgctcggaggaaatagtaacataacagcacctcttgacaggagcactacggacaccttcgacaacaattatttcaagaacctgcttgaaggaaaaggtcttttgagttctgatcagattctgttctcgagtgacttagccgtgaacaccacaaagaaactagtggaggcttatagtcggagccagagcttgtttttcagggacttcacatgtgcgatgatcagaatgggaaacatttcgaatggagctagtggggaggttaggacaaactgcagggttatcaataattag

SEQ ID NO: 1274 - DNA, 477 bp, Arabidopsis thaliana
atgggagagattgggtttacagagaagcaagaagctttggtgaaggaatcgtgggagatactgaaacaagacatccccaaatacagccttcacttcttctcacagatactggagatagcaccagcagcaaaaggcttgttctctttcctaagagactcagatgaagtccctcacaacaatcctaaactcaaagctcatgctgttaaagtcttcaagatgacatgtgaaacagctatacagctgagggaggaaggaaaggtggtagtggctgacacaaccctccaatatttaggctcaattcatctcaaaagcggcgttattgaccctcacttcgaggtggtgaaagaagctttgctaaggacattgaaagaggggttgggggagaaatacaatgaagaagtggaaggtgcttggtctcaagcttatgatcacttggctttagccatcaagaccgagatgaaacaagaagagtcataa

SEQ ID NO: 1275 - DNA, 1773 bp, Arabidopsis thaliana
atggttcatgtgtcatcatctcatggagccaaagatggctctgaagaagcctatgattacagaggaaacccaccagataagtctaaaaccggtggatggttaggcgccggtttaattttagggagcgagctatcagagagaatatgcgtgatgggcatatcaatgaatctagtgacgtaccttgttggagatttacacatctcatcagctaaatcagcgaccatagtcaccaacttcatgggaactcttaaccttctagggcttctcggtggttttttggctgacgctaaactcggtcgctacaagatggttgcaatctcagcttctgtcacagctctgggagtgttgcttttgacggtggctacaactatctcaagcatgagaccaccaatatgtgacgatttcaggagacttcatcatcagtgcatagaagcaaacggacaccagttggctcttctctatgttgctctctataccatagctctaggcggaggaggaatcaaatccaacgtctctggttttgggtctgaccagttcgatactagtgatcctaaagaagagaaacagatgattttcttcttcaacagattctatttctccatcagcgtcggctctctcttcgccgtgattgctcttgtttacgttcaggacaacgtcgggagaggctggggttacgggatctctgccgcgactatggtggttgcagccattgttttactctgcggaacgaaacggtaccgtttcaagaaacctaaaggaagcccttttacaacaatatggagggttggtttcttggcttggaagaaaagaaaggagagttaccctgcgcatccaagtcttttgaacggttatgacaacaccacggttccacacacagagatgcttaagtgtttagacaaagccgcaatttccaagaacgagagctctcctagctcgaaggacttcgaagagaaggatccgtggatcgtttcgactgttacacaagtcgaagaagtgaaactcgtgatgaaattggtaccgatttgggcaacgaacattcttttctggacgatttactcccaaatgacgactttcacggtcgaacaagcgacgtttatggaccgaaaactcggatctttcactgttcctgcaggctcttactctgctttcctcatactcacaattctcctcttcacttcccttaacgagagagtctttgttcctttaacaagaaggctcacaaaaaagcctcaaggaatcacaagcctacagagaatcggagtagggctagtattctcaatggctgcaatggctgtagccgcggttatagagaacgctagacgcgaggcagcggttaacaacgataagaaaataagcgcgttttggttggttccacaatatttcttagtcggtgcgggtgaggcctttgcttacgttggacagcttgagttctttataagagaagcaccagagaggatgaaatcgatgagcaccggattgtttctaagcacgatatcgatgggattcttcgtgagtagcttgcttgtttcgcttgttgatagggttacagacaaaagctggcttagaagtaaccttaacaaagcgagattgaactacttctactggttacttgttgtcttgggagcattgaacttcttgatttttattgtgtttgccatgaaacatcagtataaagctgatgtgattactgttgttgtgactgatgatgattcagtggagaaggaagtgacgaagaaagagagctctgaatttgagcttaaggacattccttga

SEQ ID NO: 1276 - DNA, 1347 bp, Arabidopsis thaliana
atgggaagtatcgtggagccatgggcagcaatcgccgagaacggaaacgcaaacgtgaccgcgaaaggctcgagcagggagctgcgacatgggagaacagcacacaacatgtcttcatcgtcgctaaggaagaaatcagacctgagattggttcagaaagttccatgcaaaactctcaagaacattctctctaatcttcaagaagtcattcttggtactaagcttactctcttatttctcgccatccctctcgccattcttgccaattcttacaactacggactgacacctctagctgagcgagttagctttttgacagagcaactagctttctacactggtccaacagtgggcggtttgttgaacgcgacttgtggaaacgcgacagagctgataatcgcgatactagcgttggccaataacaaagtggcagtggtgaaatactctctattgggttcaattctctcaaaccttctcttggttcttggcacttccctcttctttggtggtatcgccaatatccgccgcgagcagcggttcgaccggaaacaagccgatgtgaacttcttcttgctgcttatgggcctgttgtgtcatttgctgccattattgttaaaatatgcagcaaccggcgaagtatcgacctctatgattaacaaaatgtcgctcactctgtcgcggacaagcagcatagttatgcttattgcttacattgcttatctcatcttccagctctggactcaccgccaattgtttgaggcacaacaggatgatgatgatgcatatgatgatgaggttagtgttgaagaaactccagtgataggattctggagcggatttgcttggctcgttgggatgacaatagtcatcgcattgctatcagagtatgttgtggacacgatcgaggatgcatcggactcatggggactatcagtgagtttcataagcatcatattgcttcccattgttgggaatgcggctgagcatgctggagccatcattttcgcattcaagaacaagctcgacatatctctaggggttgcgttgggctctgcaactcagatttctttgttcgtggtcccattgagtgttatcgttgcgtggatcctgggaataaaaatggatctcaactttaacatccttgaaactagctctctagctttggccattatcatcacagccttcactttacaggatggaacttctcattacatgaagggactggttctattgttatgctatgtcatcatcgcggcgtgtttcttcgtcgaccaaattccccaaccaaatgatttggacgtgggacttcaacccatgaacaatttgggagaagttttctcagcttaa

SEQ ID NO: 1277 - DNA, 819 bp, Arabidopsis thaliana
atggcagccatagatatgttcaatagcaacacagatccttttcaagaagagctcatgaaagcacttcaaccttataccaccaacactgattcttcttctcctacgtattcaaacacagtcttcggtttcaatcaaaccacatctctcggtctaaaccagctcacaccttaccaaatccaccaaatccaaaaccagcttaaccagagacgtaacataatctctccaaatctagccccaaagcctgtcccaatgaagaacatgaccgctcagaaactctatagaggagttagacaaaggcactggggaaaatgggtagctgagatccgtttacccaagaaccggacccgactctggcttggaactttcgacacagctgaagaagcagccatggcttatgacctagctgcttacaagctaagaggcgagttcgcgagacttaatttcccacagttcagacacgaggatggatactacggaggaggtagctgtttcaatcctcttcattcctctgtcgacgcaaagctccaagagatttgtcagagcttgagaaaaacagaggatattgacctcccctgttctgaaacagagcttttcccgccaaaaacagagtatcaagaaagtgaatatgggttcttgagatctgatgagaattcgttttcagatgagtctcatgtggaatcttcttcgccggaatctggtattactacgttcttggacttttcggattctggatttgatgagattgggagtttcgggctggagaagtttccttctgtggagattgattgggatgcgattagcaaattgtccgaatcttaa

SEQ ID NO: 1278 - DNA, 771 bp, Arabidopsis thaliana
atgaagcattatgtgctagttcacggaggctgccacggtgcgtggtgttggtacaaggtgaagccgatgcttgaacattccggccaccgtgtcacggtttttgatcttacggcgcatggtgtgaacatgagcagagtagaagatattcagactttggaggatttcgctaagccgttgcttgaggttcttgagtcttttggctcggatgataaagtagtcctcgtcgcgcatagcctcggtggaataccggctgctcttgcagccgacatgtttcctagtaaaatctctgttgctgtcttcgttacttcttttatgcccgacacaacgaatccaccttcttacgtgttcgaaaagtttctcggaagcattacagaagaagaacgtatggacttcgagttagggagctatggaacagatgaccatccactaaagactgcttttcttggacctaactacttgaagaatatgtatctactttctcctatcgaagattatgaattggccaaaatgttgatgagagtcacaccggctattactagtaatctgacggggactaaaagcttaacggcacaaggatatggatcgattagtcgtgtgtatatcgtatgcggagaagataagggtatacgtgtagatttccaacgatggatgattgagaactctccggttaaagaagtgatggagatcaaagatgcagatcatatgcctatgttttccaagcctcatgaactctgtgatcgtcttctaaagattgctgataaatatccctaa

SEQ ID NO: 1279 - DNA, 888 bp, Arabidopsis thaliana
atggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgagccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatga

SEQ ID NO: 1280 - DNA, 1674 bp, Arabidopsis thaliana
atgtctaattcaaaccaaccacttctttccaaaccaaagtctcttaagcacaagaatctatgccttgtcctctccttcgtagccattcttggctctgtggctttcttcacagcccaattaatctccgttaacaccaacaataatgatgattccttattaactacgagccagatttgccatggagctcacgaccaagactcatgccaagctctcttgtccgaattcacgacgttgtcgctctcaaagctcaaccgccttgacctattgcacgtgtttttgaagaactcggtgtggcggcttgagagcacgatgaccatggtgagcgaggctaggatccgctcgaacggtgttagagacaaggcaggttttgctgactgcgaggagatgatggacgtatcaaaggatcggatgatgagttcgatggaggaacttcgcggaggaaactataatcttgagtcatactcaaacgttcatacttggctgagcagtgtgcttacaaactacatgacatgtttagaaagtattagtgatgtctccgtcaactctaagcaaatagtcaagccacaactcgaggacttggtttctagggcaagagtggctctagccatctttgtctccgtcttgcctgccagagacgatctcaaaatgatcatttccaatcgcttcccgtcgtggctaactgctcttgacagaaagcttttagaatcttctcccaagacacttaaggtgaccgcgaacgttgtggtggcaaaagacggcaccggaaagttcaaaacagtgaatgaggcagtggcggcagcaccggagaacagcaatacaagatacgttatatacgtaaagaaaggggtttacaaagaaactattgacataggaaagaaaaagaagaacttaatgcttgttggtgatggcaaagacgcaacgatcataaccggtagtttgaatgtcattgatggatccaccaccttcagatcagccactgttgctgccaatggagacgggtttatggcacaagacatatggttccaaaacactgcagggccggcaaagcaccaggctgtggctctacgagtgagtgctgatcaaactgttataaatcgttgtcgcatagatgcgtatcaagacacgctctacactcacacgttgagacaattctaccgcgacagctacatcaccggtaccgtagatttcatcttcggaaactctgctgtggtattccagaactgcgacatcgtggcacgaaatcctggagctgggcaaaagaacatgttaacggctcaaggacgggaggatcagaaccagaacaccgccatttcgatccaaaaatgtaagataacggctagttcggatcttgctcctgtaaaaggatctgtgaaaacgttccttggtcgaccgtggaagttgtactcaagaacagtgatcatgcagtctttcattgacaaccacattgacccggctggttggttcccatgggatggtgagtttgcgctctccacattgtattatggagagtatgcaaataccggtcctggagcggatacgagtaagagagtgaattggaagggatttaaagttattaaagactcaaaagaggccgaacaattcactgtggcgaagcttattcaaggaggattatggttgaaacccactggagttactttccaagagtggctttga

SEQ ID NO: 1281 - DNA, 1500 bp, Arabidopsis thaliana
tgttttgatttcgttttgcttgttcagaaatggaagaagtatggtactcacaggcttactttcatggagcgacattgtcctcctgtgtttgatagaaagcagtgtctggttcctcctcctgatggctataagccaccgataagatggccaaagagcaaagacgaatgttggtacaggaatgtgccatatgattggattaacaagcagaaatctaaccagaattggctaaggaaagagggtgaaaagttcatttttcctggtgggggtacaatgtttccacatggagtcagtgcctatgtcgatctgatgcaagatttgatccctgaaatgaaagatgggactatacgcacagccattgacactggttgtggggttgcgagctggggaggcgatttgttggaccggggtatcctcacggtatcactcgccccgagggataatcacgaagctcaagtccagtttgctctagaacgtggaattcctgcgattcttggcatcatttccactcaacgtctccctttcccttcaaattcatttgatatggctcattgctcaagatgccttattccgtggacagaatttggtggagtatatcttctggaggttcaccgtatcctaagacctggtggcttctgggtcttatctggtccaccacagagatcaaactacgagaagctgcaggaattgttatcttcaatgtgcttcaaaatgtatgccaagaaagacgatatcgcagtctggcaaaaatctccagacaatctatgctataacaagttgtctaacgaccctgatgcatacccgccaaaatgtgacgacagccttgagccagattctgcttggtatacaccattacgcccttgcgttgtggttccaagccctaagctaaagaagacggatttggaatctactcccaagtggccagaaagattacacacaactcctgaaagaatctctgatgttcctggaggaaatggtaacgtgtttaaacatgatgatagcaaatggaaaacaagggctaagcattacaagaagctgttacccgcgattggttctgacaaaattcggaatgttatggatatgaacactgcttatggaggtttggctgctgctctggtcaatgatcctttgtgggtcatgaatgtcgtctcttcttatgctgcaaacacacttcccgttgtgtttgatcgtggattgatcggaacatatcatgactggtgtgaagctttttcgacgtatccaagaacttatgatcttcttcacgtagatgggctgtgtgatatgaaatatgtaatgctggaaatggataggatcttacgtcctagcgggtatgcgattatacgcgaatcgagctacttcgcagattcaattgcttctgttgctaaagagctgagatggagttgccgtaaagaacaaacagagtctgcatcagccaatgagaagctcttgatttgccagaagaagctgtggtattcatctaacgcaagttcagaaacaaattaa

SEQ ID NO: 1282 - DNA, 1734 bp, Arabidopsis thaliana
atggctaagggatcgtggttcttcattatcctttttatcatctcaatgttagaaaatatgatcaattctctagaattagatcggcatagttttcctgatgatttcatctttgggacagctgcctcggcgtttcagtacgaaggtgcaacaagtgaaggtggcaagtctccaactatatgggatcacttcagcctcacgtatccagaaaggaccaaaatgcataatgcagatgtagcaattgatttttatcatcgttacaaggatgacataaaattgatgaaggagctaaacatggacgctttccgattttcaatctcgtggtcaagattaatacccagtggaaagctaaaggatggagtaaacaaagaaggtgtacaattctacaaggatctcatagacgaacttcttgctaatgacatacaaccttcgatgacgctctatcattgggaccacccacaatctttggaggacgaatatggtggctttctaagccctaaaatcgtagaagattttcgagattttgcaagaatttgttttgaagagtttggagataaagttaagatgtggacaacaatcaacgaaccttatataatgactgttgcgggttatgatcaaggtaacaaggcggctggacgatgctcaaaatgggtaaacgaaaagtgtcaggctggagattcgagtaccgagccttacattgtttcacatcacactcttcttgcccatgccgctgcagtggaagaatttcgaaaatgtgaaaaaacttcgcatgatggccaaattgggatagtactatcaccaagatggttcgagccttatcattccgattcaactgacgataaagaagcagctgaacgagctcttgcctttgaaattggatggcatcttgatccagtcattcacggagattatccagagattgtaaaaaagtacgcgggaaataaattaccttcatttactgttgaacaatcaaagatgttacaaaattcatcagatttcgttggaattaattactacacggctcgcttcgctgctcatcttcctcacatagaccctgaaaaacctcgtttcaaaactgaccaccatgtggaatggaaactgactaatcacagtggtcacatcatcggacctggggaagaaaggggcttcttattttcacacccggaaggcttacgaaaagttcttaactatattaaagagagatacaataacatgccagtctacatcaaagaaaatggaattaatgacaacgacgacggtacaaaaccaagagaagaaattgtgaaggacacatttaggattgaataccataagacacatttcgaagaacttcacaaagctatagtggaagatgggtgtgacgtaagaggatattacgcatggtcattgatggacaattttgaatgggagcatggatacactgcaagatttggtctatactatgttgattttgtcaatggtctcaaacgttatccaaaagattcggtcaaatggtttaagcggttccttaagaaatcggtcgtcggagagagtaacaaagaggaggtagaggagatgtcacgcgcggaagggaataagacttttaagggtttcgaagaatcggcgggtttctttgcatctttcatggcaatgaaccaatcgaggagagatgaggagaataatcgttgctcctttgattttcctcatactcattttggtgttttgcaaggcatagagaacccatcttcattttattga

SEQ ID NO: 1283 - DNA, 819 bp, Arabidopsis thaliana
atgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagtagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcaccataa

SEQ ID NO: 1284 - DNA, 957 bp, Arabidopsis thaliana
atggcgacggtaccattgttcacccagtttccctgcaaaaccctaaatccaagctcatcaaacactaaacaccaatcgaaatctccgatcctactaccgattaactcaataaatcggcgatcggagattggagtctctgttcatcggccagatttcaaaatccgagcgacggacatcgacgacgaatggggtcaagatggagtggagagagtatttgcctcatcttcaaccgtatcggtagcagataaagcaatcgaatccgtggaggagacggagaggctaaagagatcactagcggattcgttgtacggaacagatcgaggtttaagcgtatcgagtgatacgagagctgagatcagcgagctcatcacacagctcgagtctaagaaccctactccagctcctaacgaagctctgtttctcctcaacggcaaatggatcctcgcctacacgtcgttcgtggggttgttcccattgctctcacgaagaattgaaccgttggttaaagtggatgagatctcacaaaccattgattccgatagcttcaccgttcaaaactctgtccggttcgctggtccgttttccacaacgtcgtttagcaccaacgctaagtttgaaatccgaagtcctaaacgtgtccagattaagttcgagcaaggtgttatagggactcctcagctaacggattcgattgaaataccggaatccgtggaggttcttggtcagaaaatcgatctcaatcccattaaaggtttacttacatcagtccaagacactgcttcttcagtggctagaaccatttcaaaccaaccaccattgaagttttctctgcctagtgacaacacgcagtcgtggctgctcacaacttatctcgacaaggaccttcggatctcgagaggcgatggtggaagcgtctatgtgctcatcaaagaaggaagctctctcttaaacccttaa

SEQ ID NO: 1285 - DNA, 882 bp, Arabidopsis thaliana
atggctttgtctcttatctttctagctctcttagtgttgtgccctagtagtggtcacagccaacgttctccttcaccgggatactacccgagttcccgagtaccgacttcaccttttgatcgtgaattccgtactttatggggctctcaacaccaacgtagagagcaagacgttgtcactctttggctcgacaaatccactgggagtgggttcaagtctcttcgtccataccggtcgggctactttggtgcttccattaagctccaaccaggcttcactgctggagtggatacatccctctatctctcaaacaaccaagagcatcctggagaccacgatgaggtcgatatcgagtttctagggacaacgccagggaagccttattcccttcaaacgaatgtcttcgttaggggaagtggcgaccgaaatgtcattggaagagaaatgaaatttaccttgtggtttgaccctactcaagattttcaccattacgcaattttgtggaaccctaaccaaattgtattctttgtagacgatgtaccgatacgtacatataatagaaagaatgaagctatattccccacaagaccgatgtgggtttacggatcgatatgggatgcatcggactgggccacagaaaatggaaggatcaaagccgactatcgataccaaccatttgtggctaagtacaaaaactttaagctagcgggatgcacagcggatagctctagctcatgcagaccgccatcgcctgcacccatgcgcaaccgcgggttgagccggcagcagatggcggcattgacatgggcacagaggaacttcttggtctataactattgccatgatccgaaaagagaccatacccaaacaccagaatgttaa

SEQ ID NO: 1286 - DNA, 294 bp, Arabidopsis thaliana
atggcgaagcgtttgatcccgactctcaaccgtgtattggtggagaagattctcccaccgtcaaagaccgtctccggcattctcctaccggagaaatcatctcagttgaattccgggagagttatagcagttggtcctggagctagagacagagcagggaatctaattccggtttcggttaaggaaggagacaatgttcttttgcctgaatttggcggtactcaagttaagcttggagagaaagagttcctattgtatagggatgaagatatcatggctacacttcacgagtga

SEQ ID NO: 1287 - DNA, 747 bp, Arabidopsis thaliana
atggcttcccgcccttcagtgagacacccgagccacaaccatccattacgcggtcacaaagcccaagttgaagatgagatcatctgctctggttgcgacctagacctactcggtgcatatttcaagtgcacaaagtcagagtgtgattacttcttgcacaagtcatgtttcgatctcccacgtgagatccgtcacaagtctcaccctgatcaccctttgatcctcctctattccccacagaataataattcaacgtatacttgtgacgcatgcggtgagtatggatcggggttcacttacaattgttctatctgccagtacgatgttcatgttggatgtgtgtctgtgcctgagaccatgaagcatgatgagcacgttcacccgctcgctttgatctacaaggctccatgcccaaaggatcatatatttacctgcgatgtttgcgatgaaactatgccgcataatctgtggttgtactactgccagaaatgtgactacggtgctcatttacattcatgcgttgctgaagaagaggaaaagtcaaagaaaggaggaagaggaagaggaggagaaggaggaagtggtggaaatggagtgaacagaggaaggagctccgcgaattcagagctagctgcaatgttaaaggcacaaagagagatggagcagatgcaaattgctcttcacttggagatgcaaagagctaagattgataagaaatcaagaaagcatatgcttaaaatgatctaa

SEQ ID NO: 1288 - DNA, 1266 bp, Arabidopsis thaliana
atggagaagaaaggatctgtgttgatgctccgttatgaggttgggaagtttctcggtcaaggtacctttgctaaggtataccatgctaggcatttgaaaactggtgatagtgtagcgattaaggtcatcgacaaagaaagaatcctcaaagttggcatgaccgagcagattaagcgagagatctctgccatgagactcttgaggcatcccaacatcgttgagctccatgaagtcatggccaccaaatctaaaatctacttcgtcatggaacatgttaagggtggtgagctcttcaacaaagtgtcaactgggaagctgagagaagacgttgcgagaaagtactttcagcagcttgtacgcgctgttgacttctgtcacagccgtggagtatgccacagggacctgaagccggagaatctcttgttggatgagcatgggaatcttaagatctctgattttggtctcagcgctctttctgactctagaaggcaagacgggttgctgcatactacatgcgggacccctgcatatgttgcaccggaggtgataagcaggaacgggtatgatgggtttaaagcggatgtgtggtcctgtggagtgatattgttcgtcttgctcgctggatatcttcctttccgtgattccaatctgatggagctgtataagaagataggcaaagctgaagtcaagttccccaactggcttgctccgggggcaaagagattgctcaagaggatcttggatcctaaccccaacacaagggtatcaactgagaaaataatgaagagctcttggttccgtaaaggcctacaagaggaggtgaaagaatcagttgaggaagagacagaagtggacgcagaggcagagggaaacgcaagtgcagagaaggaaaagaagcggtgtatcaacctgaacgcgtttgagatcatatctctgtccacggggtttgatctctcgggactgttcgagaagggagaggagaaggaggagatgaggtttacatcaaacagagaggcatctgagataacagagaagctggtggagattgggaaggaccttaagatgaaagtgaggaagaaggaacacgaatggagggtgaaaatgtcggctgaggctacagtggtggaagcggaagtgtttgagattgcgccgagctatcacatggtggtgctaaagaagagcggtggagatactgctgagtataagagagtcatgaaggagagtataagaccggctttgatcgactttgtattagcttggcactga

SEQ ID NO: 1289 - DNA, 1185 bp, Arabidopsis thaliana
atggcgtctcaagattgtcatatgttattgagcttctttatatctacttttttaatcactgtcgtgacctcgcaaactcgatgccgaaatttcaagtcgatcatcagtttcggcgactcgattactgatactggaaacttactcggcctctctagtcctaacgatcttcctgagtcagcctttccgccatacggagaaaccttcttccaccatccgtctggtcgtttctccgatggccgcctcatcatcgacttcattgctgaattcttagggattccacatgtgcctccgttttatggatctaaaaatggaaactttgagaaaggagttaattttgcggtgggaggagcaacagcactagaatgttctgttcttgaggagaaaggaactcattgttctcaaagcaatattagtttaggaaaccagcttaagagcttcaaagagagtttaccatatctttgtggctcctcatcaccagattgtagagatatgattgaaaatgcatttattctcattggagaaattggagggaatgattacaacttcccattatttgatcgcaagaacattgaggaagtcaaagagctggttccccttgtgatcactactatttcttcggcgatctcggagttggttgatatgggagcaagaacattcctagttcctggaaattttccacttggatgctctgtagcctatttgacgttatacgaaacaccaaacaaagaagaatacaatcctctaacaggatgtttgacatggctgaacgacttttcagtataccacaacgagcagcttcaagcagaactcaaaagacttaggaatctttaccctcatgtcaacatcatatatggtgactactacaatactctgttgcgccttatgcaagaaccatccaaattcgggctcatggacagacctttgcccgcttgttgcgggttaggaggaccatacaacttcacctttagtataaaatgtgggagtaaaggagttgaatattgtagtgatccttcgaagtatgtgaattgggacggcattcatatgactgaggctgcatacaaatggatatccgagggcgtactaacagggccatatgcgattcctcctttcaattggtcatgcctcgactctaagattaagaacaatgagtcattacacacacaatattctttgatgaacagctga

SEQ ID NO: 1290 - DNA, 1041 bp, Arabidopsis thaliana
atggcggtaggaatctttggattgatcccaagctcatcaccagacgagctaaggaagattcttcaagcgctttcgacgaaatggggagacgtagttgaggattttgagagtcttgaagtgaagccaatgaaaggagcgatgactaacgaagtgttcatggttagttggcctagaaaagaaacgaatcttcgatgtaggaagcttcttgttcgtgtttatggtgaaggtgttgagcttttcttcaatagagacgatgagattcgtacttttgagtatgttgctcgtcatggtcacggtcctacacttcttggtcgcttcgccggcggtagagtcgaagagtttatccatgcccggacactatcggcaaccgatcttcgtgatccgaacatatcagctcttgttgcatctaagctaagaagatttcacagcatacacattcctggagatagaattatgctcatctgggacaggatgaggacttgggtaggacaagccaagaatctatgttcaaatgaacattcaacagagtttggtctagacgacattgaagatgaaatcaacctgctggaacaagaagtgaacaatgaacaagagattggcttctgtcacaatgacttgcagtatggtaacatcatgattgatgaagaaaccaatgcaattactatcattgattatgagtatgcaagttataatccgatcgcttacgacatagcaaatcatttctgtgaaatggcggcagattatcattcaaacactcctcatatcttggactacactctatatccaggggaagaagaaaggaggagattcatatgtaactacttaacctcttcaggtgaagaagcaagagaagaagacatagaacaacttttggatgatattgagaagtatacattggcaagccatctcttctggggtttatggggaatcatatctggttatgtgaacaagattgagtttgattatatcgagtattcgaggcagagattcaaacagtattggcttcgcaagccaaagcttttatctttcttcccatcctaa

SEQ ID NO: 1291 - DNA, 1407 bp, Arabidopsis thaliana
atgtcggagaactcaagaaacttggaagctggtttgctactgaggaagaaccaaaacgacatcaacgaatgtcgtatcactgctgttgtacttttcagtactttcgtttctgtttgtggctctttctgcttcggttgtgcggcaggttattcatcagttgctcaaacagggatcataaatgatttaggtctctctgttgcacaatactccatgtttggttcaatcatgacttttggaggaatgattggtgccatcttcagcgggaaagttgcagatctcatgggtcgaaaagggactatgtggtttgctcaaattttctgcatcttcggttgggttgcagtagcattagcaaaagactccatgtggcttgatattggaagactatccacaggatttgcagttggtttattaagctatgtgataccagtttacattgcagaaataacaccaaaacatgttcgaggagcgtttgtatttgctaatcagctgatgcagagttgtggattgtctttattctacgtcattggaaattttgttcattggcgtaacttggccttaatcggtctcattccatgtgcgttgcaagttgtgactttgttctttattccagagtcccctagactactgggaaaatggggacatgaaaaagaatgtagagcttcattgcaaagtcttcgcggagatgatgcagatatctctgaagaagccaacactatcaaagaaaccatgatcttgtttgatgaaggaccaaaatcgcgggttatggatttgtttcagagaagatatgctccatctgttgttattggtgtgggactaatgcttctacaacaactctctggaagctcaggacttatgtactatgtcggtagcgtatttgataaaggagggtttccaagcagcattggctcaatgattcttgcagtgatcatgataccaaaagctctattgggtctgattttggttgagaaaatgggacgaagaccacttctattggcctctaccggtggaatgtgctttttcagcttgctcctcagtttttccttctgctttcggtcatatggcatgcttgatgagctcactccgattttcacatgtatcggtgtagtgggtttcatctcttcatttgccgtaggcatgggaggcttaccatggatcatcatgtctgagatattcccaatgaatgttaaagtttctgctgggactctggttaccttagccaactggtcctttggttggattgttgctttcgcctacaacttcatgctagagtggaacgcatcaggaacgttcttgatcttctttactatatgtggtgcgggtatagtctttatttatgcgatggtacccgaaactaaaggaagaacattggaagatatacaagcttctcttacagattttctacaatga

SEQ ID NO: 1292 - DNA, 708 bp, Arabidopsis thaliana
atgaaacttgtgcaagaagaataccgtaaaggaccgtggacagaacaggaggacatcctcttggtcaactttgtccacttgttcggagatcgaagatgggattttgtagcgaaagtttcaggtttaaacagaacaggaaagagttgcaggttaaggtgggttaattacctgcatcctggtctcaaacgtggtaagatgactccacaagaagagcgtttagtccttgagcttcacgccaaatggggaaacaggtggtcaaaaattgcccggaaattaccggggagaacagataatgagataaagaactactggaggactcatatgaggaagaaggctcaagagaagaagcgacctatgtctcctacttcctcatcttcaaactgttgctcatcatctatgaccactactactagtcaagacactggaggctccaacgggaaaatgaatcaagaatgcgaagacgggtactactccatggatgacatatggagagagattgatcagtctggagcaaacgttattaaaccggtaaaagacaactactactcagagcaaagctgttacttgaatttccctcctctggcttctccaacatgggaaagttccttggaatctatatggaacatggatgcagatgaaagtaagatgtcttcttttgctattgatcagtttcctctaagttttgaacatggtagtggtcgcctttag

SEQ ID NO: 1293 - DNA, 810 bp, Arabidopsis thaliana
atgagtttgtggggagggatgggaggaggatggggaatggtagaagaaggttggagaaaagggccttggactgctgaagaagaccgccttttgatcgattatgtgcagcttcacggtgaagggcgatggaactctgttgcgaggctcgcggggttgaagagaaatgggaaaagctgcaggttaagatgggttaactacctaagaccagacctcaagagaggacaaatcactcctcatgaagaaaccattatccttgagttacatgctaagtggggcaataggtggtccacgattgcacgtagtttaccgggaagaacagacaacgaaatcaagaactattggcgaacccatttcaagaagaagacgaagtctccaactaacagtgcggagaagacaaagaaccgaatcttgaagaggcaacaatttcagcagcaaagacaaatggagttgcagcaagaacaacagttgcttcaattcaatcaaatcgacatgaaaaagatcatgtcgttactagatgacgacaacaacaatggtgataacaccttcagcagtagcagtagtggcgaaagtggagcattatatgtacctcatcagatcacacattcaacaacaacttctggttgtgaaccaaatagtaacgggtattacccggtggttccggtaacaatacctgaggctaatgtgaatgaagataacgctatttgggacggtttatggaatctggattttgaaggacaaggaagttttggtggcgctgcttgtgccccaaggaagcactatttccagaacatggtcattcccttctgttaa

SEQ ID NO: 1294 - DNA, 594 bp, Arabidopsis thaliana
atgcctatgaagtcgttgaggaatgaccatggaacccttaaggccatgatcggatccgatttcaacgagctcactatcgctgctaagaacctagctacacacgccttcacactcactggtttaggctttggtacctctgtcctcgaatgggttgcttcaatcgccgccatatacttgttggtgttggatcgaaccaattggaagacgaatatgctcacatcacttctcattccttacatcttcttcagtcttccttccttgatctttggtattttcagaggagaaattggtaaatggattgctttcgtagctgttgttgtacaactcttctttcctaaacacgccagagaatacctggaattaccggtggctttggttcttctcgccgtggtggcaccaaatttgattgctggcacattcagagacagttggattggtttagctatatgtttaggtattggatgttacttgcttcaagaacacattagagcttcaggtggattcagaaatgcatttactaaagccaatggtatctccaacaccgtcgggatcatctgtctcgtcgtcttccccgtctgggctcttatcttttaa

SEQ ID NO: 1295 - DNA, 2460 bp, Arabidopsis thaliana
atggataaggagaaggatcatgaagtggagtggcttgaagctcagaagatagaaataagcgttgacttattagctgcagcgaaacaacaccttttgttccttgaaactgttgataggaatcgatggctctacgatggtcctgcgcttgaaaaagccatctacaggtacaatgcttgttggcttcctttgcttgttaaatactctgagtcatcatcggttagtgaagggtctttggtccctcctcttgattgtgaatggatttggcattgtcacaggcttaatccggtgaggtataattctgactgtgagcaattttacgggagagttctcgacaattctggagttctttcttctgttgatgggaactgcaaattgaaaactgaagatttgtggaaaagattgtaccctgatgaaccttatgagcttgacttggataacatagacttagaggacatctctgagaaatcttcagctcttgagaaatgcaccaaatatgatcttgtttcagctgttaagaggcagagcccattttactaccaggtttcgaggtcccatgtaaacagtgacatttttctacaagaagctgttgctagatataaggggtttctctatctgataaagatgaacagagaaaggtctttaaaaaggttttgtgttccgacttacgatgttgaccttatctggcacacacatcagctgcacccagtttcttactgtgatgatatggtgaagctcattggtaaagtgttggagcatgatgacacagattctgaccgaggcaaaggtaagaagctcgataccggtttttctaagactactgcacaatgggaagagacattcggtacaaggtactggaaagccggtgcaatgcatagaggcaagacacctgtacctgtcacaaattctccttatgcttctgatgttttggtcaaagacccaactgcaaaagacgatttccagaatttaatccaattcccagaggtggaagttgttgaggttctcttggagattatcggggttagaaacttaccagatggacataagggaaaggtctcggttatgttcagtaaaactcagccggattctcttttcaatgctgaacgtagactgaccattttatccgaggttggggaaaagcaagtagctactttccagtgtgaacctacaggagagcttgttttcaaacttatttcctgttcaccgtctaagataccagtttcaagagagcctaaaaacttgggttttgcttctttatcactaaaggagtttctgtttccagttattactcaactctctgttgagaagtggttggagttaacacccagtaaaggtagtcaaacagatacgaaacccataagcctgcgagtcgctgtctcgtttactccaccagtacgcagtccatcagtcttacacatggttcaatcaagaccatcgtgcaaaggctcttgcttctttccaatcattggaaagtcccgtcttgctaaaagttcaacacacattgttgatgaaacccaaacagaggtgatcacacttcaaattaggaactccgctgatggaggaatacttaaagatgatcagagacaagttatgggtgtgacagactctggtgaaactcgcgtgcttgcggtttatactggtagtttctggtctttgctggactcgaaatggtcacttaagcaaataaacgcctccactgcagataatccgctctttgagattttgggccctcgagtggtgaaaattttctcggggagaaagctggattatgaaccaaaacactgcgcaaaccttagaagtgatctagatttcatgactcttgtggaattttccaagcaacatccatatggaaaaactgtgggattggttgatatgagatttggttccattgaggcgaaagagaattggttgcttttacccggaatcgtatctgctttcatactccatactgttctgaagaaaggaggttctgaaggcttcaatgtcacaaccaaagatataaaagaggaaagcaaacagactaaacttgttgctgcgacagaaaataatgtgaatgcaaactctacgaatgtggagacccaaactgctattacagcccctaaaaaaggcagcggttgcggcggtggctgtagtggtgaatgcggaaacatggtgaaagcagctaatgctagcggttgcggcagtagttgtagtggagaatgcggagacatggtgaaatcagcagcaaatgctagcggctgcggtagtggttgtagcggtgaatgtggaaatatggtgaaagcagctaacgctagtggtggtggttatggggctagatgcaaagcagctaaagctagcggttgcgggggtggttgcggtggtggctgcggcggtggttgcggagacatggtgaaatcagtaaatgctagcggctgtggcggtggttgtaacggtgaatgcggaaacatggtgaaagcagcataa

SEQ ID NO: 1296 - DNA, 858 bp, Arabidopsis thaliana
atggccaaagacgtggaaggacctgagggatttcagacaagagactacgaagatccgccaccaactccgtttttcgatgcggacgagcttaccaagtggtctttatacagagccgtcattgccgagttcgtagccactctcctcttcttgtacatcaccgttttaactgtcatcggttacaagattcagtccgacacaaaagccggtggagttgactgcggcggcgtcggaatccttggcatcgcgtgggcttttggtggcatgatcttcatccttgtctactgcaccgccggtatctcaggtggtcacataaaccctgcggtgacgtttggtttgttcttagcccggaaggtatcgctgattagggcggtgctttacatggtggctcagtgtttgggtgctatttgtggagttggtttcgtcaaagcctttcaaagctcttactatgatcgttacggtggaggagccaactctctagcagacggctacaacacaggcaccggactagccgcagagatcattggaacattcgttctcgtctacacagtcttctccgctactgatcccaaacgtaacgctagagactcccacgttccggttttggcgccacttccgattgggtttgcggtgtttatggtacatttggccactattccgatcaccggaaccggcatcaacccggctaggagtttcggagctgccgtaatctataacaagagcaagccatgggatgaccactggatattctgggtgggaccattcattggagctgcgatagctgcattttatcaccaatttgtcctaagggcttcaggttccaagtcacttggatccttcagaagtgcagccaacgtttga

SEQ ID NO: 1297 - DNA, 468 bp, Arabidopsis thaliana
atgaatttcatctccgatcaggtaaagaaactctcaagctcaacaccagaggagccagaccacaacaagccagtcgaaggaaccgaaacagctacaagaccagctaccaacgccgagctcatggcaagtgccaaggttgtagctgaagctgctcaagccgcagctcgtaacgaatcagacaaactcgacaagggtaaagtcgccggagcctctgctgatatcttagacgctgccgagaaatacggtaagttcgatgaaaagagtagcactggtcagtacctcgacaaggctgagaagtatctcaacgactacgagtcgtcacactccaccggtgctggtggtcctcctcctccgacgagtcaggctgagccagcaagtcagcctgagccggcggctaagaaagacgatgaagagtctggtggtgggcttggaggttatgccaagatggctcaaggtttcttgaagtga

SEQ ID NO: 1298 - DNA, 3114 bp, Arabidopsis thaliana
atggagcgcgcaaggagacttgcttacagaggaatcgtcaaacgtctcgttaacgacacaaaacgacaccgtaacgctgaaacacctcaccttgttcctcacgctccggcgaggtatgtctcttccctttcccctttcatctccacccctcgatctgtcaaccacacggcggctttcgggaggcaccagcagacgcgttccatctccgtcgatgctgttaaacccagcgatactttccctcgtcgtcacaactctgcaacaccagacgaacaaacccacatggctaaattctgtggctttgaccatatcgattcactcatcgatgctacggtgcccaaatcgattcgattagattccatgaagttctccaaattcgacgctggtttaaccgagagccaaatgattcaacacatggttgatttagcttccaagaacaaggttttcaaatccttcatcgggatgggttactacaacactcatgtccctactgtcattctccgtaacatcatggagaatccagcttggtacactcaatacactccttatcaagctgagatctctcaaggtcgtctcgaatcgctcctcaatttccagaccgtgatcacagatctcacgggtcttcctatgtccaatgcgtcgcttctggatgaaggcactgctgctgcggaggcaatggccatgtgtaacaacattcttaagggtaaaaagaagacctttgtcattgctagtaactgtcaccctcagactattgatgtttgtaagactagagctgatgggtttgatttgaaagttgtcacctctgatcttaaggatatagattacagctctggtgatgtttgtggggttcttgttcagtatcctggtactgaaggtgaagtcttggattatgctgagtttgttaagaatgctcatgctaatggtgttaaggttgtgatggctacggatttgctggctttgactgtgttgaaacctcctggagaatttggggcggatattgttgttggctctgctcaaaggtttggtgttccgatgggttatggtggtcctcatgctgcgttcttggctacttcacaagagtataagagaatgatgcctgggaggattattggtattagtgttgattcttcaggaaagcaagctctgcgtatggctatgcagactagagaacagcatattaggagggacaaagccactagcaacatctgtactgctcaagcgttgcttgccaacatggctgccatgtatgctgtttaccatggacctgcaggtctaaaatctattgcccagcgtgtccatggtctcgctggtatattttccttagggttgaacaagcttggggttgcagaagttcaagaacttcctttctttgacactgttaaaattaagtgttcggatgcacatgcaattgctgatgcagcttccaaaagtgaaattaatctgcgtgttgtggactcaaccactattactgcttcctttgacgaaacaaccaccttggatgatgtcgataaacttttcaaagtttttgcttctggcaagcctgttccatttacggctgaatctctagcacccgaggttcagaattccattccttctagcctaacaagagagagtccttatcttacccacccaatcttcaacatgtaccacacagagcatgagttgcttaggtacatccacaagttacagtcaaaggatctatcactgtgccacagcatgattccgttgggatcttgtacgatgaaactaaatgcaacaactgaaatgatgccagtcacatggccaagtttcactgacattcacccttttgctcctgttgaacaagcacaaggttatcaggaaatgttcgaaaatttgggtgacctcttgtgtacgatcactgggtttgactctttctcgttgcaacctaatgctggtgctgctggtgagtatgccgggcttatggttatccgcgcatatcacatgtcaagaggagatcatcaccgtaatgtgtgtatcatacctgtctctgcacacggtacaaaccctgcaagtgctgctatgtgcgggatgaaaattattacagttggaactgatgctaagggaaacattaacattgaggaggtgagaaaagctgcagaagccaacaaagacaacttagctgctcttatggttacatacccttcaactcatggagtctatgaagagggcatcgacgagatttgcaacataatacacgaaaatggaggtcaagtgtacatggatggtgccaacatgaatgcacaggttggtttgacgagccctggttttattggagcggatgtgtgccatctcaatctccacaagaccttctgtattcctcatggaggtggtggtcctggtatgggtcccattggtgtgaagaatcatttggcaccatttcttccttctcaccccgtgataccgactggtggtatcccacaacccgagaagacagcacctttgggtgcaatatccgctgcaccatggggatctgcgcttatcttgcctatatcttatacttacattgccatgatgggatctggtgggctcactgatgcctctaagattgcaattttgaatgccaattacatggcaaagcgcctagagaaacactacccagttcttttccgtggtgttaacggaacagtagcacacgaattcatcatagacttgagaggcttcaagaacactgctggaatagaaccagaggatgtggcgaaacggctaatggactatggattccatggacccacaatgtcttggcctgtccctggaactcttatgattgagccaaccgagagtgaaagcaaggcggagctagacaggttctgcgatgctctcatttcaatcagggaagaaattgcacagattgaaaaaggaaatgcagatgtccagaacaacgttctcaagggagctccacatcccccatcgttgctaatggcagacacatggaaaaagccgtattctcgagagtatgctgctttccctgcgccttggctccgctcctccaagttctggcccaccacagggcgtgtggacaatgtatatggagacaggaaactggtgtgcactctcctcccagaggaagaacaagtcgcagctgcagtgtctgcttga

SEQ ID NO: 1299 - DNA, 405 bp, Arabidopsis thaliana
atggcttctaaggctcttgcagttacagctcttcttattacacttaatcttcttttcttcacctttgtaacctccacaaaatgtccaccaactactcctaaacccccaaaaaccccgaaatcgcctaagaaggctcctgccgtgaaacccacttgtcctaccgacacacttaagcttggtgtttgcgcagacttattgggcctagttaacgttgttgttggttctccaccaaagactccttgttgtacacttcttcaaggtcttgctaatcttgaagctgcggtttgtctctgcaccgctcttaaagccaatgtcttggggattaatctcaatgttcctattgatctaaccttgctgttgaactattgtggcaagaaagttcctcatggtttccaatgttcttga

SEQ ID NO: 1300 - DNA, 1473 bp, Arabidopsis thaliana
atgtcagtcttcctctgtttcctctgcctcttaccccttatcttaatcttcttgaaaaatctcaaaccatcgaaatggaagcttcctccaggcccaaagaagcttccgatcatcgggaacttacaccaacgccgggaattacatcccaggaacagtcggaatctttccgaaaagtacggaccaatcgtgtttctccgatacggattcgtccccgtggtcgtgatctcgtcaaaagaagcagcagaggaagttctcaagacccacgatcttgagtgttgtagccgaccagagacggttgggaccagagcaatctcttacaactttaaagacatcggattcgcaccgtacggtgaagattggagaacgatgcggaagctctcggtggtcgagctcttcagctcgaaaaagcttcaatctttcaggtatatcagagaggaagagaacgacttgtgtgtcaagaaactctctgatttagcttcgagacgatctttggtgaatcttgagaaaaccctttttactttagtcggaagtatagtgtgtaggatagggtttgggataaatctccgtgagtgtgagttcgttgatgaagatagcatcgatgatcttgtgcacaagtctgaagatgtcataaggaattctatcttctctgatttctttcccggattaatgggtaggctcatcgagtggatcttcagtgagaggaagagattgaatagactttactcggaagtagacactttctttcagaatattcttgatgatcatctcaagcctggaagagagagctctgatatcatcgatgtgatgattgatatgatgaagaagcaagagaaagagggagactctttcaagttcaccactgatcatctcaaagggatgatctcggacatatttctagcaggagttggaacaagctccactacattgatatgggcgatgaccgagctgatcagaaacccgagagtgatgaagaaagttcaagacgagattcggacaacacttggggacaagaaggagagaatcacagaagaagatttaaaccagcttcactacttcaagctcatggtcaaagagatattcaggttacatccagcagctccacttttgctcccaagagagacattgtctcatgtcaagatccaaggctacgatattcctgctaaaacacagatcatgatcaacgcttacgcgattgcacgtgatccaaaactatggacaaaccctgatgagtttaaccctgataggttccttgacagctccatagattacagaggactgaactttgagctattaccgtttggatctggtaggaggatatgtccagggatgacaatggggatcgccattgttgaattgggactattgaatttgctttacttcttcgactgggggctaccagagaaggaagaagccaaggagatcatcaccgggaatgaagttgctcttgaccttgttcaagtttttctccactga

SEQ ID NO: 1301 - DNA, 1515 bp, Arabidopsis thaliana
atgtcaatcttgctctgtttcctctgtcttttacctgttttcttagtttctttatcaatcttgtcaaaaaggctaaaaccctcaaaatggaagcttcctccgggaccaaagacgctcccgatcatcggaaacttacacaacctcacaggtttgcctcacacatgttttcgaaatctctcacaaaagttcggaccagtgatgcttctccacttcggattcgtccccgtagtcgtgatctcatcgaaagaaggagcagaagaagctctcaagacccaagatcttgaatgttgcagccgaccagagactgtagcgacaagaatgatctcttacaacttcaaagacattggattcgctccttacggtgaggaatggaaagcgttgaggaagctcgtggttatggagctcttgaacacgaaaaagtttcagtctttcaggtatataagagaggaagagaatgacttgttgatcaagaaactaaccgaatccgctctgaaaaaatcaccggtgaatctgaagaagacccttttcacgctagtcgcgagtatcgtgtgtaggctcgcgttcggggtgaatatccacaagtgcgagttcgtagacgaggacaacgttgctgatctagttaacaagtttgagatgctagtcgctggtgttgccttcactgatttcttccctggagtgggttggcttgtagaccgaatctcaggtcagaacaagacactaaacaatgttttctcagaacttgacactttcttccaaaacgtgctcgatgatcatattaagcctggaagacaagtatctgagaaccctgacgtcgtagatgtgatgcttgatctaatgaagaagcaagagaaagatggagaatctttcaaactcacaacagatcatctcaaaggaatcatctcggacatatttcttgcaggagtaaacacaagcgccgtcactttgaactgggcgatggccgagctgatcagaaacccgagagtgatgaagaaagtgcaagacgagattaggacaacacttggggacaagaaacagagaatcacagagcaagatctaagccaagttcactacttcaagcttgtggtcaaggagatatttagattacatccagcagctccacttttgcttccaagagagacaatgtctcatgtcaagatccaaggctacgatattcctgtgaaaacacagatgatgatcaacatctactcgatcgcacgtgatccaaaactatggacaaaccctgatgagtttaaccctgacaggtttcttgacagctccatagattacagaggactaaactttgagctgttaccatttggttctggccggagaatctgtcccgggatgacgctgggaatcaccaccgtggaattgggactgttgaatttgctttacttcttcgattgggtagtgcctgtagggaagaatgtgaaggacatcaacttggaagaaacaggatcaatcattattagcaagaagacaacccttgagcttgttccacttgttcatcattga

SEQ ID NO: 1302 - DNA, 828 bp, Arabidopsis thaliana
atgacggaagtgattagcaaaacgagtttgttcttaggagcttgtggtaatcatcaccgtgttgatgatttctctttctctccggtgagttttggtgggtttggtttgaaaaagagtttctcttgtctgaagcttaagagtcagaagcctcttagaagtgtattttacggaaaacagatcgttttcggagattctcaagacgagagcttcagaagatcatcagctatcacagctcagacaactttgaggattgggacagctcagaagtggtgggagaaaggtctgaaagataacatgagagagatctcttcagctcaagagctcgttgattctcttactaacgctggtgataagcttgttgttgttgatttcttctcacctggctgtggtggctgcaaggctctccatcctaagatatgtcagtttgcagagatgaacccggatgtgcagtttcttcaggtgaattacgaggagcataagtccatgtgttatagtcttggtgtccatgttctcccttttttccgattctaccgtggctctcagggtcgtgtttgcagctttagctgtaccaatgccacgatcaagaaattcagagatgccttggcaaagcatggtccagataggtgcagcctcggaccgaccaaaggccttgaagagaaagagcttgtggcacttgcagccaacaaagaactcaactttacttacacaccaaagcctgtaccagttgagaaagaagcagccactcctgattcaaacccaagtctccctgttcctcttccttcgatgagctccaatgacgaaaaaacattggtctccgcagggagatga

SEQ ID NO: 1303 - DNA, 1119 bp, Arabidopsis thaliana
atggcagagcgtgtgtctctcacactcaacggaaccctcctttctcctcctcccacaacaacaacaacaacaatgtcttcttctctccgatctaccaccgccgcttctcttctcctccgctcctcctcctcctcctccagatccactctcactctctccgcttcctcctctctctccttcgtcagatctctcgtctcttctccacgtctctcttcttcttcatccctctctcagaagaaatatcgaattgcgtcggtgaatcggagtttcaactccaccaccgccgctactaaatcttcatcttcagatcctgatcagttgaagaacgctagagaagatatcaaagagcttctcagcaccaaattctgccatccgattttggttagattaggttggcatgatgctggtacgtataacaagaacattaaggaatggccacaaagaggtggagctaatggaagtttgagattcgatattgagcttaaacatgctgctaacgctggtcttgtgaatgctttaaacttgattaaggatatcaaagagaaatactctgggatcagttatgctgatttgttccagttagctagtgctactgctatagaggaagctggaggaccgaaaataccgatgaaatatggtagagttgatgcctctggtcctgaggattgtccagaagaaggaaggcttccagatgctggtcctccttcacctgctactcatctcagagaagttttttacagaatgggattagatgacaaggacatagttgcattatctggtgctcacacgttaggaagatctaggccagaacgtagtggttgggggaagcctgagacgaagtacacgaaagaaggacctggagcaccaggaggacagtcatggacaccagagtggctgaagtttgataattcttacttcaaggagatcaaggaaaagagagatgaagatctccttgtcctacccactgatgctgccatcttcgaagattcttctttcaaggtctatgctgaaaagtatgctgcagatcaggatgcatttttcaaggattacgctgtagcccatgcgaagctcagcaatcttggagcagaatttaaccctccggagggtatcgttatctaa

SEQ ID NO: 1304 - DNA, 1056 bp, Arabidopsis thaliana
atggctacaccaaacgaagtatcagctcttttcctcatcaagaagtatctcctcgacgaattgtctccgttgcctactactgccaccaccaatcgatggatgaacgatttcacgtcatttgatcaaaccggtttcgagttttctgaatttgaaaccaaaccggaaataatcgatctcgtcactcccaaaccggagatttttgatttcgatgtgaaatctgaaattccatctgaatcgaacgattccttcacgttccaatcgaatcctcctcgcgttactgttcaatccaatcgaaaaccgccgttgaagatcgcaccaccgaaccgaaccaagtggattcaattcgcaaccggaaatcctaaaccggaacttcccgtaccggttgtagcagcagaggagaagaggcattacagaggagtgaggatgaggccgtgggggaaattcgcggcggagattcgagacccgactcgtcgtggaactcgtgtttggctcgggacgtttgagacggcgatcgaagcggctagagcttacgacaaagaagcgtttagactacgaggatcaaaggcgattctgaatttcccgcttgaagttgacaagtggaatccacgcgctgaagatggtcgtggcctgtacaacaaacggaagagagacggcgaggaggaggaagtgacggtggttgagaaagtgctaaagacggaggagagttacgacgttagcggcggcgagaatgttgagtcaggtttgacggcgatagatgactgggatttgacggagtttctgagcatgccgcttttatcgccgttatctccacacccacccttgttgtatgctgacgtggaattatgctatatcttttgcttattttatgttcacattcgagcaaaatttattcattcgtttatttgttttttaatacaactcttgatatttctaaattctaaccaatcaccttatttagcggctactgagacaaaaatcgcatgtaaaggcgaatcaatatggaaagaacagagaacacataacacgaagctccgatcaaatgactttttatcatag

SEQ ID NO: 1305 - DNA, 1983 bp, Arabidopsis thaliana
atgatcaccggcaaagacatgtacgatgttttagcggctatggtgccgctatacgttgctatgatattagcctatggttcggtacggtggtgggggatattcacaccggaccaatgttccggtataaaccggttcgttgcggttttcgcggttcctcttctctctttccatttcatctcctccaatgatccttatgcaatgaattaccacttcctcgctgctgattctcttcagaaagtcgttatcctcgccgcactctttctttggcaggcgtttagccgcagaggaagcctagaatggatgataacgctcttttcactatcaacactgcctaacacgttggtaatgggaatcccattgcttagggcgatgtacggagacttctccggtaacctaatggtgcagatcgtggtgcttcagagcatcatatggtatacattaatgctcttcttgtttgagttccgtggggctaagcttctcatctccgagcagttcccggagacggctggttcaattacttccttcagagttgactctgatgttatctctcttaatggccgtgaacccctccagaccgatgcggagataggagacgacggaaagctacacgtggtggttcgaagatcaagtgccgcctcatcaatgatctcttcattcaacaaatctcacggcggaggacttaactcctccatgataacgccgcgagcttcaaatctcaccggcgtagagatttactccgttcaatcgtcacgagagccgacgccgagagcttctagctttaatcagacagatttctacgcaatgtttaacgcaagcaaagctccaagccctcgtcacggttacactaatagctacggcggcgctggagctggtccaggtggagatgtttactcacttcagtcttctaaaggcgtgacgccgagaacgtcaaattttgatgaggaagttatgaagacggcgaagaaagcaggaagaggaggcagaagtatgagtggggaattatacaacaataatagtgttccgtcgtacccaccgccgaacccaatgttcacggggtcaacgagtggagcaagtggagtcaagaaaaaggaaagtggtggcggaggaagcggtggcggagtaggagtaggaggacaaaacaaggagatgaacatgttcgtgtggagttcgagtgcttctccggtgtcggaagccaacgcgaagaatgctatgaccagaggttcttccaccgatgtatccaccgaccctaaagtttctattcctcctcacgacaacctcgctactaaagcgatgcagaatctgatagagaacatgtcaccgggaagaaaagggcatgtggaaatggaccaagacggtaataacgggggaaagtcaccttacatgggcaaaaaaggtagcgacgtggaagacggcggtcccggtcctaggaaacagcagatgccgccggcgagtgtgatgacgagactaattctgataatggtttggagaaaactcattcgaaaccctaacacttactctagtctctttggccttgcttggtcccttgtctctttcaagtggaatataaagatgccaacgataatgagtggatcgatttcgatattatctgatgctggtcttggaatggctatgtttagtcttggtctatttatggcattgcaaccaaagattattgcgtgcggaaaatcagtagcagggtttgcgatggccgtaaggttcttgactggaccagccgtgatcgcagccacctcaatagcaattggtattcgaggtgatctcctccatatcgccatcgttcagggttatattcggaatgctggttgctttgcctgtaacagtactctactacgttcttttggggctttaagttattatcaaaacgtatttgcaaataaaaggcgatacgacccaaaggtgattttttttcaaacgaaaaagaataattacaagaacgaaaaaagactaattccaggtcaggcttag

SEQ ID NO: 1306 - DNA, 312 bp, Arabidopsis thaliana
atgcgaattttgtgtgatgcttgtgagagcgccgccgctatcgtcttttgcgccgccgacgaagctgccctctgttgctcctgcgacgaaaaagttcataagtgcaacaagctggctagtcggcatcttcgtgtaggcttagctgatccgagtaatgcaccaagctgtgacatatgcgaaaatgcacccgcattcttttactgtgagatagatggtagttccctttgtctacaatgtgatatggtggtacatgttggtgggaagagaacacataggcggtttctattactgagacagagaattgaggtttga

SEQ ID NO: 1307 - DNA, 1995 bp, Arabidopsis thaliana
atggctgcgtgtacactccacgcgctctcagtcaccttattcctccttctcttctttgccgtgtcaccggcgaaagctcagcaaccgtacgtcaacaaccaccagctcgcctgcgaggtccgtgtctacgacaacataaccaacggattcacatgtaacggcccaccttcttgccgctcatacctcactttctggtctcaaccaccgtacaacacggcggactcaatcgccaaactcctcaacgtctccgccgcagagatccaatcaatcaacaacctccccacagccaccaccagaatcccaacccgtgaattagtcgtgatcccagctaactgctcctgctcctcctccagcggaggattttaccaacacaacgccacttacaatctctccggtaacagaggagatgaaacctatttctcagtggctaacgatacttaccaagctttatccacgtgtcaagccatgatgtcacaaaaccgttacggcgagagacaactaacccccggcttaaacctccttgttcctctccgatgtgcttgtcccaccgccaaacaaaccaccgccggatttaaatatctcctgacttacttagtcgccatgggagatagtatctccggcatcgccgagatgttcaacagcacatccgccgccataaccgaaggtaacgagcttacatcagacaatatcttcttcttcacaccggttctagttcctctcacaactgaacctaccaaaatcgttatatctccgtcgcctcctcctccacccgttgttgctacgccgcctcaaacgccagttgatcctccgggatcttcttcttctcacaaatggatctacatcggaattggaatcggagctggtttgcttctcttactctcaatcttagctctctgcttctacaaacgaaggtctaagaagaagtcattaccgtcgtcgttgccggaggagaacaagctctttgattcatcaaccaaacaatctattcccacaacaacaacgactcaatggtcaatagatttatccaattcatcagaagctttcggtttaaaatccgccatagaatctctaacactatacagattcaacgatcttcaatcagctacttcgaatttcagcgacgaaaacagaatcaaaggctctgtttatcgcgcgacaatcaacggcgacgatgccgctgtgaaagtgatcaaaggagatgtttcttcctctgagatcaatcttttgaagaagctaaatcattctaatatcatccgtctctcaggtttctgtatccgtgaaggaacatcgtacctcgtcttcgagtattcagagaatggatcgatcagtgattggcttcactcgtcgggcaagaagagtttgacatggaaacagagagttgaaatagcaagggatgtggcagaggcgttagattatctccataactatataactccacctcatattcataagaacttggaatcaacaaacatacttctggattctaatttcagagccaagattgcgaatttcggtgttgcgaggattcttgatgaaggtgatcttgatcttcagttaacaagacatgttgaaggaacacaaggctacttagctccagagtatgtggagaatggagtcattacttcgaaactagacgtgtttgcttttggagttgcggttcttgagcttctttcggggagagaagcagtaacgatacataagaagaaggaaggagaagaagaagtggagatgttgtgtaaagtgataaacagtgtgcttggaggagagaatgtgagagagaagttaaaagagtttatggatccatctctagggaatgagtatccgttggagctggcttacaccatggctcagcttgctaagagctgtgtcgcaactgatcttaactcgcgtccatctgtcactcaggttctaaccacgctctcaatgatcgtctcctcctccatcgattgggagccttctgatgaccttcttcgttccggctctcttggcaactag

SEQ ID NO: 1308 - DNA, 2667 bp, Arabidopsis thaliana
atggcggaaacagtggagctcccgagtaggttagcgattcttcctttcaggaataaggttctcttacctggcgccattattcgaatccgttgtacttctcatagcagcgtcacactagtggagcaagagctatggcagaaagaagagaaaggtttaattggcattttacctgttcgtgatgatgccgagggttcttcaattgggacgatgattaatccaggtgctggaagtgattctggagaaagaagcttgaaatttctagttggtacaacagatgctcagaagtctgatgctaaagatcagcaggatcttcaatggcacaccaggggagtagcagctcgtgctctgcatctttcaagaggggtggaaaaaccaagtggaagagttacgtatgtggttgtccttgaaggtctgagcaggtttaatgttcaggagcttggaaagagaggaccatattcggttgctcggattacatcgctcgagatgacaaaggcagagttggagcaagtaaaacaagatccagattttgtagcactgtcacgccagtttaaaaccacagctatggagcttgtctctgtgcttgagcagaaacaaaaaactggtggaaggacaaaagtgcttttggagacagttcctatccataaactagcagacatatttgttgctagctttgagatgagttttgaagagcaactatctatgctggattcagttgaccttaaagtaagactttcaaaggctactgaactagttgatcggcatctgcagtcaattcgcgtggcagagaagattacgcagaaggtggagggccagttgtcaaagtctcagaaggagtatctcttgcgccagcagatgagagctattaaagaggagcttggtgacaacgatgatgatgaagatgatgtagctgcacttgaaagaaagatgcaagctgcgggaatgccgtcaaacatatggaagcatgctcaaagggaattgaggcgtctaaaaaagatgcaacctcagcaacctggctataacagttcacgagtttacctggagctgttggctgatcttccttgggataaggcaagcgaagaacatgagttggatctaaaagcagcaaaagaacgtcttgacagtgatcactatggtttagccaaggtcaagcaacggatcattgaatatctggctgttcgaaagcttaaaccagatgcgagaggcccagtattgtgctttgttggtccaccaggtgtgggcaagacgtctttggcatcatctattgcagctgcattaggtagaaaatttgttcgcttatctttgggtggtgtgaaagatgaagctgacattagaggacacagaagaacttatataggaagcatgccagggcgcctcattgatggcctaaagagggttggtgtttgcaatccagttatgctgttggatgagattgacaaaacaggctcagacgttcggggtgatccagcttctgcactgctcgaggttttggatccagagcagaacaaatcttttaatgatcactatctgaatgttccatatgacttatcaaaggtggtttttgttgccactgctaatagggttcaacctattccacctcctcttctagacaggatggagctaattgagttgcctggttatacgcaagaggaaaaacttaagatagctatgcgccatctgattcctcgagttctagatcagcatgggcttagttccgagttcctcaagattccagaggctatggtaaagaatataattcagaggtatacaagggaagccggtgttcgtagtctagagaggaacttggctgctttagctcgtgcagctgctgtgatggtggcagagcatgaacaaagtcttccgttgagcaaagatgtgcagaaacttacatctcctctgcttaatggtagaatggccgaaggaggcgaagtggaaatggaagttattccaatgggtgtaaatgatcatgagattggaggcaccttccagagtccctcagctttggtggtggatgagaccatgcttgaaaaaatcctcgggcctccaaggtttgatgacagtgaagccgctgatcgagtggcgtcagctggcgtttcagtgggtctcgtttggactacttttggtggtgaagtccagttcgtggaggctacatctatggtgggcaaaggcgaaatgcatttgacgggccaactcggagatgttatcaaagaatctgctcaattagctcttacatgggtaagagctcgtgcgtcggattttaagctggcacttgcaggggatatgaatgttcttgatggacgagacatccacattcactttcctgctggtgcagtgccgaaagacgggccttctgcgggagtgactttggtgacagctttggtttcgttgttcagtcagaaacgagttagagcagacacagccatgaccggagagatgacactcagaggtctcgttctgcctgttggtggcatcaaagataagatattggctgcacaccggtatggtatcaaaagagtgattctaccgcaaaggaactcgaaagacttagttgaagtacccgccgctgtactttccagtctggaggtgatattggcaaagagaatggaagacgtcctggaaaatgcattcgaaggaggttgtccatggcggaacaactactctaaattatga

SEQ ID NO: 1309 - DNA, 582 bp, Arabidopsis thaliana
atggagattgagaaggatgaggacgacacaacattggttgattctggaggagacttcgactgcaacatatgtttggatcaggttcgagacccggtcgtgactttatgtggccacctgttttgttggccctgcattcacaagtggacttatgcgtccaacaattcaagacaacgagtcgatcaatacgatcataagagggaaccaccaaaatgtccggtatgcaaatctgatgtctccgaggctacgcttgtcccgatctacggacgaggacagaaagctccccagtccggttcaaatgtaccgagcagaccaactggtccggtttatgacttaagaggagttggtcaacgtttaggagaaggggagagtcaacgttacatgtatagaatgcctgatccggtgatgggtgtggtatgcgaaatggtataccggagactatttggagagtcttcgagcaacatggcaccttaccgcgatatgaatgtccggtctaggcgacgggcaatgcaggctgaggagtcattaagcagagtctacttgtttctactttgcttcatgtttatgtgtctatttctcttctaa

SEQ ID NO: 1310 - DNA, 654 bp, Arabidopsis thaliana
atggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaacccgtatatgggtcagccaatgtggcaacaaccaggacctgagcagcaggatcctgacaattag

SEQ ID NO: 1311 - DNA, 1488 bp, Arabidopsis thaliana
atggttttctctgtttctatatttgcctctcttgcaccatacttaatctcagcatttcttcttttccttctcgtcgagcaactctcttaccttttcaagaaacgaaacatccctggccctttcttcgtccctccaatcatcggaaacgccgttgcactcgttcgtgaccccacttccttctgggacaagcaatcctccacggcgaacatctcaggcctctccgccaactacctcatcggaaaattcatcgtctatatcagagacactgagctttcccatcaaatcttctcaaacgttcgtcccgatgccttccaccttatcggacatccctttggtaagaagctcttcggtgaccacaaccttatatacatgttcggcgaggatcacaaatccgttcgccgtcagctagcacctaacttcactcccaaggcactgtccacttactctgccctccagcaattagttattctccgtcatctacggcagtgggaggggagtacctccggcggatctcgtccagtgtcactgcgacagcttgtccgtgaactcaacctagaaacttcgcagacggtttttgttggaccctaccttgacaaggaagccaagaacaggttccgtactgattataatttgttcaatctcggatccatggctctccccatagacctccctggctttgcgttcggcgaggctcgcagggctgtaaagaggctaggggagacgctcggcatttgcgcgggaaaatccaaagcgaggatggcagcaggagaagaaccagcatgcctaatcgatttctggatgcaggcgatcgtcgcggagaatccgcagccaccgcactcgggagacgaagagatcggtggtttgctcttcgattttctctttgccgctcaagacgcgtccacgtcatcactcctctgggccgtgacgcttcttgattcagagccagaggtgctgaacagagtaagagaagaagtagccaagatctggtcacctgagtccaacgccttgatcaccgttgatcagctcgcagagatgaagtatacacgctccgtggcgcgtgaggtcattagatacaggcctcctgcaactatggtcccacacgtcgctgctatagacttccctctcacggaaacgtacactatcccaaaaggtacaattgtctttccttcggttttcgactcctcgttccaagggtttactgaaccggaccggtttgatcctgaccggtttagcgagacaagacaagaggaccaggtgttcaaacgcaacttcctagcttttggatgggggcctcaccaatgcgtaggccagcgttacgcgttgaaccacctcgtactcttcattgcaatgttctcgtcgttgttggatttcaagaggcttcgatcagacggttgtgatgagatcgtgtactgccctactatatcgcccaaggatgggtgcaccgtgttcttgtctaggcgcgtcgcaaagtatcccaacttttcctaa

SEQ ID NO: 1312 - DNA, 1359 bp, Arabidopsis thaliana
atggaatcctccggcgacaagcaaacttcttctctttaccctactgttgacacatccaatcccgaagctcctataaaccctagctcatcatcttctactaacaatctctatccttctctcgatatgaatgatctcgctcgtaatctcttccctgaacaaccagagacgagttctattccggtttcagctcctcccgctgcgacggaggaagtaattttgaaaatctccggcgcgattcttcatttaatcgacaaatcttacagcgtcgagctcgcttgcggtgatcttgagatcatccgtattgttcaaggagagaatgttgtcgctgttctcgctagtgtctccgatgagattcaatggccgttgactaaggatgagaactctgtcaaggtcgatgagtctcattacttcttcacgcttcgtcctaccaaagagatctcacatgattcaagcgacgaagaagacggagatggagggaaaaacactaacgagatgttgaactacggacttacaattgcttctaaaggtcaagagcatttactggtggagcttgagaagatcttggaggattatagtagtttctctgtgcaggaggtgtcagaggaagcgaaggaagcaggtgaaaaggttttggatgtgacggtggcgagagagacgtctccggtggagcttactggggaaaggaaagagattgtggagaggcaatgttctgcttattggactactttggctccgaatgtggaggattatagcgggaaggcggcgaagctgattgcaactggctcaggacatttgataaaagggattctttggtgtggagatgtgactatggataggcttatttggggaaatggtttcatgaaaaggaggttgtcaaaggctgagaaggagagtgaagttcaccctgacaccttgaaaagaatcagaagagtgaagaggatgaccaaaatgacagagagtgtagcaaacagcatactgtctggagtccttaaagtttctggattcttcacaagttcagtggcaaacaccaaagtaggaaagaaattcttcagccttcttcctggagaagtcatccttgcatctcttgacggattcaataaggtctgtgacgctgttgaagtagctgggaggaatgtaatgtcaacctcttccactgttacaaccgaactcgttgatcacaagtatggtggtaaagcggctgaggcgacaaacgaagggctcgatgcagcaggatatgcgcttggcacagcctgggttgctttcaaaataagaaaggctattaacccgaagagtgtactcaagccttcgacgcttgcaaaaaccgccattagatctgcagcttcacaaaaaaaagcctag

SEQ ID NO: 1313 - DNA, 1344 bp, Arabidopsis thaliana
atgacggcggaagatattcgccggcgagataaaaaaaccgaagaagaaagaagactaagagacacgtggcgtaagatccaaggagaagacgattgggccgggttaatggatccaatggatccaattcttagatcggagctaatccgttacggcgaaatggctcaagcttgttacgacgctttcgatttcgatcccgcttccaaatactgcggcacctccaggttcacgcgactcgagttcttcgattctctcggaatgatcgattccggttacgaggtggcgcgttacctctacgcgacgtcgaacatcaatctcccgaacttcttctcgaaatcgcggtggtctaaagtctggagcaaaaacgctaattggatgggatacgtcgccgtttcagacgacgaaacgtctcgtaaccgactcggccgccgtgatatcgcgattgcgtggagaggaaccgttacgaaacttgaatggatcgcggatctaaaggattatttaaaaccggtaaccgaaaacaagatccgatgccccgacccggccgttaaagtcgaatccggattcttagatctctacactgacaaagacacaacctgcaaattcgcgagattctcagcgcgtgaacagattttaacggaggtgaaacggttagtggaagaacacggcgacgacgatgattccgatttaagcatcaccgtgacgggacacagtctcggcggcgcgttagcgatattaagcgcgtacgatatagcggagatgagattgaatcggagtaagaaagggaaagtgattccggtgacggtgttgacatacggaggaccgagagttgggaacgttaggtttagggagaggatggaggaattgggagtgaaagtgatgagagtagtgaatgttcacgacgtggttcccaagtcgccgggattgtttttgaacgagagtagacctcacgcgctgatgaagatagcggaggggttgccgtggtgttatagccacgtgggggaggagctggcgttggatcatcagaactcgccgtttcttaaaccttccgttgatgtttctactgctcataatcttgaagctatgcttcatttacttgacgggtatcatggaaaaggagagagatttgtgctgtcgagtgggagagaccatgcgctagtgaacaaagcgtcggactttttgaaagagcatttacaaattccaccgttttggcgtcaagacgcgaataaaggaatggttcggaacagtgaaggtcgttggattcaagccgagcgtctccgttttgaggatcatcattctcctgatatccaccaccatctctctcagctccgtcttgatcatccttgttaa

SEQ ID NO: 1314 - DNA, 1401 bp, Arabidopsis thaliana
atggatccgacggcgccgttgcttacacacggtggcgaagtagaggaggattatgctccggcgaggagctggaccgatgtgaaacgagtcttatctacagagtcggccaagttgtggatgatagctgctcctgtggggttcaacatcatctgccaatacggagttagctcagtcactaatatctttgtcggtcacatcggcgaagtcgagctctccgccgtctctatctctctttccgtcatcggtaccttctccttcggtttcttgcttggtatgggaagtgctcttgaaacattatgtggtcaagcatatggagctggtcaagtcaatatgttaggagtttatatgcagagatcttggattatcttgttcgtttcttgtttcttcctccttcctatttacatctttgccacgccggttctgagactactcggtcaagcagaggagatcgctgttccagctggacagttcactcttctaaccataccacagctcttctcactggcctttaatttcccaacctctaagttccttcaagcacagagcaaagtggttgctattgcttggattggatttgtggctctttcccttcacgttattatgctctggttgtttataatcgagtttggttgggggacaaatggtgctgctttggcgtttaatattacaaactggggaactgcaattgctcaaattgtttatgtgattggttggtgtaatgaaggctggactggtttatcttggttggcttttaaagagatttgggctttcgttagactctccattgcatctgctgttatgctttgtcttgagatctggtatatgatgagtatcattgttcttactggccgtcttgacaatgcagttatcgctgttgattccctttctatatgcatgaatatcaacggcttggaggctatgttattcatcggaataaatgcagctataagtgtccgtgtatccaatgagcttggcctaggccgtccacgagcagctaagtactctgtctatgtcacggtcttccagtctctcctcattggtcttgtctttatggtggctatcatcatagccagagaccattttgctatcatcttcacaagcagtaaagtacttcagcgtgcagtgtctaagctagcttatcttcttggtataaccatggttctcaacagtgtgcagccggttgtttctggtgtggctgttggaggcggttggcaaggcttagtggcctatatcaacttgggctgttactacatttttggccttccctttggatatcttcttggttacattgcaaactttggagtgatggttagagaatttagaaaatggcatgagttaagtcagttaatgctgaagctaaaacttatgtataatgttttcagggactttggtctggaatga

SEQ ID NO: 1315 - DNA, 2190 bp, Arabidopsis thaliana
atgagtggagctgtgcttgttgctattgctgctgctgttggcaacttgttacaaggatgggataacgcaactattgcaggagctgtgttgtacataaaaaaggagtttaatttggagagtaatccatcagtggaaggtctaattgtggcgatgtcacttattggtgctactctgattacaacatgctctggaggggtagctgattggcttggtcgccgtcccatgctaatattgtcctcaattctctactttgttggttctctagtaatgctatggtctccgaatgtttatgtgttgctcttaggaaggttgttagatggatttggggttggtcttgtggtcacacttgttcctatttatatatctgagactgcaccacctgagattaggggactgttgaatacgctaccgcagttcactggctctggagggatgttcttatcttactgtatggttttcggaatgtcgttgatgccatcacctagctggagattgatgcttggtgtccttttcatcccttcccttgtctttttcttcctcacggtcttcttcttgcccgagtccccaaggtggctcgtgagcaaaggtcgaatgcttgaagcaaagcgggttcttcagagactgcgtggtcgcgaagatgtgtctggtgagatggctttgttggttgagggtcttggaattggaggtgaaacaaccatagaggaatatataattggtcccgcggatgaagttactgatgatcatgatatagctgtggataaggatcaaattaagttatatggtgcagaagaagggctgagttgggttgctaggccagtcaaaggaggaagcactatgagtgttttgtctcgccatggaagtacaatgagcaggaggcaaggctcattgattgatcctcttgtcacactgtttgggagcgttcacgagaagatgccggacactggaagcatgaggagtgccttgttcccacattttgggagtatgttcagtgttggagggaatcaaccaagacatgaagattgggatgaagagaatcttgttggagaaggtgaggattatccatccgaccatggagatgattctgaagatgatcttcattctccgttgatctcacgtcaaacgacaagcatggagaaagacatgcctcacactgctcatggaactctttctaccttcagacatggaagtcaagtgcagggagctcaaggggaaggagcgggtagtatggggattggaggtggatggcaagtggcatggaaatggacggaaagagaagatgaatcgggacagaaagaagaaggtttcccaggatctcgacgtggctcaattgtttcattgcctggtggtgatggaaccggtgaggcagattttgtacaagcgtctgctttggttagccaaccagctctttattccaaagaccttctcaaagaacatacaattggtcctgctatggtacatccatccgaaacaactaaagggtcaatttggcatgatcttcatgatcctggagtcaagcgtgcattagtcgtaggagttggacttcaaatacttcagcagttctcaggcatcaacggagttctttactacacaccgcaaatccttgagcaggcgggtgtcgggatcctactatcgaacatggggattagttcttcctcagcatccttacttataagtgcattgacaacctttgtgatgttacctgcaatagctgttgcaatgaggctcatggatctttctggtcgaaggaccttgcttctcaccacgataccaatcctgatagcatctctattggttttagtaatctcaaatcttgttcacatgaacagcattgtgcacgcggtcttatcaaccgtaagcgttgtgctctacttctgcttcttcgtgatgggtttcggtcctgctccaaacatcctctgttcagagatttttccaactcgagtccgcggaatctgcatcgccatctgcgcactcaccttctggatctgtgacataatcgtcacttacagtctccccgtgctgctcaaatccattggactagctggtgtgtttggaatgtacgcaatcgtatgttgcatttcatgggtctttgtgttcattaaagtcccggaaactaaaggcatgccacttgaagtcatcacagagttcttttctgttggagctagacaagctgaagctgctaaaaacgagtga

SEQ ID NO: 1316 - DNA, 1539 bp, Arabidopsis thaliana
atggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcattga

SEQ ID NO: 1317 - DNA, 528 bp, Arabidopsis thaliana
atgggctcagaggaaaacaacagcacaagctttccaccaacagagccaaagctctgtgataacggatgtggattcttcgggtcaccatccaacatgaatctctgctcgaaatgttacagaagcttaagagccgaggaagatcaaaccgcggtagcgaaagctgcggtgaagaactctttaaagcttccatcttgcagtatcattgcacctggacaaaaacatcctctggaaattaaaccagctcatttggaaaccgttgttgtaaccgctgagccgtcttctgtacctgtagccgcggaacaggacgaggctgagccgtcgagacctgttagaccgaacaacaggtgtttcagctgtaacaagaaggttggtgtaatggggtttaagtgcaaatgcggtagcacgttttgcgggagtcataggtacccggagaagcatgagtgtagcttcgatttcaaagaagttggacgtgatgcaattgcaaaggctaatcctttggttaaggcggataaagttcagaggatttga

SEQ ID NO: 1318 - DNA, 609 bp, Arabidopsis thaliana
atgagttctcagatttcggagattgaacaagagcagctgatcgagaagcttgagatcttcaagatccatggcagagacaaacgtggccgtaagatccttcgtattatcggaaaattcttcccagctcgatttctgtcactggatgtgttgaagaagtatctagaggagaagatatttcctcgattaggtagaaaaccattcgccgtactctacgtccacaccggcgtacagagaagcgagaacttcccaggtatctcagctctacgagcgatctacgacgcaattccggtaaacgtcagagacaatcttcaggaggtttacttcctccatccaggtcttcaatcacgtctcttcctcgccacctgcggccgatttctattttccggcgggttgtacgggaagctgaggtacataagcagagttgattatctgtgggaacatgtgaggaggaatgagatagagatgccggagtttgtatacgatcacgatgatgatctggagtatcgtccgatgatggattacggtcaagaaagcgatcacgcgagggttttcgccggagccgccgtggattcatcagtctcaagtttctccatgaggtgtatctcatag

SEQ ID NO: 1319 - DNA, 795 bp, Arabidopsis thaliana
atggctttcacaaaaatctccttagtccttcttctctgcctcttaggtttcttttctgaaactgtcaagtctcaaaactgcggttgcgctccaaacctctgttgcagtcagttcggttactgtggtaccgacgatgcatactgcggtgttggatgccgatcaggtccttgtagaggtagtggaaccccgaccggagggtcggtcggtagcattgtgacacaaggtttctttaacaatattatcaaccaagctggtaatggttgcgcggggaaaagattctacacccgtgactctttcgttaacgccgctaatactttccccaactttgccaattctgttaccagacgtgaaattgctaccatgtttgctcatttcactcacgagaccggacatttctgctacatagaagagattaacggagcaacacgtaactactgccagagcagcaacacacaatacccatgtgcaccgggaaaaggctacttcggtcgtggtccgatccaactatcatggaactacaactacggagcgtgtggtcaaagtctcggtcttgaccttctacgccagcccgaacttgtgggtagcaacccaactgtagctttcaggacgggtttgtggttttggatgaatagcgtaaggccggttctgaaccaagggtttggagccaccattagagctattaatggaatggaatgtaacggtggtaattccggtgcagtcaacgcaaggattggatactatagagactattgtggacagcttggtgtggaccctggtcctaaccttagttgctaa

SEQ ID NO: 1320 - DNA, 792 bp, Arabidopsis thaliana
atgagtgaggaaaagaggaaacaacattttgtactagtacatggttcgtgccatggcgcgtggtgctggtacaaggttaagccgctgctagaggcggtgggccaccgcgtaactgctgtggacttagctgcctccggaatagacacaacgaggtcgatcactgacatccccacatgcgaacaatactcggagccattgacgaagctcctgacctcattgccaaatgatgaaaaggttgtgctcgttggtcacagctttggtggcttgaacttagccatagccatggaaaagtttcccgaaaaaatctctgtcgctgtattcttgactgctttcatgccggacaccgaacactcaccatccttcgtcttggacaagtttggaagcaacatgcctcaagaagcatggatgggcaccgaattcgaaccttatggttcagacaattccggactgagtatgttttttagccctgacttcatgaagttgggtctctaccagctttctccagttgaggatcttgaactgggattacttttaatgaggccaggatcgttatttattaacgatttatcgaagatgaaaaacttctcggatgaaggatatgggtctgttcctcgagttttcatagtgtgtaaagaggacaaagcaattccagaagaacgccagagatggatgattgataattttccggtgaatttagtgatggagatggaggagacagatcatatgccaatgttctgcaagcctcagcaactcagtgattacttcctgaaaatcgcggacaaattcgtttaa

SEQ ID NO: 1321 - DNA, 1116 bp, Arabidopsis thaliana
atggcttcagcttctttctctgcggtttcttcgctctcgtatcaattccgttcaaaagaagcgatcttttcatcgaaagcttcctgttttagctcgacggctttatcaggaaggagagtgtttggatctatcaaagcagctcaagtgacaagccatgagaatcctagaagacgaactcagaacgtcgaaggagatatatttgttgacaatacttgtattgattgtgatacatgtcgttggatggttccgccaattcgtaaacagcttttctctgatttatcttcacaggatttattcactcgagtggacaacatgtctgcggttacaaagcaaccaacttgtaaggaggaaagactgaatgctcttcaggccttactatcttgtccgacgggctctattcgcactcaaactccacctgctgacataggggaagctcaagagacctttccacttgtagtggacaaagacacacttcctgtactttttaatcccttaagctttcatttttttaggatggttattaacaatcctaggtacgtggagaaacttgctggaaagatcgagatgaagggtggtgttcgctacatgtttttgacacacagggatgatgttgcagatcacaagaaatgggcagacagattcaagtctaccagaattctgcattctgatgatgttgaaccttcgacctctgatgtggagttaaagctggaaggaagtggaccatggagtatctatgaagatgtcgaacttatacacactcctggtcattcagaagtaagtttgtccaactgcaagaacatacataaaaacaaatgttcaatttttggatcagtgtgcatgttccataagtccctcaaggcattattcactggcgaccatgtaataatgaccgaatctggattgagcattttagagcagtacaatcacggttcagtgcctctccagctcgagaacgtagaaaaattgatcaacctggatttcaattggctaataccgggacatggaagaagagtacatttcaaagatggagacgagaaggcgaagaatctggaagcacttgttcagaagcacagagagaaacaacttgtttcctttagcaaatccgggaaagcttaa

SEQ ID NO: 1322 - DNA, 618 bp, Arabidopsis thaliana
atggcaactcaaaaagagaaaccttcctccaattctttcaaatggttttccaccaaaaccttaaagttaaaccttagtttccaaaaccgacgaagatcaccaaaatcaaactcttcgtcaaccttaaactctccaagaagcaacagtgatgacaacaacaacataaagagtcaccaggcctccaaagaagagctccgtcaagtcttcagccatttcgacagcgacggcgacggtaagatctcagcctttgagctcagacattacttcggctctgtcggtgagtatatatctcacgaggcagctcaagaggcgataaacgaagttgacactgacgcagacgggtctctagggtttgaggactttgttggattgatgacaagaagagatctttacggtgacggtgaagttgatggcgatggagagttgaagacagcgtttgagatgttcgaggtggaaaaaggatcaggctgcataacaccaaagggtttgcaaaagatgcttgtgaagttaggggaatcaagaacgtacggagagtgtgaagccatgataaagttttacgatatagatggtaatggaattcttgattttcatgagtttcgtcaaatgatgacggtttag

SEQ ID NO: 1323 - DNA, 798 bp, Arabidopsis thaliana
atggctgaggagtacaagaacaacgttcccgagcacgagacaccaacggtcgcaacagaggaatcaccagcgacgacaacagaggttacggatcgtggattgtttgatttcttggggaagaaggaagaggaagtgaaacctcaagagacaacgacgctcgagtctgagttcgatcataaggctcagatctctgaaccggagttagctgcggagcacgaggaagtgaaggagaacaagattactctgctagaggagcttcaagaaaagaccgaggaagatgaggagaacaagcctagtgtcatcgaaaagcttcaccgatccaacagctcttcttcctcttcgagcgatgaagaaggtgaggaaaagaaggagaagaagaagaagatcgttgaaggagaggaagataagaaaggactagtggagaagatcaaggagaagctcccaggacaccacgacaagacagcagaggatgatgtaccagtttccactaccatcccggtaccagtgtcggagagtgtggtggagcatgaccatcccgaggaagagaagaaaggattagttgagaagatcaaggagaagcttcctggtcaccacgacgagaaagcagaggattcaccagctgtcacgtccacgccgttggttgtaacggagcatccggtggagcctacgacggagcttccagtggaacatccggaggagaagaaggggattttggaaaagatcaaagagaagcttccaggttatcatgccaagaccactgaagaggaagtgaagaaagaaaaagagtctgatgattaa

SEQ ID NO: 1324 - DNA, 1122 bp, Arabidopsis thaliana
atggatcgtgtggtcttcttcttcctcatcgcagctacgttactagcaggttctctcggatctaccgtcatctccggcgaggttaccgacggtttcgttaacccgatcaggcaagtcgtcccggaggagaacgatgaacaactcctcaacgcagaacatcacttcactctattcaaatccaagtacgagaagacttacgcgactcaggtagagcacgatcatcggttccgtgtcttcaaagctaacctaagacgagctaggcgtaaccagcttctagatccgtctgccgtccacggcgtcacgcagttctcagatcttactccgaaagaattccgccgcaagtttttaggactgaaacgccgagggtttcgtcttcctactgatactcagacggcgcctattcttccgactagcgatcttccgacggagttcgattggcgtgaacaaggagccgtcacacctgttaaaaaccagggtatgtgtggttcatgctggtcatttagtgcgataggagctcttgaaggagcacattttctagccactaaagagcttgttagcctcagtgagcagcagctcgtagattgtgaccatgagtgtgatccagcacaagccaattcatgtgattctggttgcagtggaggactaatgaacaacgcttttgagtacgctcttaaagctggtggtctaatgaaggaagaggactatccttatacaggacgtgaccataccgcttgtaagttcgacaagagcaagattgttgcgagtgtgtctaacttcagcgttgtctcttcggatgaagaccaaatcgctgctaatctagtccagcatggacctctagctattgctatcaatgcgatgtggatgcaaacatacataggaggagtctcgtgcccgtatgtatgttcaaagagccaagaccatggagtgctcttggttggatttggttcatcgggttatgcaccaatccgtcttaaggagaagccttattggattatcaagaactcgtggggagcgatgtggggagagcatggttactacaaaatctgcagagggcctcataatatgtgtggtatggatacaatggtatctactgttgctgctgttcatacctcacccaagtag

SEQ ID NO: 1325 - DNA, 468 bp, Arabidopsis thaliana
atggatttaggaaggtttccaataatctcaatcctcgaagacatgcttgaagtccccgaagaccacaacaacgagaagacccgcaacaacccttcacgagtttacatgcgagacgctaaggcaatggctgctacacctgctgacgtcatcgagcaccctaacgcatatgcattcgtcgtggacatgcctggaatcaaaggagatgagatcaaggttcaggtcgagaacgacaatgtgcttgtggtgagtggagagaggcagagagagaacaaagaaaacgaaggtgtgaagtatgtgaggatggagagaagaatgggtaagttcatgaggaagtttcagttgcctgaaaatgcagatttggacaagatctctgctgtttgtcatgacggtgtgttgaaggttactgttcagaaacttcctcctccggaaccaaagaaaccaaagacaattcaagttcaagttgcttga

SEQ ID NO: 1326 - DNA, 486 bp, Arabidopsis thaliana
atgtctctcattccaagcatttttggaggacgcagatcaaacgtctttgatccgttctcgcaagacttatgggatccattcgaaggattcttcacgccatcttctgcgttggcaaacgcttcaaccgctcgtgatgtggcagcgtttacaaacgcaagagtggattggaaggaaacgccggaggcacatgtgttcaaagcggacttgccaggcctgaagaaggaagaagtcaaggttgaggttgaagacaagaacgttctgcagattagcggagagaggagcaaggagaacgaagagaagaacgataagtggcaccgtgtggagagagctagtgggaagtttatgagaaggtttaggttaccggagaatgcaaagatggaagaagtgaaggcaacaatggagaatggtgtgcttacggttgtggttccgaaagcgcctgagaagaagcctcaagtcaagtccatcgatatctccggggctaattga

SEQ ID NO: 1327 - DNA, 633 bp, Arabidopsis thaliana
atggcatctgctctcgctcttaagagactcctatcatcctccatcgctccacgttcccgtagtgttcttcgtccagctgtttcctctcgcctcttcaacaccaacgccgttaggagctacgacgacgacggcgaaaatggagacggcgttgatttatatcgccgctctgttcctcgccgccgtggtgatttcttctcagatgtgtttgatccgttttcgccgacgaggagcgttagtcaagtgctgaatctgatggaccagttcatggagaatcctctgttatcagctactcgtggcatgggagcttcaggagctcgtcgtggttgggatataaaagagaaagacgatgctctgtacctgagaatcgacatgcctgggctgagcagagaggatgtgaagctggctttggagcaggacactctggtgattagaggagaaggaaaaaacgaggaagatggtggcgaggaaggagagagcggtaatcggagattcacaagcaggattggattaccggataagatttacaagatcgatgagattaaggcggagatgaagaacggagtgttgaaagttgtgatcccgaagatgaaagaacaagagagaaatgatgttcgtcagatcgagatcaactaa

SEQ ID NO: 1328 - DNA, 1365 bp, Arabidopsis thaliana
atggaggacaagaacaatgataaggagaaaaaaaccgacgttacgttcgaagatgacgaagataacgaagatctagaagacaacagcagtaagtacgagaacgacagtgaaactgatcaaagcgatctcggagatcttcctggtgatgctgttgatcgtgacgacgacatcgatgaacctttcatttcccaggttcaatggcctcaaagcttcagggaaacgactgattcttatacgattgcggcatcaccaatcttcgggtcgctcaggagtaatcctccgagtttctatagagccagcagaagtaatttagatgttgagtcaaaagcacctttgcttcctgagaggcatgatgattcagacaaagcctcagctacacaatctgcttggtctcataaaggctcatttgctgaggaattgcccattggtggctatggatgcagcgtcattcaaaccattttcaatgctattaatgtaatggctggagttggacttctctcaacaccttatacagtgaaagaagctggttgggcaagtatggtaattcttctcttatttgctgttatttgttgttacactgctactttaatgaaagactgtttcgagaacaagaccggcattatcacttatcctgatattggagaagcagcttttggcaaatatggtcgtattcttatctgtatgctattgtacacagaactatattcatattgtgttgaattcatcattttggaaggagataaccttaccgggcttttccctggtacatccttggatttgctcgggttccgacttgactctaagcatttatttggaatcttaactgctctcattgttcttccaactgtttggttgaaagatctacgcatcatttcctacctctcagccggtggagttatcgcaaccgctttgatagcagtaagcgtgtttttcctcggtacaacgggcgggattgggtttcatcacaccgggcaggctgtgaaatggaacgggataccgtttgcaattggttgtgagtccgtttacaaaatacgctctcctgatgaatccacttgcaaggagtatagaagaactattaccggaaagaatgtcagagaacatatggtgctttcttcttctaagaacagcactcgtcgcttcttctgtttgttctgctttccttattccattttttggtcttatgatggctcttataggatctcttctcagtatactagtggcaataataatgccagctttatgcttcataaagataatggggaacaaagcaacaagaacacagatgattctgagttcgatcattgtggccatcggggtggtaagcgggaccttggggacatattcttcggtggcaaagatcattag

SEQ ID NO: 1329 - DNA, 816 bp, Arabidopsis thaliana
atggactatgatcccaacaccaatccgttcgaccttcatttctccggtaaacttccgaaaagagaagtctcggcttcagcttctaaagttgtagagaagaaatggttagtgaaagatgagaagagaaatatgctacaagatgaaataaaccgggttaattcggagaacaagaagctaaccgaaatgttagcaagagtctgtgagaagtactatgctcttaataatcttatggaggagttgcagagtcgaaagagtcctgaaagtgttaactttcagaacaaacagctaacggggaaacgaaaacaagaacttgatgagtttgttagctccccaattggactcagtctcggaccaatcgagaacatcaccaacgataaagcgacggtttcaaccgcttactttgctgctgagaagtctgacacaagcttgactgtgaaagatggatatcaatggaggaaatacgggcaaaagattacgagagataatccatctcctagagcttacttcagatgctcgttttcaccgtcttgtctagtcaagaagaaggtgcaacgaagtgcagaagatccatctttcttggtagccacttacgaagggacacataaccacaccggaccacatgcaagtgtgtccaggacagtgaaacttgatctagttcaaggtgggcttgaaccagttgaggaaaagaaagagagagggacgattcaagaggttttggtgcaacaaatggcttcttcgttgaccaaagatcctaagttcactgcagctcttgcgactgctatttccgggagattgatagagcattcaagaacatga

SEQ ID NO: 1330 - DNA, 347 bp, Arabidopsis thaliana
tttacttacgtggtccttcggcgagactcaatttccctgaagaggtctttaaggatggaaacggcggtgaaggcttaggaggagatatgtctccgacgttgatacggaagaaggcggctgaggtgggagctagagtcgacgcagagttgcggttagagaataggatggttgagaacttagacatgaataagttgccggaggcatatggattgtaatttatagtttggtagtttataggttggagattgcccggagacagagtcaaacagaggttctctgactcatatgaggcataatatagttaatatagtaatttttgttttgagcatagtaattatgtcataacc

SEQ ID NO: 1331 - DNA, 1077 bp, Arabidopsis thaliana
atgatgaagatccagccgattaacaacgatttgccggcgaatagagtggaatcatcaaccaaaccagtgcttaagtctcgtctcaagcgtttattagatcgaccgttcacgagaatctcaaactcagagaaattactcatctctggagatggagtcgtcgctggaacagagttcgagccaagcttagcgaaaatggttcaaaactatatggaagaaaacaacgacaagcaaacaaagaatggtcgcaatactcatcgttgcaattgttttaacgggaacaatgatatctccgacgatgaactcgatttcttcgattatgacaatttcaagagtttgattcaatgcggaagcttcgttgagaagagtcttttagtggaagctacgaagattatagagaagaacaaatcagttaaaagaaaagacgaattgagaaagattgttgttgatgaactctcatctcttggttacgactcttcaatttgtaaatcgaaatgggataaaactcgttctataccggccggtataatctccttaaccagtttttcttcttcttcttctacctttgatttttgtgagtatgagtatatagatgtgattgtgaacggagagaggttgataatcgacattgattttagatcggagtttgagatcgcaaggcagacgagtggttacaaggagttgcttcaatctctaccgttgattttcgtcggaaaatctgataggattcgtcagattgtttctatagtttcggaagcgtcaaaacagagcttgaagaagaaaggtatgcatttcccgccgtggagaaaagctgattacatgcgcgctaagtggctatcttcctacactcgaaactccggcgaaaaaaagccgacggttacttctgccgcgaaagtcgtagctgaaccggagctagattcttcggagattgagctgattttcgaggagaaggtcttgttgccgccattgaagtctccgattacgtctgttggtagagatgatgatgacgtggcagagtcagtgaagaaagaagcaaaggtcgtcacgggattagctttactgttcaaagaaaatcactaa

SEQ ID NO: 1332 - DNA, 1203 bp, Arabidopsis thaliana
atgggattaaggatgtcagaatcagctaaaccttattttgcaatggtctgtcttcagttcggatacgcaggtatgaacttagtaactaaaaccgtcctagaccgcggtatgagccattacgttcttgttgcataccgcaacgcttttgccacagccgctatcgcacccttcgctcttctctccgaaaggaaagtgagatcaaagatgacgtttccaatattcatgcgaatatttcttcttgctcttctcgggccggtgattgatcagaacttatactatatcggtctaaaactcacatcaccaacgttttcctccgccgttagcaacatcgtgcctgcaattaccattatccttgccacacttttcaggatggagaaagtggagatgagaaaagtaagatgcctggtaaaagtgatggggacgttagtgacagtggttggatccatattgatgatattctacaaaggtcctttcattaatttcttccggtctcacctcacggccgcctcttcgccgccgacggctgactatcttaaggctgccgtcttcctactcctcgcttccctctcatgggcgtcgttctttgttcttcaggctgcgactttgaagaaatactcagcccatctctcaatgtcaacaatggtgtgtttcatgggaacgttacagtctttagccctagccttcgtaatggaacacaatccttctgctttgaacatcggttttgacatgaaccttctcgcttctgcctacgcgggaataatgtcgtcgagcatagcttactacgttcaaggacttatgatgcagcgaaaaggaccggtctttgtcactgcttttaaccctcttatcgttgtcattgtctccatcatgagcttcttcgttctcggtcaaggaatctaccttggagggtacgttaacaacaaccgggttattggagtggttgttttgatggtgggagtctacgccgtgttatggggcaaacatgtagatgatgacggcgaagaaacacgccatgaagataacgttgtagccgttaagtgttgtagtggcaataatggtctaacgataatgccgaaaatcgacgaagctgatgaggaggatgttgaaaccggaaaggctacgtcggagaaggagtcgtcagttccggaagtggtggtggtagttttttgtagtgaaaatgtgcatagcgtttcacgacctaactag

SEQ ID NO: 1333 - DNA, 351 bp, Arabidopsis thaliana
atggcttacacaaacaaagttacgatatcagccgcggttgcgacaatgatgctgtttctggcggttacgatcgtggatgcacagtcaatgccaccaatgccaaagtttaatcctgtgtgcgcgttggcggatctcccaaacatcgtccaactttgctactttaacttggatttgacgccatctgaagagtgctgcaatgatctcaaatcgtcgagcacgatacaagtgaattgtctctgtgacaatttcattgcacatccttccaatggcaatatctcgcaagctcgctacgacctggtcaacagcgcctgtggtgttgccgacaaattcgcatgtaaaggtatcttttaa

SEQ ID NO: 1334 - DNA, 552 bp, Arabidopsis thaliana
atgatgcctcgccgtgacgtcctcttcctctcactcctcctcgtcatcgccaccgtctccgctgtcgcattagccgacgatgaagcagattgtgtctacacattcttccttagaaccggatcaaccttcaaagccggtacagattcgatcataagcgctagagtctacgacaaatacggagactacatcgggatccgaaacctagaagcatggggtggtttaatgggaccaggttacaactactacgagaggggtaatctcgacattttcagtgggaaagcaccatgtcttccgagcccagtctgttcattaaatctgacctctgacggctccggtgaccaccacggttggtatgttaactacgtggaagtcacgacagccggagttcatgcaaagtgctcgtaccaaagctttgatgttgagcaatggcttgcgtccgatacatcgccgtatgagctcagtgctgttcggaataactgtccagtttcgcttagggaaagtgtcggtcgggtcgggtctgagatccggaagactctctcttggatcgtgtga

SEQ ID NO: 1335 - DNA, 771 bp, Arabidopsis thaliana
atggcgtattctcttcctacatttccccaagccttaccttgctcgtcaaccaaaacttcttcctccttggctaccttccgatctcctttcttaagattcaatggttccacttccttaatcccctcctctatctccatcacttcacgtggcacatcctccccgaccatcatcccacgtgctgccgcctcagaatccgactctaacgaagccctagccaacacaaccttccacggcctctgctatgtcttgaaagacaacatagacaccgaccagatcatcccagcaggagccgcttgcaccttcccatcgaaccagcaagagcgtgatgagatcgccgctcacgctctctctggtctaccagacttccacaaaacacggttcattgagccaggagagaacagatcaaagtactcaatcataatcggcggcgaaaactttggttgcggatcgtcacgtgaacatgctccggtctgtcttggagcagctggagctaaagccatagttgctgagtcttacgcaagaatctttttccgtaactcggttgctacaggagaggtgtttccgctcgagtcagaggttagagtctgtgaggagtgtaagacaggagatacggtgacgatcgagctgagtgatagtggtggtttattgactaatcacacgaccggtaaaaactataagctgaagtcgatcggtgatgctggaccggttattgatgctggtggtatttttgcttatgcgaggatgatgggaatgattccatcattagcttaa

SEQ ID NO: 1336 - DNA, 2121 bp, Arabidopsis thaliana
atgaatatatctcagattattttcttcgcgtcccttcttctacggcttcacttatcaacggcggaacatcaaaattcaaacgctggtgatggagacaccatcatattcaccactctaggacgatcgcactacgaatttgacatattcgccctctccacgactcaaccgccgtcagtttccggagagctccgaatcaccgatggggaatcggtaaatttcaacggctatttcccgtctccttctccggctctattatctctccttcccgacgaaaccctaattcaaatggaagattcgtctcctctgcatctcatatacgtcaccgagagaaacggtacttctagcttgtactacgatctagtttacggcggtaattctgattttaaaacgaaacgaagatcggtgttagaagcaccgtctcgagtccaagttccgttgttatcccgctttgatcatctgagtggcatgacggtaaattcttttaaagataagcctagtttgagtggtgagtttattgtctacgtgtcaacccatgagagctcaggtgagccgagagcaagctggaccgccgtttactctaccgagttaaaaaccgggttaaccaggcggttaacaccgagtggtgtagctgatttcagcccggcggtatcgccttccggaaatttaacggctgtggcttcatacggagagagaggctggacaggggaagttgaagagctacgtacggacatctatgtattcttgactcgggatgggtctcaccgtgtcaaggtggtggagcacggtggttggccgtgttgggttgatgagtcgactctgtatttccatagaagaagtgaggaggatggttggatcagcgtttaccgagccatcttacctgaaaacggaccgttgactactgagtcggtgacaattcagcgagtcacaccaccgggagttcacgctttcacaccggccacgtcaccaaacaaccacgagttcgttgcggtagctacaaggagaccaggctcggattaccgccacgtggagttgtttgatctaaagaggaatgagtttatagagttgactcgtttggtggcgccaaagagtcatcacttgaatccattcttgtcccctgactcgtctcgagtcggatatcatagttgtagaggcgatgctaatggacggagaagtcctctgctcttccttgaaaatattcaaaccactacaagggacctctctctctttagaattgatggttcgtttccttcgttctcacctggaggtgatcgtatcgcatacgttaagatgcctggtgtgtttgtggtgaagccggatggttcagggcagcgtgaagtgtacaagggaatggcgttttcgacagcttgggatccggttcgacctggaattgtgtactctagctcaggtccaacgtttgctacagagagaacagaggttgatgttatctctattgacgttgatgcagccgataagtcatcttccgtgaggaggctaacgacaaacgggaagaacaatgctttcccttggccatctcctgatggtaagcggatagtgtttcgttcggggcggactggtcacaaaaacctctacataatggatgctgagaaaggagaaagcggtggtctatggaggttaaccgaaggtgcgtggaccgacacaatgtgtaactggtcaccggatggggaatggatcgcgtttgcatcagatcgagaaagccctggctcgggtagttttgagctcttcttgatccaccccaacggaacagggttaaggaagctcatccaaagcgggacgggtgggagaacaaaccacccgatcttcagcccggacagtaaatcattagtcttcacttctgattatgctggaatctcggcggaaccgatctcgaacccgcatcattaccagccatacggtgatatcttcacggtgaaattagatggctctaatgtgaggaggctaacgcataactcttatgaagatgggacaccggcatgggcccctcggttcatccaccccaacaatgtggagctacaaaggaggaatgattctaggtgctcgttcgaagactgtcactggctcaacaagtaccctacactaaaaggccgaaaaatatcttgttaa

SEQ ID NO: 1337 - DNA, 2043 bp, Arabidopsis thaliana
atggctgcttactttcacggaaacccaccggagatctctgccggatccgacggtggtcttcaaacgttgatcctcatgaatccaactacttacgttcagtacacccaacaagacaacgactcgaacaacaacaacaacagcaacaatagcaacaacaacaacacaaacacaaacacaaacaacaacaacagtagtttcgttttcctcgattcccacgcgccgcagccaaacgcgagccagcagttcgtcggaataccactctcaggtcacgaagctgcttccattacagccgccgacaacatctccgtacttcacggttatcctccgcgcgtgcagtacagtctctacggtagccaccaagtggatcccactcaccagcaagccgcgtgtgagacgccacgcgcgcagcaaggcctctctttaaccctctcgtctcaacagcagcagcaacagcaacatcatcaacaacaccagcctattcacgtcggattcgggtccggacatggagaagatatccgggtcgggtctggctctacaggatcgggggtaacaaacggtatagctaatcttgttagctccaagtacttgaaggcagcacaagagcttcttgacgaagtagtcaacgctgattccgatgacatgaacgctaaatcccaactattctcatcgaaaaagggtagttgcggaaatgataaacctgtcggagaatcatcggccggcgctggaggagaaggttccggtggcggagcagaagcagccgggaaacgtccggtggagctaggcacggcagagagacaagaaatacagatgaagaaagcaaaacttagtaacatgcttcatgaggtggagcagagatatagacagtaccaccagcagatgcagatggtgatctcttcgttcgagcaagcggcagggataggatcagcgaagtcatacacgtcgctagcattgaaaaccatatcaagacagttccgttgcttgaaagaggcgatcgctggtcagataaaagcggccaacaagagtcttggggaggaagattcagtgtctggtgttgggaggtttgaggggtcgaggctcaagttcgtggaccaccacttgagacagcaaagagctcttcaacaactgggaatgattcaacatccttccaataatgcttggagacctcaacgtggtctcccagaacgagccgtctcagttctccgtgcttggctcttcgaacactttcttcatccataccctaaggattcggacaagcacatgctagctaagcaaacaggactcactcgtagccaggtgtcgaactggtttataaacgcgagagttcggttatggaaaccaatggtggaggagatgtacatggaggaaatgaaggagcaggcaaagaacatgggatccatggaaaagactcctttggatcaaagcaacgaagattctgcttcaaagtcaacaagtaaccaagaaaagagcccaatggcggacactaattaccatatgaatcccaatcacaacggtgacctagaaggcgtcactggaatgcaaggaagccccaagagactaagaaccagcgacgagacaatgatgcagccaataaatgcggatttcagctccaacgagaagctcacgatgaagattctagaagaacggcaagggataagatcagatggtggctaccctttcatgggtaatttcgggcaataccaaatggatgagatgtcaagatttgatgtagtctcagaccaggagctcatggcgcaaaggtactcaggaaacaacaatggcgtgtccctcacgttaggtttacctcattgtgatagcttgtcgtccacgcaccatcagggtttcatgcagacccaccatgggattcctatagggagaagagtgaaaataggagaaacagaggaatatggacccgccaccatcaatggtggtagctcgaccacaaccgcacattcatcagcggcagctgccgcggcttacaatgggatgaacatacagaaccagaagagatatgtggctcagttattgcccgacttcgttgcataa

SEQ ID NO: 1338 - DNA, 816 bp, Arabidopsis thaliana
atggaccgaaccatgtttctttccctgacaatagcctcactcttggtcggagtcgtctcagctggtgactggaacatcttgaaccaactcagaggactcggctcatcgtcaagccaaaatggtatcgtttctaaaggtatcaagacggacctgaaaggatactgtgaaagctggaggatcaacgtggaagttcacaacatcagaaagttcgatgtggtgcctcaagagtgtgtatcgcacattaaggattacatgacgtcatcgcagtacaaggatgacgtggcgagaaccgttgatgaggtcattcttcatttcgggagcatgtgctgtagcaagtctaagtgtgacggcatggacgcttggatctttgatatcgatgacacgcttctctctaccatcccttaccacaagaaaaatggcttcttcggaggagagaaattgaactcaacgaaattcgaggattggatacagaagaagaaagcaccagcagtgccacacatgaagaaattgtaccacgacatcagagaaagaggcattaagatcttcttgatctcttcccggaaagaatatctcaggtctgccaccgtcgacaacctcatccaagccggttactatggctggtccaacctaatgctcagggggctagaagatcagcaaaaggaagtgaaacaatacaagtcagagaagagaaaatggctaatgagtcttggttacagagtctggggagtgatgggtgaccaatggagtagctttgcaggctgtcctcttcccaggagaaccttcaagctccctaactccatctactatgtcgcctga

SEQ ID NO: 1339 - DNA, 546 bp, Arabidopsis thaliana
atggctcgtcgcgatgttctcctccctttcctcctccttctcgccaccgtctccgccgtagctttcgccgaagatgatccagactgtgtatacacattctacctcagaaccggatcgatctggaaagccggaaccgattcgatcatcagcgcaagaatctacgataaggacggtgactacatcggaatcaaaaaccttcaagcttgggctggattaatgggacctgattacaattacttcgagaggggtaatctcgacattttcagtggaagagcaccgtgtttacctagtccgatctgtgccttaaacctaacctccgatggctccggcgatcaccatggttggtacgttaattacgttgagatcacgacggctggtgttcacgcacagtgctcgacgcaggattttgagattgagcaatggctcgctactgatacttctccttatgagctcaccgccgtacggaacaattgtccggtcaagcttagggatagtgttagtcgggtcgggtctgagattcggaaaaagctttcttgggtcgtttaa

SEQ ID NO: 1340 - DNA, 981 bp, Arabidopsis thaliana
atgacgagattcggattagctcttttgatgattcttgtgattcaagggcttgtgaccttttcagaagcacaattgaagatgggattctacgaccaaacgtgcccttacgcagagaagatcgtacaagatgttgtcaaccaacatataaacaatgcaccctctttggctgctggcctaattaggatgcattttcatgactgcttcgttcggggttgtgatggttccatcttgatcaacgcgacatcgagcaaccaacaagtggagaagcttgctcctccgaatctaactgtgagaggtttcgattttatcgataaagtaaagtctgctctagaatcaaagtgccctggaatcgtctcttgcgctgatatcatcacacttgctactagagactctattgttgctattggtggaccgacatggaacgttccaacggggcgcagagacggacgtatctctaactttgccgaggctatgaacaatattcctcctcctttcggaaacttcacgactctgataaccctctttggaaaccaaggacttgatgttaaagacctcgtcttgttatccggtgcccacacgattggagtgtctcattgctcctccttctcaaaccgtctcttcaatttcaccggcgttggagaccaagatccatcgctcgacagcgaatatgccgacaatctcaaatcacggagatgtttatctatcgctgacaataccacaaaagtcgaaatggatcccggtagtcgaaacaccttcgatcttagctactaccgtcttgtcctaaaacgtcgtggactttttgagtctgacgctgcattgactatgaatcctgcggcattggctcaggtcaaacgcttcgccggaggatcggagcaagagttctttgctgagttctccaactccatggagaaaatgggaaggattggggtcaaaacagggtcggatggggagattcgaagaacatgtgcatttgttaactaa

SEQ ID NO: 1341 - DNA, 2463 bp, Arabidopsis thaliana
atgggaacaaacggtacaacatgtccaggaccaatgaaagcaacctctaatggagtctttcaaggagagaatcctctggaacacgcgttgcctcttctcatactccagatctgtatcgttcttcttctcactcgtcttcttgcttttctcctccgtcctctccggcagccacgtgtcatcgccgagattgtcggtggaatattacttggaccatcagcacttgggaaaagcactaagtttatcaacacagttttcccaccaaagagtctaacggttttagacacacttgcaaacttaggactcatcttcttcctcttcctcgttggtctcgagctcgatcccaaatctcttaagcgaaccggaaagagagctctctctatcgctctcgccggaatcactcttcctttcgtattaggcattggaacttcttttgctctccgcagttccatagctgatggagccagcaaagctcctttccttgtcttcatgggtgttgctctctccatcacagcgtttcccgtcttggcccgaatactcgctgagattaagcttctaaccactgatatcggaaagattgctttgtccgctgctgcggtcaatgacgtggctgcttggattctccttgctctcgcggtggctctttctggagaggggagctctccgcttacttctctttgggtgtttctctcgggttgcggttttgtcttgttctgtatctttgttgtgcaaccagggattaagttgattgctaaacgttgccctgaaggagaaccggtaaatgaactttacgtgtgttgcacgttaggtattgttcttgcagctagcttcgtcacagactttattgggattcatgcgctgtttggtgcttttgtgatcggggttattttccctaaagaaggcaatttcgcgaatgctttagttgagaaagttgaggatctcgtgtcaggtcttttcttgccgctctacttcgtctcaagtggtttaaagaccaatgttgcgacgatccaaggagctcagtcttggggactcttggttttggttatatttaatgcttgtttcggtaaaatcatcggtacagtcctagtttccctttactgcaaagttccgcttgaccagtctttagcgcttggtttcttgatgaacacgaaaggtcttgttgagctcatcgtcctcaacattggtaaagacagaggggttctgaatgatcaaattttcgctataatggttctaatggcgatattcaccacattcatgacgactcctctagttctggcagtgtacaaaccgggtaaatccttaaccaaagctgattataagaaccgaacggtggaggagacgaaccgttcaaacaaaccgctctgcctcatgttctgtttccagagcataatgaacatccccacgatcgtcaacctcatagaagcatcccgaggcataaaccgtaaagaaaatctatcagtctacgcgatgcatcttatggagctttcagagagatcatcggctatactcatggcacacaaggtcaggagaaacggtcttcccttctggaacaaagacaaatctgagaacaatagttcttcttccgacatggttgtggtcgcattcgaggctttccgaagactcagccgtgtctcagtgcgtcccatgacagcgatctcaccgatggcgactatacatgaggatatttgccaaagcgcggaacgcaaaaaaaccgctatggtgattcttccgtttcataagcacgttaggctggacagaacatgggagacgactaggaatgactaccgttggattaacaagaaggttatggaggaatctccatgttctgttgcgattttggttgatcgtggacttggtggtacgacacgtgtcgcgtctagtgatttctcgttgactataacagttttgttttttggagggaatgatgatcgtgaggcgttagcgtttgcggtgcgaatggctgaacatcccgggataagcttaaccgttgttcggtttatccctagcgatgaattcaaaccggaaaacgtgaggatcgagataaccgaagatcagctctgttcaggggcaactagattgattgatattgaagctataaccgaacttaaagcaaagattaaagaaaaagaaagttctcgttctaattcggattctgaatctcatatcatttacgaagagaaaatcgtgaaatgttacgaggaagttatcgaagttattaaagagtattctaaaagcaaccttttcttggtggggaagtcaccggaaggttctgtagcgtcagggataaacgtaagaagcgacacgcctgagcttggaccgatcgggaatttgttaacggaaagcgaaagtgtttcgacggtggcatcagtgttggtggtgcaacagtatatagcaagccgtccggtcggaatttcgaagaacgtcacgactgaagagtcgctggttgaggattctgagagtccttag

SEQ ID NO: 1342 - DNA, 366 bp, Arabidopsis thaliana
atgggcaccggagaaaaaaccctgaagagcttccagttacatcgcaaacaatcagtcaaagtcaaagatgttccaaaagggtgtttagcgatcaaagtgggatcgcaaggagaagagcaacagagatttatcgttcctgttttgtattttaaccatccattgttcatgcagctcctgaaagaagcagaagacgagtatggattcgatcaaaagggcaccatcacaattccttgtcacgtggaggagtttcgttacgttcaagctttgatagatggagagagatcagtttacaatggtaacaaccatcatcatagacatggtggccgtgaccagtatcatcatcttgttggatgcttcagagcttga

SEQ ID NO: 1343 - DNA, 219 bp, Arabidopsis thaliana
atgagccagtacgatcacaaccagtctgcaggagctaacccaccgccaccgatgtctacctgtacatcaccaccaccgccgattggttacccgactaaccaaccgagtcatggttcggtagctcagggtaaagtggaaaccaagtctaagggtgacggattcttcaaaggctgtcttgcggccatgtgttgctgttgtgccctggacatttgcttctaa

SEQ ID NO: 1344 - DNA, 3396 bp, Arabidopsis thaliana
atggaggaagatcgtggggaagcgatcgttttagatatttcgccggagattaataatactccggcggtaatgatgagagttccacggaggattcgtgagaggcttttgtctgactgtagtaataagaagacagtatcttctgttcaagatattgaagacaagcttcttcatgcccatctacgaagacagcaattttatcataacgtttcgagaaaggctcgtgctaaacctagaagtccttcacgatcatctgatgaagaacttggccaacgaatcgaagcaagacttctggctgctgaacaaaaaaggttggagattcttgcgaaggcacagatgcgtttggcgaagttagatgagttaagacaagcagcgaaaacaagtgtggagatacggtcggagagggaacgtgtgaagcttggaactcaagtggagtctcgtgttcaaaaggctgaagctaatagaatgaagattctcaaggcgtctcatcagaaaagggcttgtgctaaagagagaacgtcacagtctatgatgaggaggatggctagagagagtaagtataaggaaagagttcgtgcttcgattaatcagaaacgtgtagctgctgagaagaaacgtcttgggttgcttgaagctgagaagaagaaagcacgtgctcgtgtccaacaagtacgtcatgttgccaactctgtttctaatcagcgtgagatagagagaagtaaaatgagggataaacttgaagacaaattgcaaagagcaaagagatatagatcggagtttcttcgtcagagaagaagacaacgtgattccattagtctctattgcgatatgatgcaggaagatgctgatcttctttctagaaagctgtcaaggtgttggaggtgctttgtaaggcagaagaggacaactttggatttggcgaaagcttatgatggtttgaagattaacgagtcattaccgtttgagcagcttgcgatgctacttgaatcgctgaacactcttaaaacggttaaatctttgcttgatcgccttgaaattcgcttagaagcttctaagaatgttaccacggtttctcaaccgtccatattggataatattgatcaccttcttaaaagagttgccacaccaaggagaaaggctacgccgagtactctgaggagcagaaagggaaagaaggtttcttctgttaggaatgtggctgggacatcagtgaagatgtctaggtatcctgtcagagttgttctttctgcctttatgatactcggccatccagatgctgtttttaatggtcaaggtgatcaagaggctgctctcaataacgcggctaaagggtttgtgagggagcttaagttattgataaacgttattcaagagggtcctgttcaggtttcgggtggagaatcaaaacatcggaccttaagatctcagttggacttattcgataaggcttggtgctcctttttgaactcatttgtgatttggaaagtcaaggatgctcggttgttggaagatgacctggttagagcagcttgtcagcttgagctttctatgattcaaaaatgcaagctaactccagaaggggttgacactatgctcactcatgataagaaagcaattcaaatgcaggtaacacaagatcaagaactcctaacagagaaagtacgacacctgagtggagttgcaggagttgagcgcatggaaagtgcgttgttggaaacacgaacaaagtactttcaggcgaaggaggatggaagccctatggctaatcagctcgcacatttcttttctccaagcccagcttcatctccagttcagtctgtgtctagttccagcagcagaagtaaagatagcataggtgttgaaggatcaaatcgtgttaatcgttctttattgaaggatgatactccaccctcatctggaccctctagagtcagtaatggcactgtggacgaggtttcaaatcagaatgagttgatggtgaatgagttcctgcatgatgggaacctcaactttcctggtggatccactgtcaaggatgaagaggacaatcttaagagaaggataaaggagactatggagagagctttctgggataatgtcatggaatccatgaaattggagaagccagactatagctgcatctctaaccttatgaaagaagtgagtgacgaactttgccagatggtaccagatagctggaaagtagaaataactgaaactattgatctggacattctctcacagttgctcaactccggcaccttggatatcgattaccttggaaagatgcttgagtttgcgttggctactctgcggaaactctctgccccagctaatgaccgtgagaatgaaagcacccaccgggatttactcaaggaacttcacaggttgtgtgaagctgaagatgagtctggtaacttccgtgctgttgcaatagtcaaggggatccgcttcattcttgagcaaattcaggaacttaagcgagagataggcataggtcgcatagcaatcatgaaaccctttttgcaaggaccagcaggctttgattaccttacaaaagcatttgaaaagcgttatggacctcccactcaagcctacgaatcactaccagtgacacgaaggtggatatcaactcttttgtctagcaaagaagagtgggaagaacacaacaatacgctttcagccttgaatgtggttgagagatcctccatgggtatttctctcaaaacgggtggaagctttctatccccagtcaataccacgtccaagtcaactgttatggacactgcaggtcaactatcagaatgcaagggagaaagagttgatttggcagtgaggcttgggttgttgaagctggtgaatcaggtagctggtttaacaccagaagttctaccggaaacttttcagctcaacctctttcgcgtgagggatattcaagctgaaattcagaatataattgtggtaaccacaagcttgctcatttggcgtcaaatgcttgcaaagagcgaaagcgaaacagaaagtatggcaaagaaattgttggagttgttagatgggaaggaaggagcaggactaacggagataatcgaaacaacaatgagtgaagaagatggagagaagaagaagatgatgagaggattattggggaagagtttgggagaaggtaacacagtgtatgagagagttacaagttgtatatacaaagcggctcgaggagctttattggctgggaatggagaaaatgggaagagaatggttgaaacagagatgaagaaagtaggaggaggtggaggattgaaagaaagggttttagagacagctcgagcccttggtgttgtagcttgtgtctcagtcagagttcatggtccatggttgactcagctcatgccacaacattga

SEQ ID NO: 1345 - DNA, 2589 bp, Arabidopsis thaliana
atgtcgccggaatcttggaaagaccagcttagtctggtttcggctgatgattatcggatcatgggtcgaaatcggatccccaatgccgtcacgaagctttccggtctcgaaaccgacgatcctaacggcggcgcgtgggttacgaaaccgaaacgaatcgtggtttcgaatcagcttcctcttcgtgctcacagagacatttcgtcgaacaagtggtgctttgaattcgacaatgacagtctttacttacaactcaaagatgggtttcctccggagacggaagtcgtctacgtcggatctttaaacgccgacgtcttaccttcagagcaagaggacgtctctcagttcttgcttgagaagtttcagtgtgttcctactttcttacctagtgacttgctcaacaagtattaccatggtttctgtaaacactatctctggcccatttttcactatcttcttcctatgacgcaagctcaaggctctctctttgatcgttcgaattggagagcgtacacgactgttaacaagatcttcgctgataagatcttcgaagtgctaaacccggatgatgattacgtctggattcatgattatcacctcatgattttgcccacttttttgaggaacaggtttcatcggataaagcttgggattttcctccatagtccctttccttcgtcggagatttaccgtactcttcctgtgagagacgagattctcaaagggtttctgaattgcgatttggttggtttccacacgtttgattacgctaggcatttcttgtcttgttgtagtaggatgcttggtcttgattacgaatctaaaagaggctacattggtcttgaatattttggaagaacggtgagcatcaagatattgcccgttgggattcatatggggcagattgaatcgataaaggcttcggagaaaactgcagagaaagtgaagagattgagagaaaggttcaaggggaacattgtgatgttaggtgtggatgatttggatatgttcaaaggtattagcttgaagttttgggcgatgggtcagcttcttgaacagaacgaagagcttcgtgggaaagtggttctcgtgcagattactaatcctgctcgtagttcaggtaaggatgttcaagatgtagagaaacagataaatttgattgctgatgagatcaattctaaatttgggagacctggtggttataagcctattgtgtttatcaatggacctgttagtactttggataaagttgcttattacgcgatctcggagtgtgttgtcgtgaatgctgtgagagatgggatgaatttggtgccttataagtacacagtgactcggcaagggagccctgctttggatgcagctttaggttttggggaggatgatgttaggaagagtgtgattattgtttctgagttcatcggttgttctccatctctgagtggtgcgatccgtgttaatccgtggaacatcgatgcagtcactaacgccatgagctctgcaatgacgatgtccgacaaagagaaaaatctgcgccaccagaagcatcataagtacataagctctcacaatgttgcctattgggcgcggagttatgaccaagatcttcaaagggcgtgcaaagatcattacaacaagagattctggggagtcggattcggtctttttttcaaggttgttgcgttagatccgaatttcagaaggctctgtggtgaaaccatagtccccgcgtataggagatcaagcagtaggttgatcctattggactatgatgggacaatgatggatcaggatactctggataaaaggccaagtgatgatcttatctcgcttctcaatcgcttatgtgacgaccccagcaatctagtctttattgttagtggtcgaggtaaggaccctctcagcaaatggtttgactcttgcccaaatcttggtatctcagctgaacatggttatttcactagatggaactcaaattccccttgggaaacaagtgaattgcctgcggatttaagctggaagaaaatagctaaaccagtgatgaatcactatatggaagcgactgatggatcattcatagaggagaaagagagtgctatggtgtggcaccaccaagaagctgaccattcatttggttcttggcaagctaaggagcttcttgatcatctagagagtgttctcaccaatgagcctgttgttgtcaagagaggccagcacatagtagaagttaaacctcagggagtaagcaaaggaaaggtggtggagcatttgatagcaacgatgaggaacaccaaagggaagagaccggactttttgttgtgcataggtgatgaccggtctgatgaagacatgtttgatagcatagtgaagcaccaagatgtttcctctattggtctcgaagaggtctttgcgtgcacagttggtcagaaaccgagcaaggccaagtactatctcgatgataccccaagtgttatcaagatgcttgaatggttggcctcagcttcagatggatcaaagcatgagcaacagaagaaacagagcaagttcacttttcaacagcctatgggacaatgtcgaaagaaagcatag

SEQ ID NO: 1346 - DNA, 831 bp, Arabidopsis thaliana
atgcagattcacaaactctgttttcttgttctgttcttagctaacgcagcttttgccgtcaaattcaacttcgattccttcgatggcagcaacttgttattcctaggagacgcagagcttggtccttcctctgatggtgtaagccgatccggagctttatccatgacccgagacgagaacccattctctcatggtcaaggtctttacatcaatcaaatcccattcaaaccttcaaacacttcttctcctttttcatttgaaacttctttcactttctccatcactcctcgcaccaaacctaactccggtcaaggtttcgccttcatcataaccccggaagctgataactccggtgcttcagatggcggatatctcggaatcctcaacaaaaccaacgatggaaagccagagaaccacatcttggctatcgaattcgatacttttcagaacaaagagtttctagacattagtggtaaccatgttggagttaacatcaactcaatgacttctcttgtcgctgagaaagctggttactgggttcagacaagagtcgggaaaaggaaagtttggtcgtttaaagatgtgaatcttagcagtggagagaggttcaaggcttgggttgagttcagaaacaaagactctacgattacggttacactcgcgcctgaaaacgttaagaaacctaagcgggctttgatcgaagctcccagagtgctcaatgaagttcttcttcaaaacatgtacgccggttttgctggttccatgggacgtgccgttgagcgtcacgatatttggagctggtcgtttgaaaacgccgccaaaaacaactaa

SEQ ID NO: 1347 - DNA, 1710 bp, Arabidopsis thaliana
atggccacaagatgcttttggtgttggaccactttgctcttctgctctcagctgcttaccggctttgcccgagcttcctctgcaggcggcgccaaagagaaaggactctcccaaactcccacctgggccgttgccctcgtctgtaccttcttcattcttgtctccgtcctcctcgagaaggctcttcacagagttgccacgtggttgtgggagaaacataagaactctctgcttgaagccttggagaaaataaaggcggagctgatgattctaggattcatttccttgttgctcaccttcggagagcagtacattctcaagatttgtattcctgaaaaggctgcagcctctatgttaccttgtccagctccttctactcatgaccaagacaagacccaccgcagacgtctagctgctgctacgacctcttcccgctgcgatgagggtcatgaaccactcatacctgccacgggtttgcaccagctacacattctattgttcttcatggctgcctttcatatcctctacagtttcatcaccatgatgcttggcagactcaagatccgtggctggaaaaagtgggagcaggagacatgttctcatgattacgagttttcaatcgatccatcaagattcagactcactcatgagacgtcctttgttagacaacattccagtttctggacaaaaatccccttcttcttttatgctgggtgcttcctacagcagtttttccgatctgtagggaggactgactacttaactctgcgccatggcttcatcgctgcccatttagctccaggaagaaagttcgacttccagaagtatatcaaaagatcattggaagacgatttcaaggtggtagttggaataagtcctcttttgtgggcatcatttgtaattttcctacttctgaatgttaatggctgggaagcattgttttgggcgtcaatcctacctgtacttatcattctagctgtcagtacgaagcttcaagcgatcctaacaagaatggctctgggaatcacggagagacacgcagttgttcaagggatacctctcgtgcatggttcagataagtacttttggtttaatcgccctcagttgctacttcatcttcttcacttcgccttatttcagaatgctttccagctaacatacttcttctgggtctggtattcctttgggctaaaatcttgctttcacacggatttcaaactagtcatcgtaaaactctctctaggcgttggagctttgattttgtgcagctacatcacacttcctttgtatgcactagttactcagatgggttcaaacatgaagaaagctgtgtttgatgagcaaatggcaaaagcgttgaagaaatggcacatgactgtgaagaagaagaaaggcaaagcgagaaagccaccaacagagacccttggtgtttctgacactgtcagcacctctacctcatcctttcacgcctctggagccactctactccgctccaagaccactggtcactcgacagcctcttatatgagtaatttcgaggaccaaagcatgtctgatcttgaagctgagccattatcccctgaaccaatagaggggcacactctcgtcagggttggtgatcagaacacagagatagaatatactggagatattagtcctggaaaccaattctcctttgtgaagaacgttcctgctaatgatattgactaa

SEQ ID NO: 1348 - DNA, 1062 bp, Arabidopsis thaliana
atgactactactccagattggatcatgattggaggagacggtcctgagagttataaccaacaatcctcgtatcagagagcattgttggaagcgacaaaggacaagatgaccaaggcgatctcagccaatctcgacctagacttgatttcgaatcgcttcattgtagcggatttcggttgtgcaagtggacctaacacttttgtggcagttcaaaacataatagatgcggtagaagaaaagtaccgtagagaaaccggacaaaacccggcagataacatcgagttccaagtcctcttcaatgatttcagcctcaatgatttcaacactctcttccagacacttccacccggaagaagatacttcagcgctggagttcctggttccttcttcgaacgtgttcttcctaaggagagtttccacatcggagtcatgagttacgcgttccatttcacctccaaaatccccaaagggattatggaccgcgactctcccttgtggaacaaagacatgcagtgcacggggttcaaccccgctgtcaagaaagcgtatcttgaccagtactctatcgacaccaaaattcttttagatgctagagctgaagagctcgtgcccggggggttgatgttgcttttaggatcgtgtctaagagacggagttaagatgtccgagacccctaaaggaactgtaatggattttattggagaatctcttagcgatcttgctaaacagggtgtcaccgagcaagagaaggtggacactttcagaacctcaatttactttgcagaacaaggtgagataaggcaaatcattgaggagaatgggaagttcacaatcgaggcttttgaagatatcattcacgctaaaaacgagtttccttttgaccccaagacattggccatctctttcaaggccttctatggtgctttcatttccgcacattttggagtcgaagtcatgaggaaagcctttgagcttgttgaggtcaaggcacgcgaacagatttctcgcctccataactccaaacccggaatgcagtacctcatcgtgcttcgcaagaactaa

SEQ ID NO: 1349 - DNA, 735 bp, Arabidopsis thaliana
atggaatatcaaactaacttcttaagtggagagttttccccggagaactcttcttcaagctcatggagctcacaagaatcattcttgtgggaagagagtttcttacatcaatcatttgaccaatccttccttttatctagccctactgataactactgtgatgacttctttgcatttgaatcatcaatcataaaagaagaaggaaaagaagccaccgtggcggccgaggaggaggagaagtcatacagaggagtgaggaaacggccgtgggggaaattcgcggccgagataagagactcaacgaggaaagggataagagtgtggcttgggacattcgacaccgcggaggcggcggctctcgcttatgatcaggcggctttcgctttgaaaggcagcctcgcagtactcaatttccccgcggatgtcgttgaagaatctctccggaagatggagaatgtgaatctcaatgatggagagtctccggtgatagccttgaagagaaaacactccatgagaaaccgtcctagaggaaagaagaaatcttcttcttcttcgacgttgacatcttctccttcttcctcctcctcctattcatcttcttcgtcttcttcttctttgtcgtcaagaagtagaaaacagagtgttgttatgacgcaagaaagtaatacaacacttgtggttcttgaggatttaggtgctgaatacttagaagagcttatgagatcatgttcttga

SEQ ID NO: 1350 - DNA, 1026 bp, Arabidopsis thaliana
atggtggttttgccacagccagtcactttagataaccacatctccctaatccccacatacaaaccggttccggttctcacttcccattcaatccccgtcgtcaacctagccgatccggaagcgaaaacccgaatcgtaaaagcctgcgaggagttcgggttcttcaaggtcgtaaaccacggagtccgacccgaactcatgactcggttagagcaggaggctattggcttcttcggcttgcctcagtctcttaaaaaccgggccggtccacctgaaccgtacggttatggtaataaacggattggaccaaacggtgacgttggttggattgagtatctcctcctcaatgctaatcctcagctctcctctcctaaaacctccgccgttttccgtcaaacccctcaaattttccgtgagtcggtggaggagtacatgaaggagattaaggaagtgtcgtacaaggtgttggagatggttgccgaagaactagggatagagccaagggacactctgagtaaaatgctgagagatgagaagagtgactcgtgcctgagactaaaccattatccggcggcggaggaagaggcggagaagatggtgaaggtggggtttggggaacacacagacccacagataatctcagtgctaagatctaataacacggcgggtcttcaaatctgtgtgaaagatggaagttgggtcgctgtccctcctgatcactcttctttcttcattaatgttggagatgctcttcaggttatgactaacgggaggttcaagagtgttaaacacagggtcttagccgatacaaggagatcgaggatttcaatgatatatttcggcggaccgccattgagccagaagatcgcaccattgccatgccttgtccctgagcaagatgattggctttacaaagaattcacttggtctcaatacaaatcttctgcttacaagtctaagcttggtgattatagacttggtctctttgagaaacaacctcttctcaatcataaaacccttgtatga

SEQ ID NO: 1351 - DNA, 819 bp, Arabidopsis thaliana
atgcaacacattcaccagacctatgactttgtgaagaagatgaggaaagagtatggaaaacttaacaagatggaaatgagtatatgggaatgttgtgagttattgaacaatgttgttgatgaaagcgatccggatcttgatgagcctcaaattcaacaccttctccaaaccgctgaagccattcgaagggactatcccgacgaagattggctccatctcactgccctaatccatgatcttggcaaggttctccttctgccagaattcggtggtcttccccagtgggctgtcgttggcgatacatttccagttggatgtaccttcgactcagccaatattcaccacaagtatttcaaaggaaaccatgatatcaacaacccaaagtacaacacaaaaaatggagtttacactgaaggatgtggtttagacaatgttctcatgtcatggggtcatgacgactacatgtatttggtggctaagaagaatggcacgacccttcctcacgctggtctcttcattattcgatatcattccttttatccattgcacaaggcaggagcctacacacacttgatgaacgatgaggacagagatgatctcaagtggctccatgtcttcaataaatatgacctatacagtaagagcaaagttctggtagatgtcgaacaagtgaagccttactacatttcactcatcaacaaggtaaaaatacatttaaatataatttctttaataaccaaacttgtaataatttgtctaatgtgtatatatttttttgacattgcagtattttccggcgaaactaaaatggtgagataa

SEQ ID NO: 1352 - DNA, 1242 bp, Arabidopsis thaliana
atggggtctagattaaacttcaagagctttgttgatggtgtgagtgagcagcagccaacggtggggactagtcttccattgactaggcagaactctgtgttctcgttaacctttgatgagtttcagaactcatggggtggtggaattgggaaagattttgggtctatgaacatggatgagctcttgaagaacatttggactgcagaggaaagtcattcaatgatgggaaacaataccagttacaccaacatcagcaatggtaatagtggaaacactgttattaacggcggtggtaacaacattggtgggttagctgttggtgtgggaggagaaagtggtggttttttcactggtgggagtttgcagagacaaggttcacttaccttgcctcggacgattagtcagaaaagggttgatgatgtctggaaggagctgatgaaggaggatgacattggaaatggtgttgttaatggtgggacaagcggaattccgcagaggcaacaaacgctgggagagatgactttggaggagtttttggtcagggctggtgtggttagggaagaacctcaaccggtggagagtgtaactaacttcaatggcggattctatggatttggcagtaatggaggtcttgggacagctagtaatgggtttgttgcaaaccaacctcaagatttgtcaggaaatggagtagcggtgagacaggatctgctgactgctcaaactcagccactacagatgcagcagccacagatggtgcagcagccacagatggtgcagcagccgcaacaactgatacagacgcaggagaggccttttcccaaacagaccactatagcattttccaacactgttgatgtggttaaccgttctcaacctgcaacacaggtgactaaagaacctaagctactacatttttgccaggaagtgaagccttcaatacttggaattcataaccatcctatgaacaacaatctactgcaagctgtcgattttaaaacaggagtaacggttgcagcagtatctcctggaagccagatgtcacctgatctgactccaaagagcgccctggatgcatctttgtcccctgttccttacatgtttgggcgagtgagaaaaacaggtgcagttctggagaaagtgattgagagaaggcaaaaaaggatgataaagaatagggaatcagctgcaagatcccgcgctcgcaagcaagtgagtgtttgtttaaattttggagattaa

SEQ ID NO: 1353 - DNA, 1080 bp, Arabidopsis thaliana
atggagatatcgaaatacaaggcggtgctagcgttagtgatgttgcagtttacgtccgccggagttgcactcttcacgaaagctgctttcatggaaggtctcaatcccaccgtcttcgttgtttaccgtcaagccatcgccactctcttcatctgccccatctctttcatttccgcttggaggaaagaaaacaaaccttctctgggagtaagaggcttttggtgggtggctttgacggctgttattggtgtgactgttaatcagaacgcttatttcaaagggattgacttgtcttcttcatccatggcttgtgccatgactaatcttattcctgccgtcaccttcattatctccatcattgttgggttcgagagtataaagaggagaagtatgaaaagtgttgcaaaagtaataggaactggtgtctgtgtgggaggagccatggcaatgacttttctcagaggtccaaaattgctcaatgccttgctcaaccaagacaacacagcttggttactcggctgcttcttccttcttattagcacatttgcttggtctctttggttgatccttcaggttcctattgcctctcactgtcctgaccacttgtacacttctgcctgcacatgtttcatcgctaccatagcttctttcctcgtggctctcgccttaggcaacactcatttaccgccctggaagcttgattccttcttgaagctctcttgctgcatatactctggattccagttggcgatatctttctttctacaagcttggatcgtatcacagaaaggacctgttttctctgccctcttcaaccctctttctgcagtcatcgtcactttcttcggcgctctgtatctaaaagaacagacttacctcgggagcttgttaggcgctttggctatcatccttggtctctacattgttctctggggcaaatctgaagactatcaagaagaatcaacagacctgaaattggaaaatgaacacaacacttcctctcaatctgacattgtttccattatgattggtgataaggcctttcgtagttcggagctattagaacctcttctcatgtga

SEQ ID NO: 1354 - DNA, 1551 bp, Arabidopsis thaliana
atggctcttcttctagtttcttcttcctcctcctatgccctcagagtcaccattttcttgtctttcttcttctttctctgcaatggcttctcttaccctactacttcttctcttttcaacacccatcaccatcgtcaccacttggccaagcacaactacaaagatgctctcactaaatcaatcctcttctttgaaggccaaaggtcagggaaacttccttctaaccagagaatgagttggagaagagactctggtctctctgatggctctgctcttcatgtggatttggttggagggtactatgatgcaggagacaatatcaaatttggtttcccaatggcattcacaaccacaatgctttcatggagtgtaattgaattcggtggactcatgaaatctgaattacaaaacgctaaaatagcgattcgttgggctactgattatctcctcaaagccacttcacaacctgacacaatctatgttcaagttggtgatgctaataaagaccattcttgttgggaaagacctgaagacatggatactgtaagaagtgtgtttaaagttgacaagaacattcctggttctgatgtcgccgctgaaaccgccgctgctctagccgccgccgccattgtattcagaaaatctgatccttcttactccaaagtcctcctcaaacgagccatcagtgtttttgcatttgcggacaaatacagaggaacttatagtgcaggattaaaacctgatgtttgtccattttattgctcttactctggttatcaggatgaattgttgtggggagctgcttggttacaaaaagcgacaaagaatataaaatatttgaattacataaaaatcaatggacaaatccttggagctgctgaatatgataacacttttggttgggataacaagcacgctggtgccagaatccttcttactaaggcatttttggttcagaatgtgaagacacttcatgaatacaaaggtcatgctgataatttcatctgctctgttattcctggagctcctttctcttctactcagtatacaccaggtggattattgtttaaaatggcagacgccaacatgcaatacgtgacgtcaacatcgttcttgctcttaacctatgccaaatacttaacctccgccaaaaccgtcgtccattgcggtggctccgtctacactcccggtcgtcttcgctccatcgccaaaagacaggtggattatcttcttggagacaacccattaagaatgtcttacatggttggttacggtccaaaattcccacggagaatccaccaccgtggctcctcattaccttgtgttgcaagccacccggccaagatccaatgccaccaaggatttgcaatcatgaactctcaatctccaaaccctaacttccttgttggtgcagtcgttggtggtccggaccagcatgatcgcttcccagacgaacggtctgattacgagcagtccgagccggctacttacatcaattcaccactcgttggagctcttgcctacttcgcccacgcctatggtcaactctag

SEQ ID NO: 1355 - DNA, 933 bp, Arabidopsis thaliana
atggttttgatcaaagagagagagatggagattccagttattgattttgcagagttggatggagagaagagaagcaagaccatgtcacttcttgatcatgcatgtgataagtggggattcttcatggttgataatcatggaattgataaagagttgatggagaaagtgaagaagatgattaactctcactatgaggagcatttgaaagagaagttttaccagtcagagatggtcaaggctttgagtgaaggcaaaacctcagatgcagattgggaaagcagtttcttcatctcacataaaccaacttcaaatatctgtcagatcccaaacatttcagaggaactcagcaagacgatggatgaatatgtttgtcaactgcacaagtttgcagagagactctccaagctcatgtgtgagaatcttggtcttgatcaggaagacataatgaatgccttttctggtccaaaaggtccagcttttggaacaaaagtggctaaatacccagaatgcccacgtcctgagcttatgagagggctgagagaacatacggatgctgggggaatcatattactcctgcaggatgatcaagtgcctggtcttgagttctttaaagatgggaagtgggttcctataccgccatccaagaacaataccatttttgtcaataccggtgatcaactagagatactgagtaatgggaggtacaagagtgttgttcaccgtgtaatgacagtgaagcatggaagtagactgtcgattgctacgttttacaatccggctggtgatgccataatatctccagctccaaagctcttgtatccaagtggctaccgttttcaagactacctaaagctttattcaactaccaagtttggagacaaaggccccagacttgagaccatgaagaaaatgggaaatgcggattcagcctag

SEQ ID NO: 1356 - DNA, 1629 bp, Arabidopsis thaliana
atggaagagacttttgtgccgtttgaaggaatcaagaatgatcttaaaggaagattgatgtgctataagcaagattggactggtggattcaaagctggatttaggattctggctcccaccacttacatatttttcgcttctgcgattcctgtcatctcatttggtgaacaactcgaaagaagcaccgatggagttctcacggctgttcaaaccttagcatctacagccatttgcggtatgatacattcgattatcggaggtcagccactgcttattctcggtgttgcagagcctactgtgattatgtacacattcatgtttaactttgcaaaggccagacctgaattgggacgagacctgttcttggcgtgggtttgtgtttggactgctttgatgctgtttgtgttggcaatatgtggagcttgttctatcatcaataggtttactcgagtagctggagaattgtttggactgcttattgctatgcttttcatgcagcaagccatcaaagggctagttgatgaattccgcattcctgaacgagaaaatcagaagctgaaggagttcttaccttcctggaggtttgctaatgggatgtttgctctggttctctcctttggccttcttctgactggacttagaagcagaaaagccagatcatggcggtacggaactggctggctcagaagcttaatagctgactatggtgtaccactcatggtgctcgtgtggaccggtgtctcctacattccagcaggagatgagatgcttgatgttccaatcgtctacataattggagctttcattccagcatcaatgattgctgtgctttactacttcgaccatagtgtagcttcacagctcgcgcagcagaaagaattcaatttgagaaaaccgtcttcttaccactatgacttgcttcttcttgggtttctgacattaatgtgtggtctacttggagtccctccatcaaacggtgtcattcctcaatctccaatgcataccaagagcttagcaactcttaaataccagaaagaaatagatgatttactaccagttgaagtcaaagaacaacgggtaagcaacttgcttcagtctacaatggtaggaggatgcgttgcagctatgcctatccttaaaatgatcccaacatcagtcctttggggctattttgccttcatggccatcgaaagcttacccggaaaccaattctgggaaagaatcttacttctgttcaccgccccaagtcgccgcttcaaggttcttgaagattaccacgcgacattcgtggaaaccgttccattcaagacgattgcaatgtttactcttttccaaacgacttatctcttgatctgctttggtctcacatggataccaatcgcaggagtcatgttccctttaatgatcatgttcttaatccccgtacgacaatatctcctccctagattcttcaaaggagctcatcttcaggacttagatgcagcagagtatgaagaagctccagctttacccttcaatctcgcagcgcttcttcttattgttatttcaaacacgatcttgaacaggaaacggagattggatccacaacatcgtatccgggagatttggagattcttgatgaggttatga

SEQ ID NO: 1357 - DNA, 1062 bp, Arabidopsis thaliana
atggaaggtaaaggagtaacctttagttctgttatagttccttctgttcaagagatggtgaaggagaaggtgatcacaacggtacttcctccgaggtatgtgcggtctgatcaagaaaaaggcgaggcagccattgattctggtgaaaaccaaatcccaatcatagacatgagtcttttgtcttcttcaacctccatggattctgagattgacaaactcgactttgcttgcaaagaatggggatttttccagcttgtaaaccatggaatggacttggacaaattcaagtccgatattcaagatttcttcaaccttcccatggaagagaagaagaagctgtggcaacaacccggtgatatcgaagggtttggacaagcttttgtgttttcagaagagcagaaactcgattgggctgacgttttcttccttacaatgcaacctgttccattacgcaaacctcacttgtttcccaagttacctcttcccttcagagatacactggatacgtattcggctgaactgaaaagcatagctaaggtcttattcgcgaaactagcgagtgcactcaaaatcaaacctgaggaaatggaaaagttgtttgatgatgagttaggtcagagaattaggatgaattactacccgccttgtccggagcccgataaggctattggtctaactccacattccgatgctacaggactcaccatactgttgcaggttaatgaagttgaaggtctccaaatcaagaaagatggcaagtgggtttctgtcaaacctctcccaaatgctttagttgtcaatgttggagacatcttagagatcataacgaatgggacataccgaagtatagagcatcgtggagttgtaaactcagagaaagagaggctttctgtggcgtcattccataatacggggttcggtaaagaaattggtccgatgagaagtctcgtggaaaggcacaagggtgcacttttcaaaaccctgaccactgaagagtatttccatggcttgttttcccgtgagctcgatggaaaagcttaccttgatgttatgagaatctaa

SEQ ID NO: 1358 - DNA, 1389 bp, Arabidopsis thaliana
atgttgtgtgcatcatcttcgcttgctcttttgggtcctccttcttcagctatggtgactatggcttcttcaccagtgtccagatttgttggatttggtcatcatactattctcaggtatgataatgatcaacgtcttcgtcgtggttgttcttggactggaattgaaaagaagatcccttttcctcggaagaagactgcctctgcttctgcttaccctctctttcgcagtcagcatactaaagactcatcaagacccaaaaattacaaagaggttactaagtcagccaggcaaatgtttgctcgagagatctctatccaatcgaaagacagtgaaatttcgattgcaaaggttctcttctacattgctgctgaagatgaagccttcttggctgttaaccgagagagggatgctcagtcactcatgaaggagagggaaagtgtacaagatcagtctgatccgagtgagacagactctgaggagctattgcagttagatggaaagagtatatctgagtgggtgagtgaaatagatgcaatttccaaagaagtagaggcagagttagtctcacgagatatcggctgtcacttggttcaagttcttgaagctgtaaatacagttctcttcgatctgagaggcttcaagaggacatctattactttagacccggagaattcctaccttcactctgtacttaactgtagatgcagcactggtaagagtctttctttaagctttctcacgtttctgattagtgtaatatacattgaagtttgtaagcgcctgaatgtaccaattgttggatctccagttggggaagattttctgatttggcctaaaacggagtatcctgaggaactctttaaagcaacttcaggacagagcttgttctctattgtcaatggaaggtgtgttgatgatcctggatcaatggcatcagacttaactgcaaaatcacttcaagacctcgacatggcaacaaacagagacattatagggattgctctagccaatttgattaggcttcactggagacgtgcttctaagtcatcccatggacttatgctgacttctcctcttagtcaacttaacaacatcagtagttctaatttcccattgttgcggcctcaagatcttaggttggctattgcggctgcagaaaggttgttgattttgcaacctcataactgggcacttcgcagagaccttggtatgatgctgtactacgacaggcaatatggagaggcggtacaagagctgagcatatgtatggcatttgctcctcctgaagaagaagctgtgttggagccatttgtagaaagacttcatctccttcgtctcatatcttcattgaagcctcttggttctgatcgcttgaccgttccttga

SEQ ID NO: 1359 - DNA, 945 bp, Arabidopsis thaliana
atgtatttgttagtgtttaaactctttctatttttgtctcttcttcaaatctctgtctctgctagaaacctagcttcacaagaaccaaaccagtttcaactactcaagtaccacaaaggagctcttctctccggcaaaatctccgttaacctaatctggtacggcaaattcaaaccatctcaaagagcaatcatctccgacttcattacctcactcacacacacttctcctacgtccaaaactctccaccaaccatctgttgccacgtggtggaaaaccacagaaaaatactacaaactcgcaacacccagcaaaaactcatcacctctgtctctaactctcgggaaacaaatcatcgacgagtcttgctctctaggaaaatctttaaccgataaaaagattcaaaccctagcttcgaaaggagaccaacgcaacgccatcaacgtcgttttgacttcagctgacgttacggttacaggatttggtatgagtcgttgcgggactcacggacacgctcgtggtttaggtaaacgtggctccaagtttgcttacatttgggttggaaactctgagacacaatgtcctggtcaatgcgcgtggcctttccacgcgccggtgtacggtccacagagtccaccactagtggcaccaaacaatgacgtgggactcgatgggatggttattaacttagctagtcttttagctggaaccgcaacgaacccttttggtaatggttactatcaaggtccacaaaacgcaccgcttgaagctgcttctgcttgtcctggcgtttatggtaaaggagcttatcctggttacgctggagatttgcttgtggatactacaacgggaggtagttttaatgcgtatggtgcaaacggcaggaagtttttgcttcctgctttgtatgatcctacgacgtcggcttgctctactatggtctga

SEQ ID NO: 1360 - DNA, 813 bp, Arabidopsis thaliana
atgggtgtggtagaagaagctcacaacgtgaaggtgattggttcaggagaagccacgatcgtgttaggtcacgggttcggcacggaccagtcagtatggaaacacttggttccacatctggtcgacgattaccgcgtcgtcctctacgacaacatgggagccggtacgaccaaccctgactatttcgacttcgatcgttactcaaatctcgaaggctactctttcgatttgattgcaatcttggaagatctcaagattgagtcttgtatctttgttggccactctgtttctgccatgattggtgtcttggcttctcttaaccgtcctgatctcttctccaaaatcgtcatgatctctgcttctccgagatacgtaaacgatgttgattaccaaggtggattcgaacaagaagacttaaaccaactattcgaagccatccgaagcaactacaaagcgtggtgcttaggtttcgctccactcgccgtcggtggcgacatggactccatcgccgttcaagaattcagcagaacactcttcaatatgcgtcccgacatagctctctccgtcggccagaccattttccaaagtgacatgagacagatcttaccttttgtcactgttccgtgtcacattctccaaagtgttaaggacttagctgtaccagtcgttgtctccgagtatcttcacgccaatcttggctgtgaatccgtcgtcgaggttattccttctgatggtcatcttcctcagcttagctcaccagattctgttattcctgtcatcctccgtcacattcgtaatgacattgctatgtga

SEQ ID NO: 1361 - DNA, 810 bp, Arabidopsis thaliana
atggcgaaattattcatcaagcaagcagagcaatatgcagcagcccgacccagttaccccaccaaactcttcgaatatatcgcatcgaaaacaccgtgccacgaccttgcctgggacgttggcgccggaagcggccaagcctcacgatcgctagccggaatctacaagaacgtgattgctacagacacgagctcaaagcaacttgaatttgctgcaaagcttcccaacgtccgttacgagatcactccaccgacgatgtcttcatcggagatcgagaagctagtagcacctgaatcatcagttgatttagtcaccgtcgctcaagcccttcattggttcgacctcacgaacttttacagcaacgtgaaacacgtgctcaagaaacccaacggagtaatcgccgcctggtgctacaccaatccggaagttaacgacgccgtggacaaggtctttcaacggttttacgatgagaaacttggtcctcattgggatctagcgcgacggcttgtggaggatgggtacagaggaattgagtttccgttcgagaaagtggataatgatgagtcaacggaaagtcaaagttttccggtgaggtttgtaacggagaaagaaatggtgtttgaagagtatatgacgtatctgaggtcatcttcggcgtatcagacggctaaggagaaaggtttagagcttttgacggctgagatggaaggagagtttgctggttcgtggaaagaagatgggaaagagaagaaagttgttaggtatccgatttatctgttgatcggaagagttgcagaagaacgtgtataa

SEQ ID NO: 1362 - DNA, 771 bp, Arabidopsis thaliana
atggatttctctccgatcaactgcctcattttcgatttggatgacacattataccctctaaaaactggaatagcgccagctgtcaagaagaatattgacgattttctagtggagaaatttggattctcagaaagtaaagcttcaagcttaagagttgaactcttcaagacttatggaagtactctcgctggtcttagggcgttaggtcatgatgttcatcctgatgaatatcacagtttcgtgcacggaaggttaccgtatgggtcgatcgaaccaaacaacaagctacgtaaccttctcaacaaaatcaaacagagaaaaattaatcatgcggtgaaggtcctcaagaaacttggtttagaagattgtttcgaagagatgatttgttttgagacaatgaacccaaatttattcgggtcaacaacccgacccgatgaatacccggttgttctcaagccttcgttgaccgcaatggatatttgcattcgtgtagccaacgttgatcctcgccgaacagtatttttggatgataatatccacaatattaccgcgggtaaatctgtcgggcttcgcacaatcctggtgggaagagcagaaaagacgaaagatgcggattatgcggtggagacggttactgagatagctacggcggtgccagagatttgggctacggcgacggcgacaggcggatttgacgttggtggtgagaggatcagacggagcaagagtgagctggagggtatggcttcaatagcagccgtcggtgcgtga

SEQ ID NO: 1363 - DNA, 201 bp, Arabidopsis thaliana
atggtgataaagaaaatcgagctatgcatagagattacgaagataacaatggagttcttggtggtggtggctgacgccgtcacaatcttcttaaggcaatcttctccacctcctccggctctactccgccatggtctctactcatactctgcctcccctaatcctccttcttcccattacatcatcggctttcttccctaa

SEQ ID NO: 1364 - DNA, 591 bp, Arabidopsis thaliana
atggattctcaggacatcagataccgcggcggagacgacagagacgctgcaacgacggctatggccgagacagagaggaaaagcgctgacgacaacaaaggaaaacgcgatcaaaagagggcgatggcgaaacgtggtctcaagtctctgacggtagcggttgcggctcctgtgctcgtgacgctcttcgctacgtatttcctcggcacaagcgacggatacgggaatcgagctaagtcctcgtcgtggatcccacctctgtggctcctacacacaacgtgtctcgcttctagtggtctgatgggtttggctgcgtggcttgtatgggttgacggtggcttccacaagaagcccaatgctctgtatctttacttagctcagtttttgctctgtttggtttgggatccggttacgttccgcgtcgggtcgggagtagcggggcttgcggtgtggttgggtcaatcggctgcgttattcggatgctacaaggcctttaatgagataagtccggtcgctggtaatctggtaaagccgtgtttggcttgggctgcctttgtagccgctgttaatgtaaagcttgcagtcgcgtga

SEQ ID NO: 1365 - DNA, 1581 bp, Arabidopsis thaliana
atgaccggaggaggatttgcgacttcggcgaacggagtagagtttgaggcaaagataactccaatagtcatcatatcttgcatcatggctgctaccggcggcctcatgtttggttacgacgtcggtgtctccggcggagtgacatcgatgccggactttctcgaaaagttttttcccgtggtttatcggaaagtagtagctggcgccgacaaagacagcaactactgcaaatacgacaaccaaggactacaacttttcacatcatctttatacttagccggtctaaccgcaacgttctttgcttcatacacgacaagaacgctcggaaggaggctaactatgctcatagccggcgttttcttcatcataggtgtggctctcaacgcgggggctcaagacctagccatgcttattgcaggcaggatattgcttggttgtggagttgggttcgctaatcaagccgttccgttgttcttgtcggagattgcacctactaggatccgtggtggtcttaatattctctttcagcttaacgtcactattggtatcctcttcgccaatcttgtcaactatgggaccgccaagattaaaggaggttggggatggaggttatcgttaggtttggcgggaattcccgcgcttcttctaacggtcggagctttattggtgacagagacaccaaacagtttagtcgaaagaggtcgtctcgatgaaggtaaagctgttcttcgtcgtattcgagggaccgataatgttgaaccagagttcgctgatctccttgaagctagtcgacttgctaaagaagttaaacacccttttagaaaccttcttcaacgtagaaaccgtcctcagctcgtcatcgccgtcgctttacagattttccagcaatgtactggaatcaacgcgattatgttctacgcgcctgttctgttcagcacattagggtttggtagtgacgcttcactttactcagcagtggtgaccggagcagtcaacgtcctctcaactttagtctcaatctactccgttgacaaagtcggtcgccgagttcttctcctagaagctggtgtccaaatgttcttctctcaagtcgtaatcgccattatccttggcgtcaaagtaacagacacttctacaaatctctccaaaggtttcgcaattctagtcgtggtaatgatctgcacatacgtcgctgctttcgcctggtcttggggaccgctcgggtggttaatccctagtgagacattccctctagagacacgttccgcgggacaaagtgtaacggtctgcgttaacttgctcttcacgttcattatcgctcaagctttcctctctatgctttgccatttcaagtttgggatattcatcttcttttctgcatgggttttgattatgtctgtctttgtgatgttcctacttccggagactaagaatattcctatcgaggagatgactgagagagtttggaagaagcattggttctgggctaggttcatggatgatcataatgatcacgagttcgtgaatggtgagaagagtaatggtaaatctaatggctttgatccttcaacacggctttaa

SEQ ID NO: 1366 - DNA, 1455 bp, Arabidopsis thaliana
atggcgagtctctgtctctcatcgtcccggatcgtttctcttcaccaccagaaaccattcctctctcttaaactccggtctcgtccttcagatctctccggtctaggtcgccacacgagtcctgtttgcttcaatccgcttaggttatcgggtgatcgtcagcgaaccgctacggtatcaacgagggtggagaagcggcgaaagagaggatcgagtgtggtctgttatgctgctccgatttctgccaatagtctacaatggatctccaccatttcttgccttgcattgatgcttgcaaggggtactggtatacataagtcagttgttgttccactattcgctctccacgcaccatcgagcatcgtcgcctggattaagggagagtatggtgtatgggcagcattcttggcgcttattgctcgacttttcttcacttttccaggtgaacttgagcttccattcatcgcattactcttggtgattgtggcgccatatcaagtcatgaacataagagggaagcaagaaggggcaatcatagcaatagcaatatctggttttctggctttccaacatttctcacgagcagggagcttggagaaagcatatgagaagggttcagttcttgccactgtagccattattggtgtcacagttaaaccctttctcgctcttaaactccggcctcgtccttcaaatatctccggtctaggtcacagtactagtgttgtttgcttcaatccgttaaggttatcggctgatcgtcagcgaaccgctacggtgtcggcgagggctgagaagcggcgaaagagaggatcgagtgtggtctgttatgctactccaatgttgtctgttcataatctacaatggatctcgacaatttcttgcgttgcattgatgtttgcaaggggtactggtatccataagtcctttgttgttccactattcgcactacaagcaccaatgggcattgtctcctggatgaagggtgaatatggcatctgggcagcattcttggcgcttcttactcgactgttcttctcttttccagttgaacttgagctgcccttcattgctttgcttttggtgattgtggcgccatatcaagttatgagcataagagggaaacaggaaggtgctatcctttctttagcaatctcttgttttctggctttccagcatttctcaagagcaggcaccttgcagaaagcatttgatcagaattcagttcttgccactgtagccataattggtgtcacagttgtatcatggagcttgtctgtcattttcggtgtgcctacttgttttagagtgctgcaggttgctgaattcggaagccctgttggctctgctacgccgaagggtggtccagagccagttatgcctgtagttggagttgttattggcggtgggtatgtagatgatggtggggaactaaaatctggtggactcatttga

SEQ ID NO: 1367 - DNA, 573 bp, Arabidopsis thaliana
atgggtcgtgtcactactccatccgaggaggattcaaacaacggtttaccggttcagcaacccggtacaccgaaccagcgaaccagagttcccgtgagtcaattcgcgccgccgaattatcagcaagctaatgttaacctatctgttgggaggccatggagcactggtttgtttgattgtcaagcagaccaagccaatgccgttttgaccacaattgtaccttgtgtaacatttggacaaatagcagaagtgatggatgaaggagagatgacttgtcctcttggaactttcatgtacttattgatgatgccggctttatgctctcactgggtgatgggatcaaagtatagagaaaaaatgaggagaaaatttaatcttgtggaagctccatattcagattgtgccagtcatgtcctatgcccttgttgctctctttgtcaagaatacagagagctcaagattaggaatcttgatccttctctaggttggaatgggatacttgctcaaggacaaggacaatatgagagagaagcaccaagttttgctcctacaaatcaatatatgtctaagtaa

SEQ ID NO: 1368 - DNA, 1713 bp, Arabidopsis thaliana
atggaagaaaaagatgtgtatacgcaagatggaactgttgatattcacaaaaatcctgcaaacaaggagaaaaccggaaattggaaagcttgccgcttcattctcggaaatgagtgctgtgaaagattggcctactatggcatgggcactaaccttgtgaattatcttgagagccgtctgaatcaaggcaatgctacggctgcaaataacgtcacgaattggtctggaacatgttatataactcctttgattggagcctttatagctgatgcttaccttggacgatattggactattgcaacttttgttttcatctatgtctccggtatgactcttttgacattatcagcttcagttcctggacttaaaccaggtaactgcaatgctgatacttgtcatccaaattctagtcagactgctgttttctttgtcgcgctttatatgattgctcttggaactggcggtataaagccgtgtgtttcgtcctttggagctgatcagtttgatgagaatgatgagaatgagaagatcaagaaaagttctttcttcaactggttttacttctccattaatgttggagctctcattgctgcaactgttctcgtctggatacaaatgaatgttggttggggatggggtttcggtgttccaacagtcgcgatggttatcgcggtttgctttttcttcttcggaagccgtttttacagacttcagagacctggagggagtccacttactaggatctttcaggttatagtagcggcttttcggaagataagtgttaaggttccagaggacaagtctctgctctttgaaactgcagatgatgagagtaacatcaaaggtagccggaaacttgtgcacacagataacttaaagttttttgacaaggcagcggttgagagtcaatctgatagcatcaaagacggggaagtcaatccatggagactatgttctgttactcaagttgaagaacttaagtcaataatcacacttcttccagtttgggccacaggaatagtcttcgccacagtgtacagccaaatgagcacaatgtttgtgttacaaggaaacacaatggaccaacacatgggaaaaaactttgaaatcccatcagcttcactctcacttttcgacactgtcagtgtactcttctggactcctgtctatgaccagttcattatcccgctggcaagaaagttcacacgcaatgaacgaggcttcactcagcttcaacgtatgggtataggtcttgtggtctccatctttgccatgatcactgcaggagtcttggaggttgtcaggcttgattatgtcaaaactcacaatgcatatgaccaaaaacagatccatatgtcgatattctggcagataccgcagtatttacttatcggttgtgcagaagttttcacctttataggtcagcttgagtttttctatgatcaggctcctgatgccatgagaagtctctgctctgctttgtcgttgaccacggttgcgttggggaactatttgagcacagttcttgtgacggttgtgatgaagataacgaagaagaacggtaaaccgggttggataccggataacttgaaccgaggccatcttgattactttttctacttgttggcaactctcagtttcctcaacttcttagtgtacctctggatttcaaaacgctacaaatacaagaaagctgttggtcgagcacattga

SEQ ID NO: 1369 - DNA, 1476 bp, Arabidopsis thaliana
atggatccgtgctctttcgtacggatcatagtcggtaacttggccgttaggtttccgtcgtcgtcttcttcttcttcttcctcatcaggaccgtctgtttccggaatcaatccaacggctcctaactgttactgtaaaatcagattcaagaactttcctcgtgagattgtttctgttccggttatgttccgaactgaatctgaatccgagactcgttgctcctcctccggtaacgtatccaccgttgctgcttgtttcagtttaagtaaagctcagatcgaagcgtcgttgaagaaacctaaatttagtgttctctccgttgaggcttattcccgcggaaatagcgacggagacgacggtgttagcggcgcgtcgtgtggactcgctacggcgggtgagaagttgcttggtcgatttgaggtttcgcttgatttgaaatcggcggagacgaagagttttttggcgcataacggttgggttgctttgccgtctaagaaaacgaagagtaaaactggatccgatccggagctccacgttagcgtacgggtcgaacctgacccgagattcgtgtttcagttcgacggtgagcctgagtgtagtcctcaggtttttcaagttcaaggaaacacaaagcaagccgtgttcacttgcaaattcggctctagaaactccaactccggtgatcgaaatcttcttcacagttcttcgatgatgtctgagataagctcaacgagaagttgtatatcgtcgatgaattcggaaaaagaacaaccgtcaaaagagagaaaaggatggtcaataacggtccatgatctctccggttcacccgtggctatggcctctatggtaacacctttcgtaccatctcctggttcgaaccgggtgactcggtcaagtcccggagcgtggcttattcttcgacctgacggttgcacatggaagccatggggaagactagaagcatggcgtgaggctggttactctgacactctaggttatcgtttcgagcttttccaagacggtatagccaccgcagtttctgcatcgtcgtcgatcagtttgaaaaatggcgggagttttgttattgatgttaccggcggtacaagcacaacggcgtctacgccgacaacgagtcctcaaggaagctgggatctcggatccggttcaagcgccggttcaagacccgcgtcgagaccaggatcaggatccgggtcggatttcggatatctactaccgcaacatccgtctgcggccgcgcaaaacagagggttcgttatgtcggctacggttgaaggagttgggaaacgaagcaaaccagaagtagaagtcggtgtgacgcacgtgacatgtacggaggatgcagcagcgcacgtggcattagctgcggcggtggatctgagtttggatgcttgcaggcttttctcacacaagctaaggaaagagctgagacagcaaagccagcttggtgtcgtttga

SEQ ID NO: 1370 - DNA, 1935 bp, Arabidopsis thaliana
atggttttggaggatagaaaggacggttcttctttgccgggacgatccggtagtttctctaaatcgtcaccgtcggagttggatgttgttgatccctacaagcggataagttcgccgggatctatattggatgctgagaaggtagagaaaaagcctggaggatggagagccgtctcgttcattttaggaaatgagacgctggagagactgggatcgataggattgttggcaaacttcatggtttatctaaccaaagtgtttcacttagaacaagtcgacgctgcaaatgtcatcaacatttggtcaggtttcaccaatctcactcctctcgtcggagcgtatatctcagacacttatgttggccgcttcaagaccatcgctttcgcctcattcgccactctcctcctattaaattacttttgtatcgtacgaaaacgcatgaacttattgagggaccacgctatcgaggacgataagggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacacagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaagctgaaacttccggcggaagatgacggcactgtcacctattacgacccagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcgcgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaactctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttcgaagaaatcgatgaaatga

SEQ ID NO: 1371 - DNA, 3207 bp, Arabidopsis thaliana
atggaggggaagcttttcttgggacaatacttgatatgtgtgattttactgttggggcagctacatggatacaaaagctgtattgagaaagaaaggaaggctttgttggagctcaaagcatttctgatcccattgaatgcaggagaatggaacgacaatgttcttagttggaccaatgacacaaagagtgattgttgccagtggatgggggttgagtgcaatcgtaaaagtgggcggattaccaacattgcctttggtataggattcattatagagaaccctctcctaaatctttctctgttgcatccctttgaagatgttagaagtctggacttatcatcctctcgttcgtgcgaagactgtggattcagtggcttgtttgatgacgttgaaggttacaaaagcctcagtagattaagaaacctggagattctggatctctcttcacatagattcaacaacagcatctttccttttcttaatgccgctacatcccttacaactctttttcttacgtacaacaacatgcatagcccatttcttgttaaagaattcaaagatttaacaaatttggaacatctagacttgcgtggaaacagatttaatggctccataccaacacaagattataacagcctaaggagatttagaaagctggagattctggatctctctgataatttattcaatagcaggatctttcccttccttaattctgctacatcacttaaatctctgtctctttggggaaacaacatgggtggcccttttcctgctaaagaacttagagatttgacaaacgtggaactgctggacctgagtagaaacagatttaacggctccataccagtacgagctttatttgccctgaggaagctgaaagccctggatctaagcgataatgaattttcaagctcagtggaattgcaaggcaagtttgctaaaacaaaacccctttctgggacttgcccatggaaaaatatggaagagctcaaactcagtaacaacaaactagctggtcagtttcctctatgtttaactagcttgactggacttcgagttcttgatctttcatcaaatcaattgactgggaacgtaccctctgctctcgctaaccttgaatcccttgagtacctatcactgtttggtaacaacttcgaaggcttcttctcacttggtttactcgccaacctctcaaaacttaaggtgctcagacttgattcacaatccaactcacttgaagtagagtttgaaacgtcttggaagccaaaattccaattggtagttattgcgctacgatcttgcaacttggagaaggttcctcattttctcctacatcaaaaggatttgcatcacgttgatctctctgacaatcaaattcatggaaattttccttcttggctgttagagaacaatacgaaactcgaggttttgcttctacagaataattcttttacgagctttcagctaccgaaatctgctcataacctgcttttcctgaacgtgtcagtcaacaaattcaatcatctctttcttcagaactttgggtggatactccctcatttagtctgtgtgaatttagcctataatggttttcaaggaaatctgccatcttctctggataacatgaagagtattgaatttctagatttgtctcacaacaggttccacgggaagctaccaagaagatttttaaagggttgttataacttaacaatcttgaagctgtcacacaacaaactaagtggagaggtttttccagaagcagccaactttactcgtttatgggtgatgtctatggataacaatctgtttacaggaaatattggaaaaggttttcggagcctaccatctttgaatgtacttgacatttcaaacaacaaactcacaggtgttattccaagttggattggcgaacgtcagggattattcgcactgcagctttcaaacaacatgttggaaggtgaaatacctacttccttgttcaacatatcctatcttcagctactggacctctcttcaaacaggttatctggggatatacctccgcacgtaagttccatatatcatggggcagtgttactcctccaaaacaataatttatcaggggttattccagacacactactactgaatgttattgtacttgatctgagaaataaccgactgtctgggaatcttccggagttcatcaacacccaaaacatcagtattcttcttttgcgggggaacaattttacaggacagattcctcaccagttctgcagtctaagtaacatccaacttctggatctttccaacaacaaattcaatggatcgataccatcatgtcttagcaatacatcatttggtttgaggaaaggggatgattcttatagatatgatgtcccttcaagatttggcacagctaaggatcctgtatattttgaatctctactcatgatagatgaatttaatatggtcaatgaaaccaactcccagacgaaaattgaatttgcaacaaagcacaggtatgatgcctacatgggtggaaatctcaaattattgtttggaatggatctctcagaaaatgagctgagtggtgagatcccggtagagcttggaggtcttgtggaattagaagctctcaatctttctcacaacaacttatcaggagtgatactagaaagcttttcaggtctgaagaatgtggaaagccttgatctttctttcaacagattacaaggtcctatcccactacaacttacagatatgatcagccttgctgtgttcaatgtctcctacaacaacttatcaggaatcgttccacagggaagacagtttaacacctttgagacacaaagctactttggtaatcctcttctctgtgggaagtccatagacataagctgcgcgagcaataactttcacccaacagataatggagtggaagctgatgaatctacagtcgacatggaatctttctactggagttttgttgcagcctatgtgacaatacttcttggaatacttgcatctctctcatttgattctccttggagcagagcttggttctacatcgttgatgctttcgtcctcaaggttaggaatatgttgtggcaaaacactgcaggtaccaaatgttcttacgtgctagtttcattgtcgtccccatctgttgttgttcttctcaaacctcctgctttgtttcacaaaaccagaacataa

SEQ ID NO: 1372 - DNA, 1392 bp, Arabidopsis thaliana
atgggtttcttaaagttatctccaatgatccttctcctagcaatgatcggcgtttcatatgccatggacatgtcaatcatctcctacgacgaaaaccaccacatcaccaccgagaccagccgtagcgactcggaggttgagagaatctacgaagcgtggatggtggaacacgggaagaagaagatgaatcaaaacggtcttggtgcagagaaagatcaaagattcgagatctttaaagataatcttcgtttcatcgatgaacataacaccaaaaacctcagttataaacttggtttaacccggtttgctgatttaaccaatgaggagtaccgatctatgtaccttggtgctaaaccgaccaagagggttttgaaaaccagtgatcggtatcaggcgcgtgttggtgacgcgcttcctgattcggttgactggagaaaagaaggtgccgtcgctgatgttaaagatcaaggaagctgtgggagttgttgggcattctcaactattggagcagtggaaggaataaacaagattgtgacaggagatttaatatctttgtctgaacaagaattggttgattgtgacacatcttataaccaaggatgtaatggtggtttaatggactatgcgtttgagtttattatcaaaaatggtggtattgataccgaagcggattatccttacaaggctgctgatggtcgttgtgaccagaacaggaaaaatgctaaggttgttaccattgattcatatgaagatgtccctgagaacagcgaggcgtctctaaagaaagctttggctcaccagcctattagtgtcgccattgaagcgggtggtcgcgctttccagctctattcttcgggtgtatttgatggactttgtgggacggagttagaccacggtgttgtggctgtgggttatggaaccgagaacggaaaggactactggattgtgagaaactcatggggaaacagatggggagagagcggatacataaagatggcacgtaacattgaagcgccaacaggaaagtgtggaatcgctatggaggcttcgtatccgatcaagaaaggtcagaacccaccaaaccctggcccgtcaccaccatctcccattaagccaccaaccacatgtgacaagtacttctcttgccctgagagcaacacttgttgttgtctctacaagtatggtaagtactgcttcggatggggatgttgcccgctcgaagctgctacttgctgcgatgataactcaagttgctgtcctcatgagtacccggtttgtgacgttaaccgcggaacctgtttgatgagcaagaacagtccgtttagcgtgaaggctttaaagcgtacacccgcaataccgttctgggcaaagagcagaaagcacattgcgtaa

SEQ ID NO: 1373 - DNA, 1473 bp, Arabidopsis thaliana
atgtcggttttcctctgtttcctcgtcctcttacccctgatcttaatcttcttgaacgttttgaaaccttcgaaatataagcttcctccgggtccaaagaagcttcccatcatcggaaacttacaccaacgcaggacactacatccgaggaatcgccgtaatctcgccgaaatgtatggaccagtggcgcttctccaatacggattcgtccccgtggtcgcgatctcttcgaaagaagcagcagaggaagtgctaaagatcaacgatcttgagtgttgtagtcgaccagaggcggccggaatgagagcaactttttacaacttcaaagacatcgggatggcacccttcggtgacgagtggagtctgatgcggaagctctcggtggtcgagctcttcagcgtgaaaaagcttcaatctttcaagtatatcatagaggaagagaataacttgtgtgtcaagaaactctctgagtttgctacgagacaatctccggtgaatcttgagagagccattttcactttagtcggaaatatagtgtgtcgtatcgggtacgggataaatctctatgagtgtgatttctttgaagctgatagagtcgtggatcttgtgctaaaggctgaagcggtcataagagaaactgtgttctctgatttctttcccggaagaatcggtaggttcatcgactgtatctccggtcagaacaggagattgaagaataatttctcggtagtagacactttctttcagaatgttcttaacgagcatcttaagcctggaagagagagctctactattgttgacttgatgatcgatatgaagaagaagcaagagaacgatggagatgctctcaagttcaccactgatcatctcaaaggaatgatctcggacatatttgtagcagggattggtggagtcgctggcataacactatggggaatgaccgagctgatcagaaacccaagagtgatgaagaaagtgcaagacgagattcggacaacacttggggacaagaaggagagaatcaaagaagaagatctaaaccaacttcactactttaagctcgtggtcaaggagacattaaggttacatccaacaactccactcttgctcccaagacagacaatgtctcatatcaagattcaaggctacgatgttcctgcgaaaacacagatcttagtcaacgtttatgcgatgggtcgtgatccaaaactctgggaaaacgcagatgagtttaaccctgacaggtttctcgacagttccgttgattttaaaggaaaaaactacgagtttataccgtttggatctggtaggagaatatgtccagggatgacaatgggtaccatacttgttgagatggcattgttgaatttgctttacttcttcgattggggattggcgaagcaggaggaagccaaagagatcatcaatggggaagaaaattttctagccttctttcaagttcttcaccactga

SEQ ID NO: 1374 - DNA, 1626 bp, Arabidopsis thaliana
atggacgattgtcgattcgagacgagtgagttgcaagcttcggtaatgatatcgactcctttatttaccgattcttggagttcatgcaacaccgcaaattgcaacgggagtataaagatccatgacatcgccgggattacatacgttgctataccggcggtatcgatgattcagttggggaatcttgtgggcttgccagtcaccggagatgttcttttccccggcttatcctccgatgaacctctacctatggtcgacgctgccatactcaaactctttcttcagttaaagatcaaggaaggattggaattggaattgttaggtaaaaagctggtggtgataaccggccattcaaccggcggcgcattggccgctttcaccgcactttggcttctatctcaatcttctccgccgtcattccgcgtcttttgtatcacctttggctctcctctgctcggaaaccaatctctctccacctcaatttcacgatcacgtttagcacacaacttctgccacgtggtctccatccacgacctcgttcctagaagcagcaatgaacaattctggccctttggaacttacttgttctgttccgacaaaggaggtgtctgtctagacaacgctggttctgttcgtctgatgtttaatatcctcaacaccacagcaactcaaaacaccgaggaacatcagaggtacggacactatgtgttcacactttcacacatgtttcttaaatctagaagctttcttggtgggagtatccccgacaatagctaccaagctggtgttgcgttagccgttgaagctctaggtttctctaacgatgacacaagtggcgttttagtcaaagaatgtatagaaacagctacaagaattgttcgggctcctattctgaggtcagctgagttagccaatgagcttgctagtgtcttgccagcaagactcgagattcaatggtacaaagatcgttgcgatgcatcagaagagcagctaggttactacgatttcttcaaacgatattcgttgaagagagactttaaagtgaacatgagtcgcataagactagctaagttttgggacacagtgattaaaatggtggagacgaatgagttaccttttgattttcatttaggaaagaaatggatttacgcatctcaattttatcaactcttagccgagccactcgacattgcgaatttctacaaaaacagagatataaagactggcgggcattacttggaggggaatagacctaaaaggtatgaggtgattgataaatggcagaaaggagttaaagtgcctgaggagtgtgtgagaagcagatacgcgagcacaacgcaagatacttgcttttgggctaagcttgagcaagcaaaagagtggttggatgaggcgagaaaagagagtagtgatccccagaggagatctttgttacgggaaaagattgttccattcgagagttatgcgaatacattggtgacgaagaaggaggtttctttggatgttaaagcgaagaactcgagttatagtgtgtgggaggcgaatctgaaagagttcaagtgcaaaatgggttatgaaaatgaaattgagatggttgttgatgagagtgacgcaatggagacttag

SEQ ID NO: 1375 - DNA, 2061 bp, Arabidopsis thaliana
atgatccatacaccaaccgggtcgagtcgtcggattctgacctttccggcggtgaatccatgcgaatcgatctctttaaccactctcgtcgactcacttttacaactcgccggcgagattcttagcttcaaaccaaaacacttctctaccaacaaaagaagtgttaaagaaactctccgacatgttcaaactcttgtgatcttctttgaagagctccggattcaaatccgagtcgggtcaataccggcgggtcgttcggtaatcttgagcctttcagagcttcacgtcatcttccagaaactcaagttcctactagacgactgtacaagagatggagctaagctatatatgttaatgaactccggtcaagtctcggctcatttccgggatttgacccgatccatatccactagcctcgacacgtttccagtcaggtctgttgacttacctggagaagttaatgagctaatctatctagtaatgcgtcagactcgaaaatccgaagcaagacccgaccgagacgacaaacgagctatagactctgtttattggttctttaatctgtttgagaacagaattaatccgaattctgatgaaatactccgagttcttgatcacattggtgtaagaaaatggagagattgtgtcaaagagatcgattttttacgagaagagatctccgtggggaagaagagtaacatcgaaatcgagcttctcagcaacttaatggggttcatatgttactgcagatgtgttatacttcgaggcattgatgttgatgatgaagagaaagacaaggaagaagatgatttgatgatggttcgaagtttaaacgttgatgatcttcgttgtccgatttctctagagatcatgagtgatccagtggttttagaatcaggacacacttatgatcggagctctatcacaaagtggttcgcttccggtaacattacgtgccctaaaaccggtaaaactttggttagtactgtgttggtggataacttctctgtcaagcaagtgattcaaagctactccaagcaaaacggtgtagttatgggtcaaaaggggaagaagaaggtggatgtggcggagagtttagcggcggaagaagctggaaaactaacggcggagtttctcgccggagaattgatcaagggagacgaagaagagatggttaaagcattagtggagattcgaattctcaccaagacgagtactttttacagatcgtgtttagtggaagctggagttgttgaatcgttgatgaagattcttcgttcggatgatccgaggatccaagagaacgccatggctgggattatgaatttatcgaaagatatcgccggaaaaactcgaatcgtcggagaagacggtggtggattaaggctaatcgttgaggttttaaacgatggtgcgagaagagagagcagacaatacgcagcagctgctctgttttatctatcttctctcggagattacagcagattgatcggagaaatctctgatgcgattccgggattggtgagaatcgttaaaagttgcgattacggtgattcagcgaaacgcaacgcgttaatcgcgattcggagtttgttaatgaaccaacctgataatcactggcggatcctcgccgccggaattgttcctgttcttctagatttagtgaaatcggaggagattagcgacggagttacggcggactcgatggcgattttagcgaaaatggctgagtatcccgacgggatgatatcagtgctccgtcgtgggggattaaaactcgcggtgaagatattgggttcgtcggaggtttcgccggcgacgaaacagcattgtgttgctctgcttttgaatctgtgtcataacggcggaagtgacgtcgttgggtctctggctaagaatccgtctatcatggggtcgctttacacggcgtcaagtaacggagagttgggaggtgggaaaaaggcaagtgctctaattaaaatgatccacgagtttcaggagaggaaaaccggtccgggtgaaccggttctagaaagagaacggtttgtccacgcctggtga

SEQ ID NO: 1376 - DNA, 999 bp, Arabidopsis thaliana
atggaggtccatggctccggattccgtcgaattctgttgttggcgttgtgtatctccgggatctggtccgcctacatctaccaaggcgttcttcaagagactctgtccacgaagagatttggtccagatgagaagaggttcgagcatcttgcattcttgaacttagctcaaagtgtagtctgcttgatctggtcttatataatgatcaagctctggtcaaatgctggtaacggtggagcaccatggtggacgtattggagtgcaggcattactaatacaattggtcctgccatgggaattgaagccttgaagtatatcagttatccagctcaggttttggcaaaatcgtcaaaaatgattccagttatgctaatgggaactttagtttacggaataagatacactttccctgaatacatgtgcacctttcttgtcgctggaggagtatccatctttgctcttcttaagacaagctctaagacaattagcaagctagcacatccaaatgctcccctcggttacgcactttgttccttaaacctcgcctttgacggattcacaaatgccacacaagactccattgcctcaaggtacccgaaaaccgaagcgtgggacataatgctgggaatgaacttatggggcacaatatacaacatgatctacatgtttggcttgccacaagggataggattcaaagcaattcagttctgtaagctacacccggaagcggcatgggacattctaaagtattgtatatgcggtgccgtgggacaaaacttcatcttcatgacaataagtaacttcgggtcactagctaacacgaccataaccacgaccaggaagtttgttagcattgttgtatcatcagtaatgagcggaaatccattgtcgttgaagcaatggggatgtgtttcgatggtctttggtggtttggcatatcaaatttatcttaaatggaagaaattgcagagagtggagaagaagaagcaaaagagttga

SEQ ID NO: 1377 - DNA, 1638 bp, Arabidopsis thaliana
atggcagagtctcagactgctcagaggaatcagccgcaatcctcaggctcctctggggagaagcaagctttgatatctctatctgacaagagggacttggcttctcttggcaacggtctgcaagaattgggatacactattgtttctactggaggaactgcctctactttggagaatgctggagtctctgtgaccaaagtggagaagcttactcattttccagaaatgcttgatggccgtgtgaaaactttgcatccaaacatacatggtggtatcctcgctagaagggatgtggagcatcatatggaagctcttaatgagcatgggattggtacatttgatgttgtggttgtcaatttgtacccgttctatgaaaaagttactgctccaggtgggatcagttttgaggatgggattgagaacattgacattggtggccctgctatgattagagcagctgctaagaaccacaaagacgttctcattgttgtcgattcaggagattatcaagctgttttggagtatctcaaaggaggacagagcgaccaacaattccgcagaaaacttgcgtggaaggcctttcagcatgttgctgcatatgattctgcggtttcagaatggctatggaagcagactgaaggaaaagagaagttccctcccagctttacagttccgcttgtacttaagagttctcttcgttacggtgaaaatcctcatcaaaaagctgcattttatgttgataagagccttgctgaagtgaatgccggtggtatcgcaacagcgattcagcatcatggaaaggaaatgtcatacaacaactatcttgatgctgacgctgcatggaactgtgtgtcggaatttgaaaacccaacatgtgtagtcgtgaagcatacaaatccttgtggtgtggcctctcgtgatgatattcttgaggcttaccggctagctgtaaaagctgacccagttagtgcctttggtggcattgtagctttcaatgttgaagttgacgaggttcttgcgagggagatccgagagttcaggagcccaacagacggggaaactagaatgttttatgaaatcgtggttgctccaaagtatactgctaaaggtcttgaagtcctcaaagggaaatcaaaaactttgaggatcctcgaagctaaaaagaatgaccaagggaaactatcgctcagacaggttggtggcggctggttggctcaggactcggacgatttaactccagaagacatcagcttcaattctgtctcagacaaaactccgactgaaagcgaacttgcggatgcaaaatttgcctggctctgcgttaagcatgtcaagagcaatgccattgtgatagcaaagaacaattgtatgctggggatgggaagcggacagccaaaccgagtagagagtctgagaatagctttcaagaaagctggggaggaagctaaaggagctgccttggccagtgacgcattcttcccattcgcttggaaagatgcggtggaagaggcgtgccagatgggaataggagtgatagcagaacctggaggcagtattagagaccaagacgctattgattgctgcaaaaagtatggagtctctctgctcttcaccaacgttagacatttccgccattaa

SEQ ID NO: 1378 - DNA, 885 bp, Arabidopsis thaliana
atgatggacctaacgaaactgaagcctccacagatcactttttattgctcggcgttttccgtcttgctcacacttcatttcacgatacagcttgtatcgcagcatctcttccactggaagaaccctaaggaacaaaaggctatactcatcattgtgcttatggctcctatctacgccgttgtttcctttattggtttgttagaagtcaaaggaagtgaaaccttcttcctctttcttgaatccatcaaagaatgctacgaagctcttgtcattgccaaattcttggcattgatgtatagttatctaaacatatctatgagcaaaaacattttgcctgatggaatcaaaggaagagagattcaccattctttcccaatgactctttttcagcctcatgtagtccgtttggatcgtcacactcttaaacttttgaaatactggacatggcaatttgtggtcattcgacccgtgtgctccactttgatgatagctttacagctcatcgggttttatccttcatggttgagctggacattcactatcattgtcaatttctcggtttctctggccttgtattctcttgtgatattctaccatgtgtttgctaaggagcttgctcctcataatccactcgcaaagttcctctgcatcaaaggaattgtcttctttgtcttttggcagggaatagcactagacatactggtggcaatgggattcataaaatctcaccatttctggttggaggtagaacaaatccaagaagcaattcagaatgtgttggtatgtcttgagatggttatcttcgctgcggttcagaaacacgcttatcatgctggtccttatagcggcgagaccaagaagaaactcgataaaaagaccgaatga

SEQ ID NO: 1379 - DNA, 996 bp, Arabidopsis thaliana
ctcagtctagatcgaggagatgctgtaattgaaatcacagaatgggtagacgttcctaagaagaacgtgactattgatagtaacacaactacatcaacaggcaatgccactgacgagaattcacaagaaaataaagaagacctgcaaaccgatgctgaaaacagcactgcttcaaatacaacagcagaagagccagctgttgcttctctgggcacagaaaaaaagctgaagaagcggacattcagaatacctctgaaggtagttgagaaaactgttggacctggagcaccattttcgaaagagtctcttgctgaagctaagataaaattagaagccttggacaagaaagatagggaaagaagaagaacggctgagttaaaaaacaaccttgaatcttatatatatgctaccaaagagaagctggaaacacccgagtttgaaaagatatccacccaagaagagcgcaaggcgtttgttgaaaagcttgatgaggtgcaagattggctttacatggatggagaagatgctaatgccacagagtttgagaagcggcttgactcacttaaagccatcggcagtcccatatctttccgatcagaggagcttacagcacgaccagtagcaattgaatatgctaggaaatacctaactgaactcaaagagatcataaaagaatgggagacgaacaaaacttggcttccaaaagaaaaaatcgacgaggtctcaaaggaagcagagaaagtaaaaagctggttagataagaatgtggctgagcaagaaaagacttctctgtggagcaaaccggtgttcacgtccactgaagtgtacgctaaagtatttactctacaagacaaggtcacaaaggtgaataagatcccaaagccaaagccaaagatagagaaagtaaccaagacggagaacacaacaaaggaggaggaacaatcaaaatcctctgatgaagctgccaaagaagaagaaagtcacgacgagctttga

SEQ ID NO: 1380 - DNA, 1839 bp, Arabidopsis thaliana
atggttcagaggaagaagacttgtctaacaatcgagtcttcttccaatctccaacctgaaactcggtttgggcaagaacatctcaagaatcttggaccagagatgatgatgatgaagagaactaaacctaggaggaagcttaaagacaatcatgtttcttctcaatcaggtaagtcacaagaactaccaaagcatgaccttgttgttaaagtgataggtggttcacctaattacatgaaaggcaccagtagttctgaggcaaggaaggagaacaagaaaaaatttaatctttctaggaatcagaagaaccaaaccggttcaaaacatgattctcgttatggagttaacaaggaaagaagttgtaacaagtcgagttcgaggaacggtagaggtttgacaaaggctccgattttcaagagatgttcacagagagctacttgttcttcaactctaaaagattccaagtttccagagtatttgatgcttaaccatggcgagacttttgaccaagttaatggaacctctgtcttgaaagtctgtccttacacgtattgttcactcaacggtcatcttcatgcagcgcagtatcctcctctgaaaagcttcatatcgttgaggagacagagtttgaagtcacaaaagagtgtgaaaatggaagcttctgaggaagagtttgtgaagatggatgatctagaggagaagaaagagtttgagaatggtaatggaggttcttgtgaggttgatattgatagtcaaatatcggaaactgtttctgaaggagcacctcgttctgaaactgattctgatgattactctgatagtgctgagatggtgattgagttaaaagaatcttgtttggaggagactttggtggatgactctgagaatgaggtccaagagaaagcaaacagagatggagatacctacctattaaaagaatctgacttggaggagactttggttgaggattctatgaatcaagatgaaggaaacagagatggagatgctgatcactctggttgctttgattctgaagttattggtataatcaagaactcagaagcagatattgttattgatgagactttgatagatgactctgtgaaagatttcgaagatacaacaaacatatatggggatgctaatgaatttggttgctttaattctgaagttatcgatatgatgaagaacacagaagcagatactgcaatcggggagactttggtagatgagtctatgaaagagatccaggagaaagaaaacaaagatgaagatgctgatgaatctagttgctttgtttcagaacttatcgatatgataaagaactcagctgcaagtgatgctattgaggataaagatgctactggtgaagagacactaaaggataaagctgaagattgcaaagaggtgtctaaaggccagactgaagttatattgatgacagaagaaaatgcaaaggttccatttaaccgtacacgaaaaccctgcaaacaagaagagtcaggctctaccatttcatggactatcatcaaatgcaagaaacccgttgcagagaccgaggatttaagagaatttaatccaagagaaccaaattaccttccagctgtaatggatgaggatgctgaaaaagtggacctcaagcatcaagacatagatgagaggagaaattcagaggattggatgtttgattatgctctgcagcgtgctgttagcaaacttgccccagcaaggaagaggaaagttgcattactcgtagaggcatttgaaaccgtgcaaccacatggtagagaacctgaacaggttttaagttatggaagacaccttcaagcctgcaattaa

SEQ ID NO: 1381 - DNA, 807 bp, Arabidopsis thaliana
atggagtacaaacatttcagccatccacacactctaaaactccaacagattcagccacataaaagctcagattcttcagtaatctgctcaggttgtgaatcagccatctctgaatccgaaaccgcgtatatctgttcaacatgtgacttcaatcttcatgagcaatgtggtaacgcagtgcgtgggatgcaacatccttctcacgctggtctccaccacttgactctagtcccttacacaacttacagcgctggtaccttcctctgcagagcctgtggctgcactggaggtaaagggttctcttactgttgtcctttgtgtgactttgaccttcatgttcaatgcgctcacctgcctcaggtcttggttcatgagtctcatcctatgcatagtcttcttcttgtctacaacagtactcctcctatgtcttttactcagtttggtttcgggaatcagcttgtttgcaatctttgtaatatgactatggatggtaggttttggtcttacaactgttatgcttgtaactatcatattcatgcttcatgtgctgtgaataagcccaatccagtggctgcttctgctgagaactgtggggcgagtgatgaaggaaagacaccgactgctgaatctgttcctgttcagggtttggagactgagcagacggaacaagtagctgcaataacagagcaagtggaagatccagttttgaggcaacagcttgagcttcagaagcttcagcttgagctagatatgagttctgctctcgcaaacatgattggttccttcaatctcagttctttcgtttga

SEQ ID NO: 1382 - DNA, 1494 bp, Arabidopsis thaliana
atggaaatgatattgagtatctctttgtgcttaacgaccctcataacccttctcttgctgaggcgattcctcaaacgaaccgccactaaagtgaacctaccaccatctccatggaggcttccggtgatcggaaacctccaccagctgagcctccatcctcaccgttccctccggtccctcagtctcaggtacggaccactcatgctccttcattttggccgtgtccctatactcgtagtctcctccggtgaagcagctcaagaggtattgaaaacacatgatcataaatttgcgaaccgcccgagatcaaaagccgttcatgggcttatgaatggtggacgtgatgttgtgtttgctccctatggagaatactggagacagatgaagagtgtatgcattctcaatctgctcaccaacaaaatggttgaatcctttgagaaggtaagagaagacgaggtaaatgcaatgatcgagaagctggagaaagcaagttcttcttcttcatcagaaaatctgagcgaactctttataactctaccaagcgatgttacgagtagagttgcgttgggaagaaaacatagcgaggacgagaccgcaagggatctcaagaagcgagtgaggcagatcatggagcttttaggcgagttcccgatcggggaatatgtccccatattggcatggatagatgggatccgtggtttcaataataaaattaaggaagtgagtcgagggtttagcgatcttatggacaaagtggtgcaagaacatttagaggcgagtaacgataaagcggatttcgtggatatattgttatcaatcgaaaaagataagaacagtggattccaagttcaaagaaacgacataaaatttatgatcttggatatgtttatcggaggaacgtcaacaacttcgactctactagaatggacgatgacggaactgatcagaagtccaaagagtatgaagaaactccaagacgagattcggtcaactattaggccacatggttcatacataaaagaaaaagaagtggaaaatatgaaatacttaaaagccgtgattaaagaggtgcttcggttgcatccttctcttccaatgatacttcccagactcttaagtgaagatgtcaaagtaaagggatataacatagccgcagggacagaggtgataatcaatgcttgggcgatccaacgagacactgcgatatggggaccggatgctgaagaattcaaaccggagagacacttagattcaggtttagattatcacggaaaaaatctgaactacatcccattcggatcagggagaaggatatgccccgggataaatcttgctttgggtctggcagaggtgacagtggccaaccttgtaggccgatttgactggagggtagaggctggaccaaatggggatcaacctgatctaactgaagccattggtatcgatgtttgccgcaaattccctctcattgcatttccatcttcggttgtgtaa

SEQ ID NO: 1383 - DNA, 1722 bp, Arabidopsis thaliana
atgctatctctcaaactcttcctcgtaacactcttcttatctcttcaaacactcttcattgcttctcaaactcttcttccttcaaactcttcatcaaccatatgcaaaacaacacccgatccaaaattctgcaaatcagtgttcccacaaacatctcaaggcgacgttcgcgaatacggccgcttctccctccgcaaatcgctaacgcaatcgcggaaattcacacgcaccattgacagatacctcaaacgcaacaatgcactattatctcaatccgccgttggagctctccaagactgccgttacctagcaagcctcacaacagactatctcataacatcgttcgagacggtcaatatcactacatcatccaaaacgttgtcgttttccaaagccgacgaaatccaaacacttctctccgcggctttgactaacgagcaaacatgtcttgatggaatcaacaccgccgcttcctcttcatggactatacgaaacggtgtcgcattgcctctaatcaacgacacgaagctctttagtgtctcgctcgcattattcaccaaaggttgggttccaaagaagaagaaacaagtagccagttactcttgggcccatccaaagaacactcacagtcacacaaaaccattccgtcatttccgtaacggagctttaccgttaaagatgacggaacacacacgcgccgtttacgagtctttaagcaggaggaaactcgctgacgacgataatgacgtaaacacggtgcttgtaagcgacatcgtaacggtgaaccaaaacggaacggggaatttcacgaccataacggaagctgttaattcggcgccgaataaaactgacggtaccgccggttatttcgttatctacgtgacgtcaggtgtttatgaggaaaacgtagtgattgccaaaaacaaaagatatctaatgatgattggtgacggaataaaccgtacggtggttaccggtaaccggaatgtcgtcgacggttggaccactttcaactccgccacttttgctgttacatcgccgaacttcgttgccgtgaacatgactttccgaaataccgctggaccagagaagcaccaggccgtagctatgaggagcagtgcagatctttcaatcttctatagttgcagtttcgaagcttatcaagacactttatacacacattcactaagacagttctatagagaatgtgacatttatggaacagtcgatttcatattcggcaatgcagctgttgtgttccaagactgtaatctctatccaagacaaccgatgcagaaccagttcaacgctattacagctcaaggtcgtactgatccgaatcaaaacacgggaatttcgattcacaattgtacgattaaaccggcagatgatttggtttcgagtaactatacggttaaaacgtatttgggacgaccatggaaggagtattcacgtacggtttttatgcaatcgtacatagacgaggttgttgaaccggttggttggagagaatggaacggagatttcgcattgagtacgttgtactatgctgagtataacaataccggttccggttcaagtactacagatcgagtggtttggcccggttatcatgtgattaattctacggatgcgaataatttcacagtcgagaatttcttgttaggagatggttggatggttcagagtggtgtaccttatattagtggtttactttcgtaa

SEQ ID NO: 1384 - DNA, 1368 bp, Arabidopsis thaliana
atggatccaaatgaatctccaccaaaccaatttcgccacgtggtggccatgccttatccaggtcgaggacacatcaaccctatgatgaacctctgcaaacgccttgtccgtcgataccctaaccttcacgtcaccttcgtcgtcacagaagaatggctcgggtttattggacccgacccgaaacccgaccggatccatttctccactctccctaatctcatcccttccgagcttgtcagggccaaagacttcataggcttcattgatgccgtctacacaagattggaagaaccattcgagaagcttcttgacagcctcaattcaccacctccgagtgtaatattcgccgacacttacgtcatttgggctgtgcgagtcggcagaaaaaggaatattccggtggtttctctctggaccatgtcagccacgattctctccttcttcctccactctgatctactcataagtcatggccatgctctgttcgaaccatcagaagaagaggttgttgattacgtccccggtttatctccgacgaaactccgagatttgccgccgatatttgacggttacagcgaccgagtcttcaagacagctaagttgtgtttcgatgaactaccaggagctaggtctttactcttcaccaccgcctatgagcttgaacacaaagctattgacgctttcacctccaagctcgatatcccggtctacgctattggtcctttaataccttttgaagaactttctgttcaaaatgataacaaggaacctaattacatccagtggcttgaggaacaaccggaaggctctgttctttacatatctcagggaagttttctttcggtctcggaagctcagatggaggaaatagtgaaaggactgagagaaagtggagtccggtttctttgggtggctcgtgggggcgagttaaagcttaaggaggctcttgaaggtagcttaggtgtagtggtgagctggtgtgatcagcttcgggtgctgtgtcacaaagctgtaggcgggttttggactcattgcgggtttaactcgacattggaagggatatattcaggagtaccaatgctagcgtttccgttgttttgggatcagattctgaacgctaagatgattgttgaggactggagagtcggaatgaggatcgagaggacgaaaaagaatgagttgttgatagggagagaggagatcaaggaagtagtgaagaggtttatggatagagagagtgaagaagggaaagagatgagaagaagggcttgtgaccttagtgaaatcagtcgaggagctgttgcgaaaagcggttcgtctaatgtaaacatcgatgagttcgttcggcatattaccaatacaaattaa

SEQ ID NO: 1385 - DNA, 720 bp, Arabidopsis thaliana
atggcaaatatctccagtattcacattctcttcctcgtgttcatcacaagcggcattgctgttatggccacagacttcactctaaggaacaattgccctaccaccgtctgggccggaactctcgccggtcaaggacccaagctcggcgatggaggatttgaattgactccaggtgcttcccgacagctcacggctcctgcaggatggtcaggccggttctgggctcgtacaggctgcaactttgacgcctccggaaacggtagatgtgtaaccggagactgtggcggtctaagatgtaacggcggcggagttcctcccgtcactctggctgaattcactctagtaggcgatggcggcaaagatttctacgatgtgagcctcgtagatggttacaatgtcaagctggggataagaccatccggaggatcgggagattgcaaatacgcaggctgtgtctctgacctcaacgcggcttgccccgacatgcttaaggtcatggatcagaacaatgtcgtggcctgcaagagtgcctgtgagaggtttaatacggatcaatattgctgccgtggagctaacgataagccggaaacttgtcctcccacggactactcgaggattttcaagaacgcttgccctgacgcctatagctacgcttatgacgacgaaacgagcaccttcacttgtaccggagctaactacgaaatcactttctgcccttaa

SEQ ID NO: 1386 - DNA, 1107 bp, Arabidopsis thaliana
atggatcgtcttaagctttatttctccgttttcgttttgtctttctttatcgtctcggtttcgtcgtctgatgtcaacgacggcgatgatctcgtgatccgtcaggtggttggtggagccgagcctcaggttttgacctcagaggatcacttttctctcttcaagcggaagttcgggaaggtctacgcttccaacgaggagcatgactatagattctcggttttcaaagcgaatctcaggcgagcgaggcgtcaccagaagttggatccgtcggcgactcatggtgttacgcagttctcagatctgactcggtctgagttccgtaagaagcacttgggggttagaagtggctttaagcttcctaaagatgccaacaaggctccgattctccctaccgaaaatctccctgaggattttgattggagagatcatggcgccgttactcccgtcaaaaatcagggatcttgcggctcttgctggagtttcagcgccactggagctttggaaggtgctaacttcctcgctaccggcaaactcgtcagcctcagcgaacaacagctcgtcgactgtgatcacgagtgtgatcccgaggaggcagattcctgcgactctggttgcaatggtgggctaatgaacagcgcttttgaatacaccctcaaaaccggagggctcatgaaagaagaagactatccttacaccggaaaggacggcaagacctgcaagctagacaagtccaagatcgttgcctctgtctccaacttcagtgttatctccattgatgaagaacagattgctgcaaaccttgtcaagaacggacctcttgctgtagccatcaacgctggctatatgcagacttacattggaggagtctcatgcccttacatatgcaccaggaggctcaaccacggtgtcttattggttggctatggagcggcaggttacgctccggctaggttcaaggagaagccttactggatcatcaagaactcgtggggagagacttggggtgaaaatggtttctacaaaatctgcaaaggccgtaacatttgtggtgttgacagtatggtctccactgttgcagccaccgtctcaaccaccgcccattaa

SEQ ID NO: 1387 - DNA, 798 bp, Arabidopsis thaliana
atgaaaatcctctcactttcacttctcttgctcttggccgctacggtctcggcatccgttccagggctcatcgaactcgtcgattcgaaaaccatctttgggaacgtagccgaactcttagagaaagagaaactttccatcaactacgccaactgcagaagctggcaccttggtgttgagacctctaacatcatagacttcgacacggtgcccgcaaattgcaaagactatgttgaagactacttgatcacttccaaacagtaccaatacgactccaaaaccgtgtgcaaagaggcttatttctatgccaaaggacttgccctaaagaacgacaccgtcaatgtttggatctttgacctagatgataccctcctctctagtattccctactacgcaaaatatggatacggaacagagaagaccgacccgggggcgtactggttgtggttagggaccggagcatcaacccctggactcccggaggccttgcatctttaccaaaacatcatagagctcgggattgaacccatcatactcagtgaccgttggaagttgtggaagaatgtcactctcgacaatctcgaagctgctggcgtgacctactggaagcatctcatattgaagcctaatggttcgaacttgaggcaagtggtgtacaagtcaaaggtgaggaagagtctcgtgaagaaaggatacaacatcgttggcaatatcggagatcaatgggctgatttggttgaggatacccctgggagggtttttaagctcccaaatccactctactacgtaccttcttaa

SEQ ID NO: 1388 - DNA, 219 bp, Arabidopsis thaliana
atgaatccatccgagcagaatcacttgtccgtggaaaaaccttcacagacttcttcggggccgtacacaagtccaccaccgattggttatccgaccagagatgcgatggttggtgatcctccagccgccgcagtggagacaaagtccaagggcgatggtttttggaaaggatgttgtgctgccatatgctgctgttgtgtcctggatgcatgcttctga

SEQ ID NO: 1389 - DNA, 624 bp, Arabidopsis thaliana
atgcagcagccctgtgtgatagtgggttcgaagtactgctcaccaaaccctgtaggtttggcgatcgtccgtaaggtgatgaagataacggacggtaacttcgtgataacgagtgcggacggtaagttattgttcaaggtgaaggatcctttgtttagtcttcacggcaagaggatcttgctggattgttctggagctaaggtcttaactttgagagggaagatgatgaccatgcatgacaggtggcaagtgtttagaggagggagtacggaggagggtgctctactatacacggtgaaaagatcgtcgatgattcagctagcccctaaacttgaggtgtttttggctaacaacgtagaggagaagatatgtgatttcaaagtcaaaggggcctggctcgacgactcttgtgttgtctacgccggcgattctgacaccattattgcccacatgtgcggaaagcaaacgatgcgaggctttttcttcggaaaggaccatttctccgtcactgttgataagaacgttgattatgccttcattgcatctctcattgtcatccttgtagaaatagaaaaagctggttttattacgaaaatgacaacacaaatgataataggtttttag

SEQ ID NO: 1390 - DNA, 1428 bp, Arabidopsis thaliana
atgccttcttgttcggtaactgaaatttcaaaatgtatcgtctatccggagaagaagtccaccgtctccgatctccgtctctccgtctccgacctccctatgctctcatgtcattacattcaaaaaggcgtcctcctcaccagccctcctccttccttctccttcgacgaccttgtctcctctctccgccgttctctctcctccactctttccctcttccctgctttagccggccgtttctccaccactcccgccggtcacatttccattgtctgcaacgacgccggagttgatttcgtcgccgcttccgctaaacacgtcaaactctctgatgttctcttaccaggtgaagacgttcctctgcttttccgtgagtttttcgtcttcgagcgtctcgttagttacaacggtcatcataagcctctcgccgccgttcaagtgacggagctccacgacggtgtcttcatcggatgtaccgtgaatcattccgttactgacggaacttccttctggcacttcttcaacacctttgctgacgtcactagcggtgcttgtaagatcaaacaccttccagatttctcccgccacaccgtcttcgattctccggtcgttcttccagtccctcccggtggtccacgtgtcactttcgacgccgaccaacctctacgggagagaatttttcatttcagcagagaggcgattaccaaactgaaacagaggacgaataacagagttaacggaattgagactgccgttaacgatggaaggaaatgtaacggagagattaacggaaaaataacaaccgttttggatagttttttgaataataagaagagttatgatcggacggctgagatttcatcgttccaatctctcagcgctcagctatggcgatccgttacacgagcgaggaatctcgatccgagcaagacgacgacgtttcgaatggcggttaattgccggcaccggcttgagccgaagatggatccgtactacttcggaaacgcgatacagagcataccgacgttggcgtctgcgggagatctgctaagcaaagatctcaggtggtccgccgaacagttacacaggaacgtggtggcgcacgacgacgcgacggtccgccgtggaatcgccgcttgggaaagcgatccgaggctgtttcctctcggaaatccagatggagcttcgatcacgatggggagctcgccgagattcccaatgtacgacaatgatttcggatggggaaaaccgttagctgtgagaagcggcggagcgaataaattcgacgggaagatctcggcgtttcccggtagagaaggaaacggaagcgtggatctggaagtagttctggcgccggagactatgactgggattgagaacgatgctgagtttatgcaatacgtatcagaagtcacttacgattgttga

SEQ ID NO: 1391 - DNA, 2154 bp, Arabidopsis thaliana
atggaggagctagatcgttcacgtgcttttgccagagacgtcaaacgtatcgtcgttaaggttgggacagcagttgttactggaaaaggtggaagattggctcttggtcgtttaggagcactgtgtgaacagcttgcggaattaaactcggatggatttgaggtgatattggtgtcatctggtgcggttggtcttggcaggcaaaggcttcgttatcgacaattagtcaatagcagctttgcggatcttcagaagcctcagactgaacttgatgggaaggcttgtgctggtgttggacaaagcagtcttatggcttactatgagactatgtttgaccagcttgatgtgacggcagctcaacttctggtgaatgacagtagttttagagacaaggatttcaggaagcaacttaatgaaactgtcaagtctatgcttgatttgagggttattccaattttcaatgagaatgatgctattagcacccgaagagccccatatcaggattcttctggtattttctgggataacgatagcttagctgctctactggcgttggaactgaaagctgatcttctgattcttctgagcgatgttgaaggtctttacacaggccctccaagtgatcctaactcaaagttgatccacacttttgttaaagaaaaacatcaagatgagattacattcggcgacaaatcaagattagggagagggggtatgactgcaaaagtcaaagctgcagtcaatgcagcttatgctgggattcctgtcatcataaccagtgggtattcagctgagaacatagataaagtcctcagaggactacgtgttggaaccttgtttcatcaagatgctcgtttatgggctccgatcacagattctaatgctcgtgacatggcagttgctgcgagggaaagttccagaaagcttcaggccttatcttcggaagacaggaaaaaaattctgcttgatattgccgatgcccttgaagcaaatgttactacaatcaaagctgagaatgagttagatgtagcttctgcacaagaggctgggttggaagagtcaatggtggctcgcttagttatgacacctggaaagatctcgagccttgcagcttcagttcgtaagctagctgatatggaagatccaatcggccgtgttttaaagaaaacagaggtggcagatggtcttgtcttagagaagacctcatcaccattaggcgtacttctgattgtttttgaatcccgacctgatgcacttgtacagatagcttcacttgccatccgtagtggaaatggtcttctgctgaagggtggaaaggaggcccggcgatcaaatgctatcttacacaaggtgatcactgatgcaattccagagactgttgggggtaaactcattggacttgtgacttcaagagaagagattcctgatttgcttaagcttgatgacgttatcgatcttgtgatcccaagaggaagcaacaagcttgttactcagataaaaaatactacaaaaatccctgtgctaggtcatgctgatggaatctgtcatgtatatgtcgacaaggcttgtgatacggatatggcaaagcgcatagtttctgatgcaaagttggactatccagcagcctgtaatgcgatggaaacccttcttgtgcataaggatctagagcagaatgctgtgcttaatgagcttatttttgctctgcagagcaatggagtcactttgtatggtggaccaagggcaagtaagatactgaacataccagaagcacggtcattcaaccatgagtactgtgccaaggcttgcactgttgaagttgtagaagacgtttatggtgctatagatcacattcaccgacatgggagtgcacacacagactgcattgtgacagaggatcacgaagttgcagagctattccttcgccaagtggatagcgctgctgtgttccacaacgccagcacaagattctcagatggtttccgatttggacttggtgcagaggtgggggtaagcacgggcaggatccatgctcgtggtccagtcggggtcgaaggattacttacaacgagatggataatgagaggaaaaggacaagttgtcgacggagacaatggaattgtttacacccatcaggacattcccatccaagcttaa

SEQ ID NO: 1392 - DNA, 4869 bp, Arabidopsis thaliana
atggggtttgagccgttggattggtattgcaagccggtgccgaatggtgtgtggactaaaactgtggattatgcgtttggtgcatacacgccttgtgctattgactcttttgtgcttggtatctctcatctggttctgttgattctgtgtctttatcgcttgtggctcatcacgaaggatcacaaagtggataagttctgcttgaggtctaaatggtttagctattttctggctcttttggctgcttatgctactgcggagcctttgtttagattggtcatgaggatctctgttttggatttggatggagctgggtttcctccctatgaggcgtttatgttggtccttgaggcttttgcttggggttctgctttggtcatgactgttgtggaaactaaaacgtatatccatgaactccgttggtatgtcagattcgctgtcatttatgctcttgtgggagacatggtgttgttaaatcttgttctctctgttaaggagtactatggcagttttaaactgtatctttacataagcgaggtggcagttcaggttgcatttggaaccctcttgtttgtgtatttccctaatttggacccttaccctggttacacaccagttgggactgaaaattccgaggattacgagtatgaagagcttcctggaggagaaaatatatgtcctgagaggcatgcaaatttatttgacagtatcttcttctcatggttgaacccattgatgactctgggatcaaaacgacctctcaccgagaaggatgtatggcatctggacacttgggataaaactgaaactcttatgaggagcttccagaagtcctgggataaggaactagaaaagcccaaaccgtggcttttgagagcactgaacaacagccttgggggaaggttttggtggggtggcttttggaagattgggaatgactgttcacagttcgtggggcctcttctactgaatgagctcttaaagtcaatgcaacttaatgaaccagcgtggataggttacatctatgcaatctcaatctttgttggagtggtattgggggttttatgtgaagctcagtatttccaaaatgtgatgcgtgttggttaccggcttaggtctgcactgattgctgctgtgttccgaaaatctttgaggctaactaatgaggggcggaagaagtttcaaacaggaaaaataacaaacttaatgactactgatgctgagtcgctgcagcaaatctgccaatcacttcataccatgtggtcggcgccatttcgtataattgtagcactggttctcctctatcaacaattgggtgttgcctcgatcattggtgcattgtttcttgtccttatgttccccatacagactgttattataagcaaaacgcagaagttaacaaaagaagggttgcagcgtactgacaagagaattggcctaatgaatgaggttttagcggcaatggatacagtgaagtgttacgcttgggaaaacagttttcagtccaaggttcaaactgtacgtgatgatgaattatcttggttccggaaagcacaactcctgtcagcgttcaatatgttcatactaaacagcattcctgtcctcgtgactgttgtttcatttggtgtgttctcattgcttggaggagatctgacacctgcaagagcgtttacgtcactctctctattttctgtgcttcgcttccctttattcatgcttccaaacattataactcagatggtaaatgctaatgtatccttaaaccgtttggaggaggtactgtcaaccgaagagagagttctcttaccgaatcctcccattgaacctggacagccagctatctcaataagaaatggatacttctcctgggattcaaaggcggataggccaacattgtcaaacatcaacctggacatacctcttggcagcctagttgcggtagttggcagcacaggagaaggaaaaacctccctgatatctgctatgcttggggaacttcctgcaagatctgatgcgactgttactcttagaggatcagtcgcttatgttccacaagtttcatggatctttaacgcaacagtacgtgacaatatattgtttggggctccttttgaccaagaaaaatatgaaagggtgattgatgtgacagcactccagcatgaccttgagttactgcctggaggtgacctcacggagatcggagaaaggggtgttaacatcagtgggggacaaaagcagagggtttctatggctagggccgtttactcaaattcagacgtgtgcatcttagatgacccattgagtgcccttgatgcgcatgttggtcagcaggtttttgaaaaatgcataaaaagggaactagggcagacaacgagagtacttgttacaaatcagctccacttcctatcacaagtggataaaatcctacttgtccatgagggaacagtaaaagaggaaggaacatatgaagaattatgccatagtggcccgttgttccagaggttaatggaaaatgcagggaaggttgaagattattcagaagaaaatggagaagctgaagtagatcaaacatctgtaaaaccagttgaaaatgggaacgctaataatctgcagaaggatggaatcgagacaaagaattccaaagaaggaaactctgttcttgtcaagcgagaagaacgtgaaactggagttgtgagttggaaagtcctggagaggtaccagaatgcacttggaggtgcatgggtagtgatgatgctcgttatatgctacgtcttgactcaagtatttcgggtttcaagcagcacttggttgagtgagtggactgattcaggaaccccaaagactcatggacccctattctataatattgtctatgcgcttctttcgtttggacaggtctctgtgacattgatcaattcatattggttgattatgtccagtctatatgcagctaaaaagatgcatgatgctatgcttggttccatactaagggctccaatggtgttctttcaaaccaatccattaggacggataatcaatcgatttgcaaaagatatgggagatattgatcgaactgtggcagtctttgtaaacatgtttatgggttcaatcgcacagcttctttcaactgttatcttgattggcattgtcagcactctgtccctgtgggccatcatgcccctgttggtcgtgttctatggagcttatctgtattaccagaacacatctcgggaaattaaacgtatggattccactacaagatcgccagtttatgctcaatttggtgaggcattgaatggactatctagtatccgtgcttataaagcatatgacaggatggctgaaattaatggaaggtcaatggacaataacatcagattcacacttgtaaacatggctgcaaatcggtggctgggaatccgtttggaagttttgggaggtctcatggtttggttgactgcgtcattagccgtcatgcagaacggaaaggcagcgaaccaacaagcatatgcatctacgatgggtttgcttctcagttatgcgttaagcattaccagctctttaacagctgtactgagactcgcgagtctagctgagaatagtttaaactcggttgagcgtgttggaaattatatcgagataccatcagaggctccattggtcattgaaaacaaccgtccacctcccggatggccatcatctggatccataaaatttgaggatgttgttcttcgttaccgccctgagttacctcctgttcttcatggagtttcgttcttgatttctccaatggataaggtgggaattgttgggaggacaggcgctgggaaatcaagcctcttaaatgccttattcaggattgtggagctggaaaaaggaaggattttaattgatgaatgcgacattggaagatttggactgatggacctacgtaaagtgctcggaattataccgcaagcgccagttcttttctcaggtaccgtgagattcaatcttgacccatttagtgaacacaacgacgccgatctctgggaatctcttgagagggcacacttgaaagatactatccgcagaaatcctcttggtcttgatgctgaggtaactgaggcaggagagaatttcagtgttggacagagacagttgttgagtcttgcacgtgcattgttacgaagatctaagatacttgttcttgatgaagcaactgctgcagttgacgtaagaactgatgttctcatccaaaagaccatccgagaagaattcaagtcatgcacaatgctaatcatcgctcatcgtctcaatactatcatcgactgtgacaaagttcttgtccttgattctggaaaagttcaggaattcagttcaccggagaatcttctttcaaatggagaaagttctttctcgaagatggttcaaagtacaggaactgcaaacgcggagtacttacgtagtataacactagagaacaaacgtaccagagaagctaacggtgatgattcacaacctttagaaggtcaaaggaaatggcaagcttcttctcgttgggctgcagctgctcaatttgcattggctgtgagcctcacttcatctcacaacgacctccaaagccttgaaatcgaagatgataacagtattttgaagaaaacaaaggacgccgtcgtcactctacgcagtgtccttgaagggaaacatgataaagagattgaagactctctaaaccaaagtgacatctctagagagcgttggtggccatctctttacaaaatggtcgaagggcttgccgtgatgagcagattggcgaggaacagaatgcaacacccggattacaatttagaagggaaatcgtttgactgggacaatgtcgagatgtaa

SEQ ID NO: 1393 - DNA, 1197 bp, Arabidopsis thaliana
atggcggctgttcaatgtctcactttcctcttcttgtttcttctccaaaacgcgacgtcagcttcacctctccctctcttccggcggccgatccaaagcaaccacagcaacttcgtgaagcatcctcgccgaagtcaggtggttttcccggtgaatcatagtagttgtgatctgttcgccggcgagtgggtgcgggatgagacttacccactttaccggtctaaagaatgcggccgaggaatcatagatccgggattcgactgccagacttacggcagacctgactccgactatctcaagttccggtggaaacctttcaactgcaatgtccctagattcaatggagtgaagtttctacaagaaatgagagacaaaaccataatgttcgttggtgattcgttgggtagaaaccaatgggagtcgttgatatgtatgatctcttcatcagcaccgtccattaatactcacatcattcatgaagatcctctctctaccttcaagatccttgactacaacgtgaaggtatcattctatagagctccttatcttgtagacatcgacaaaattaacggaaagacaactcttaaactcgacgaaatctctgtggatgcatcgaatgcttggcgcacagccgacgttctattgttcaacactggtcactggtggagccacacaggttctttacgagggtgggagcagatggagacaggtgggagatattacggcgacatggataggttagtggcgttgagaaaaggactaggaacgtggtctagttgggtccttcgttatatcaattctcctctcactagagttttcttcctctcggtctcacccacacactacaacccaaatgagtggacttcaagatcaaaaacttcaacaataactcaaggaggtaaaagctgctacggacaaacgacaccgtttagtggaacaacgtatccaacaagttcatacgtgaaccagaagaaagtgatagacgacgtggttaaagagatgaagtctcatgtctcattgatggatataactatgctctctgctcttcgtgtcgacggtcatccttcgatatatagtggagatctcaacccttctttgaaaagaaatcctgaccgttcatctgattgtagccattggtgtcttccgggtcttcccgacacttggaaccaattgttttatgctgctttgttgtactga

SEQ ID NO: 1394 - DNA, 1365 bp, Arabidopsis thaliana
atgggggagattgtggttttaagtagtgatgatggtatggagactataaagaacagagtaaagtcatcggaagttgttcagtgggagaagtatttgcctaaaactgtacttagggttttgttagttgaatctgattactcaactcgtcaaatcatcactgcccttcttcgtaaatgctgttacaaaggtcgattggtctttcctttcattagcttatttgtagctgtttctgatggtttagctgcgtgggaggttctaaaggagaagtcacataacattgatcttatactaacagagctggatttgccatctatatctggttttgctctgcttgctttggtaatggagcatgaagcttgcaagaacattcctgtcataatgatgtcttctcaagattcgataaaaatggtgttgaagtgtatgctgagaggtgctgctgattatctaatcaaaccaatgaggaaaaacgagttgaaaaatctatggcaacatgtttggagaagactgactttgcgtgatgatcctactgctcatgctcaaagcttaccagcttcacagcacaaccttgaagatactgatgaaacttgtgaagattccagatatcattcagatcaaggaagtggtgctcaggctatcaattacaatggtcacaataagctgatggagaatggcaaatcagtggatgaaagagacgagtttaaggaaacttttgatgtgacaatggatttgattggtggaattgacaagcgtcctgatagtatttataaagacaagagtcgagatgagtgtgttggtcctgagcttggactttctctgaaaagatcttgctctgtaagttttgagaaccaagatgaaagcaagcatcaaaagcttagcctctctgatgcgtcggccttctcaagatttgaggaaagcaagtcagcagaaaaagccgtcgttgctttagaggagagtacttcaggtgagccaaagacaccaaccgaatcacatgaaaagttaagaaaagtaacatctgatcaaggaagcgccacaacgagcagcaaccaggagaatatcggatcatcaagcgtaagcttccgtaaccaagttcttcagtccacagtaacgaatcagaagcaagattcacccataccggtagaatcaaatcgcgagaaagcagctagcaaggaagtagaagctggttctcaaagcaccaatgaggggattgctggacaaagcagtagcacagagaaaccaaaggaagaagaaagtgcgaaacaacgttggagtagaagccagagagaagctgcattgatgaagttccggttgaagaggaaagatcgatgctttgacaaaaaggtaagagacacacaagcttcatcataa

SEQ ID NO: 1395 - DNA, 1341 bp, Arabidopsis thaliana
atgacttcacagtgggatgatcatccggctattatggctgttggtgttgttgatggaacctcagaaactattttccaaacgcttctttctcttggaccctcaagatcagaatgggatttctgtttttatcaaggcagtgtggtcgaacatcttgatggtcacactgatataatccacaaacagctatacagcgattggttaccttgggggatgaagagaagagatttttcgctacggcgttactggagaagggaagacgatggcacatatggtggcggttatgtgatttctcccatagacaacggaaaacaatcagttgtgaagcacatgcttgctgttgattggaagtcctggagatcttatgtgaagccgtccttagctagatctattaccgtgaaaatgcttggaagaatttctggggagttgtcaagaagtgcaagattgactcagaacgaagatggtgtgtttggtgattcttccctgagggaaaacgaaatgtttaaggacactgcaaatgaagagagagacaaatttccctcagagcgctctagccttgtagacttggatgagtttttcgacgttccagaaccatcagataatgacaatttggatgacagctggacctcagattttgatttggatacatgctgtcagagcagcccacatgctacctgcaacccgccttgctgctatggaaccacgcttccaactgatcctagttgtgatttgccttgtagttggacaacaacggacccatctacttttctcattcgaggaaaaacttatcttgatgaccagaagaaggtcaaggcaaagggtacactgatggaaatggtagctgcagactggctaaaatctgacaagcgggaagatgatttggggtcccgtccaggaggcatagttcaggttcctggatcaacaacgtacagccttgtgctttattacatgatgagcactcctattgaagagcatcctttgctagttagctttgttaatggtgatgacgcatataggaattcaaggttcaagctcattccctacatatccaagggctcttggatagttaagcaaagtgtgggaaagaaagcatgccttattggtcaagccctggagatcaactacttcaggggaaagaactatattgagctgggcgttgatattgggtcatcaactgttgcaagaggagttgtgagtcttgttcttggttacctcaacaaactcgtgattgaaatggccttcttaatacaggcgaataccgaagaggagctcccagaatatcttcttggaacatgtcggtttaaccatctcgacgcttccaaagcaatttcaattattccatga

SEQ ID NO: 1396 - DNA, 759 bp, Arabidopsis thaliana
atgatgttctgtttctcaacggctacatctgtctgtgatccttttttaatccaacgatccagatctctcctcatcgcctatataaaactcacttctcttacatcaaacaaacaacacgcttggttaaactccatcagtactttaaccatcacttcaaagttcaaactcttttttttttttttgtttgatccaaattttaacaaaattatggatcgcaatttcctcctaacagttacattgatctgcattgtcgtcgccggtgtcggtggccaatctcctatctcttctccgaccaaatctcccaccactccttctgctccaactacttcccctactaaatcccccgccgttacttctcccactacggctccggcgaaaactccaactgcttcggcttcttcaccggttgagtcaccaaaatctccggctcctgttagcgagtcgtctccaccaccgacacctgttccagagagctctcctccggttcctgcaccaatggtttcttctccagtgagctctccaccggttccagcaccagtagctgattctcctccagctccggtagccgctccggttgctgatgtaccggctcctgctccaagcaagcataagaagactacaaagaaatcgaaaaagcatcaagctgcacctgctccggctccggaacttctcggtccacctgcaccaccgactgaatctcccggacctaactccgacgctttttctcccggtccttccgccgacgatcaggtacattag

SEQ ID NO: 1397 - DNA, 369 bp, Arabidopsis thaliana
atggcatcaaagttgctacaattgaaatccaaggcatgtgaagcatcaaagtttgtttccaagcatggaacaacttactacaaacagttgctggataagaacaagatgtatatccaggagccagctactatagagaaatgcaatgaattgtctaagcagcttctctacactcgtcttgctagcattcctgggcgttctgagtcattttggaaggaagtcaatcacgtgaagggtttatggaagaatcgggcggatttgaaggttgaagatgctggaatagctgcactttttggtctggaatgctttgcgtggtactgtgcaggagagattgtaggaaggggcttcactttcaccggctactacccttga

SEQ ID NO: 1398 - DNA, 1257 bp, Arabidopsis thaliana
atggaggatggaattggagggctgagacacatgttggcgacggtttttctttctgccttcgccggattcatggtagtaccagtgattactgatgtcaccgtcgctgctgtatgctctggccctgacgactcatgttctcttgccgtttacctcactggttttcaacaagtggcaatagggatggggactatgataatgatgccagtaattgggaatctatcagacagatatgggattaaaacaatcctcacccttcccatgtgtctctccattgttcctcctgtaattttaggatacagaagggatataaaattcttttatgtgttttatataagcaagattctgacctctatggcagtaaatattcatggcagtacaagaatttcagcttttggtattttagctggtatcaaaacaattgctggactttttggaacattagttgctcgttttcttcccatagctttgacttttcaggtttctgctatatcatttttcgttggcctagtgtacatgagagttttcctaaaagaaaagctaaacgatgatgaagatgatgatcttcatcatggtacgtatcatcaagaggatcatgatagtattaataccacaatgttagcagagccgattctgaacgatagacccatcaaaacacaagtctttcacaagaagtattcttcattgaaagatatgatcagcttgatgaagactaggtattactttttgaaagcacgttttggatttgacaagaagcagtttgctgatctcttgctgttgattaccatcgttgggtctatctctcaattgtttgtactgccaagatttgcatcggccattggagaatgcaagcttttatcaacagggctttttatggaattcataaacatggccattgtcagcatttcttgggcaccatgggttccttatctcaccactgtgtttgtacctggagccttatttgtgatgccatcggtttgtggtattgcctcgagacaagttggacctggtgaacagggaaaagttcaaggatgcatatctggagtgaggtcctttggcaaagtggtggcaccatttgtgttcagtccattgacagcgttgtttctttcaaaaaatgcaccgttctatttccctggattcagcctcctttgcatctccttgtcctcgttgatcggtttctttcagagtctactgattaaagatgtccctactccaccattgaacaaagcaatcaacaaaacctcaggcgaggaagtgtga

SEQ ID NO: 1399 - DNA, 1143 bp, Arabidopsis thaliana
atggaggagatagaaggaacaaacagagcagctgttgagagttgtcatagagttcttaatcttttacatagatcacagcaacaagatcatgttggttttgaaaagaatttagtatctgaaactagagaagctgtgattaggttcaagagagttgggagtttgttaagcagtagtgttggtcatgctaggtttagaagagctaagaaacttcagagtcatgtctctcaaagtctcttacttgatccatgtcaacaaaggacaacagaagttccatcatcatcttctcagaaaacaccggtactccggtctggtttccaggaattgagcttgagacaaccttcagattcactcactttagggactcgctcttttagtttaaactcaaatgctaaagctcctctccttcagcttaatcagcagacaatgcctccttcgaattatcctactttgtttccagtacaacaacaacaacaacaacaacaacaacaacaacagcaggagcagcagcagcagcagcagcagcaacagcaacagtttcatgaacggttacaagctcaccatcttcatcagcaacagcagctacagaaacatcaagctgagcttatgcttaggaaatgcaatggtgggataagtttgagtttcgataactctagttgtactccaactatgtcatccactaggtcctttgtttcttcacttagcatagatggtagtgttgctaatatagagggaaagaactccttccattttggggttcctagttcaactgatcagaattcactacattctaagaggaaatgccccttgaaaggagatgaacatggaagcttaaaatgcgggagctctagccgatgccactgcgctaagaagaggaaacatcgggttaggagatcgattagagtaccggctataagtaacaaggttgcagatatccctcctgatgattattcatggcgaaaatatggtcagaagcccatcaagggctctccttatcccagaggatattacaaatgtagtagcatgagaggttgtccagcgaggaagcatgttgagagatgtttggaagatccggcaatgcttattgttacttatgaagcagagcataaccacccgaaattgccatctcaagctataacaacttaa

SEQ ID NO: 1400 - DNA, 1392 bp, Arabidopsis thaliana
atggagaaacagaacattatctcaaacacttcttcttcttcgtcttcttggattcgtggttcttgtgttggaagaggttgttttggtacagtaagcaaagctttgagtaaaatcgacggtggacttttcgccgtgaagtcgatagatctcgccacgtgtcttccttctcaagcagagtcgttagagaacgaaatcgttattctacggtcgatgaagtctcatccaaacatagtgaggtttctcggtgatgatgtgtctaaagaaggaacggcgtcgtttcgaaatcttcatttagagtattcaccggaaggtgacgttgctaacggtggaatcgttaacgaaacgcttctcaggcgttacgtgtggtgtcttgtctctgctttgagtcacgttcattctaacggaattgttcactgcgacgttaaatctaagaacgttcttgtttttaacggtggtagctccgttaagctagcggattttggatcggcggttgagtttgagaaatctacgattcatgtttcgccacgtggaagtccgctttggatggctccggaggtggttagaagagagtaccaaggaccggagagtgacgtgtggtctttagggtgtaccgtcatcgagatgctcaccggaaaaccagcttgggaagatcacggtttcgactcgctgagtcggatcgggttctctaacgatttgccttttattccggtggggttatcggaactcgggagagatttcttagagaaatgcttgaaacgtgatcggagtcagcgttggagctgtgatcagctcttgcagcatccgtttctgtgtcaagatcatcatgactcgttcttcactgagtcgtctccgcgttgtgttcttgactgggtcaactcggagtttgacgaagaagaagagagcgacgaatggagaccagaatccatggtttcggcgatggcaaggataagtaaattagctataaccggaggagcaaattgggaatctaatggttggactgaggttagagacacttccgaagagtcagaggcaaaaaaggaagttcttgtttctccaagggtagaattggaatcttacatatcattggagtcgtcaagcgatgattccgtaagacaaccgaggaatgaagagtcggcgacggagttggcgtcggcagtgacgtgtgaagcaatattgttggtgatgatattggtggtagagaatattcaaatatatgccacgttttacaccagtagtattattatgcatattctatattgttgtagttgttgttgttattatcattatcaaaacaataataagaagaataatttttcgaaatctacatctttcattctcagccttaactttttgtttggtattgcatgtgattcggatcggtctatctattaa

SEQ ID NO: 1401 - DNA, 1305 bp, Arabidopsis thaliana
atggcggcgacggagcatcgcggcctcagtggaggagactacaatgtcgaccttttaccaattgaccaagacgattcgccaccatcttcatggcgtctcagcctcgacacattccgtctcccttcttcttcaccgttatcatcaggacgtcacaacggccgtactcgcttgtctcgttatctccggactccgaaaaaggaacgcaaagtctcagagtactacaaacagcaagagaagcttctggagggtttcaatgagatggagacaattaacgaaactggttttgtatctggagctccaactgaggaagaactgaagaagcttgcaaagagcgagaggcttgcagttcacatctcaaacgcagcaaaccttgtgctttttgtagcaaaagtttatgcttctgtggagagtaggtctatggctgtcattgcttccactttggactctctcttagatctcttgtctggatttattctatggtttactgctaatgccatgagaacacctaacaattttcgctatccaattggaaaacgacggatgcaacctgtgggaatcattgtgtttgcatctgtgatggcaactcttggactacaagtgatactagagtcaactaggctacttgtttccaagaatggttctcatatgagtagcaccgaggaaaaatggatgattggaataatggcttcagctacagtcgtcaagtttctgctcatgctttactgcaggagtttccagaacgaaattgtcagggcctatgcacaagatcacctctttgatgttatcaccaattcagtcggtttagcaaccgctgttttagctgtaaaattctactggtggattgatccctctggggctatactaattgccctgtatacaatcagcacatgggcaagaacagttctagagaatgtccattcactgataggacgctcagcaccaccagatttcttggcgaaactaacgttcttgatttggaaccatcacgagaagataaaacacatagacacagtgagagcctacacgtttgggtcacactactttgtggaagttgacattgtgttgccagaggacatgaggctgcatgaagctcacaacataggagaaactcttcaggagaagctggagcaactctctgaggttgagagagcttttgtccatattgactttgagtttactcatcgtccagaacacaaatgcaaggaaaggcaacaaattagagtctctgattcacttatgtcaatagtggataaagcgctgtacgttgccgagatagatatggcgatattctggtacttggactag

SEQ ID NO: 1402 - DNA, 594 bp, Arabidopsis thaliana
atgatgagacctactctccttatacttctcttttccacctttctcccacaaatcctcaccgttgatccaccactcctaccatccaacggctccgatttcatccgtttggcctgcaacaccacactctacccggacctttgcttctccactctctcctcttttgccaactccatccaaaatgactcaaaccgcctcgcgcgcgtagccatctccctcactctccacaacactctccaccttctctcttacctccaaaacgcttataaccgcgaccacccaacccccgtccttagagactgcttcgagaatcttaaagatgccgttgacggtatgagaggctccatgaaacagatgaaggagcttgtctccgcgtctggctcgatcgagtcatttaggttccagatgagtaatgtcaagacttggcttagtgcagctcttactgatgagtatacttgtacggacgggttcaaagacgtccacgaagacgactctatcaaagatgacgtctgctctcgagtcgatgacgtcaagaagcttactagcaatgcgctggctttagttaaccgctatgccgacgagtcaataataaattaa

SEQ ID NO: 1403 - DNA, 1326 bp, Arabidopsis thaliana
atggattcgtcatcatcatcatcattatctctttcaaaaaattttcttcgaatctcagttctacttcttattttccctctaacgttctgcaaaacatcttctacaaatcaaacactactcttctctctcaaaacacagaaacttcctcagtcttcttcagacaagctttcattcagacacaatgttactctcaccgtcactctcgccgtcggcgatccacctcaaaatatctcgatggttcttgataccggaagcgagctctcatggcttcactgcaagaaatctccaaacttaggatccgtttttaacccggtttcatcctctacgtactcccctgtgccttgctcctcaccaatttgcaggacccgtacccgggatttacccatacccgcttcatgcgatccgaagacccatctctgccacgtggctatctcctacgctgacgctacatcaatcgaaggcaacttggctcatgagacgttcgtaatcgggtctgtgacccgacccggtactttattcgggtgtatggactcaggtttaagctccaattcggaggaagatgctaaatcgaccggtttaatgggaatgaaccggggatctttatcttttgttaaccagctgggtttctcaaaattttcgtattgcatatccggttcagattcctccggttttttgcttctcggtgacgcgtcctactcctggctcggtccaatccaatatacgcctctggttctacaatcgacgccgttaccttatttcgaccgggttgcttacacggtccaattagaaggaatccgggtcgggtcaaagatactttctttaccgaaatctgtattcgtaccggatcataccggagcaggtcagacgatggtggattcaggtacccaatttacgttcctaatgggtccggtttacactgccttaaaaaacgagtttattacgcaaaccaaatcggttctcaggcttgtagacgacccggatttcgtgttccaagggacaatggacctttgttacaaggttgggtcaacgacacggcccaatttctcgggtttacccatggttagtttaatgttccgtggcgcggagatgagtgtgtcgggtcagaaactgttgtaccgggtaaacggagccgggtcggaaggaaaagaagaagtatattgcttcacgtttgggaactctgatcttttggggatagaagcatttgttataggtcaccatcatcagcaaaacgtgtggatggagtttgatttagctaaatcaagggttggtttcgctggtaacgtcagatgtgatttagctagtcaacggctcggattaagagattga

SEQ ID NO: 1404 - DNA, 711 bp, Arabidopsis thaliana
atggcaggagaggcagaggctttggccacgacggcaccgttagctccggtcaccagtcagcgaaaagtacggaacgatttggaggaaacattaccaaaaccatacatggcaagagcattagcagctccagatacagagcatccgaatggaacagaaggtcacgatagcaaaggaatgagtgttatgcaacaacatgttgctttcttcgaccaaaacgacgatggaatcgtctatccttgggagacttataagggatttcgtgaccttggtttcaacccaatttcctctatcttttggaccttactcataaacttagcgttcagctacgttacacttccgagttgggtgccatcaccattattgccggtttatatcgacaacatacacaaagccaagcatgggagtgattcgagcacctatgacaccgaaggaaggtatgtcccagttaacctcgagaacatatttagcaaatacgcgctaacggttaaagataagttatcatttaaagaggtttggaatgtaaccgagggaaatcgaatggcaatcgatccttttggatggctttcaaacaaagttgaatggatactactctatattcttgctaaggacgaagatggtttcctatctaaagaagctgtgagaggttgctttgatggaagtttatttgaacaaattgccaaagagagggccaattctcgcaaacaagactaa

SEQ ID NO: 1405 - DNA, 1074 bp, Arabidopsis thaliana
atgggaaaggttcttgagaaggaggcgtttggattggctgcgaaagacgaatcgggaattctttcgcctttcagtttctctagaagggcgacgggtgaaaaggatgtgaggttcaaagtcttgttctgtggaatttgccacactgatctgagtatggccaaaaacgaatgggggttaactacttatcctcttgtccctgggcatgagattgtgggcgtggtgactgaagttggagccaaagtgaaaaaattcaacgctggagacaaagtcggagttggctatatggccggctcgtgcaggtcatgtgacagctgcaatgatggcgacgagaactactgtccaaagatgatcttaacgtccggagccaaaaactttgacgataccatgacccatggtggatactccgaccacatggtgtgtgctgaggatttcatcatccgtattcctgacaatctcccattagacggtgccgcaccactactctgcgccggggtcacggtctactcccccatgaagtatcacgggctcgacaagcccggtatgcacatcggtgtggtgggactaggcggtttgggccatgtagcagtgaaatttgctaaggctatgggtactaaagttacggttattagtacttcggagcgtaagagagacgaggccgttactcggcttggtgcggatgccttcttggtgagccgtgacccgaaacaaatgaaggatgcaatggggactatggatggtatcattgataccgtatctgcgacccatccacttcttccgctgcttggtttgcttaaaaataagggaaaacttgttatggttggtgcaccagcagaaccgctcgagcttcctgtttttcctctcatctttgggcggaagatggtggtgggtagtatggtaggaggtataaaggagacgcaagagatggtggatttggctggaaaacacaacatcacggcggatattgagctcatctctgcggattatgtcaacaccgccatggaacggcttgcaaaggctgacgttaagtaccgatttgtgattgatgttgccaacacgatgaagccaactccttaa

SEQ ID NO: 1406 - DNA, 1572 bp, Arabidopsis thaliana
atggctgcttcatcgtctccgtgcatcttcttcgccactaccttactggtgctgcttctcactttctcatccgggaaattaccatttcaccctcgagacctgcttccgctttttccgaggcaagtctcgtggccggtagtcaattctctcaacactgccgtcgatctcctccctactttcatcggctccgcttctgttagaaacgacgccgtggagtggaaaggtgcttgcttttatgagaacaaagcttggttggagctcaataacaagtccggttccgaattcggcggcggcacacttcacattaaggtcgataaggcacatagttggacgtgcatggatatttatgtctttgtcacaccatatcgtgtgacatgggattggtactttgcttcgagagagcacactatggaattcaaggagtgggagggtaaagctgagtatgaatatgttaagcagaaaggagtttcgatattcctcatggaagcagggatgttgggaactctccgagctctgtgggatgtcttccctctgtttaccaatactggttggggggagaattctaacatagcgtttcttaagaatcatatgggtgctaatttctatcctcgtcctaaaccttgggttacaaatattactaccgatgaaattcactctggagacttactagctatctccaaaatccgtgggcggtggggtggttttgagaccctagagaagtgggtaagtggagcctatgctggtcacactgctgtctgtttgagggactctgaagggaaactctgggttggtgaatccgggaatgaaaatgaaaagggagaagatgtaatagcgatattgccatgggaagagtggtgggagtttgaacaaaccaaggatgactcgaatccccacattgcattgctaccgttgcatcctgattatcgagccaagtttaatgttacagctgcatgggaatatgctcgtagcatggatggcaaaccatatggctatcacaacttgatctttagctggatcgataccatcagcggaaattacccacctcctctggatgctcaacttgttgcttctgtcatgacagtttggagcaaaatccagcctgattatgctgctaacatgtggaatgaagcccttaacaagcgactcggaacagagggtcttgatcttcctgatgtactggtggaagtcgaaaagcgtggatcctcttttgacgagttgctggcagttcctgaacaagatgattggatatatagcgatgggaaatcaacgtcttgtatcgcttttatcctcgaaatgtacaaagaagctgggcttttcgatccaatctctagttccattcaagtcacagaattcacgatcaaagatgcttacatgctcaagtttttcgagagtaatgcaagtcgttttcccaaatggtgcaatgacaatgacgttgtgaagcttccgtactgtcaaatacttgggaaatacaggatggaacttcccggttacaacacaatggagccatacccacatatgaacgagcactgcccgtctctgcctccaaaataccacagaccaaagaactgctag

SEQ ID NO: 1407 - DNA, 435 bp, Arabidopsis thaliana
atgccgggaaattctcaccgccggggatccgacgtcatattcaccgtgatgatgatcgccttgctgacgtgtccaacactcatcaacggttcatcatcatcagatgcttctttagaagcaagaaagctcgatgaggtcgatcccataaagtgctctccaagctgcatccaaaaccctcctccgccatctcctccaccaccgtctccgccaccacctgcatgtcctccacccccggctcttccaccgcctccgcctaagaaagtcagttcctactgcccaccgcctccgccggctaatttcttgtacatcacgggtccgccgggaaatctctaccccgttgatgagcaattcggagcggccgccggaaaaagttttatggtggtgaagctctccggtctaatcgcgtttggaattatggcgttcctgattctttga

SEQ ID NO: 1408 - DNA, 549 bp, Arabidopsis thaliana
atggaaaccactgcttttaacacaacatcacgaattggaaactggtcatcggctatttctccacctctacaaacatgtggatctttcaagtgccaattaccaacacgaagaggtgttattgtagctgatcttcgaaactcaaacttccgatggaggaaagcaacgacaacaagcagaggaaatgttgcagcagaggcagttaaaattcctacgtcagtaccagtaagagtggcgcgtgagctagctcaagcaggataccgctatctcgacgtgaggacaccagacgaattcagcatcggacatccgactagagccatcaacgtaccttacatgtacagagtcggatcaggaatggttaagaacccgagttttctaagacaggtctcgtcccacttcaggaaacacgatgaaatcataatcggttgtgagagcggtcaaatgtcatttatggcctcaactgatcttctcactgctggcttcacggcgatcacagacattgctggaggatacgtcgcttggacagagaatgagctgccggtagaagagtga

SEQ ID NO: 1409 - DNA, 783 bp, Arabidopsis thaliana
atggcagaagagtacaagaacaccgttccagagcaggagacccctaaggttgcaacagaggaatcatcggcgccagagattaaggagcggggaatgttcgatttcttgaagaaaaaggaggaagttaaacctcaagaaacgacgactctcgcgtctgagtttgagcacaagactcagatctctgaaccagagtcgtttgtggccaagcacgaagaagaggaacataagcctactcttctcgagcagcttcaccagaagcacgaggaggaagaagaaaacaagccaagtctcctcgacaaactccaccgatccaacagctcttcttcctcttcgagtgatgaagaaggtgaagacggtgagaagaagaagaaggagaaaaagaagaagattgttgaaggagatcatgtgaaaacagtggaagaagagaatcaaggagtaatggacaggattaaggagaagtttccactcggagagaaaccagggggtgatgatgtaccagtcgtcaccaccatgccagcaccacattcggtagaggatcacaaaccagaggaagaagagaagaaagggtttatggataagatcaaggagaagcttccaggccacagcaagaaaccagaggattcacaagtcgtcaacaccacaccgctggttgaaacagcaacaccgattgctgacatcccggaggagaagaagggatttatggacaagatcaaagagaagcttccaggttatcacgccaagaccactggagaggaagagaagaaagaaaaagtgtctgattaa

SEQ ID NO: 1410 - DNA, 1722 bp, Arabidopsis thaliana
atgtctcttcctgaaactaaatctgatgatatccttcttgatgcttgggacttccaaggccgtcccgccgatcgctcaaaaaccggcggctgggccagcgccgccatgattctttgtattgaggccgtggagaggctgacgacgttaggtatcggagttaatctggtgacgtatttgacgggaactatgcatttaggcaatgcaactgcggctaacaccgttaccaatttcctcggaacttctttcatgctctgtctcctcggtggcttcatcgccgatacctttctcggcaggtacctaacgattgctatattcgccgcaatccaagccacgggtgtttcaatcttaactctatcaacaatcataccgggacttcgaccaccaagatgcaatccaacaacgtcgtctcactgcgaacaagcaagtggaatacaactgacggtcctatacttagccttatacctcaccgctctaggaacgggaggcgtgaaggctagtgtctcgggtttcgggtcggaccaattcgatgagaccgaaccaaaagaacgatcgaaaatgacatatttcttcaaccgtttcttcttttgtatcaacgttggctctcttttagctgtgacggtccttgtctacgtacaagacgatgttggacgcaaatggggctatggaatttgcgcgtttgcgatcgtgcttgcactcagcgttttcttggccggaacaaaccgctaccgtttcaagaagttgatcggtagcccgatgacgcaggttgctgcggttatcgtggcggcgtggaggaataggaagctcgagctgccggcagatccgtcctatctctacgatgtggatgatattattgcggcggaaggttcgatgaaggcaataagggatcaggaagcgggagttacctcgaatgtattcaacaagtggacactctcaacactaacagatgttgaggaagtgaaacaaatcgtgcgaatgttaccaatttgggcaacatgcatcctcttctggaccgtccacgctcaattaacgacattatcagtcgcacaatccgagacattggaccgttccatcgggagcttcgagatccctccagcatcgatggcagtcttctacgtcggtggcctcctcctaaccaccgccgtctatgaccgcgtcgccattcgtctatgcaaaaagctattcaactacccccatggtctaagaccgcttcaacggatcggtttggggcttttcttcggatcaatggctatggctgtggctgctttggtcgagctcaaacgtcttagaactgcacacgctcatggtccaacagtcaaaacgcttcctctagggttttatctactcatcccacaatatcttattgtcggtatcggcgaagcgttaatctacacaggacagttagatttcttcttgagagagtgccctaaaggtatgaaagggatgagcacgggtctattgttgagcacattggcattaggctttttcttcagctcggttctcgtgacaatcgtcgagaaattcaccgggaaagctcatccatggattgccgatgatctcaacaagggccgtctttacaatttctactggcttgtggccgtacttgttgccttgaacttcctcattttcctagttttctccaagtggtacgtttacaaggaaaaaagactagctgaggtggggattgagttggatgatgagccgagtattccaatgggtcattga

SEQ ID NO: 1411 - DNA, 1461 bp, Arabidopsis thaliana
tcttaccgtttacccgcttttagcccggtgggtcctcccaccgtgactgcttccaccgccgtcgtcccggagattctctcctttggacaacaagcaccggaaccacctcttcaccacccaaaacccaccgagcaatctcacgatggtctcgatctctccgatcaagcccgtcttttctcctctatcccaacctctgatctcctccgttccaccgccgtgttgcatgcggcggcgataggtcctatggtcgacctagggacgtgggtcatgagctctaaacttatggacgcttcggtgacgcgtggcatggttttagggcttgtgaaaagtacgttttatgaccatttttgcgccggtgaagatgccgacgcagccgctgagcgcgtgagaagcgtttatgaagctactggtcttaaagggatgcttgtctatggcgtcgaacacgccgatgacgctgtatcttgtgatgataacatgcaacaattcattcgaaccattgaagctgccaaatctttaccaacatctcactttagctcagtggttgtgaagataactgccatttgtccaattagtcttctgaaacgagtgagcgatctgctgcggtgggaatacaaaagtccgaacttcaaactctcatggaagctcaaatcgtttccggttttctccgaatcgagtcctctctaccacacaaactcagaaccggaaccgttaaccgcggaagaagaaagggagctcgaagcagctcatggaaggattcaagaaatctgtaggaaatgccaagagtccaatgtaccattgttgattgatgcggaagacacaatcctccaacccgcgatcgattacatggcttattcatcggcgatcatgttcaatgctgacaaagaccgaccaatcgtttacaacacgattcaggcgtacttgagagacgccggtgagagactgcatttggcagtacaaaatgctgagaaagagaatgttcctatggggttcaagttggtgagaggggcttacatgtctagcgaagctagcttggcggattccctgggttgcaagtcgccagtccacgacacaattcaggatactcactcttgttacaatgattgtatgacattcctgatggagaaagcatcaaacggttctggtttcggtgtcgttctcgcaacacataacgctgattcggggagacttgcgtcgaggaaagcgagtgacctcgggatcgataaacagaacgggaagatagagtttgcacagctatatggtatgtcagatgcattgtccttcgggttaaagagagcagggttcaatgttagcaagtacatgccgtttggacccgtcgcaaccgctataccgtatcttctccgacgcgcttatgagaaccggggaatgatggccaccggagctcatgaccgtcaactcatgaggatggaacttaagaggagattaatcgccgggattgcgtaa

SEQ ID NO: 1412 - DNA, 780 bp, Arabidopsis thaliana
atggccagagacggtggtgtttcttgtttacgaaggtcggagatgatgagcgtcggtggtatcggaggaattgaatctgcgccgttggatttagatgaagttcatgtcttagccgttgatgacagtctcgttgatcgtattgtcatcgagagattgcttcgtattacttcctgcaaagttacggcggtagatagtggatggcgtgctctggaatttctagggttagataatgagaaagcttctgctgaattcgatagattgaaagttgatttgatcatcactgattactgtatgcctggaatgactggttatgagcttctcaagaagattaaggaatcgtccaatttcagagaagttccggttgtaatcatgtcgtcggagaatgtattgaccagaatcgacagatgccttgaggaaggtgctcaagatttcttattgaaaccggtgaaactcgccgacgtgaaacgtctgagaagtcatttaactaaagacgttaaactttccaacggaaacaaacggaagcttccggaagattctagttccgttaactcttcgcttcctccaccgtcacctccgttgactatctcgcctgaatcgtcgccgccgttgactgtttcgactgaatcgtcggattcgtctccgccgttatctccggtggagatcttttccacctcgccactttcatctccgatagacgatgaagatgatgacgtgttgacgtcgtcgtcggaggaatcgccgattcgacggcagaagatgaggagtcccggattagattag

SEQ ID NO: 1413 - DNA, 1878 bp, Arabidopsis thaliana
atggccacaaaaccaggagtcctcaccgattggccttggacacccctcggaagtttcaagtacatcgtaatagcaccatgggctgtccatagcacatacaggtttgtgacagatgatccagagaagagggatctcgggtacttccttgtgttcccattcttgctcttcagaattctgcacaaccaggtttggatctctctgtcccgttactatacgtcctcgggaaagagacgcatcgtcgacaagggaatcgacttcaatcaggtcgacagggagaccaactgggatgaccaaatattgttcaacggagtgctgttctatataggcatcaacctattgccggaggccaaacaacttccctggtggagaactgacggagtgttgatggcagcgcttattcacaccggaccggtggagttcctctattattggctccacaaagctctccaccatcactttctttattcccgctaccattcccaccaccactcctctatcgtcactgagcccatcacttcggtgatacatccgtttgcggagcacatagcatacttcatcctcttcgcgataccactacttaccacgttgctaacaaaaacggcgtcaataatttcgttcgccggatacataatctacatagacttcatgaacaacatgggacactgcaacttcgagctaatccctaagcgccttttccacctctttcctcccctcaagttcctctgttacaccccctcataccactcgctgcaccacacgcagttccggaccaactactccctcttcatgcccttgtatgactacatctacggcacaatggatgaaagcacggatacgttgtacgagaaaactctagaaagaggagatgatatagtggacgtggtgcacttaactcacctgacgacgccagaatccatataccatttgcgcattggcttggcctcatttgcctcctaccccttcgcttatagatggttcatgcgccttttgtggcctttcacctctctctccatgatattcacgctcttctacgcccgcctctttgtcgctgagagaaactccttcaacaagctcaacttgcagtcttgggtgatacctagatataatctacagtacttgttaaaatggaggaaagaagcgatcaataacatgattgagaaagcgatactggaggcagataagaaaggagtgaaggtgcttagtctgggtctcatgaaccaaggggaggagcttaacaggaacggagaggtgtatatccacaaccatccagatatgaaagtgagactggtcgacggcagtagattagcagcagctgttgtgatcaacagtgtacccaaagcaactacaagcgtcgtgatgacaggcaatctcactaaggttgcctacaccatcgcctctgctctctgccagagaggcgttcaggtctccactctgcgcctagacgagtatgagaaaataagatcatgcgttccacaagaatgcagagaccatttggtctatttaacctctgaagcactctcatcaaacaaggtatggctggtgggagaaggaacaacaagagaagagcaggaaaaagccacaaaagggacattgtttataccattctcacagttccccctcaagcagttacgtagagattgtatctatcataccacaccagcattgatagttccaaaatctctggtgaatgtccactcctgtgagaactggttaccgagaaaggcgatgagtgcaactagagtggccggcatattgcacgccttagaaggatgggaaatgcatgagtgtggcacatcccttcttctctcggatttggaccaagtatgggaagcctgtctcagccacggcttccagcctctcctccttccacatcattaa

SEQ ID NO: 1414 - DNA, 1755 bp, Arabidopsis thaliana
atgtgtggaatacttgccgtgttaggatgttccgatgattctcaggccaagagagttcgtgttcttgagctttctcgcagattgaggcacagaggacctgactggagtggcttatatcagaacggagataattacttggcccatcaacgtcttgccgtcatcgatcctgcttccggtgatcaacctcttttcaacgaggacaagaccattgttgtcacggtgaacggagagatttataaccatgaggagctgagaaaacgtctgaagaatcacaagttccgtactggtagtgattgtgaagtcattgctcacttgtacgaggagtatggtgtggattttgttgatatgttggatggaatattctcctttgtgttgctcgacacacgagataactctttcatggtggctcgtgatgcgattggtgtcacttcgctctacattggttggggactagacggatctgtgtggatatcttcagagatgaaaggcctaaacgatgactgtgagcatttcgaaacgtttcctccaggtcatttttattcaagcaaattaggagggtttaagcaatggtataatcctccttggttcaatgaatctgttccttcaacgccttatgagcctcttgcgataagacgcgcctttgaaaacgctgtgattaagcggttgatgactgatgttccatttggagttttgctctctggtggtcttgattcttcccttgttgcctccatcactgcacgtcacttggccggtactaaggcggctaagcaatggggtcctcagctccattccttttgcgttggtcttgagggctcaccggacttgaaggcagggaaagaggtggcggaatatttggggacggtgcaccacgagttccacttctcggtgcaggacgggattgatgcgatagaggatgtgatttaccatgttgagacctatgatgtgacgactatcagagcgagcacaccgatgttcttgatgtcccggaaaatcaagtctctaggggtcaagatggttctctccggcgaaggtgcggacgagatctttggagggtacctctatttccacaaggcacctaacaagaaagagtttcaccaagaaacttgtcgcaagatcaaggctcttcacaagtatgactgtctaagagccaacaaatctacctctgcctttggactagaggcacgtgttcctttccttgacaaagacttcatcaacacagctatgtctctcgaccctgaatccaagatgatcaagccagaggaaggaaggatcgagaaatgggttctaaggagagcctttgacgacgaagaacgtccttatctaccaaaacacattctctacagacagaaagaacagttcagtgatggtgttggctacagttggatcgatggcctgaaagatcacgctgctcaaaatgtcaatgacaagatgatgtcgaacgcggggcatatcttccctcacaacactccaaacactaaagaagcttactactacagaatgatctttgaaaggttcttcccgcagaactctgcgagactaacggttcctggaggtgccaccgtggcttgttcgactgcaaaggcagtggagtgggatgcaagctggtccaacaatatggatccatcaggaagagccgctatcggagttcacctttcggcctacgatggcaagaacgtggcattgaccataccaccacttaaggcaattgacaacatgccgatgatgatgggtcaaggagttgtgattcagtcataa

SEQ ID NO: 1415 - DNA, 3195 bp, Arabidopsis thaliana
atgaattcaaatggccatgaggaggagaagaagttggggaatggagttgtggggattctagctgaaacagttaacaaatgggagagacgaacaccattgacgccatcgcattgcgctcgccttttacacggtgggaaagacagaaccggcatttcccgcattgtggttcagccatctgctaagcgtatccatcatgatgccttgtatgaagatgttgggtgtgaaatttctgatgatttgtctgattgtgggcttatacttggaatcaaacaacctgagctagaaatgattcttccagagagagcatacgctttcttttcacatactcataaggcacagaaagagaacatgcctttgttggataaaattctttctgagagagtgactttgtgtgattatgagctcattgttggggatcatgggaaacgattattggcgtttggtaaatatgcaggcagagctggtcttgttgacttcttacacggacttggacagcgtaagctcattctaggatactcaacacctttcctctcgctcggtgcatcgtatatgtattcctcattggctgctgcaaaagccgctgtaatttctgttggtgaagaaattgcaagccagggactgccattaggaatctgccctcttgtatttgtcttcaccggaacaggaaatgtttctctgggggcgcaagaaattttcaagcttcttcctcacacttttgttgaaccaagcaaacttcctgaactatttgtaaaagacaaaggaattagtcaaaatgggatttcaacaaagcgagtctatcaagtatatggttgtattattaccagccaagacatggttgaacacaaagatccatcaaagtcattcgacaaagccgactattatgcacacccggaacattacaatccagttttccacgaaaagatatcgccatatacgtctgttcttgtaaactgtatgtactgggagaagaggtttccctgtcttctgagcacaaaacagcttcaagatttaacaaaaaaaggactcccactagtaggcatatgtgatataacttgtgacatcggtggctccattgaatttgttaaccgagctactttaatcgattcccctttcttcaggtttaatccctcgaacaattcatactacgatgacatggatggggatggcgtactatgcatggctgttgacattttacccacagaatttgcaaaagaggcatcccagcattttggagatattctttccggatttgtcggtagtttggcttcaatgactgaaatttcagatctaccagcacatctgaagagggcttgcataagctataggggagaattgacatctttgtatgagtatattccacgtatgaggaagtcaaatccagaagaggcacaagataatattatcgccaacggggtttccagccagagaacattcaacatattggtatctctgagcggacacctatttgataagtttctgataaacgaagctcttgatatgatcgaagcggctggtggctcatttcatttggctaaatgtgaactggggcagagcgctgatgctgaatcgtactcagaacttgaagttggtgcggatgataagagagtattggatcaaatcattgattcattaactcggttagctaatccaaatgaagattatatatccccacatagagaagcaaataagatctcactgaagattggtaaagtccagcaagaaaatgagataaaagagaagcctgaaatgacgaaaaaatcaggtgttttgattcttggtgctggacgtgtgtgtcgcccagctgctgatttcctagcttcagttagaaccatttcgtcacagcaatggtacaaaacatatttcggagcagactctgaagagaaaacagatgttcatgtgattgtcgcgtctctgtatcttaaggatgccaaagagacggttgaaggtatttcagatgtagaagcagttcggctagatgtatctgatagtgaaagtctccttaagtatgtttctcaggttgatgttgtcctaagtttattacctgcaagttgtcatgctgttgtagcaaagacatgcattgagctgaagaagcatctcgtcactgctagctatgttgatgatgaaacgtccatgttacatgagaaggctaagagtgctgggataacgattctaggcgaaatgggactggaccctggaatcgatcacatgatggcgatgaaaatgatcaacgatgctcatatcaaaaaagggaaagtgaagtcttttacctcttattgtggagggcttccctctcctgctgcagcaaataatccattagcatataaatttagctggaaccctgctggagcaattcgagctggtcaaaaccccgccaaatacaaaagcaacggcgacataatacatgttgatgggaagaatctctatgattccgcggcaagattccgagtacctaatcttccagcttttgcattggagtgttttccaaatcgtgactccttggtttacggggaacattatggcatcgagagcgaagcaacaacgatatttcgtggaacactcagatatgaagggtttagtatgataatggcaacactttcgaaacttggattctttgacagtgaagcaaatcaagtactctccactggaaagaggattacgtttggtgctcttttaagtaacattctaaataaggatgcagacaatgaatcagagcccctagcgggagaagaagagataagcaagagaattatcaagcttggacattccaaggagactgcagccaaagctgccaaaacaattgtattcttggggttcaacgaagagagggaggttccatcactgtgtaaaagcgtatttgatgcaacttgttacctaatggaagagaaactagcttattccggaaatgaacaggacatggtgcttttgcatcacgaagtagaagtggaattccttgaaagcaaacgtatagagaagcacactgcgactcttttggaattcggggacatcaagaatggacaaacaacaaccgctatggccaagactgttgggatccctgcagccattggagctctgctgttaattgaagacaagatcaagacaagaggagtcttaaggcctctcgaagcagaggtgtatttgccagctttggatatattgcaagcatatggtataaagctgatggagaaggcagaatga

SEQ ID NO: 1416 - DNA, 921 bp, Arabidopsis thaliana
atgagagggatggtgagttttgccgtttgggctctctttgctgctttactctcacagcagctctttgcttctgttgcttccgtaaggtttgaggatgccaaaacatactacttatctcctccctctggctcacatggaactcctccatcacacacgcctccttcttctaactgtggaagtccaccttacgacccttctccttcaactccttctcacccttcacctccatcacatactccaactccttccactccatcacacactccaactccacacactccatcacacacgccaactccacacacccctccttgtaactgtggaagtccaccttcccacccttccacgccttcacacccttccactccttcgcacccaacgccatcacaccctccttctggtggatattactcatctcctccaccaagaactccggttgttgtgactccaccatcacccattgttgatccaggcacacccatcattggaggaagcccaccaactcctatcattgacccaggcactcctggaactcctttcattcctgctcctttcccaccaatcactggaacatgcgattactggagaaaccaccctacattgatatggggcttgcttggatggtggggaactgttggaggagcttttggtacagtcagtattcccagtagcattccagggtttgatcctcacatgaaccttcttcaggcactttccaacacccgctctgatcccattggtgctctctaccgtgaaggcacagcttcttggttaaactccatggtcaaccataagttccctttcacaacccctcaagttagagaccactttgttgcaggactttcctcaaacaaggcagccacaaagcaggcccataccttcaagcttgctaatgaaggtcgtctaaagcctagagtctga

SEQ ID NO: 1417 - DNA, 1149 bp, Arabidopsis thaliana
atgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatatggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattgcatcaactgctcgatacgaagcctcgagctaaagcagtagctgcaggctga

SEQ ID NO: 1418 - DNA, 1137 bp, Arabidopsis thaliana
atgtctgcttcatgtgctttaacaccgtctgttaggacagagttattcagttcatcatcatctaaaagatcaatctttcctgctagaatttgtcgaccaagaaacaaatgtgaaatcagcagaagggattttgcaattaggggagggattgttgcttctggagtttcagtcatggatacttcttctgcttcttctcagtctgttcaaggtagtgagaggttggcttttaaaccagaaggctataacttttgggaatggagaggtcacaagattcattatgttgttcaaggagaaggctcgcctctagttcttattcatggttttggtgcttctgtctttcattggaggtataacattcctgaattggctaagaaatacaaggtttacgccttggacttactcggtttcggatggagtgacaaagctctcatagagtatgatgccatggtttggacagatcaagttattgatttcatgaaagaggtagtgaaagaaccagctgttgtcgttggaaacagccttgggggatttacggcattgtcagttgcggttggattacccgagcaagtcacgggagttgcacttctgaactctgcgggacaatttgcagccgagagtagaaaacgagaggaagctgatgaaactgtgataaccaagtttatagttaagccgctaaaagagattttccaacgtgtggttcttgggttcttgttctggcaagccaagcaaccttctcgaatcgaatctgtcttaaagagtgtgtacatagactctactaatgtcgatgactacctcgtcgaatccatttcaaaacctgcaacagatccaaatgctggagaagtatactacagattgatgacaaggttcttaacaaaccagagtagatacactctagatagtgttctaagtaagatgacttgtccgcttctgttggtttggggagatcttgatccgtgggtcggtccagctaaagccgagaaaatcaaagcattttactcgaactcatcgctcgttcacttacaagcagggcattgtcctcatgatgaagtcccggaagctgtaaacaaggctttgttggattggttgtccattaatattgcttcaaagccagcttctcctatagtcttggagacgtaa

SEQ ID NO: 1419 - DNA, 570 bp, Arabidopsis thaliana
atgggttgctgctgttgtctcccgagtatacccgaaagctcaagaactatagatgagcatcttcccttatctcgtgccacgccttcctctctctctaatgcatacagttcacctctttcgccgcctattcctttagccatcacgaatataaatcttcaaactagtccaccgaaattgccaagaactcagggcaattcgagtgaagcatccccgggactcacacaagttgttccagagaagaaaacatggcatgttgatgatctaactgattttgagctaaagaaacagtatcgagaagcaatcgatgaatgtccaatttgcttagaagaatatgagattgataacccgaaattgctcactaaatgtggccatgactttcatctcgcttgcattcttgcatggatggaaagaagcgaggcgtgtccagtttgcgataaggtttgtgtccgtttaaaatccgccattttcacaatacattttgaacttcttgagtcactagaatctgttttgacaatagagtctactttttgggtattcttttcacaggaattagtgctcactgaatcataa

SEQ ID NO: 1420 - DNA, 288 bp, Arabidopsis thaliana
atgaatgccggaaagcaagcttcgtgggcggtggcgacggcgatcgcagccgtggaagtgctaaaagaccaaggcgttgctcggtggaactaccttttccgcttactccacaaagaagcaatggctcgcgtccgtaccattacagtcccatctcgtccctctcctcctacgtcttcatcttcggctacttccatcagatccaaacctttgtccaccacaccctttgagacatcctttgagaaagctatgggtcttagctgctttggtcccaccaccgttagattctag

SEQ ID NO: 1421 - DNA, 474 bp, Arabidopsis thaliana
atgaagcaaaagatcttgataagagtgactatgaccgatgacaaaacccgagcaaaagcaatgacaaaagcagttcagtttaaaggcgtgtcagccgtggaaataaaaggcgatcacaggaaccagatagaggtaaccggcgttgaagttgatatgatccctcttatccaaatactcagaaagaaggtagcgttcgcagagcttgtgagcgtgaccaaagttgaaccaccaaagaaagaagacgagaagaaaggaggggacggaaagggtgcagagggaaaaggcggtgaccaaaaaggtggcgataagaaagggccagatgacaaggaacctccggagccaaaacctgtgccgtgttatccatggcctctgcagggatacggtgtaccttcctcctttcctcatccggcacatccctacaatgatataggggaacccgtttacaatcacgaacccaattgcaaaatcatgtga

SEQ ID NO: 1422 - DNA, 783 bp, Arabidopsis thaliana
atggctgaacgagtctatcccgccgattcaccaccacaaagcggacaattctccggcaacttcagctccggcgaattccccaaaaaaccagcaccaccaccatcaacatacgtaatccaagtcccaaaagatcaaatctaccgtataccaccgccggaaaacgcacaccgctttgaacaactctctcgtaaaaaaaccaaccgcagtaactgtagatgctgcttctgctcattcctcgccgcggttttcatcttaatcgtcctcgccggaatatccttcgcggttctctacctaatctaccgtcccgaagctcctaaatactccatcgaaggattctctgtttccggtatcaatctgaattcaacatctccgatttcgccgagttttaacgttaccgttagatcacgtaacggtaacggtaaaatcggggtttactacgagaaagaaagctctgttgatgtgtattacaacgacgttgatataagtaacggtgttatgccggtgttttatcagccggcgaagaatgtaacggtcgttaagttggttttaagtggttctaaaatacagttgactagtggtatgaggaaggagatgcgtaatgaggtgagtaagaaaacggtgccgtttaagttgaagattaaagctccggtgaagattaagtttggttctgttaagacgtggactatgattgttaatgttgactgtgatgtaacggtggataaattgacggcgccgtcgaggattgtgtcgagaaaatgcagtcatgacgtggatctttggtga

SEQ ID NO: 1423 - DNA, 270 bp, Arabidopsis thaliana
atgcagaccgacactgcatcagttcttctagagggaatgcaatacattcagtttcttcaagaacaagtcaagtgctccttatctgcaagcaaccccttctactacagagtggaagagtacagcttaagaagtaaagggctatgtcttgttccattggagtatacatcagaagttgctcaaaccaatggtgctgatatttgggctcctgtgaagactccaacatcttctcatgcttttaatctctcgtcttctaattcgccctttcaatga

SEQ ID NO: 1424 - DNA, 348 bp, Arabidopsis thaliana
atgggaagtggcatgataaggacattggttattctagcaatagctttattcatgatcggttccgacaacgtccacgtggcaaaagcccaggtctgtggagctaacttgtcgggactgatgaacgaatgtcaacgctacgtcagcaacgccggaccaaattctcagccgccgtctcggtcttgttgtgctctaatccgtcccattgacgtaccttgtgcttgccgctacgtttcaagggatgttacgaactatattgatatggacaaagtggtttacgttgctcgttcttgcggcaagaagattccctccggttataaatgtggaagttacaccattccggcggcttaa

SEQ ID NO: 1425 - DNA, 543 bp, Arabidopsis thaliana
atggcttcttctctcatcttcctcctcctcgttaccctaaccttttcagcatcaaccctaatctcagccaaatccaacacaacaacaataatcgaatcaacttgcaaaaccacaaactactacaaattctgcgtctcagctctcaaatccgacccaagaagtcccacagccgacacaaaaggtctcgcctccattatggtcggcgttggtatgacaaacgccacctccaccgcaaattacatcgctggaaacctatccgccaccgtaaaagacaccgttctcaaaaaggtcttacaagattgctccgagaagtatgctctcgccgctgattctctccggctgacgattcaagatcttgatgatgaagcttatgactatgcctccatgcatgtgttggcggcgcaggattatcctaatgtttgccggaatatttttaggcgggttaaagggttggcttatccggtggagattcgccggcgtgaagctagtctgagacgtatttgtggtgttgtctccgggattcttgatcgccttgttgaatga

SEQ ID NO: 1426 - DNA, 825 bp, Arabidopsis thaliana
atggattcgcttagtactcagaaggctaaaccaagaaagatgaaggttgttgtgaagaagtctcgggctcaagtactcttagatttgttttaccgggtgatcgagataactctagttataattactctagccaagctctgttaccaactagtcatcacggtagagagctctggtctcgcaagttttctcatcaaccgtcaccttgctttcgtcttggggaatacgatagtcatcaccatagtcgtcaagtgtgggttctttgcgaatcaagaaactgatgcacggagaaacagaaacgatttttacgacgagtttgttcgggagagctcaagaggagaacggaggttacacaccgatgtgatatgcagagaaaaacagagtgaagtcgagagcgttgcaaaacaaagcattgaagaaaacagagcaaaacagagcattgaagataagagacaaagcagagcaaaaccgagcatgtcagagaacagggcaaaacagagcactgaagaaaagagagagaaacttaaaaagtctgagatcagtggcagacagagcagtggcgatgagagtgagaagaaggacataactgtgaagaaacaaagacaaatcgttgctcaaaatcaagatagcccaatgaagagttacgaaaggagccggtcagagaatcacgagggctcgaagaagagttcttgtgtacaactgaagagatcagagacagagagacctgctgatagaattgtttctgatgatgagctacgatacaaaatcgagtctttcattgctagacagaggaggaaccaaaaggatgaagagttctgtattatctaa

SEQ ID NO: 1427 - DNA, 591 bp, Arabidopsis thaliana
atgacaaaagttcacccaaaattcccaagcacatgcgaagagagcttgtgtgatagcaaagcagcagttgttttaacggtgtggaagaagtcccttctcttcaactgcgacggattcacggtttacaacgccaatggagagcttgtctttagagttgacaactacatgaattgtcctagagacaacatcgtccttatggatgcttccggctttcccctcctctccattcgccgcaagaagttgagtcttggagattgctggatggtatacgatggagaaacagagagagatccaatattcacggcgagaaagaacgttagcataatatctaaccggaaaagcttggcgtgggttagcgcaaagaagacggtgttgtacgagatagaaggatcttacggtcaaagaagctgcaaaatattggatgagaggaggaacaagaagaaaacggcggagatcaagaggaaagaaacggtgatcggaggagttgcctttggcaaagatgtctataagcttatcgttgaatcggagatggaacctcgtgtggccatggcacttaccatcatcctcgaccaaatgtttcgatcttcttga

SEQ ID NO: 1428 - DNA, 399 bp, Arabidopsis thaliana
atggcgaatctaatttcgtttcacgatgtggctaaacataagtgcaagaacgattgttggattctcatccatggaaaggtctatgacatcagcactttcatggacgaacatcccggaggtgacaatgttctcctcgccgtcaccgggaaagacgcgtcgatcgatttcgaagatgtgaaccatagcaaagatgccaaggagctaatgaagaaatactgtatcggtgacgttgaccagtcaacggttccggtgacgcaacagtatattccgccgtgggagaaggaatctacggcggcggaaacaactaaagaagaatctggaaagaagctgcttatctacttaattcctctcttgatactcggcgttgctttcgctctcagattctacaacaacaagtag

SEQ ID NO: 1429 - DNA, 1023 bp, Arabidopsis thaliana
atgggtagcaagatgttgtttagtttgacaagtcctcgacttttctccgccgtttctcgcaaaccttcctcttctttctctccttctcctccgtcgccgtcttcgaggactcaatggactcagctcagccctggaaaatcgatttctttgagaagaagagtcttcttgttgcctgctaaagccacaacagagcaatcagtaggaggagacaacgtcgatagcaatgttttgccctattgtagcatcaacaaggctgagaagaaaacaattggtgaaatggaacaagagtttctccaagcgttgcaatctttctattatgatggcaaagcgatcatgtctaatgaagagtttgataaccttaaagaagagttaatgtgggaaggaagcagtgttgtgatgctaagttccgatgaacaaagattcttggaagcttccatggcttatgtttctggaaatccaatcttgaatgatgaagaatatgataagctcaaactcaaactaaaggtttccattcactttttatgcttcagtgaaaatagacatacccttataagattgattgatggtagcgacattgtgagcgagggtccaagatgcagtctccgtagtaaaaaggtgtatagtgatctcgctgtagattatttcaaaatgttattgttgaatgttccagcaaccgttgttgctctcggactctttttcttcctggacgacattacaggttttgagatcacatacatcatggagcttccagaaccatacagtttcatattcacttggttcgctgctgtgcctgtgattgtatatctggctttatcaatcaccaaattgatcatcaaggacttcttgatcttgaagggtccttgtccgaattgtggaacggaaaacacctccttctttggaacaattctgtcaatctccagcggcggcaaaaccaacactgtcaaatgcaccaactgcggaaccgcgatggtgtatgactcgggttctaggttgatcacattgccagaaggaagccaagcttaa

SEQ ID NO: 1430 - DNA, 336 bp, Arabidopsis thaliana
atggagctatcgcagtgtgtaaatgcaagtttgtgtcttccaaagaaaccaaaattggtagttggattgaaagcagccactgcttacatatttgtggataatgcagcctatagaaatttcttatacgatacttttggagtctcctcctctgatatggagagttctgcagtagccatgacatgcgcatcaaatgggtatccgataattgtgataaggggtttatcagatttagctggagaaggaggagataacactgttcataagtttggatctttggctgccactaacactgccaaagctgttttagagttcattaggaagctcccaccgtactaa

SEQ ID NO: 1431 - DNA, 990 bp, Arabidopsis thaliana
atggatcacaatcattttctttttcctctcctcttcatcatcatcatctcttccttgcacgttttgcgtgcttcgaccacaccttcacactcacacaaactaaaatccgccactaccattagaaaaatcaaccgtagaggaccttacattggccttgtgacggtctttgagaccgaagaagatgcttttctcggcagtgttgatttcagactcgatcctacgcatcctttcctcgatctctctgggaagattcatggaaagaaggttgtgtatgtcagatgtgggataggaatggtgaacgcagcagcagcaacacaacaaatgatagatgtgttcagtgtgaaagggattgtgcattttgggattgctggaaatataaacaactcgatgtccataggagatgtgagcatccctaagcaaatcacgaatgctggcttgtgggattggctgaatccaggcaaagcaaaaggaaatgaggatgtagcgtacttagatgtcgggaactataatgttccacaaggaaacaataagttaggaactattggatacagttacgaggaattatattcagtcagtggtcacatcaattcaccaaagaaagtgttttggattaatacaactcaagagtggcttcatcttgcagctgatcttgagaagatggagctattgcagtgtgtgaatgcaagtctgtgtcttccaaataaacccaaagtagtagttggattaaaagcagccactgctgacatatttgtggataatgcagcctatagaaatttcttatacgatacttttggagtttcctcctcagacatggagagttctgctgtggccatgacttgcgtgtcaaatgggtatcccctaattgtgataagaggattatcagatttagcaggagtaggagataacactgttcgaaagtttggatctttggctgccactaacactgccaaagctgttttagagttcattaaaaagctcccaccgtcataa

SEQ ID NO: 1432 - DNA, 5204 bp, Arabidopsis thaliana
agtcctcaaatatgtcgagggatttttggatgcctgaccaaagctgtcctgtgtgttatgagtgtgatgctcagttcactgtgtttaatcgaagacatcattgccgcctttgtggtcgagttttttgtgccaaatgcgctgcaaattccattccatctccatcagatgaaacaaaggatagtcatgaggaaccagaaaggattagggtgtgtaattactgctacaaacagtgggaacaggggatagttccccctgataatggggcttctattattagccttcattttagttcatcgccttctgctagaagcgtcgcaagtactacctctaatagtagcaactgcaccattgattcaactgctggaccttcccctagacccaaaatgaatccccgagctagccgtcgtgtctcgtcaaacatggattctgaaaagtctgagcagcagaatgcaaaatcgcgtaggagctcagatcattatgggcatgtgttagattcttctgataatcaagttgaattctttgtcaacagtagtggcaggagtgatggtgaagctgatgacgatgacgattatcaatctgattttgcacaatcttacgctcaaggaaatgactactatggtgccatcaacctcgatgaagtagaccatatctatgggtcacatgaagctcatgacgttggtgtaaaaatagaaccaaacataagtggctttccccctgatcaagatcttgactcactgaatacagagacgatagataaaaccagacaccaagaaaatggatggaccgatgtaaaggagggaagccctccttgtgaagagtcctttgagcccgaagttgttgattttgagagtgatgggctcttatggctaccaccagagccagagaacgaagaagatgaaagagaagcagtgctatctgatgatgacggtgatgaaggtgatagaggtgattgggggtaccttcgcccatcaaatagctttaacgagaaggatttccactctaaggacaagtccagtggtgctatgaaaaatgttgttgaagggcactttagggctttggtagcacaacttttggaggttgataatctacctatggtcaacgaaggtgatgaagagggctggcttgatataattacatcattatcttgggaggctgcaacgcttctcaagccagatacaagtaaaagtggaggaatggatccaggaggatacgtgaaggttaaatgcatcccttgtggacgtcgcagtgagagtatggtcgtgaaaggagttgtttgtaagaaaaatgtggctcatcggcgaatgacttcaaagatcgagaagccgcgtctgctaatccttggaggagctctggagtatcagcgcatctctaaccagctgtctagttttgacactttgttgcaacaggaaatggaccatttgaagatggctgttgccaaaattgattctcacaatcctgacattctcttggtggagaaatctgtctcgcggtttgcgcaggaatatcttctcgcgaaggacatatctctcgtgttaaatattaaaaggtcccttctagagcgcatatcccgctgtactggtgcgcagattgtcccttcgatcgaccagctcacatcaccaaagctaggttattgtgacctgttccatgtggaaaagtttgtggagacacatgttagtccttgtcaagttgcgaagaaaatggccaagactttaatgttttttgatggctgcccgaaacctttgggttgtacaatattgctcaagggggcacatgaagatgagctaaagaaggtgaaacatgtgattcagtatggagtttttgcagcatatcacttggctcttgagacatccttcctagcagatgaaggtgcttccattcacgaacttcctctgcagaccccaattactgtggcgttacctgataaaccatcaatggttaacagatcaatatccacaatacctggttttactgtgtcaagtgctgaaaagtctccaactactgagttaaggggtgagccacataaagccaatggcgaccttactggtaatttcacttctagtaagactcatttccaagggaaattggatggaaacgacaggattgacccatctgaaagactgcttcacaacttggatactgtttactgtaagcctccagaaactattacctctaaggacgatgggttagttcctactctagaatccaggcagctatcatttcacgtggaagaaccttctgttcaaaaagatcagtggtctgttttatccggtgccacagaacaagtaacagatggtggttacacgaatgactccgcagtaataggaaatcaaaattttaatagacaggaacaaatggaatcttcaaaaggagactttcatccgtcagcttctgaccatcaaagtatattggtttccttatcaacaagatgcgtatggaaaggatctgtgtgtgagcgggctcatctactccgtatcaaatactatgggagctttgacaagcctttaggacggtttttaagggataatctctttgatcaggatcagtgctgcccgtcatgtacgatgccagcggaagcacacattcattgttatactcataggcaaggtagtctgacaatatctgttaagaaactgcctgaattgctacctgggcaacgtgaagggaagatttggatgtggcatcggtgcctgaaatgtcctcggatcaatggctttcctccagccacacgcagaattgtaatgtcagatgctgcgtggggcctgtcttttggcaaatttttggagctgagcttttctaaccatgcagcggctagtcgtgtggccaactgtggtcattcccttcacagagactgtctccggttctacggttttgggagaatggttgcttgcttccgctatgcttcaatcaatatttacgcagtgactctgccaccagcaaagctttattttaactatgagaaccaggaatggctccaaaaggaatcaaaagaggtgattaaaaaagcggaagtcctttttaatgaggttcaggaggctcttagtcaaatttcagcgaaaactatgggcgcaggttccaagggcagcactcccaacaagatcaagctttctcttgaagaacttgcaggacttcttgagcaacgtaaaaaggaatataaggattcattgcagcaaatgttaaatgtggttaaggatggacaacctactattgatatccttctgataaataaacttcgaaggctgataattttcgattcatatgcttgggatgaatgcctagcaggggcggccaatatggtaagaaataactatttggaagctccgaagaattcagccccaaaagttatgggtcgtaacgtctccttagagaagctcagtgatgaaaaagtaaagtcgataccgacccatgttgcaatttgtaatgactctcttctccaggatgcagactacgaaacgtgtcttaaccaaggtaaatcatttgctgatactagtggcaaatttgctattcctgaagatgtaggctcagacagacccccagattgtaggatggagttcgaccctagtgaaggtggtaaagataattttgtagagtcttcgcaggtggttaaaccagcacacaccgagagccagtttcaagcaacagacttatctgatactcttgatgcagcatggataggtgaacaaactacttcagagaatggtattttccgtccgcctagcagagctgcttcaacaaatggaactcagatccctgatttaaggctgttgggttcagaaagtgagctgaactttaaaggaggccctaccaatgatgaacatacaacacaagttcagttgccttctcctagtttctactattcactcaacaagaattattcgcttaattctcgcaagcatatcatggctgaagaccggcctgtttatgtttcttcatatagagagcttgaatggcgaagtggtgcaaggctgctgcttcctctgggatgtaatgacttagtactgccagtttatgatgacgaacctactagtatcatagcttatgcccttacatcatcagaatataaagctcagatgtctggatcagataagtcaagagatcgcttggatagtggaggttccttttcactttttgattctgttaatcttctctcattgaactctttgagtgatttgtcggtcgacatgagtagaagtcttagctctgctgatgaacaagtctcgcagctgctacattcatcactgtatttgaaagatctgcatgcgaggatttcgtttacagatgaaggtcctcctgggaaagtgaagtactctgtgacgtgttattatgctaaggagtttgaagccctgaggatgatttgctgtccttcagaaacagatttcattagatctcttggtcgttgtagaaaatggggagcccagggtggaaagagcaacgtcttctttgcaaaaagtttggatgaccgttttatcatcaagcaagttacaaagacagagcttgagtccttcatcaaatttgggccagcttacttcaaatacctgactgagtccatcagtactaaaagccctacaagccttgcaaagatcttgggaatctatcaggtttcatccaaacaccttaaaggaggaaaagagttcaaaatggacgtcttggtgatggagaatcttctgttcaagcgaaacttcactaggctttatgacctaaaaggctccactcgggctcgttacaatcccgatacaagtggtagcaatacagttttgctggatcagaatcttgtcgaagcaatgccaacatctccaatatttgttgggagcaaggcaaaacggcttcttgaaagagcagtctggaatgatacatcatttcttgcttcgattcacgtaatggattactccttactagtcggggtagatgaggaaagaaacgagctggttctaggaattatcgatttcatgaggcaatacacttgggacaaacatctggagacttgggtcaagacttcagggctccttggaggacccaagaactcaactcccacagtgatatcgccgcagcaatacaagaaaagattcaggaaagcgatgacggcttattttctgatggttcctgaccagtggtcgcctgccgcggttgtgccaagcaacagttcttcagcagaggtgaaggaggaagaagagaaagacaatcctcaagctgttggtaacaagtcctga

SEQ ID NO: 1433 - DNA, 657 bp, Arabidopsis thaliana
atggctgccaccaacacaatcctcgcattctcatctccttctcgtcttctcattcctccttcctccaatccttcaactctccgttcctctttccgcggcgtctctctcaacaacaacaatctccaccgtctccaatctgtttccttcgccgttaaagctccgtcgaaagcgttgacagttgtttccgcggcgaagaaggctgttgcagtgcttaaaggtacttctgatgtcgaaggagttgttactttgacccaagatgactcaggtcctacaactgtgaatgttcgtatcactggtctcactccagggcctcatggatttcatctccatgagtttggtgatacaactaatggatgtatctcaacaggaccacatttcaaccctaacaacatgacacacggagctccagaagatgagtgccgtcatgcgggtgacctgggaaacataaatgccaatgccgatggcgtggcagaaacaacaatagtggacaatcagattcctctgactggtcctaattctgttgttggaagagcctttgtggttcacgagcttaaggatgacctcggaaagggtggccatgagcttagtctgaccactggaaacgcaggcgggagattggcatgtggtatgtttaaactttctatcactatgacttag

SEQ ID NO: 1434 - DNA, 1305 bp, Arabidopsis thaliana
atggaggaagtatctccggcgatcgcaggtcctttcaggccattctccgaaacccagatggatttcaccgggatcagattgggtaaaggttactgcaataaccaatactcaaatcaagattccgagaacggagatctaatggtttcgttaccggagacttcatcatgctctgtttctgggtcacatggttctgaatctaggaaagttttgatttctcggatcaattctcctaatttaaacatgaaggaatcagcagctgctgatatagtcgtcgttgatatctccgccggagatgagatcaacggctcagatattactagcgagaagaagatgatcagcagaacagagagtaggagtttgtttgaattcaagagtgtgcctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgagtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaagcctcggaggaaactcaagagcaaacccttgaactga

SEQ ID NO: 1435 - DNA, 1236 bp, Arabidopsis thaliana
atgaatgctttagctgcaacaaacagaaacttccgtcatgcatctcgaatcctgggtttggattcgaagatcgagagaagtcttatgatcccatttagagaaatcaaggttgagtgtacgattcctaaagacgatggcactctggtttcatacatcggatttagggttcaacatgacaatgctcgtggacccatgaaaggtggaatcagatatcatcctgaggttgatccagatgaagttaacgcactagctcagctgatgacttggaagactgctgtagcagatattccatatggtggtgctaaaggtggaattggatgtagtcctcgtgacttgagtttgagcgagcttgagaggttgactcgtgtgtttacacagaagattcatgatcttatcggtattcataccgatgtgcctgctcctgatatgggcactaacgctcaaaccatggcttggattcttgatgagtactccaagtttcatggtcattcccctgctgttgtcactggaaagcccattgatcttggtggttcattaggtagggaagctgccacaggtcgtggtgtagtatttgccaccgaagctcttcttgctgagtacgggaaatcgattcagggtttgacatttgttattcaaggttttgggaatgttggaacatgggctgcgaagctgatccacgagaaaggcggtaaagtggttgcagtaagcgacattactggtgcaatcaggaaccctgaaggtatcgacatcaacgctctcataaaacacaaggacgcaactggaagtctcaatgatttcaatggtggagacgctatgaattcagatgaattgctcattcatgagtgtgatgttctcattccatgcgctcttggtggtgtcctgaacaaggaaaatgctggagatgtgaaggcaaagtttatagtagaggcagctaaccatccaacagatccagatgctgatgagattctgtcgaagaaaggagtgattatacttccagatatctacgcaaacgcaggaggagtgacagtgagttacttcgagtgggtgcagaacattcaaggattcatgtgggaagaggaaaaagtgaacttggagctgcaaaaatacatgactcgagcctttcacaacatcaagacaatgtgccatactcattcttgcaacctccgtatgggagctttcactcttggagttaaccgagtcgctcgagccacccagttgcgtggttgggaagcttaa

SEQ ID NO: 1436 - DNA, 5598 bp, Arabidopsis thaliana
attcctctctggcaaatccctgagataagacggttctatggaatagaacatggtggaggttatgattcttggcgaaaaacatctgttgtagccttcccttttgattttgataaagctcaatctataaggccaaaaggtcattgtgtggctgtacgtgtgacaagtgaggatcctgatgacgggttcaaaccaaccagcggtagagttcaggagttgagttttaagagcaagccaaatgtgtgggcgtacttctctgtcaagtctggtggaggcatccacgagttctcggattcccagtttggacatgtttttgcatttggggaatccagagccctggcgatagcgaatatggttcttgggctaaaagaaattcagatccgtggagaaattaggactaacgttgactacacgatcgaccttttacatgcttctgattaccgtgataacaaaattcacactggttggttggatagtaggattgctatgcgggtcagagctgagaggcctccatggtatctctctgttgtcggcggagctctctataaagcatcagcgaccagtgctgctgtggtttcagattacgttggttatctggagaaggggcaaatccctccaaagcatatatctcttgtacattctcaagtgtctctgaatattgaaggaagtaaatatacgattgatgtagtccggggtggatcaggaacctacaggctaagaatgaacaagtcagaagtggtagcagaaatacacactctacgtgatggaggtctgttgatgcagttggatggcaaaagccatgtgatatatgcagaggaagaagctgcaggaactcgtcttctcattgatggaagaacttgtttgctacagaatgaccacgatccatcaaagttaatggctgagacaccgtgcaagttgatgaggtatttgatttccgacaacagcaatattgacgctgatacgccttatgccgaagttgaggtcatgaagatgtgcatgccacttctttcacctgcttcaggagttatccattttaaaatgtctgaaggacaagccatgcaggctggtgaacttatagccaatcttgatcttgatgatccttctgctgtaagaaaggccgaacccttccatggaagtttcccaagattagggcttccaactgcaatatccggtagagttcatcagagatgtgccgcaacattaaatgctgcacgcatgattcttgctggctatgagcataaagtagatgaggttgttcaagacttacttaattgccttgatagccctgaactcccatttcttcagtggcaagagtgctttgcagttctggcgacacgactacctaaaaatctcaggaacatgctagaatcaaagtatagggaatttgagagtatttccagaaactctttgaccaccgatttccctgccaaacttttaaaaggcattcttgaggcacatttatcttcttgtgatgagaaagagagaggtgcccttgaaaggctcattgaaccattgatgagccttgcaaaatcttatgaaggtggtagagaaagtcatgcccgtgttattgttcattctctctttgaagaatatctatcagtagaagaattattcaatgataacatgctggctgatgttatagaacgcatgcgtcagctatacaagaaagatctgttgaaaattgtggatatagtgctctcacaccagggcataaaaaacaaaaacaaactcgttctccggctcatggagcagcttgtttaccctaatcctgctgcttacagagataaacttattcgattctcaacacttaaccatactaactactctgagttggcgctcaaggcgagtcaattacttgaacagaccaaactaagtgagcttcgttcaaacattgctagaagcctttcagagttagaaatgtttacagaggacggagaaaatatggatactcccaagaggaaaagtgccattaatgaaagaatagaagatcttgtaagcgcatctttagctgttgaagacgctctcgtgggactatttgaccatagcgatcacacacttcaaagacgggttgttgagacttatattcgcagattataccagccctacgtcgttaaagatagcgtgaggatgcagtggcaccgttctggtcttcttgcttcctgggagttcctagaggagcatatggaaagaaaaaacattggcttagacgatcccgacacatctgaaaaaggattggttgagaagcgtagtaagagaaaatggggggctatgtttcttccaagtataataagtgcagcattgagagaaacaaagcacaacgactatgaaactgccggagctcctttatctggcaatatgatgcacattgctattgtgggcatcaacaaccagatgagtctgcttcaggacagtggggatgaagaccaagctcaggaaagagtaaacaagttggccaaaattcttaaagaggaagaagtgagttcaagcctctgttctgccggtgttggtgtaatcagctgtataattcagcgagatgaaggacgaacacccatgagacattctttccattggtcgttggagaaacagtattatgtagaagagccgttgctgcgtcatcttgaacctcctctgtccatttaccttgagttggataagctgaaaggatactcaaatatacaatatacgccttctcgagatcgtcaatggcatctgtatactgttacagacaagccagtgccaatcaagaggatgttcctgagatctcttgttcgacaggctacaatgaacgatggatttatattgcagcaagggcaggataagcagcttagccaaacactgatctccatggcgtttacgtcgaaatgtgttctgaggtctttgatggatgccatggaggaactggaactgaatgcccataatgctgcaatgaaaccagatcacgcacatatgtttctttgcatattgcgtgagcagcagatagatgatcttgtgcctttccccaggagagttgaagtgaatgcggaggatgaagaaactacagttgaaatgatcttagaagaagcagcacgagagatacatagatctgttggagtgagaatgcataggttgggcgtgtgcgagtgggaagtgcggctgtggttggtgtcctctggactggcatgtggtgcttggagggttgtggttgcaaacgtgacaggccgtacatgcactgtccacatataccgagaagttgaaactcctggaagaaacagtttaatctaccactcaataaccaagaagggacctttgcatgaaacaccaatcagtgatcaatataagcccctgggatatctcgacaggcaacgtttagcagcaaggaggagtaacactacttattgctatgacttcccgttggcatttgggacagccttggaactgttgtgggcatcacaacacccaggagttaagaaaccatataaggatactctgatcaatgttaaagagcttgtattctcaaaaccagaaggttcttcgggtacatctctagatctggttgaaagaccacccggtctcaacgactttggaatggttgcctggtgcctagatatgtcgaccccagagtttcctatggggcggaaacttctcgtgattgcgaatgatgtcaccttcaaagctggttcttttggtcctagagaggacgcgtttttccttgctgttactgaactcgcttgtgccaagaagcttcccttgatttacttggcagcaaattctggtgcccgacttggggttgctgaagaagtcaaagcctgcttcaaagttggatggtcggatgaaatttcccctgagaatggttttcagtatatatacctaagccctgaagaccacgaaaggattggatcatctgtcattgcccatgaagtaaagctctctagtggggaaactaggtgggtgattgatacgatcgttggcaaagaagatggtattggtgtagagaacttaacaggaagtggggccatagcgggtgcttactcaaaggcatacaatgaaacttttactttaacctttgttagtggaagaacggttggaattggtgcttatcttgcccgcctaggtatgcggtgcatacagagacttgatcagccgatcatcttgactggcttctctacactcaacaagttacttgggcgtgaggtctatagctctcacatgcaactgggtggcccgaaaatcatgggcacaaatggtgttgttcatcttacagtctcagatgatcttgaaggcgtatcagcaattctcaactggctcagctacattcctgcttacgtgggtggtcctcttcctgttcttgcccctttagatccaccggagagaattgtggagtatgtcccagagaactcttgcgacccacgagcggctatagctggggtcaaagacaataccggtaaatggcttggaggtatctttgataaaaatagtttcattgagactcttgaaggctgggcaaggacggtagtgactggtagagccaagctcgggggaatacccgttggagttgttgcagttgagacacagactgtcatgcagatcatcccagccgatcctggacagcttgactctcatgaaagagtggttccgcaagcagggcaagtctggtttcctgattcagcggccaagactgctcaagcgcttatggatttcaaccgggaagagcttccattgtttatcctagcgaactggagagggttttcaggtgggcagagagatcttttcgaaggaatacttcaggcaggttcaactatagtagaaaatctgagaacctatcgtcagccagtgtttgtgtacatcccaatgatgggagagctgcgcggtggagcgtgggttgttgttgacagccagataaattcggattatgttgaaatgtatgctgatgaaacagctcgtggaaatgtgcttgagccagaagggacaatagagataaaatttagaacaaaagagctattagagtgcatgggaaggttggaccagaagctaatcagtctgaaagcaaaactgcaagatgccaagcaaagcgaggcctatgcaaacatcgagcttctccagcaacagattaaagcccgagagaaacagcttttaccagtttatatccaaatcgccaccaaatttgcagaacttcatgacacttccatgagaatggctgcaaagggagtgatcaaaagtgttgtggaatggagcggctcgcggtccttcttctacaaaaagctcaataggagaatcgctgagagctctcttgtgaaaaacgtaagagaagcatctggagacaacttagcatataaatcttcaatgcgtctgattcaggattggttctgcaactctgatattgcaaaggggaaagaagaagcttggacagacgaccaagtgttctttacatggaaggacaatgttagtaactacgagttgaagctgagcgagttgagagcgcagaaactactgaaccaacttgcagagattgggaattcctcagatttgcaagctctgccacaaggacttgctaatcttctaaacaaggtggagccgtcgaaaagagaagagctggtggctgctattcgaaaggtcttgggttga

SEQ ID NO: 1437 - DNA, 2133 bp, Arabidopsis thaliana
atggatcaaacagaggaaccaccactcaacacacaccagcagcacccagaagaagttgaacatcatgagaatggtgcgactaagatgtttaggaaagtaaaggctagagctaagaagttcaagaacagtctcactaaacatggacaaagcaatgagcatgagcaagatcatgatttggttgaagaagatgatgatgatgacgagctagaacctgaagtgatcgatgcaccaggcgtaacaggtaaacctagagaaactaatgttccagcatcggaggaaattattccaccagggacaaaggtgtttcctgtcgtgtcttccgattacaccaaacccactgaatctgtaccagtacaagaggcctcttacggacacgatgcaccggctcattctgtaaggacgacgtttacatcggacaaggaagagaaaagagatgtaccgattcatcatcctctgtccgaattgtcagacagagaagagagtagagagactcatcatgagtcattgaacactccggtctctctgctttctggaacagaggatgtaacgagtacgtttgctccaagtggtgatgatgaatatcttgatggtcaacggaaggtcaacgtcgagaccccgataacgttggaggaagagtcggctgtttcagactatcttagtggtgtatctaattatcagtccaaagttactgatcccaccaaagaagaaactggaggagtaccggagattgctgagtcttttggtaatatggaagtgactgatgagtctcctgatcagaagccaggacaatttgaaagagacttgtcgacgagaagcaaagaattcaaagagtttgatcaggactttgactctgttctcggtaaggattcgccggcgaaatttccaggtgaatcaggagttgttttcccggtgggctttggtgacgagtcaggagctgagctggaaaaagattttccgacgagaagtcatgattttgatatgaagactgaaactggaatggacacgaattctccatcaagaagccatgaatttgatctgaagactgaatctggaaacgacaagaattctccgatgggctttggtagtgaatcaggagctgagctggaaaaagaatttgatcagaagaacgattctggaagaaacgagtattcgccggaatctgacggcggtttaggagctccgttgggaggaaattttccggtgagaagtcatgagttggatctgaagaacgaatctgatatcgacaaggatgtgccgacgggatttgacggagaaccagattttctggcgaagggaagacctggatacggtgaggcatcagaagaggataaatttccggcgagaagtgatgatgtggaagtagagactgagctgggaagagacccaaagacggagactcttgatcaattctcaccggaactttctcatcctaaagaaagagatgagtttaaggagtccagagatgattttgaggagacgagagatgagaaaacagaggagccaaaacagagcacttacacagagaagtttgcttcaatgctaggttactccggagaaattccggtgggagatcaaactcaagtggcgggaactgttgatgagaagttgactccggtcaatgagaaggatcaagaaacagagtctgccgtgacgacgaagttacctatctccggaggtggaagtggagtagaggagcaacgaggggaagataaaagtgtgtcgggtagagattatgtggcggagaaactgacaactgaagaagaagacaaagccttttctgatatggttgccgagaaacttcagattggaggagaagaagagaagaaggaaacgacgacaaaggaagtggagaagatctctaccgagaaggcagcatcggaggagggtgaggcggtggaagaggaagtgaaaggaggaggaggaatggttgggaggattaaaggatggttcggtggtggtgcgactgatgaggtgaagccagaatcgccacattctgttgaagaggctccaaaatcatctggctggtttggtggtggtgcgacggaggaggtgaagccaaaatcgcctcattccgttgaagagtctccacaatcacttggctccactgttgttccggtgcagaaggagctttaa

SEQ ID NO: 1438 - DNA, 1533 bp, Arabidopsis thaliana
atgttcatcgagagcttcaaagtagagagtccaaatgtcaaatacacagagaatgagatcaattcggtgtacgattacgaaacaacagaggtcgtccacgagaatcgtaacggtacatatcaatgggtcgtgaagccaaagactgtcaaatacgatttcaaaacagacactcgtgtccccaaattaggggttatgcttgttggttggggaggaaacaatggatcaacactaaccgctggtgtcattgctaacaaagaaggaatatcgtgggcgactaaagacaaagtgcaacaagctaattactttggttcacttactcaagcttcatcgattcgtgttggctcttacaatggtgaagagatctatgctcctttcaagagtcttcttccaatggtgaatccagaggatgttgtgtttggtggttgggatataagtgacatgaatttagcagacgctatggctagagctagagttcttgatattgatctgcagaaacaacttagaccttacatggagaacatgatcccacttcctggtatctatgaccctgatttcatcgctgctaatcaaggttcacgtgctaatagcgtgatcaaaggtaccaagaaggaacaagttgatcacatcatcaaggacatgagggagtttaaggagaagaacaaagtggataagttggttgtgttatggactgcaaacacagagcgttatagcaatgtgattgtaggacttaacgatacgacggagaatctattggcttctgttgaaaaggacgagtctgagatctcgccgtctacgttgtatgcgattgcttgtgttcttgaaggcattcctttcatcaatgggagtcctcagaatacttttgtccccggtcttatcgaattggctatatcgaagaattgtttgattggtggggatgatttcaagagtggtcagactaagatgaaatccgttttggttgatttccttgttggagctggcattaagcctacttcgattgtgagctataatcatttgggaaacaacgacgggatgaacctctcagcgccacagactttccgctctaaggagatttcaaagagcaatgttgtagacgacatggtagctagtaatggcatcctctttgagcctggtgaacaccctgaccatgtcgttgtcatcaagtatgtgccatatgttgcggatagtaaaagagcaatggatgagtacacgtctgagatattcatgggagggaggaacactatagtgttgcataacacttgtgaggactctctcttggctgcaccaattatcttggatcttgtccttctcgctgaactcagcaccagaatccaatttaaagctgaaggagaggggaagtttcactctttccacccggtagctaccatactcagttacctcacaaaggcacctcttgtaccgcccggaacaccggtggttaacgctctgtcgaagcagcgggcaatgctggaaaacattcttagggcatgtgttgggcttgcgccagagaacaacatgatcatggagtacaagtga

SEQ ID NO: 1439 - DNA, 1575 bp, Arabidopsis thaliana
atggccgaacaacaactaggagtgctaaaggcactcgatgttgcgaagacgcaactttatcatttcacggcgattgtcatcgccggtatgggtttctttaccgatgcctacgatcttttttgcgtgtccttggtgacgaaactccttggccgcatctactatttcaatccggagtcagcgaagcctggctcacttccccctcatgttgcggccgcggtcaacggtgtggccctttgtggaaccctttctggtcaactcttcttcggttggctcggtgacaaactcggacggaaaaaagtgtacggtctcactttggtaatgatgatcttgtgctctgtcgcttctggtctctcttttggccacgaagccaagggtgtcatgaccaccctttgcttcttcaggttttggttgggatttggtattggaggtgactacccactttctgccaccatcatgtctgaatacgcaaacaagaagacccgtggggctttcatcgcagctgtcttcgccatgcaaggtgtcggtatcttggctggaggtttcgtggcactcgcagtatcttctatattcgacaaaaagttcccagctccaacatatgcagtaaacagggccctctcaacgcctcctcaagttgactacatttggcgaatcatcgtcatgtttggtgctttacccgcagctttgacttactactggcgtatgaagatgcctgaaactgcccgttacaccgctttggttgccaagaacatcaaacaagccacagccgacatgtccaaggtcttacaaacagatatcgagcttgaggaaagggtggaggatgacgtcaaagaccccaaacaaaactatggcttgttctccaaggaattccttagacgccatgggcttcatctccttggaactacctccacatggtttttgcttgacattgccttctacagccaaaacttgttccagaaggatattttctcggccatcggatggatcccaaaggcagccaccatgaacgccacccatgaggttttcaggattgctagggctcagactcttatcgccctttgcagtacagtcccaggctactggttcacagttgcgtttattgataccattggaaggtttaagatccaactaaatggatttttcatgatgaccgtgtttatgtttgccattgccttcccttacaaccactggatcaaaccagaaaaccgtatcggatttgtggttatgtactctcttactttcttcttcgccaattttggtccaaatgcaaccacttttattgtccctgctgagatattcccggccaggctaaggtctacatgtcatggaatatcagccgcggctggtaaggctggagccattgttggagcctttgggttcctatatgcggctcaatcacaagacaaggccaaggtagacgcaggatacccaccaggcatcggagttaagaactcattgatcatgcttggtgttcttaactttatcggtatgctcttcaccttccttgtcccagagcccaaaggcaagtcccttgaagaactctctggtgaggctgaggttagccatgacgagaaataa

SEQ ID NO: 1440 - DNA, 1338 bp, Arabidopsis thaliana
atgggccaccaaaacgccgccgtttcagagaatcaaaaccatgatgacggcgctgcgtcgtcgccgggattcaagctcgtcggattttccaagttcgtaagaaagaatccaaagtctgataaattcaaggttaagcgcttccatcacatcgagttctggtgcggcgacgcaaccaacgtcgctcgtcgcttctcctggggtctggggatgagattctccgccaaatccgatctttccaccggaaacatggttcacgcctcttacctactcacctccggtgacctccgattccttttcactgctccttactctccgtctctctccgccggagagattaaaccgacaaccacagcttctatcccaagtttcgatcacggctcttgtcgttccttcttctcttcacatggtctcggtgttagagccgttgcgattgaagtagaagacgcagagtcagctttctccatcagtgtagctaatggcgctattccttcgtcgcctcctatcgtcctcaatgaagcagttacgatcgctgaggttaaactatacggcgatgttgttctccgatatgttagttacaaagcagaagataccgaaaaatccgaattcttgccagggttcgagcgtgtagaggatgcgtcgtcgttcccattggattatggtatccggcggcttgaccacgccgtgggaaacgttcctgagcttggtccggctttaacttatgtagcggggttcactggttttcaccaattcgcagagttcacagcagacgacgttggaaccgccgagagcggtttaaattcagcggtcctggctagcaatgatgaaatggttcttctaccgattaacgagccagtgcacggaacaaagaggaagagtcagattcagacgtatttggaacataacgaaggcgcagggctacaacatctggctctgatgagtgaagacatattcaggaccctgagagagatgaggaagaggagcagtattggaggattcgacttcatgccttctcctccgcctacttactaccagaatctcaagaaacgggtcggcgacgtgctcagcgatgatcagatcaaggagtgtgaggaattagggattcttgtagacagagatgatcaagggacgttgcttcaaatcttcacaaaaccactaggtgacaggccgacgatatttatagagataatccagagagtaggatgcatgatgaaagatgaggaagggaaggcttaccagagtggaggatgtggtggttttggcaaaggcaatttctctgagctcttcaagtccattgaagaatacgaaaagactcttgaagccaaacagttagtgggatga

SEQ ID NO: 1441 - DNA, 504 bp, Arabidopsis thaliana
atggcagaagacaagatcttaaagaagactccggcggcgaagaagccgcgaaaaccgaaaaccaccactcatcctccatactttcagatgataaaagaggctttgatggtcctgaaagagaagaacggatcaagcccttatgctatagctaagaagatagaggagaaacacaagtctttacttccagagagtttccgtaaaacactttctctacagcttaaaaactctgttgctaaaggtaagctcgtgaagatcagagcctcttacaagctctcagataccaccaagatgataacgaggcagcaggacaagaagaataagaagaatatgaagcaagaagataaagagatcacaaagaggactaggtcttcttcgacaaggcctaagaagactgtgtctgtgaacaaacaagaaaagaagaggaaagtgaagaaggcgagacagcctaagtctatcaaatcttcagttggtaagaagaaggccatgaaagcttccgctgcttga

SEQ ID NO: 1442 - DNA, 1371 bp, Arabidopsis thaliana
atggcgtcaatcctctcaaagaagcagaagaagaacgaaaaatacaccttgaaagagctcaaatcattaggtcatgacttactcacttctcgatctcacatcaataaccttcctctccttctcaccttcgtctcaccagaatctccgccgcagttcgtcgttgaatcactcctctcactccaatcctttttcactcctctactctctcagcttcctccgacttcttcgtctccttcttcaaccaaaacagaggaccctgaagttgtgttcaaagcttggctcagatcaaaatttgacgaattcgtcaagcttttactcgatgttcttgtctctcaacaatcagaagattctctaaggggaattgtgttgggaacattaatggaatttgtaaagcttttgaatgctggaaggtttcattcttcaatctaccacagattacttgatgctattattcactctgaggttgatattgagatattcttggatatacttacttcaaagtacttcaagtacattgatgtccggtatgttgataacacttcgactgatagaactgtgatcgaaaataatgaggctgagagtgattcaaaagaaagcctagaactctctgttcgcaagatctatcaagttttatctcaaatcccacctcctgagaaacaagctgagaagtctcaacacgagatgtggagtgggtcagatgaaagtattagtgagaagccgacagataaaaagaagaaaactgagaaaggagacagcactctcctttctccggcaacaattagcaagaggatgaagttgaacgactttttaacaaaatcgtacgacattgggggtgttgtcagtgtgatggctcttagcagtctcttcatcctcatgacccaacatggtttggagtatccgttcttttatgaaaaactgtatgcgttactggttccttctgtctttgtggcaaagcaccgagcaaaatttcttcaggaaatcgttgaaaatgccgatgaagccaacacagaggctggtgaacacaatgagagccaaccaaagaccatcaaaaagcgaaagcttggtattgactatttcaacaaccaggagagtgatcccaagaaatctggagccttaagtaagtttatctcatctctagaaactaatctaaccatcagatcgaaaaccacggaaatgaaaattgaagatttttgctctggttcatatgccaccatatttggggacgagaagggtaaagcaagttcctttagcgttctacaaaacggttccaacatctctgtttgcggattcagattttcctgggtggacgttcactattccacaagaggaaggcacatgctgatttctaagagtaaccaactcatgaactaa

SEQ ID NO: 1443 - DNA, 2196 bp, Arabidopsis thaliana
atggttgagacgagacgtagctcttccgcttccaagcgtttctgtgcttcttcttcttcccctgaagcatcttcttctcaaaggcctaacaagcgatctaaggttaagatcgatgccgctgcttcttctctcgaacctgcgacggcggaaccggctggttcttcatcagcgagcgaagttccgatcgagaatcaaggacctgcttcggatcctggatcggaatctggagagccggaacttggatcttctgatccacaggctatggatgcggagaagcctgttgttacaactgatgtccctgtgatggagaactctcctgaaaccgacgctaaccctgaagtcgaagtcttggccacacctaccgtagcaggtgaagcggtggcggatgctgacaaatctaaggcggctaagaagcgagctttaaaggctccatgggcgaagctactttcccagtattctcagaatcctcaccgtgtcatcagaggccctgtgtttactgttggacgccggggatgtgatttatctatcagagaccaagctatgcccagcaccctctgtgaactgaagcagtctgagagtctcttgcagcacggtggtccatcagttgcatcccttgagatattaggaaatggagttattgttcatgtcaatggcaagtgttaccagaaaagtacttgtgttcatctacggggtggtgacgaggtgatcttcagccttaatgggaaacatgcttatgtatcctttttggagttgcgtgaaactcctgacagagcttcttcgttgagtatatgtgaagctcggggtgcccctctgaaaggggttcatgtcgagacaagggcaggagatgttgatggggcctcagatgttgatggggcctctatattggcatctctatcaaagctccgcagcttccatcttctaccaccaattgctaaagctggcaagaggcagcaaaatcctgcggttcctgtggtaccttccagtttcaatgattgcatctcggatacagacatgaacgatgctgatagtaataatgaccatgctgctgttgcttctgtggaaaaaattgctgctgcttctacccctggtactgccaatgagaacctgaatgtcgatggcagtggattggacccttttcaagaagctgatggtggaaatgtccctgctgctggttatgaaattagaccaatcgtgcaccttcttggtgaatcttcttcatttgatataaggggtagcatctccagattactggatgaacgaagggaagtgaaagaattcctcagagaatttgacctttcatcaactatatcgactagacgccaagcttttaaggatagtctgcgaggaggagtactcaatgctcaaaacatagatatttcttttgagaacttcccatattatttaagtgctacaacaaagggtgttttgatgatatcgatgtatgttcatatgaacggtggaagcaagtatgcaaattttgcaacagacttgactacagcctgtccccgtatcttactctctggaccatcaggctctgagatatatcaggaaatgttggcaaaagcgcttgctaaacagtttggggccaaattgatgattgttgattctcttttgttgcctgggggatcaccagccagggaagctgaatcctctaaagaaggttctaggcgtgaaaggctgtctatgcttgctaaaagagctgttcaggctgcacaagtattgcagcataagaaaccgacttcaagtgttgatgctgatataacaggtggctcaacattaagctctcaggctttgccaaaacaagaagtgtcaacagcaacttctaaaagttacacattcaaagcaggcatgatgtttttcttttcatctgactgtgacagagttaaatttgtaggtccttcggcttctgcaatttcttctcttcaaggccagcttaggggaccggccattggttcccagggaaaagtagcccttgcatttgaagacaactgtgcttcaaaaattgggattagattcgataggcctgtacaagatggcaatgatcttggtggcctctgcgaagaagaccatggttttttttgtgctgctagctcacttcggttagaaggttcttctagcgatgatgctgataaactcgccgttaatgaaatctttgaggatagtaacctcttgacccataccataggtcgcacttag

SEQ ID NO: 1444 - DNA, 1788 bp, Arabidopsis thaliana
atggactctgtttcttcttcttccttcctctcctccacattctctcttcatcactctcttcttcgccgccgatcttcctctcctactctcctccgtatcaactccgccgtcgtcgaagaacgttctccaatcacaaacccaagcgacaacaatgatcgtcgtaacaaacccaaaacactccacaaccgaaccaatcacaccttagtctcatcaccaccgaaactccgaccagaaatgactctcgcaacagctctcttcaccaccgtcgaagatgtaatcaacacgttcatcgatccaccttcacgtccttccgttgatccaaaacatgtcctctctgataacttcgctcctgtcctcgacgagcttcctccaacagactgtgaaatcatccacggcactcttccactgtcacttaacggcgcttacatccgtaacggtccaaatccacagtttctccctcgtggtccttaccatctcttcgacggcgacggtatgcttcacgccataaaaatccacaacggtaaagccactctctgtagcagatacgtcaagacttataaatacaacgtcgagaaacaaaccggagctccggttatgcctaacgtgttttccggattcaacggtgtaacggcgtcagtagctcgtggagctttaacggcagctagggttttaaccggacagtataatccggttaacggcattggtttagctaatacaagtctagctttcttcagtaaccgtctctttgctttaggtgaatctgatttaccctacgccgtccgattaaccgaatcaggagatattgaaacgatcggacggtacgatttcgacgggaaattagcgatgagtatgacagctcatcctaaaaccgatccaataaccggagaaactttcgctttccggtacggtccggttccaccgtttttaacatatttccggtttgattccgccgggaaaaaacaaagagacgttccgatattctcgatgacgtctccgtcgtttctccatgacttcgcgatcacgaaacgtcacgcgattttcgcagagattcagcttggcatgaggatgaacatgttggatttggttctcgaaggtggttctccggttggtactgataacggaaaaactccaaggcttggagtgattcctaagtacgccggagatgagtcggagatgaaatggttcgaagttcctggattcaatatcattcacgctattaatgcttgggatgaagatgatggaaacagcgtcgttttgattgcaccgaatattatgtcgattgaacatactttagagaggatggatctggttcatgctttggtggagaaggtgaagatcgatctcgtcaccgggattgtgagacgtcatccgatctcagcgaggaatctcgatttcgctgtgattaatccggcgtttctcgggagatgtagcaggtacgtttacgcggcgattggagatccgatgccgaagatctccggtgtggtgaagcttgatgtgtctaaaggagatcgggatgattgtacggtggcccgtagaatgtacggttcaggttgttacggcggagaaccgtttttcgtagctagggatcctggtaatccggaggcggaggaggatgatggttatgtggtgacgtatgttcacgatgaagtgactggagaatcgaagtttctggtgatggacgctaaatcgccggagcttgaaatcgtcgccgccgtgaggttgccgcgaagggttccgtacggattccatgggttatttgtcaaggaaagtgaccttaataagctttaa

SEQ ID NO: 1445 - DNA, 1179 bp, Arabidopsis thaliana
atggcgattcgtcttcctctgatctgtcttcttggttcattcatggtagtggcgattgcggctgatttaacaccggagcgttattggagcactgctttaccaaacactcccattcccaactctctccataatcttttgactttcgattttaccgacgagaaaagtaccaacgtccaagtaggtaaaggcggagtaaacgttaacacccataaaggtaaaaccggtagcggaaccgccgtgaacgttggaaagggaggtgtacgcgtggacacaggcaagggcaagcccggaggagggacacacgtgagcgttggcagcggaaaaggtcacggaggtggcgtcgcagtccacacgggtaaacccggtaaaagaaccgacgtaggagtcggtaaaggcggtgtgacggtgcacacgcgccacaagggaagaccgatttacgttggtgtgaaaccaggagcaaaccctttcgtgtataactatgcagcgaaggagactcagctccacgacgatcctaacgcggctctcttcttcttggagaaggacttggttcgcgggaaagaaatgaatgtccggtttaacgctgaggatggttacggaggcaaaactgcgttcttgccacgtggagaggctgaaacggtgccttttggatcggagaagttttcggagacgttgaaacgtttctcggtggaagctggttcggaagaagcggagatgatgaagaagaccattgaggagtgtgaagccagaaaagttagtggagaggagaagtattgtgcgacgtctttggagtcgatggtcgactttagtgtttcgaaacttggtaaatatcacgtcagggctgtttccactgaggtggctaagaagaacgcaccgatgcagaagtacaaaatcgcggcggctggggtaaagaagttgtctgacgataaatctgtggtgtgtcacaaacagaagtacccattcgcggtgttctactgccacaaggcgatgatgacgaccgtctacgcggttccgctcgagggagagaacgggatgcgagctaaagcagttgcggtatgccacaagaacacctcagcttggaacccaaaccacttggccttcaaagtcttaaaggtgaagccagggaccgttccggtctgccacttcctcccggagactcatgttgtgtggttcagctactag

SEQ ID NO: 1446 - DNA, 507 bp, Arabidopsis thaliana
atggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaa

SEQ ID NO: 1447 - DNA, 186 bp, Arabidopsis thaliana
atgtcggcgacttgcgttgcgaaccgtccgtacatacataatatgcattacacaaatatgtctaattgtgtctctatgtgtatgttattcaggagcagattaagggcttttagttttagtttcgtgcaagtaagatcatgtcatgtgatagatctccgagtttttcttttcaaggatttcgtgtaa

SEQ ID NO: 1448 - DNA, 408 bp, Arabidopsis thaliana
atggtccatgcctctcagttaaattcatactcacttgcaattttgaagctttgtttgtttatccttgattttgttttgctctgcttttttctgatgctcacggatgaggagattgattctgattctgagttagatgaatatatggaacaacaaattgctgctttgcctcaaaatgagatcaatcctgaagaagatgatgaatccgactcagatgagatgggtttggacgaggatgatgactcttcagatgaagaagatgtagaggctgaagcacctttaaaggtggctcctccgagcaaaaagatgccaaatggtgcatttgagatagctaaaggtggaaagaagaacaagtcatcaggagggaagaagagatgcccattcccttgtggtccctcttgcaaaaagtag

SEQ ID NO: 1449 - DNA, 75 bp, Arabidopsis thaliana
atgacttcccctgttttcttacattcagatgatccctattccttttttgtcttttactctctctattcacaatga

SEQ ID NO: 1450 - DNA, 237 bp, Arabidopsis thaliana
atggagtctgtgaagaccaaatcctccaccgcgaggagcgttgagctaccgcctcgccgtggaaaggtgaagcgagagatctttggtttcttagccaattccattgtttccgccgccgtgaaagctggtggatcgtttaggaggaacggcggaggtggtggtggtggctcttcttcctcaaccaccactcctccagggagtggatacacctccgaccagaacaacgaatccacttaa

SEQ ID NO: 1451 - DNA, 351 bp, Arabidopsis thaliana
atgtacatagctcatatttttagagtatcagtagcccatttacaattttttaatggaccaaccacaaaaaactgggctgagccgtatcagtctattgagacttctgatactcagtctcatattacgtggcaggctctgattggtcgtccatttatttttgtcgaaaaaaaattccttctgtttctctcaaaaaaattctctctcgtggggaattttccgattccttctaattttgccgatcaattttcttctgtttcgattccttctgaatctcttcccttttctcgaaaatccttctcagatcatcatccatggcttcctctgatttcgatggaatcctcttgggaatga

SEQ ID NO: 1452 - DNA, 699 bp, Arabidopsis thaliana
atggaccacactctttctcttcttccatttctcttcatcataatcatttcttccttccatgttttgcctgtttcacccacaccttcacacaaactaaaatccgccactaccatcagaaaactcaaccgcggaggaccttacatcggtctcgtgacggtcattgcgaccgaagaaaatgcttttctccgcagtgtcgatttcagacctgaccctactcatcccttcttggatctctctgggagacgttttcgaatagggaagattcatggaaagaaggttgtgtatgttagatgtgggagaggaatggtgaatggagcagcagcaacacaacagatgatagatgtgttcaatgtgaaagggatagtgcattttgggattgctggaaatatgaacaactcaatgtccataggagatgtgagcatccctaagcaaattacgaatgctggcttgtgggattggctgaatccagacaaagtaaagggagttgaggatatagcgtacttagatgtcggaaactataatgttccaaaaggagatggcgacaatgagttagggagtattggatataattacgagcaactatattcagtcactggtcacatcaatgcacctcagaatgtgttttggatcaacacaactcaagagtggcttcatcttgcagctgatctagaggttgttaagagctatacaacatactga

SEQ ID NO: 1453 - DNA, 1746 bp, Arabidopsis thaliana
atgattctctcacgctctgtctccgtgcttcatttgtgtggagtctcttcttcagcgccgtcgaagctcttatctcagaggttcaaggtctcgttcgctctcgcttatggttcatctgtttctttccgtttaagctctctcaatcgatctgatagaaaatgggttcgtgggtttgcgtctgctactgaagcagaagtcgagaaaaagggtaatgatactttttttgctgaccataccgtttcttggaagtctcttgggttatcagataatgtctctatagctcttcgagattctgggttcgatagaccatctcttactcaggctgtttgcataccgtctatattgtctgggaaagatgtgattgttgcagcagaaactggtagtggtaaaacacatggttatcttgctccaataattgatcaattaacaaacaccgctcttgattccgaggttacgaatagagaggaaagaccgtttccgcttaagaatatctctcttattctgtgtccaaatgtgatgctttgtgaacaagtggttcggatggttaatggtcttgttgatgaagatggtaatccacttcttagagttgaagctgtgtgtggatctcagggttggccagatagactccctgatataattgtttcgacacctgctgctcttcttaataatattgagccgaaaagaaataggcgtctggaatttctacgatgtgtcaaatatgtggtctttgatgaagctgatatgcttctgtgtggaagcttccagaatcagattatccgtctgataaatatgctgcgtttcgatgagaaacaggtgtctcgtttggctaaatccaatcttggcagaccaatggagattgatgcctctgtaccccaaattgatctagaaaatgaggatgatgcagaattcgatgaaggatctatttctgaggaagaggatgaagaagaggaagaggaatatcttgatgatatagcacaaatgcctagtgttgaagctgaagctgggtcagatactaaaaagggctggagaagagtgagaaagatctatacccgtagtaagcagtatattttcattgcagccacacttccagttaacgggaagaagactgccgggggaattttgaaacatatgtttcaagatgctgtttgggttagcggaaactttcttcaccgaaacagtccgagactaaagcaaaaatgggttgaagtcacagtagactcacaggttgatgctcttatagaggctgtaaaaaacaataacaacaccaacacagagaggacaatggtgtttgcaaacacggtcgaagctgttgaagcagtggccgatatattggagaaagctagtatccagtgttaccgttatcacaagaatcacaagctagacgaacgtgctaatatattagctgatttcagagaaactggtggtgtctttgtttgcactgatgcggctgcccgtggagttgatgttcctaatgtctcacacgttattcaggcggattttgctagttctgcagtggatttccttcacaggattggtcgaacagctagagctgggcaatatggaactgtgaccagtctatacaccgaggctaaccgtgatttagtagaggcaatccgtgaagcagtgaagatgggtcagccagtggaaactgcattcagcaggaagagaggttttaggaacaaggttaagaagagagcttttttgaaagctgaagaagcagaggagcctcaagctgtgagatattaa

SEQ ID NO: 1454 - DNA, 408 bp, Arabidopsis thaliana
atggcttcaaaagcattgctttttttaagtctcattgttgttcttcttatagcttctgaggtggtagccagagacctcgctgagaaatcggcagagcagaaaaacaatgaaagagacgaagtaaagcaaacggagcagtttggcgggtttccaggaggagggtatggagggttcccgggaggagggtatggaggaaaccctggtggaggatatggaaaccgtggtggtggatatagaaaccgtgatggaggatatggaaaccgcggtggaggatatggaaaccgaggaggaggatattgtcgctatggttgctgctacagaggctactacggtggctgcttcaggtgttgtgcttatgctggtcaggctgttcaaactcagccacagagtactgagccgggtcactaa

SEQ ID NO: 1455 - DNA, 1344 bp, Arabidopsis thaliana
atgtcaagcaatggatatgagtctcattctgacgaaagcccattaactaaaactatggcccattttatgtgctgcacaaaaacgaatggttccacaagagtcactctctcttcttcttcttcttcatcttggtgtagtagcggaagcggtggatttaggagtagttctaagcttttcgattctccggcgtgttcgagatcggatttgaagaaacgtagcgggaagagaaattcacggttaaacggactttcgttagagaaattaaggtcgattaaagcatcgtcgtcttccgctggacagagcagtagcgaagtgatcgacgacggagatgcggcggcgcgtggtttagctgttacttcaggagatgtaacgtcggttggaagtttcagtagcggcgaatttgttggtgctggtagtggcggtttagctggaccttcaggtgaggttacttccgtcggcgagtttgtcggcggaagcggcggggattttaaggattgggataagatcggtgctattgttaggttgagttatggaatcggaatatattgtggaatggcagtagcaggaagattcatatgtgaagtagcaggaatagattacacaggaggttttaatgcttctttagatacaattatcgctggacttggttatgcttctccacctattatggctcttctcttcattcttgatgatgaagttgttaaattgtcgcctcatgctcgtgccattagagatgttgaagatgatgagcttcgaggtttctttcaaggaatgtcagcttggcagtttatcttagtagttactgcaagttcagttggagaagagctcttctatcgtgctgcgtttcagactggactcttgccaccatttgtaccatttgctcaagtatttgcagccactattacagccgctctcactggttctctctactacatagctgcttcccctaaagatccaacttatataatggcaccggtcttgaaaactcgctctgcccgagacgagctgaagaagttgtttgcagcgtggtatgagcgaagacagatgaagaaaatctactctcctcttcttgaagggcttttgggtctatacctcggctttgaatggattcaggtttttacttcttctgttcacgcatttcttttttcgacatgtcgtagtaaaatcgttgataccaaactgaaaatattgcagacaaacaatcttcttgctcctatcatcacacatggtatatactcagccgttgtattgggtaatggtctctggaaactacaccatcatcagcaaagactccggctacgtgttcagaaacttgaaactgaaggtgacaacaactcaagatag

SEQ ID NO: 1456 - DNA, 1086 bp, Arabidopsis thaliana
atggattatcagaaatggagtctaggtttcatatctcttgtttttctcttgatcacttcatcttcggctgagctcctcattaaacaggtcacagagggcagaggaatagagtacaacaattcttatagtctcaagacgaatcttggactgacaagggtattgagagaagagcgaccatcgagtaagatagtgacaataacaagcttctccgtgattaagggcagatctgaagcctttgaatcctctacttttgaggctgctggttacaaatggagatttatgttgttcgtgaatggtaatcaaaacgacttgttcgtgaatggtaatcaaaacgaccccgatggtggacatgaaaatatggcactttacgtggggatcaaagagaccgaatcttttccaagaggctgggaagtcaatgttgatctcaaactctttgtccacaatgagaagctacacaagtacttgactgtttcagatggaacagtgaagcggtacgaagctgcgaaaacatattggggattcggaaacttgatccctcgtacaacattgcttgacccaaacgaaggttacatcttgcatgataccttatcttttggtgctgagatatccatcgttaatccagccgaaaaacaagagaaaatcacattcatatcaaaccctccggacaatgtcttcacttggaagatacttcgtttctccaccttggaaaataagttctattactctgacgaatttctcgttggagaccgatactggagattaggatttaacccgaaagggtatcaaggagaaagaccacgtgcactttcaatctttctatatgctcaaggctataaggcaaacgcagttattacaaacacttggggatcggttaatctgcagttaaagaatcaacgaagctccaaccacattcaactatatagtgaagcttggtgtgcgattcgaagcggttatggtattgaagggaacagtatcatattgttagaagatttacaaaattcatcaaaaggatatttggtgaatgatgcaattatctttgaagctgaacttgttaaggtctctgtgaccaatattgtttccgcttag

SEQ ID NO: 1457 - DNA, 1062 bp, Arabidopsis thaliana
atgcatttctcttcgtcttcaacatcgtccacttggacaatcttaatcacattgggatgtcttatgcttcatgcatctttgtccgctgctcaactcacccctaccttctacgataggtcatgtcctaatgtcactaacatcgtacgagaaaccattgtaaatgagttaaggtcggaccctcgtatcgctgcgagcatccttcgtcttcacttccacgactgctttgttaatggttgtgacgcatccatcttgttagacaacacgacatcatttcgaacagagaaagatgcgtttggaaacgcaaattcggctcggggatttccagtgattgatagaatgaaagctgcggtggagagggcatgcccaagaaccgtttcatgcgcagatatgctcaccattgcagctcaacaatctgtcactttggcaggaggtccttcttggagggttcctttgggaaggagagacagtttacaagcattcctggaactcgctaatgcaaatcttccagctccattctttacacttccacaacttaaagccagcttcagaaatgttggtctcgatcgtccttctgatctcgttgctctctccggtggtcacacatttggtaaaaatcaatgtcagtttattcttgacagattatacaatttcagcaacacaggtttacccgaccctacactcaacactacttacctccaaactcttcgtggactatgcccccttaatggcaatcgaagtgccttggtagattttgatctacgtacgcctacggttttcgacaacaaatactacgtgaatctcaaagagcgaaaaggtcttatccagagcgaccaagagttgttctctagccccaatgccactgacacaatccccttggtgagagcatatgctgatggcacacaaacattcttcaatgcatttgtggaggcaatgaataggatgggaaacattacaccaactacaggaactcaaggacaaatcagattgaactgtagagttgtgaactccaactctctgctccatgatgtggtggatatcgttgactttgttagctctatgtga

SEQ ID NO: 1458 - DNA, 996 bp, Arabidopsis thaliana
atgggtcgtggttacaatttgctattcgttctagtaacgtttttagtattggttgcagctgtaaccgcacaagggaaccgtggctcaaacagcggtggtggtcgaagaccacatgttgggttttatgggaatagatgccgaaacgtagagtctattgtgagatctgtagttcagtctcatgtccggtctatcccggctaatgcacctggaattttgcgaatgcatttccacgattgctttgtccatggctgcgatggctcggttctcctcgctggtaacacctcagagagaaccgcagttccgaaccgttcattgagagggttcgaagttattgaagaagctaaggctcggcttgagaaggcttgtcctcgtaccgtttcttgtgctgatattctcacccttgcagcccgagacgccgtcgttttgaccggtggacaacgctgggaagtgcccttgggacgtctcgacggccgaatctcgcaagcctcagacgtgaacttgcccggaccaagcgactccgttgctaagcagaagcaagacttcgctgctaaaactctcaacacattagacctcgtgactcttgttggcggacacacaataggaactgctggctgcggtctagtaaggggaaggttcgttaacttcaacggcacaggacaacctgacccatcaatcgacccgagttttgtgccgctgattctggctcagtgccctcaaaatggaggcacccgagtggagttagacgagggaagtgttgacaagtttgacacatcgttcctaaggaaggtgacgtcaagtcgcgtggttctccaatccgatctagtcctatggaaggatcccgagacccgagccatcattgaacgtttattaggattacgccgaccatccttgaggttcggaaccgagttcgggaagtcgatggtcaaaatgagtctcatagaagttaagactggatcagatggggagattcgtcgggtttgttccgccatcaactaa

SEQ ID NO: 1459 - DNA, 246 bp, Arabidopsis thaliana
atgtcttgctgtggaggaaactgcggatgtggatctggctgcaagtgcggcaacggttgtggaggttgcaaaatgtaccctgacttgggattctccggcgagacaaccacaactgagacttttgtcttgggcgttgcaccggcgatgaagaatcagtacgaggcttcaggggagagtaacaacgctgagaacgatgcttgcaagtgtggatctgactgcaagtgtgatccttgcacctgcaagtga

SEQ ID NO: 1460 - DNA, 678 bp, Arabidopsis thaliana
atgggttactggaattccaaggttgttccaaaattcaagaagttattcgagaaaaatagtgctaagaaggctgctgctgctgaagctaccaagacctttgatgaatctaaggaaacaatcaacaaggaaattgaggagaaaaagacagaactccaaccaaaggtcgtggaaacctatgaagccacgtctgcagaagtcaaggctttggtgagagaccctaaggtggctggtttgaagaaaaactcagcggctgtgcagaagtacctcgaggagctagtcaaaattgaattccccggatcaaaagcggtgagtgaggcttcgtctagcttcggagctggctatgtcgcaggaccggtcacgttcatattcgagaaggtatctgttttcctcccggaggaggtgaagactaaagaaataccggtggaggaagtgaaagctgaagaacctgccaaaactgaagaaccagccaaaaccgaaggaacaagtggtgagaaagaggagattgttgaagagacaaagaaaggcgagacccctgaaaccgcggtcgtggaggagaagaaaccagaggtagaggagaagaaggaagaggctactccggctccggcagtggttgaaactccagttaaggaaccggagacaacgacgacagcgccagtggctgaaccaccaaagccttga

SEQ ID NO: 1461 - DNA, 768 bp, Arabidopsis thaliana
atggcctcaaacgcactctcgtctttcaccgccgctaatcccgctctgtctcctaagccactactccctcacggctctgcttctccgtcggtttctctcggcttctccaggaaagttggcggcggcagagcagtggtcgttgcagcggctacggtggacacaaacaacatgccgatgaccggagtcgtgttccagcctttcgaagaggtgaagaaagccgatctggccattccaatcacatctcatgcctctctcgctcgccagaggtttgccgacgctagcgaggcagtcattaatgagcaaatcaatgtggaatacaacgtctcctatgtgtaccattcaatgtacgcatactttgacagagacaacgttgctatgaagggactagccaaatttttcaaggaatcaagtgaggaagagagagggcatgctgagaagtttatggagtaccagaaccaaagaggaggaagagtgaaactccaccctatcgtctcacctatctcagaattcgaacatgctgaaaaaggagatgctttatatgcaatggagttggctctgtctctagagaaactcactaatgagaagcttctaaacgttcacaaagtggcctcagagaacaatgatccccagttagctgatttcgttgagagtgaatttctgggagagcagattgaagcaatcaagaagatctcagactacatcacccagctaaggatgatcggcaaaggccacggagtttggcatttcgaccagatgcttctgaactag

SEQ ID NO: 1462 - DNA, 561 bp, Arabidopsis thaliana
atggcgtcttaccagaaccgtccaggaggtcaggccactgacgagtacggaaacccgatccagcagcagtatgacgagtacggaaatccgatgggaggaggaggatacggaactggtggtggtggaggagctacaggtggccaaggatacggaacaggtggccaagggtacggatcaggtggccaagggtacggaaccggtggccaaggatacggaaccgggaccgggactgaaggctttggaactggcggaggagctaggcaccacggccaagagcaactccacaaggaaagtggtggtggcttgggaggaatgcttcaccgctccggatctggatccagctctagctcggaggatgatggacaaggagggaggaggaagaagggaataacacaaaagatcaaggagaagttgccaggtcatcatgatcagtctggtcaagctcaagcgatgggcggcatgggatccggatatgatgctggtggctacggtggtgagcaccacgagaagaaggggatgatggacaagatcaaggaaaagcttcccggtggtggccgttaa

SEQ ID NO: 1463 - DNA, 1341 bp, Arabidopsis thaliana
atggagacgatgacgatgaaggttgaaaccattagtaaagaaatcataaagccatcttcgccaactccaaataatctccaaactctccaactctcaatttacgatcacatccttcctccagtttacacagtagcctttctcttctacaccaaaaatgatttgatctctcaagaacacacttcccacaaactcaagacttctctgtctgaaaccctgaccaagttctaccctcttgccggaagaatcaccggagtaaccgtcgattgtaccgatgaaggagctatctttgtcgatgctcgtgtcaataactgtcctctcactgaatttctcaagtgccctgatttcgacgccctccaacagttgcttcctctagatgttgtagacaacccatacgtggctgctgccacgtggcctttgctgctcgtgaaggcaacttacttcggatgcggaggcatggccataggaatctgcatcactcacaaaatcgcggacgcagcctccatctcgactttcattcggtcctgggccgccacggctcgaggagagaacgatgccgctgcgatggaaagtcctgtatttgctggtgcgaatttctacccaccagccaatgaggcttttaagctacctgcggacgaacaagccggcaagagaagcagcattacaaagagatttgtgttcgaagcttctaaggtggaagatctcaggaccaaagccgctagtgaagaaacagtagaccaacctacgcgggtggagagcgttactgcgctcatctggaaatgcttcgtcgcatcctcaaagacaactacttgtgatcacaaagtgctggtccagcttgctaacttgcggtccaagataccttcccttctgcaagaaagctctatcggaaatctcatgttctcttctgtggtcttgagtattggtcgaggaggggaagttaaaattgaagaggccgttagagacttacgaaaaaaaaaggaggagttaggaactgtgatcctagacgagggtgggtcatctgactcatcttccatgatcggttcgaaactagcaaatctgatgctcaccaactattctcggttgagctatgagactcatgaaccctataccgtgagtagctggtgtaagctacctctttacgaggctagctttggatgggattctccggtttgggttgttgggaatgtgtcccccgtgttaggcaacttggccatgttgatagattccaaggacggacaaggaattgaagcgttcgtcacactgcctgaagagaacatgtcgtccttcgagcagaacccagagttgctcgcctttgctaccatgaaccctagtgtcttggtttaa

SEQ ID NO: 1464 - DNA, 426 bp, Arabidopsis thaliana
atgcagggagctctgtttatcaaaccaactattcttcttcctcttccttcttcagtttcttctccaaaactcacttttcttcttcctcacgcaaccaaagcttcaagactctcatctctcagatcaaacaactcatcatcatcatcatccttaacgtctgaccctaacaccgtcgactataactcctccatcctttctgtttttccagctgaagcatgcgaagtaatcagtggatacgcttgttctgctgatatttaccctgaagtcaagctcgatacaaagcccgtctcacgtcccgtggcttcagagcccgttgacagagaatacgaagagtataacagccccaaaacggttttccgtgaagaggcctgcgatgatcttggaggagaattctgtgaacctgactttcaaaaagatgccaactag

SEQ ID NO: 1465 - DNA, 630 bp, Arabidopsis thaliana
atgaaggccaccatatccatcactaccatctttctcgtggtcgctttggccgcaccctccctagctcgtcctgacaaccatgtcgaggactctgtaggccgtctacttcgtcctggtcaaacgtaccacatcgtacctgcgaatcccgagacaggaggaggtattttctcgaacagtgaagaaatctgtcctcttgacatcttccagtcaaacaatccgcttgacttgggcctacccatcaaatttaagtccgagttatggtttgttaaggaaatgaatagtatcaccatcgagtttgaggctccgaactggtttttgtgtcctaaagaatccaaggggtggagagttgtgtactctgaagaattcaaaaagagtcttataataagcactggtggttcatcaaacccaagtggcttccagatccatcgagtcgacggaggtgcttacaagattgtatattgtacaaacatctcgactactacgtgcatgaacgttggcatattcaccgatatctctggtgcacgacgcttagccttgaccagcgatgaggctctcctagttaagttccagaaggcagcaactccaaaagctgatttgaagactaagctgaggatgttccctttctactga

SEQ ID NO: 1466 - DNA, 1065 bp, Arabidopsis thaliana
atgaacagaggaagcttatgccctaatcccatctgtctccctcctcttgagcaatccatctccaaattcttaacacagagtggaacgtttaaagatggagatcttcgagtgaacaaagatggaatccagaccgtgtctctgtccgaaccaggagctccacctcctattgagccattggacaaccaattgagtttggcagatttagaagtgatcaaagtcattggcaaaggaagtagtggtaatgtccagttggtcaaacacaaactcactcaacagtttttcgctcttaaggtcattcaattgaacacagaagaatcaacatgtcgggcgatttctcaggagctgagaataaacttgagctcgcaatgtccatatcttgtctcatgttatcaatctttctaccacaacggtcttgtttcaatcatattggaattcatggatggtggatcccttgcagacttgttaaagaaagtcggaaaagttcctgaaaacatgctatctgccatctgcaagcgagttcttcgaggtctttgttatattcatcatgagaggcgaatcattcatcgggacttaaagccttcaaacttgctaatcaatcatagaggtgaagtcaagatcacagactttggtgtcagcaagatcttgacaagcacaagtagtcttgctaattctttcgtgggcacatacccttatatgtctccagagagaatcagcgggagtttgtacagtaacaagagcgatatttggagcttgggactggttttgctcgaatgtgcaacgggtaaattcccgtatactcctccagaacacaagaaaggatggagtagcgtgtacgagcttgtggacgccattgttgaaaacccgcctccttgtgcaccttccaatctcttttctccagagttttgctccttcatctcgcaatgtgtacaaaaagatccaagggacagaaaatcagcaaaggagcttctggaacacaagttcgtaaagatgtttgaagattcggatacaaatctctcggcttacttcaccgacgcaggatctttgattcccccacttgctaactag

SEQ ID NO: 1467 - DNA, 675 bp, Arabidopsis thaliana
atggctgagaaagaagaagtgaagcttttggggatatgggcgagcccttttagccgtcgggtcgagatggctctcaaactcaaaggcataccgtacgagtacgtggaagagatactggagaacaaaagccctttgcttcttgctcttaaccctattcacaagaaagtccctgttcttgtccacaatggtaaaaccattctcgagtctcatgtgattcttgaatacatcgatgagacttggccacaaaatccaattctccctcaagatccttatgaaagatccaaagctcgtttctttgctaaactcgtcgatgaacagattatgaacgtggggtttatatcaatggcaagagcagacgagaaaggaagagaagttttagccgagcaggtaagagaactgattatgtatctcgagaaagaacttgtcggaaaagattacttcggaggcaagactgtcggattcttggactttgtcgccggaagtttaattccgttttgtttggagagaggttgggaaggaataggattggaagtgattacagaggagaagtttccagagttcaagagatgggttaggaatttggagaaggttgagattgttaaagattgtgttccaccaagagaggaacatgtagaacacatgaactatatggcagagagagtgagatcttcttaa

SEQ ID NO: 1468 - DNA, 642 bp, Arabidopsis thaliana
aatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgatacgacgaccacgaatcatggcctggacatggaggagacgatggtggaagctatttatacaccggaacagagcgaaggtgcgttttatatggatgaggagacaatgtttgggatgccgactttgttggataatatggctgaaggcatgcttttaccgccgccgtctgttcaatggaatcataattatgacggcgaaggagatggtgacgtgtcgctttggagttacta

SEQ ID NO: 1469 - DNA, 708 bp, Arabidopsis thaliana
atggaagaaggagattttttcaactgctgtttcagcgagattagtagtggcatgaccatgaataagaagaagatgaagaagagcaataaccaaaagaggtttagcgaggaacagatcaagtcacttgagcttatatttgagtctgagacgaggcttgagccgaggaagaaggttcaggtagctagagagctagggctgcaaccaagacaagtggctatatggtttcaaaacaagagggctcgatggaaaactaagcaacttgagaaagagtataacactcttagagccaattacaacaatttggcttcacaatttgaaatcatgaagaaagaaaagcaatctctggtctctgagctgcagagactaaacgaagagatgcaaaggcctaaagaagaaaagcatcatgagtgttgtggtgatcaaggactggctctaagcagcagcacagagtcgcataatggaaagagtgagccagaagggaggttagaccaagggagtgttctatgtaatgatggtgattacaacaacaacattaaaacagagtattttgggttcgaggaagagactgatcatgagctgatgaacattgtggagaaagctgatgatagttgcttgacatcttctgagaattggggaggtttcaattctgattctctcttagaccaatctagcagcaattaccctaactggtgggagttttggtcataa

SEQ ID NO: 1470 - DNA, 1458 bp, Arabidopsis thaliana
atgaagagtttcaacacagaaggacacaaccactccacggcggaatccggcgatgcctacaccgtgtcggacccgacaaagaacgtcgatgaagatggtcgagagaagcgtaccgggacgtggcttacggcgagtgcgcatattatcacggcggtgataggctccggagtgttgtctttagcatgggctatagctcagcttggttggatcgcagggacatcgatcttactcattttctcgttcattacttacttcacctccaccatgcttgccgattgctaccgtgcgccggatcccgtcaccggaaaacggaattacacttacatggacgttgttcgatcttacctcggtggtaggaaagtgcagctctgtggagtggcacaatatgggaatctgattggggtcactgttggttacaccatcactgcttctattagtttggtagcggtagggaaatcgaactgcttccacgataaagggcacactgcggattgtactatatcgaattatccgtatatggcggtttttggcattattcaggttattcttagccagatcccaaatttccacaagctctcttttctttccattatggccgcggtcatgtcctttacttatgcaactattggaatcggtctagccatcgcaaccgtcgcaggtgggaaagtgggtaagacgagtatgacgggcacagcggttggagtagatgtaaccgcagctcaaaagatatggagatcgtttcaagcggttggggacatagcgttcgcctatgcttatgccacggttctcatcgagattcaggatacactaagatctagcccagctgagaacaaagccatgaaaagagcaagtcttgtgggagtatcaaccaccacttttttctacatcttatgtggatgcatcggctatgctgcatttggaaacaatgcccctggagatttcctcacagatttcgggtttttcgagcccttttggctcattgactttgcaaacgcttgcatcgctgtccaccttattggtgcctatcaggtgttcgcgcagccgatattccagtttgttgagaaaaaatgcaacagaaactatccagacaacaagttcatcacttctgaatattcagtaaacgtacctttccttggaaaattcaacattagcctcttcagattggtgtggaggacagcttatgtggttataaccactgttgtagctatgatattccctttcttcaacgcgatcttaggtcttatcggagcagcttccttctggcctttaacggtttatttccctgtggagatgcacattgcacaaaccaagattaagaagtactctgctagatggattgcgctgaaaacgatgtgctatgtttgcttgatcgtctcgctcttagctgcagccggatccatcgcaggacttataagtagtgtcaaaacctacaagcccttccggactatgcatgagtga

SEQ ID NO: 1471 - DNA, 1107 bp, Arabidopsis thaliana
atggcgatgttagttgagccaccaaatgggattaagcaacaagggaaacattactactccatgtggcaaacattgttcgaaatcgatacaaagtatgttccgattaaacccattggaagaggagcttatggtgtggtttgttcttctatcaatcgtgagactaatgagagagttgctattaaaaagattcacaatgtgtttgagaatcgtgttgatgctttgagaacgttgagggaacttaaacttcttaggcatgtgaggcatgagaatgtgatcgcgcttaaagatgttatgttgcctgctaatagatccagtttcaaggatgtttatttggtttatgagctaatggatactgatcttcatcagattattaaatcctctcagtctctttctgatgatcactgcaagtacttcttgtttcagttgcttagagggttgaagtatcttcattctgcaaacatacttcaccgggatttgaagcccgggaacctcttagttaatgcgaactgcgatctcaagatttgtgatttcgggttggcgagaacgagccaaggtaatgaacagttcatgactgagtatgtggttacacgttggtacagagcacctgagcttcttctttgttgtgataactatggaacctccattgatgtatggtcggttggttgcatattcgcggagattcttggtaggaaaccgatttttccaggaacagaatgcttgaatcagcttaagctaatcatcaacgttgttggtagccaacaagaatctgatattcggttcatagacaacccgaaagctcgaaggtttataaagtctcttccgtactcaagaggaactcatctctccaatctttatccacaagccaatcctctagctatagatttgttacagaggatgcttgtgtttgatccaaccaagagaatctctgtaaccgatgcgctcttacacccgtatatggcggggttgtttgatcctggatccaatccgcctgcacatgtcccaatctctctggacatagatgaaaacatggaggaaccagtgataagagagatgatgtggaatgagatgctttattaccaccctgaagctgaaatctcaaatgcctaa

SEQ ID NO: 1472 - DNA, 2364 bp, Arabidopsis thaliana
atgaagctcaggcgttttcatcagcatcgaggaaaaggaagagaagaagagtatgatgcttcttctctcagcttgaacaatctgtcaaaacttattcttcctccacttggtgttgctagctataaccagaatcacatcaggtctagtggatggatcatctcacctatggactcaagatacaggtgctgggaattttatatggtgcttttagtggcatactctgcgtgggtttacccttttgaagttgcatttctgaattcatcaccaaagagaaacctttgtatcgcggacaacatcgtagacttgttcttcgcggttgacattgtcttgacgtttttcgttgcttacatagacgaaagaacacagcttcttgtccgtgaacctaaacagattgcagtgaggtacctatcaacatggttcttgatggatgttgcatcaactataccatttgacgctattggatacttaatcactggcacatccacgttaaatatcacttgtaatctcttgggattacttagattttggcgacttcgaagagttaaacacctcttcactaggctcgagaaggacataagatatagctatttctggattcgctgctttcgacttctatcagtgacattgtttctagtgcactgtgctggatgcagttattacctaatagcagacagatatccacaccaaggaaagacatggactgatgcgatccctaatttcacagagacaagtctttccatcagatacattgcagctatatattggtctatcactacaatgaccacagtgggatatggagatcttcatgcaagcaacactattgaaatggtattcataacagtctacatgttattcaatcttggcctcactgcttaccttattggtaacatgactaatttggtcgtggaagggactcgtcgtaccatggaatttaggaatagcattgaagcagcgtcaaactttgttaacagaaacagattgcctcctagattaaaagaccagatattagcttacatgtgtttaaggtttaaagcagagagcttaaatcagcaacatcttattgaccagctcccaaaatctatctacaaaagcatttgtcaacatctttttcttccatctgttgaaaaagtttacctcttcaaaggcgtctcaagagaaatacttcttcttctggtttcaaaaatgaaggctgagtatataccaccaagagaggatgtcattatgcagaacgaagcgccggatgatgtttacataattgtgtcaggagaagttgagatcattgattcagagatggagagagagtctgttttaggcactctacgttgtggagacatatttggagaagttggagcactttgttgcagaccacaaagctacacttttcaaactaagtctttatcacagcttctccgactcaaaacatctttccttattgagacaatgcagattaaacaacaagacaatgccacaatgctcaagaacttcttgcagcatcacaaaaagctgagtaatttagacattggtgatctaaaggcacaacaaaatggcgaaaacaccgatgttgttcctcctaacattgcctcaaatctcatcgctgtggtgactacaggcaatgcagctcttcttgatgagctacttaaggctaagttaagccctgacattacagattccaaaggaaaaactccattgcatgtagcagcttctagaggatatgaagattgtgttttagtactcttaaagcacggttgcaacatccacataagagatgtgaatggtaatagtgctctatgggaagcaataatatcgaagcattacgagatattcagaatcctttatcatttcgcagccatatcggatccacacatagctggagatcttctatgtgaagcagcgaaacagaacaatgtagaagtcatgaaggctcttttaaaacaggggcttaacgtcgacacagaggatcaccatggcgtcacagctttacaggtcgctatggcggaggatcagatggacatggtgaatctcctggcgacgaacggtgcagatgtagtttgtgtgaatacacataatgaattcacaccattggagaagttaagagttgtggaagaagaagaagaagaagaacgaggaagagtgagtatttacagaggacatccattggagaggagagaaagaagttgcaatgaagctgggaagcttattcttcttcctccttcacttgatgacctcaagaaaattgcaggagagaagtttgggtttgatggaagtgagacgatggtgacgaatgaagatggagctgagattgacagtattgaagtgattagagataatgacaaactctactttgtcgtaaacaagataatttag

SEQ ID NO: 1473 - DNA, 1503 bp, Arabidopsis thaliana
atgttatacttcatccttctccctcttctatttcttgtaataagttacaaatttctctactccaaaacgcaacgtttcaaccttcctccaggaccaccgtcacgacccttcgtcggccatctccacctcatgaaaccgccgatccaccgtctcctccaacgctactccaaccaatacggcccaatcttttccctccgtttcggctcccgacgcgtcgtggtcataacatccccttctctcgcccaagaatccttcaccggccaaaacgacatcgttctctccagccggccgctccaactcaccgccaaatacgtcgcatacaaccacacaaccgttggtacagctccttacggcgaccactggcgtaacctccgccgcatttgctcccaagagattctctcctctcaccgtctcatcaacttccaacacatccgcaaagacgagatcttacggatgctcacacgcctctcacgttacacacaaacctccaacgaaagcaacgatttcactcacatcgagctagaaccgctcttatctgatctaacattcaacaacatagtaagaatggttacagggaagagatattacggcgacgacgtcaacaacaaagaagaagcagagctattcaagaagctagtctacgatatcgccatgtatagcggcgctaatcattccgctgattacttaccaatactaaaactattcggaaacaaattcgagaaagaagttaaagctataggcaaatcaatggatgatattttgcagcgtttgttagatgaatgtagaagagataaagaaggtaacacaatggtcaatcatttgatctctctacaacaacaacaacctgagtattacactgacgttatcatcaaaggccttatgatgtcgatgatgctcgccggaactgagacctccgctgtgacattagagtgggcgatggcgaatctactgagaaatccagaagtactggagaaggcgagatcggagatcgatgagaagatcggaaaagatcgactaatcgacgaatcagacatcgcagtgcttccttacctccaaaacgtcgtctccgaaacattccggctatttccggtggcgccgtttctaatccctcgatcaccgacggacgacatgaaaatcggaggttacgacgtcccgcgagatacgatagtgatggttaacgcttgggctatacatagagatccagagatttgggaggagccagagaagtttaatccagatcgatataatgacggatgcggaagcgattactatgtttacaagctgatgccgtttgggaatggccggagaacttgtcccggcgccggattaggtcagaggattgtgacattggcgcttggatcgttgattcaatgctttgaatgggagaatgtgaaaggggaagagatggatatgtctgagagtactgggttgggtatgcgtaagatggatcctttacgggccatgtgtaggcctaggcccattatgtcaaagcttttactctaa

SEQ ID NO: 1474 - DNA, 1140 bp, Arabidopsis thaliana
atgggtgtgatatctccgactgaaactctgttcttaaagtctcaacatcgtcttcttcaacctcgaaactattcatacgcacttgcttttcacagcactcgacgagttgcgaatttcccacgcaactcattctcttctctaggtttcactttctttctcctctgtttttatgaaatttctgttttgtttcagctgtatcataagaaggtttcttctattatggaaacattaaagcaagcctactcttttattcctcatggaattctgttaagtacaatattagctcttgtctatccaccttctttcacatggttcaagccaaggtactttgtacctggcttagggttcatgatgtttgctgttggtatcaactctaatgaaagagattttcttgaagcacttaaaagaccagatgctatttttgccggttacatcggacaatacttgattaaacctctcttaggtgctggaatcatgttggtctcatgtgttagtggagctcagctatcaaattacacaactttcttgaccgatccttcactcgcggcgcttagcatcgtcatgacatctatctcaacggccactgcggtcctcgttacacctatgctttcactcttactcattggtaaaaagcttcccgttgatgtgtttgggatgatctctagcattcttcaagtggtgattacacctattgccgcaggactacttctgaaccgaaagaacaaaaaactaacgttacgttacaaatgtgagtgcaggttgtttccaaggttgtctaatgcaatcaaaccatttcttccggcgttaacagttatcgatatgagttgttgcataggagcaccccttgctttgaatatagattcaatcttgtctccgtttggtgcaaccattttgttcctcgtcatcacgtttcatctcttggcttttgttgctggttactttttcactggtttcttcttcagcaaggcacctgatgtaaaagctctgcaaagaacaatttcctatgaaacaggaatgcaaagtagtcttctcgctctggccctcgctacaaagttctttcaagatcctctcgttggagtgcctccagcaatctccgtgagttttcaatatagttttgttacatctattttcttctattaa

SEQ ID NO: 1475 - DNA, 375 bp, Arabidopsis thaliana
atgccaacatcagcaacagcggtggctccatcaactggatctgtccagaaaaaagatcaagactggcgtgcgattttgtctcccgagcaatttagagttctcagggaaaagggcacagagaaccgaggtaaaggagagtataccaaactgttcgacgacggaatctatagttgtgctggttgtgcaactcctctttataagtccaccactaagttcgactctggttgtggctggccttccttcttcgatgctatccctggtgccattaaacaaacggatatgtttggtagcaatgctgccgatggatcaatagtaacgagcggtttggactacattttgatttccatcaatgagaagttaaaagcttacacttaa

SEQ ID NO: 1476 - DNA, 807 bp, Arabidopsis thaliana
atgtgtagtttgtcggcgattatgttgttaccaacgaagctgaaaccagcttattcagacaaacggagtaacagtagcagcagcagctcactcttcttcaacaatagaagatccaagaagaagaaccaatcgattgttcccgttgcaaggttgtttggaccggcgattttcgaatcatccaaattgaaagtactcttcttaggggttgatgagaagaagcatccttcaacgctccctaggacttacacactcactcacagtgacattacagctaaactaaccttagctatttctcaatccataaacaactctcagttgcaaggatgggcaaataggctataccgggatgaagttgtggcagaatggaagaaagtgaaagggaaaatgtcgcttcacgttcattgtcacataagcggtggccatttccttttagatctctttgcaaagtttcgatatttcatcttttgcaaagaactacctgtggtgttgaaggcttttgtgcatggagatgggaacttgttgaacaactatcctgagctacaagaagctcttgtttgggtctatttccattctaatgtcaatgagttcaacaaagtcgagtgttggggtccgctttgggaagctgtttcgcctgatggtcacaagactgagactcttcccgaggctcggtgtgcggacgagtgtagttgttgttttccaaccgttagctcgattccatggtctcatagtcttagtaatgaaggtgtaaatggttactctgggactcagactgagggaattgctactccaaatccggagaaactctag

SEQ ID NO: 1477 - DNA, 684 bp, Arabidopsis thaliana
atgtctttggacactgtggacaaactggtggtgttcttggccaagagagacggaatagacaagcttgtgaagacattccaatacgtggccaagctcgcgtgctggcatgttgaagccacacgacccgaagccgccgataggttcaagaagtgggaggtcgcctccggtctcagccgcaaagccttcaggaccgggagatctctcacggggttcaatgcgctgagacgaaaccccggggcaaccccgatgatccgtttcttggcggtcctagccaattcaggggaaatggtttacttcttctttgatcattttctttggttatcaagaattggttcaatagacgccaagctcgccaagaaaatgagtttcatatccgcttttggcgaatctttcggctacactttcttcatcatcattgattgcatcttcataaagcaaagactcaaatccttaaaaaagctccagcattcgaccgatgaaccgaaagaagaaatcggcgccaaaattagcgagattcggggagatatagtaatgaggttgatgggaatttcagccaacgttgcggatttacttatagcattggcagaaattcacccaaaccccttttgtaaccacaccattacactcggtataagcggtttagtttcagcttgggccggttggtataggaactggccatcgtga

SEQ ID NO: 1478 - DNA, 2418 bp, Arabidopsis thaliana
atgggtatggttttatttgcttgcttgcttttactaatcatattcccaacttgtggctatgcagctataaacacatcaagtcctttgtcaataagacaaactctgagttctcctggtggattttatgagttaggcttcttcagtcctaataatactcagaatcagtatgtcgggatctggttcaagaagattgttcctcgtgtagttgtgtgggtggctaacagagatacgccagttactagctctgcagcaaatctcactatcagcagcaatgggagcctgatcttgcttgatgggaaacaagatgttatttggtcaacaggaaaagctttcacatccaacaaatgtcatgcggagctcttagataccggaaattttgttgtaattgatgatgtttcagggaataaattatggcaaagcttcgagcatcttggtaatactatgctgcctcagtcatcattgatgtatgatacttctaatggcaagaagcgtgtgttgactacatggaaaagtaacagcgatccttcgcctggggagttctcactggagattacaccacaaatccccacacaaggccttataagaagaggctcagtaccttactggagatgtggtccttgggcaaaaacaagattctctgggatatctggaattgatgcatcatatgtaagtccattcagcgttgtccaggatacagcagccggcacaggatctttctcttattccacattaagaaactataatctctcatatgttacgctaacaccagaagggaaaatgaagatcctctgggatgatggaaataattggaagcttcacttgtctctcccagagaacccatgtgatctatatggtagatgcgggccttatggtttgtgtgtgagatctgatcccccaaagtgtgaatgcttgaaagggtttgtaccaaagtctgatgaggagtggggaaaaggaaactggacaagtgggtgtgtgagacgtacaaaattatcttgccaagcaaaatcttctatgaaaacacaaggcaaagacacagacatcttctatcgtatgacagatgtaaagactccggatctgcaccaatttgcaagctttctcaatgccgaacagtgctatcaaggttgtctaggcaactgttcttgcacagccttcgcctatattagtggaattggatgtttggtatggaatggggagctagcagacaccgttcaatttttgtctagcggagagtttctcttcattcgtcttgcaagttcagaattggctggaagcagtcgaaggaagattatcgtaggcactactgtcagcctttccattttcttgatcttggtatttgctgcaattatgttgtggagatacagagcgaaacaaaatgatgcatggaagaatggttttgaacgacaagatgtctccggcgtcaatttctttgagatgcatacaatacgaactgccaccaataacttcagtccttcaaataaacttggtcaaggtggatttggtccagtttacaagggaaagttggtagatgggaaggaaataggtgttaaacgccttgctagtagttccggtcagggtacagaggagttcatgaatgaaataacactgatctcaaaattgcaacacagaaacttggttcggcttttgggatactgcatcgacggagaagagaagctactgatctatgagttcatggtgaacaaaagtctcgatatttttatatttgatccatgtctaaagtttgagcttgattggccaaagagatttaatatcattcaaggtattgcgcgtggacttctctatctccaccgtgactcacgcctcagagttattcaccgagacctgaaggtcagcaatattcttctggacgacagaatgaatccaaaaatatcagattttggattggctcggatgttccagggaacccaatatcaagacaacactcgcagagttgtaggaactctaggatatatgtctcccgagtatgcatgggcaggattgttctctgagaagtctgatatctatagcttcggagttctgatgttagaaatcatcagcggaaagagaatttcacggttcatctatggtgatgaaagcaaaggccttcttgcttatacatgggattcttggtgcgagaccgggggatcaaatctacttgacagagatcttactgatacatgccaagcattcgaagttgcgagatgtgttcagattggtctgctctgtgttcaacacgaagccgtcgacagacccaacactcttcaagtactatccatgcttacttcagcaacagatcttccagtaccaaaacagccaatatttgcagtgcatactctaaacgatatgccaatgttacaggctaattctcaagatttcttatctgtaaatgagatgacagaatctatgatccaaggaaggtaa

SEQ ID NO: 1479 - DNA, 3012 bp, Arabidopsis thaliana
atgaaactttttcttctccttctttttcttctccacatttctcataccttcaccgcaagccgaccaatctccgagttccgtgctctcctctcactcaaaacctctctcaccggcgccggagatgacaaaaactcgcctctctcttcctggaaagtctcaacaagcttctgtacatggattggtgtcacgtgcgatgtatctcgccgtcacgtgacttctcttgatctctccggtctcaacctctccggtactctttccccagatgtttctcatttacgtcttcttcagaatctatcactcgctgaaaatctaatctccggtccgattccgccggaaatctcgagcctttccggtcttcgtcacttaaatctctcgaacaatgtcttcaacggttcgtttcccgatgagatttcttctggattggtgaatctccgagttcttgatgtctacaacaacaatctaaccggagatttaccggtttccgtcaccaatctgactcagctccggcaccttcacctcggtggtaactacttcgctggaaagatcccgccttcgtacggaagctggccagttattgagtatctagcggtttccggcaacgagcttgtcgggaaaatccctccagagatcggaaacctaacgactctccgggagctttacatcggctactacaacgctttcgaagacggtcttcctccagagatcggaaatctatcggagctagtcagattcgacggagctaattgcggattaaccggtgagattccgccggagattgggaagcttcagaaactcgatacgcttttcttgcaagtgaatgtcttctccggtccattaacttgggagctaggaacgctatcgagtttaaaatcaatggatttgtctaacaacatgttcaccggagagattccagcgagtttcgcagagttgaagaatctcacgcttttgaatctcttccgtaacaaacttcacggcgagataccggagttcatcggagatttgccggagcttgaagtgttacagctttgggagaacaatttcaccggaagcatcccgcagaaattaggagaaaacggtaaactaaatctcgtcgatctctcttccaataagctgaccggaactttaccgccgaacatgtgctccggtaacaagttagaaactttaatcactcttggaaactttctctttggttcaatccctgattctcttggtaaatgtgagtctttgacccggatccgaatgggtgagaatttcctgaacgggtcaatcccaaaaggactattcggattacccaaattaactcaagtggagctccaagataattatctctccggagagttaccagtcgccggaggtgtctctgttaatcttggtcagatcagtttatcaaacaaccagctctcaggtccattacctccggcgatcgggaacttcaccggcgttcagaaacttcttcttgatggaaacaagttccaaggtcctattccttcagaggtagggaagcttcagcagctctcgaagattgatttcagccacaacttgttctccggtcgaatcgcgccggagattagtcgttgcaagctcttaacgtttgttgatctgagcagaaacgagctctccggtgaaatcccaaatgagatcactgctatgaagatattgaattacttgaacctgtcgagaaaccatctggttggatcaatccctggttcaatctcgtcaatgcagagcttaacatctcttgatttctcttacaacaacctctccggtttagttccgggaacaggacaattcagttacttcaactacacatcgttcttgggtaatcctgatctctgtggtccttatcttggtccttgtaaagacggtgttgctaaaggaggtcaccagagtcatagtaaaggacctttatcagcttctatgaagttattgcttgttcttggactacttgtttgttcgattgcgttcgcggtagtagccataatcaaagctagatcattgaaaaaggcgagtgagtcacgggcttggaggttaacagctttccagagactagacttcacgtgtgacgatgtcttggattctctcaaagaagacaacattataggcaaaggaggagctggtattgtctataaaggcgtaatgcctaatggtgatctagtcgcggttaaaagactcgctgcaatgtctcgtggatcttcccatgatcacggcttcaacgcagagattcaaaccttaggaaggataagacacagacacatagtgaggcttctcggattttgctcaaaccacgagacgaatctacttgtctatgagtacatgcctaatggtagtctcggtgaggtgcttcacggtaagaaaggaggacacttgcattgggacacacgttacaagattgctcttgaagctgctaaaggactctgttaccttcatcacgattgttctccattgatcgttcacagagatgtcaaatcaaacaacatcctccttgattcaaactttgaagctcatgttgctgactttggtctcgctaaattccttcaagattccggtacttctgaatgtatgtctgcaatcgctggctcttacggctacatagctccagagtatgcgtatacgttgaaggtagatgagaagagcgatgtgtatagtttcggtgtggttcttttggaactcgtcaccggaagaaaacctgtcggagaatttggagacggtgtcgatatagtgcaatgggttcgtaaaatgactgattcgaacaaggattcggttctgaaagtattggatccgagactttcttcgattccgattcatgaagtgacgcacgtcttctatgtagcgatgctctgtgtagaagaacaagctgttgagaggccgactatgagagaagttgttcagattctcactgagatcccgaagttgccaccgtcgaaggatcagccgatgacggaatcagcgccggagagtgagctttcgccgaagtctggtgttcaaagtccgccggatctactcaatctatga

SEQ ID NO: 1480 - DNA, 2136 bp, Arabidopsis thaliana
atggaacatgtcagagttatctttttcttctttgcttgtgtcctaaagattgtaccatttatctgcttagcacagaaggataaatatgagtttcctccaggtttcaactgtgtagctagtggaggcaatttcacggccaacagctctttcgctggtaatctcaacggccttgtctcctctctctcgtcactcacatccaaaccttatggcttctacaacctctcttctggagattcatctggagaaagagcttatgcaattggtctttgtagaagagaagtaaaaagagatgattgtctcagctgcattcagatagctgcaagaaacctcatcgagcagtgtccactgacaaatcaagctgttgtgtggtacacacactgtatgtttcgttactcgaacatgataatctatggaagaaaagagacgaccccaactctgtcttttcaagccggtaaaaatatatcagcaaacagagatgagtttgatcgtctgcagatagaactattggacagactcaaagggattgctgcagctggtgggccaaatagaaaatacgctcaagggagcggttcgggtgtggcagggtacccgcaattctacggaagtgcacactgtacgccggatttgtctgaacaggattgtaatgactgtctagtctttggttttgaaaagatcccaggttgttgtgctggtcaggttggtcttaggtggttttttcctagttgtagctacagatttgagacctggcgattctacgagttcgatgccgatctagagcctgatccacctgctattcagcctgctgactccccaacatcagctgcaagaactgagagaacaggaaagggcaaaggtggatctaaagtcattgttgcgatagtcatcccaatagtttttgttgcgttatttgcaatttgcctatgcttgctcttgaagtggaagaagaacaagtctgtaggtagagtcaaaggtaacaaacacaaccttcttcttttggttatcgttatcttgttacaaaaggatgagttctcagattcgttggtagttgactttgaaactctaaaggcagcaacagataacttttcaccagaaaatgaacttggacgtggtgggtttggctcagtttataagggtgtgttctcgggtgggcaagaaatcgcggtgaaaagattatcgtgtacttcaggacaaggagacagtgaattcaagaacgaaattttacttcttgcaaagcttcaacataggaacttggttaggctattaggtttttgcatagaaggacaagaacgaatccttgtctatgagttcatcaagaacgctagtcttgacaatttcatcttcggtaattgttttccgccgttttctccatatgatgatcctaccgttctgttttttctgctctgtgttgatctttacgctgttacagatcttaaaaagcgtcaacttttggattggggagtgcgatacaaaatgataggtggagttgctagaggacttctttatcttcatgaagactctcgttaccggataattcaccgtgatcttaaagctagcaacattcttttggaccaagaaatgaatccgaaaatcgcagattttggattagctaaactctatgacacagaccaaacttcgacacatcgatttacaagcaaaattgcaggaacttacgggtatatggctccagaatacgctatttacggtcaattctcggtgaaaacagacgttttcagcttcggtgtattagtcatagagatcattacgggtaagggaaacaataatggtcgatcaaatgatgacgaagaggcagaaaatctccttagttgggtgtggagatgttggagagaagacattatactaagcgttattgatccgagtctaaccacgggatcaagaagcgagatcttgagatgcatacacattggtcttttatgtgttcaagaaagtccagcgagtagaccaactatggattcggttgctctaatgctcaatagctattcctatactctcccaacgccttcaaggcccgcctttgcgttagagagtgtcatgccttcgatgaatgtttcttcttccacagaaccgttattaatgtccttgaatgatgtcactgtttctgagttatctcctcgttag

SEQ ID NO: 1481 - DNA, 327 bp, Arabidopsis thaliana
atgtgggatgaaactgtagccggacctaaaccggagcatggccttggccgcctccgcaataagatcaccacccaaccccttgacatcaaaggtgtaggagaagggagcagtagtaaaactgtggcggcggtggccgggagtcctggaactccgacgacgccaggatcggcgcgtaaggaaaacgtgtggagaagtgtgtttcatccaggaagtaacatcgccactagaggaatgggcacaaacctcttcgacaagccttctcacccaaactctcccaccgtctacgattggctatacagcgacgacactaggagcaagcaccgttga

SEQ ID NO: 1482 - DNA, 1482 bp, Arabidopsis thaliana
atgggtgaaaccgctgccgccaataaccaccgtcaccaccaccatcacggccaccaggtctttgacgtggccagccacgatttcgtccctccacaaccggcttttaaatgcttcgatgatgatggccgcctcaaaagaactgggactgtttggaccgcgagcgctcatataataactgcggttatcggatccggcgttttgtcattggcgtgggcgattgcacagctcggatggatcgctggccctgctgtgatgctattgttctctcttgttactctttactcctccacacttcttagcgactgctacagaaccggcgatgcagtgtctggcaagagaaactacacttacatggatgccgttcgatcaattctcggtgggttcaagttcaagatttgtgggttgattcaatacttgaatctctttggtatcgcaattggatacacgatagcagcttccataagcatgatggcgatcaagagatccaactgcttccacaagagtggaggaaaagacccatgtcacatgtccagtaatccttacatgatcgtatttggtgtggcagagatcttgctctctcaggttcctgatttcgatcagatttggtggatctccattgttgcagctgttatgtccttcacttactctgccattggtctagctcttggaatcgttcaagttgcagcgaatggagttttcaaaggaagtctcactggaataagcatcggaacagtgactcaaacacagaagatatggagaaccttccaagcacttggagacattgcctttgcgtactcatactctgttgtcctaatcgagattcaggatactgtaagatccccaccggcggaatcgaaaacgatgaagaaagcaacaaaaatcagtattgccgtcacaactatcttctacatgctatgtggctcaatgggttatgccgcttttggagatgcagcaccgggaaacctcctcaccggttttggattctacaacccgttttggctccttgacatagctaacgccgccattgttgtccacctcgttggagcttaccaagtctttgctcagcccatctttgcctttattgaaaaatcagtcgcagagagatatccagacaatgacttcctcagcaaggaatttgaaatcagaatccccggatttaagtctccttacaaagtaaacgttttcaggatggtttacaggagtggctttgtcgttacaaccaccgtgatatcgatgctgatgccgttttttaacgacgtggtcgggatcttaggggcgttagggttttggcccttgacggtttattttccggtggagatgtatattaagcagaggaaggttgagaaatggagcacgagatgggtgtgtttacagatgcttagtgttgcttgtcttgtgatctcggtggtcgccggggttggatcaatcgccggagtgatgcttgatcttaaggtctataagccattcaagtctacatattga

SEQ ID NO: 1483 - DNA, 744 bp, Arabidopsis thaliana
atggctaccactcgtctaactctagctcctctcctcctcatcgcagccgtactactcgcaaccaaggcaacggctcagccggcagcccccgctccagagcctgctggtcccatcaacctcactgcgatcctcgaaaaaggtggtcaattcactactttcatccatcttctaaacatcactcaagtcggtagtcaagtgaacattcaagtcaatagttcatccgaaggtatgacggtgttcgcaccaacagacaatgcttttcaaaaccttaaacccggaaccctaaaccagttaagccctgacgatcaagttaaactcattctctaccacgttagccccaaatattacagtatggatgatctcctctccgtgagtaacccggttaggactcaagcttctggccgagacaacggtgtttacgggcttaacttcaccggccaaacaaaccaaatcaatgtctctactggttatgtggagacacgtattagcaattcgttgaggcaacaacgtcctctcgcagtttatgttgtcgacatggttttgttgcccggtgagatgttcggagagcacaagctttcgccgattgctcctgcccctaaatctaaatccggtggggttaccgatgactccggctccactaagaaggcagcgtcaccgtcggataagtcaggctccggtgagaagaaagtcggactagggtttggtcttggacttattgtcttatgtttgaaatttctcttttga

SEQ ID NO: 1484 - DNA, 201 bp, Arabidopsis thaliana
atgtcagagaccaacaagaatgccttccaagccggtcagaccgctggcaaagctgaggagaagagcaatgttctgctggacaaggccaaggatgctgcagctggtgctggagctggagcacaacaggcgggaaagagtgtatcggatgcggcagcgggaggtgttaacttcgtgaaggacaagaccggcctgaacaagtag

SEQ ID NO: 1485 - DNA, 1485 bp, Arabidopsis thaliana
atggccacaacgatgacacgtgtctccgtcggcgtcgtcctctttgttctcttagtctcgctggttgccgtctccgccgcgagaagcggtcctgatgatgttatcaaactcccttcgcaggcttctcgcttcttccgtcctgctgaaaacgacgacgattctaactccggtactaggtgggctgttctagtcgccggatctagcggatattggaattacaggcatcaggctgatatatgccatgcctatcaacttctgaggaaaggtggattgaaagaggagaatattgtggtattcatgtatgatgatattgctaacaattacgagaatccaaggcctggaaccattatcaacagccctcatggaaaagatgtctatcaaggagttcccaaggattatactggagatgatgtcaatgttgataatctatttgctgtgatccttggagacaaaactgctgttaaagggggaagtgggaaggttgtggatagtggtcctaatgatcatatcttcatattctacagtgaccatggtggtcctggagttcttgggatgccaacttctccttacctatatgcaaatgatctcaatgatgtcttgaagaagaaacatgctttaggaacatataaaagcttggtgttttatctcgaagcttgcgaatctggaagtatctttgaagggcttcttcctgagggtttgaacatctatgccacaactgcatcaaacgccgaagaaagcagttggggtacctattgccctggagaggaacccagtcctccaccggagtatgaaacttgtttaggtgacttgtacagtgttgcttggatggaagatagtggtatgcacaatttacagactgagactctgcaccagcaatatgaacttgtgaaaaggaggactgcacctgttgggtactcttatggttctcatgtcatgcaatatggcgatgtaggaattagcaaggataatctcgatctttatatgggaacaaaccctgccaatgacaattttacctttgcggatgcgaattcactaaagccaccttcaagagttacaaaccagcgtgatgcagatcttgttcatttttgggaaaagtaccgaaaagcaccagaaggttcagcaagaaaaacagaagctcagaagcaagtacttgaagccatgtctcacagacttcatattgacaatagcgtgatactcgtcggaaaaatcttgtttggcatttcgagaggtcctgaagtgctaaacaaagtacggtctgctgggcaacctctagtcgatgactggaactgccttaaaaatcaggtgagagctttcgagaggcactgtggatcgctgtctcagtacggtatcaagcacatgaggtcttttgcaaacatctgcaatgcagggattcaaatggagcaaatggaggaggcagcttcacaggcttgtaccacactgccaactggtccttggagctcgcttaaccgtggattcagtgcatag

SEQ ID NO: 1486 - DNA, 996 bp, Arabidopsis thaliana
atggcaacttctctccaagccgccgcaacttttcttcaaccggcgaagattgccgcttctccttctcgtaatgtccatctccgatcaaaccaaaccgtgggcaagtcctttgggttagactcttcacaagctaggctcacgtgctctctccactctgacctcaaagacttcgctggaaaatgctccgacgccgccaagatcgccggttttgctctagccacctctgctctcgttgtctcgggggccggtgcggagggagcaccaaagaggctaacgtacgacgagatacagagcaagacttacatggaggtaaagggtaccggtacggcaaaccagtgtccaactatcgatggtggctctgagacattctcgttcaaagctggtaagtacacaggcaagaagttctgcttcgagcccacttccttcaccgtcaaggcagatagcgtcagcaagaatgcaccgccggatttccaaaacaccaagctcatgacccgtctcacttacacactcgatgagatcgaaggacccttcgaggttggttcagacggaagcgtgaagttcaaggaagaagatggtatcgattacgcagcagtcacagtccagcttccgggaggagaacgcgtgccgttcctcttcacggttaagcagctcgaggcttcagggaaacccgaaagcttcagtggcaagttcttagttccatcgtaccgtggctcgtcctttttggacccaaagggtcgtggtggatccactgggtacgataatgcagtggctttgcctgccggaggcagaggagacgaggaagagctatccaaggaaaacgtcaagaacacggcggcttccgtcggagagatcactttgaagatcacaaagagcaaaccggagacaggtgaagtgatcggagtgttcgagagtcttcagccatcggatactgacttgggtgctaaggtaccaaaagatgtgaagatccaaggggtttggtacggtcagattgagtga

SEQ ID NO: 1487 - DNA, 1281 bp, Arabidopsis thaliana
atggcaaaaaactgtaatttagtcagtgttctatgtgtatttttggtattgaccctctttaacaaacccatcaccgtcgccgggcagaatattccggcggtgggcttgttcacctttggtgactccaacttcgacgccggaaacaaacagactctcaccaaaaccttactccctcaaactttctggccgtatggaaaatcccgagatgatcccaacggcaaattctccgacggcctcatcgctccagacttcctcgctaaattcatgaggattccgatcgtgatcccgccggcccttcaaccgaacgtcaatgtctcacgtggagctagtttcgccgtcgctgatgctactctactcggagctccggtggaatctttgactctgaatcaacaagtgagaaagttcaatcaaatgaaagcagcaaattggaatgatgatttcgtgaagaagtcagtgtttatgatatacattggtgcaaacgattacttgaatttcaccaagaacaaccctaacgccgatgcatctactcaacaagcttttgtcacttccgtgaccaacaagttaaagaacgatatcagcttgttgtattcatcaggagcgagtaaatttgtgatccaaaccctagctccattgggttgcttacccatcgtcagacaagagttcaacaccgggatggatcaatgctatgagaaactcaacgatttggctaaacaacacaacgaaaaaattggaccgatgttgaacgaattggctagaacagctcctgcatcagctcctttccaattcaccgtctttgatttctacaacgcgattcttactaggacgcagaggaaccaaaacttccgtgagttggttaattatcatggatttttcgttacgaacgcatcgtgctgcggagttgggacacatgatgcttatggttgcggttttcctaacgtacattcgaggctatgcgagtaccaacggtcttacctattcttcgacggacgtcacaacactgagaaggcgcaagagatgtttggtcatcttctttttggagccgatacaaatgttatccaaccgatgaacatccgtgagcttgtcgtttaccctgccgatgaacctatgcgtgagtcttgggtgcccccaacgtcagccaccgttcaactcagggagagccgcgcggacccaaatgttatccaacctatgaatgttcgtgagctcattgtgtatcctgttaatgagcctatgcgtgagttttgggaggatccaatggatgagaatatcatcgttagtccatga

SEQ ID NO: 1488 - DNA, 1059 bp, Arabidopsis thaliana
atgggaagacattcttgttgttttaagcagaagctaagaaaaggcctttggtctcctgaagaagatgagaaacttctcaattacatcactagacatggtcatggctgttggagttctgtccctaaactcgcaggtttgcaaagatgtggaaagagttgtagacttaggtggataaattatttgagaccagatttaaagagaggagctttctctcaagacgaagaaagcttgatcattgagctccatgctgcattaggcaacagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatctacagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacatggtgtttgatcagagcctttag

SEQ ID NO: 1489 - DNA, 1347 bp, Arabidopsis thaliana
atgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgtgatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaacgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttag

SEQ ID NO: 1490 - DNA, 1545 bp, Arabidopsis thaliana
atggacaccgcaaccaccacatgctctgccgtagatctatctgccctcctatcctcttcttctaactcaacatcttccctcgccgcggcaacctttttatgttcccaaatttcaaacatctccaacaaactctccgacacaacttatgccgtcgacaacacgtatctcctcttctccgcctaccttgtctttgccatgcagctcggtttcgctatgctttgtgctggatcagtccgagccaagaacactatgaacatcatgcttaccaatgtccttgatgctgccgctggagccatctcttactacctcttcggattcgcattcgcctttggtacaccttccaacggattcatcggtcgccaccatagcttcttcgctttaagctcttaccctgaacgccccggctccgacttcagctttttcctctaccaatgggcttttgccatagccgcggccggaatcactagcggttccatcgccgagcgaacgcaattcgttgcttaccttatctactctactttcttgaccggttttgtttacccgacagtctcgcactggttctggtcaagtgatggatgggctagcgcgtcccggtctgacaacaatctcttgtttggctcaggtgctattgatttcgcaggttcaggagttgttcacatggtaggtggaattgccggtttatgtggagcgttagttgaaggaccaagaataggtagatttgaccggtcaggccggtccgtggctttacgtggtcacagtgcatcccttgtcgtgcttggtaccttcttgttgtggtttggatggtatgggtttaaccctggttcctttttaaccattcttaaaggctacgacaagtctcggccatattatggtcaatggagcgctgtaggtcgcaccgcggtcaccacaacgctttctggctgcaccgctgcgttgactactctattcagtaaacggcttttagcaggtcattggaacgttattgacgtatgcaacggacttctaggcggctttgcagctataacctccggatgtgccgtggtggagccgtgggctgctatagtatgtggctttgtggcatcatgggttttaatcggatttaacttgcttgccaagaaacttaaatatgatgacccactcgaggctgctcagctccacggtggatgtggagcatggggattaatctttaccgggctgttcgcaaggaaagaatacgttaacgagatttactccggtgataggccttacggactgttcatgggcgggggaggaaaactgctcgccgcgcagatcgttcagattattgtgatcgttgggtgggtgacggtaactatgggaccgttgttttatgggttacataagatgaatcttttgaggatatcagcagaagatgagatggcaggaatggacatgacacgtcatggaggatttgcttacgcatacaatgacgaagacgacgtgtcgactaaaccatggggtcatttcgctggaagagtggagcctacaagccggagctcgactcctacaccgaccttgactgtttga

SEQ ID NO: 1491 - DNA, 1677 bp, Arabidopsis thaliana
atggcttcttcagtcgtcttcgcggcaactgggtctctctccgttcctccattgaagtctcggagattctatgttaattcttcactcgactccgatgtttccgacatgagtgttaacgctccaaaggggttatttcctccagagcctgtaccatacaagggacctaagctgaaagtagccattataggagctggacttgcaggcatgtcgactgctgtagagcttctggatcagggtcacgaggtggatatatatgattcgaggacattcattggtggcaaagtgggttcttttgtagatagacgtgggaaccatattgaaatgggattacatgttttcttcggatgctacaacaatctcttccgtttgatgaaaaaggtgggtgctgagaaaaaccttctagtcaaagaccatactcatacatttataaacaaagacggcacaattggagagcttgattttcggtttcctgttggagctccaatccatggtattcgcgcatttttggtcacaaatcaactcaagccctatgacaaactaaggaattcactggctcttgcattaagccctgttgttaaagctcttgtcgaccccgatggagcaatgagagacattcgcaaccttgacagcataagtttctcggattggttcctgtcaaaaggtgggacacgggcaagtatccagagaatgtgggatcctgttgcttatgctctaggtttcatagactgcgataacatgagtgcgcgatgcatgcttacaatattctcattattcgctaccaaaacagaagcttctctgttgcgtatgctcaagggctctcctgatgtttacttgagtggtcctatcaaacaatatatcacagatagaggtggcagaatccatctaaggtggggttgcagggagatactttatgataaatcagcagatggagaaacttatgtcactggactagcaatttctaaggctacgaacaagaagattgtgaaagctgatgtatatgttgcagcatgtgatgtgccgggaatcaaaaggttacttccaaaagaatggagggaatctcggtttttcaacgatatatatgaactcgagggagtacctgtggttacagtacagctcagatacaatggttgggtcacggagttacaagacattgaacttgctaggcagttgaaacgagcggttggcttagataatcttctctacactcctgatgctgatttctcgtgctttgcggatcttgcactagcttcgcctgcagattattacatcgaaggacaaggcactttacttcagtgcgttctaacaccaggagatccgtatatgcgaatgccaaatgataagatcatagagaaagtagcgatgcaggtcactgagttgtttccatcgtcacgaggcctagaagtcacttggtcgtcggttgtaaaaatcgctcagtctctgtaccgtgaagcacccggaaaagatccattcagacccgatcagaagacgcccataaagaatttcttcctcgccggttcatacacaaagcaggattacatagatagtatggaaggagcaacattatcagggagacaagcttcgtcatacatctgtgatgctggtgaagaactagcagagctaaacaagaagctttcttcttctgcaactgcagttcctgatgagctaagtctggtctaa

SEQ ID NO: 1492 - DNA, 1593 bp, Arabidopsis thaliana
atgggtgattctactggtgagccggggagctccatgcatggagtcaccggtagagaacaaagctttgctttctcggtgcaatcaccaattgtgcataccgacaagacggccaagttcgaccttccggtggacacagagcataaggcaacggttttcaagctcttctccttcgccaaacctcacatgagaacgttccatctctcgtggatctctttctccacatgttttgtctcgactttcgcagctgcaccacttgtccctatcatccgggagaatctcaacctcaccaaacaagacattggaaacgccggagttgcctctgtctctgggagtatcttctctaggctcgtgatgggagccgtgtgtgatcttttgggtccccgttacggttgtgccttccttgtgatgttgtctgccccaacggtgttctccatgagcttcgtgagtgacgcagcaggcttcataacggtgaggttcatgattggtttttgcctggcgacgtttgtgtcttgtcaatactggatgagcactatgttcaacagtcagatcattggtctggtgaatgggacagcagccggatggggaaacatgggtggcggcataacgcagttgctcatgcccattgtgtatgaaatcattaggcgctgcggttccacagccttcacggcctggaggatcgccttctttgtacccggttggttgcacatcatcatgggaatcttggtgctcaatctaggtcaagatctgccagatggaaatcgagctaccttggagaaagcgggagaagttgccaaagacaaattcggaaagattctgtggtatgccgttacaaactacaggacttggatcttcgttcttctctacggatactccatgggagttgagttgagcactgataatgttatcgccgagtacttctttgacaggtttcacttgaagctccacacagcagggctcatagcagcatgtttcggaatggccaatttctttgctcgtccagcaggaggctacgcatctgactttgcagccaagtacttcgggatgagagggaggttgtggacgttgtggatcatacagacggctggtggcctcttctgtgtgtggctcggccgcgccaacacccttgtaactgccgttgtggctatggtgctcttctctatgggggcacaagctgcttgcggagccacctttgcaattgtgccctttgtctcccggcgagctctaggcatcatctcgggtttaaccggggctggagggaactttggatcagggctcacacaactcctcttcttctcgacctcacacttcacaactgaacaagggctaacgtggatgggagtgatgatagtcgcttgcacgttacctgtgaccttagttcactttcctcaatggggaagcatgttcttgcctccttccacagatccagtgaaaggtacagaggctcattattatggttctgagtggaatgagcaggagaagcagaagaacatgcatcaaggaagcctccggtttgccgagaacgccaagtcagagggtggacgccgcgtccgctctgctgctacgccgcctgagaacacacccaacaatgtttga

SEQ ID NO: 1493 - DNA, 957 bp, Arabidopsis thaliana
atggcaacggcgtcgtttaacatgcagtcagtgttcgctgctccttccggtgtattgactacacgcaacatcagaaacacaaaccaactcttcttcaagaggattgctccggtaggagtcagatgcatggctcagggcgatcctatcaaggaagatccttctgtgccctcgacctcgacttcggccactccaccacaaatgccacagtctcctcctccaccagttagcaagcctaaggtgagtacgaagtttggagatttgctagcgtttagcggtccagcacccgagaggatcaacgggagactagcaatggttggattcgtggcggccatcgccatggagttatcaaagggagaaaacgtgtttgctcagatctctgacggtggtgtcgggtggtttctaggaacaacagcgttgttgacgttggcatcgatggttccgttgttcaagggaataagggcagaggcaaagtcaaaagggttcatgacttcagacgccgagctatggaacggtcggtttgcgatgctcggtctcgttgcgttggccttcaccgagtacgtcactggtgggactctagagactgaaacaagacagagaaaagagaatctccgaggaaaacaaaagttgatggcgacgtctaagcttcaagctctctggaatcacccggcaggaccaaagacaattcatttctgggctccaacatttaagtggggtataagcattgctaacattgcagatttccagaaacctccagaaaatatttcgtaccttcagcaaattgctgtgacatgcactggaatgatttggtgtcgttgcagcactataattactcctaaaaactggaacctgtttagtgttaatgttgctatggcagctacagggatataccaacttactcgcaaaataaagtatgattatgtatctgaagcagaggctgctgttgaaattgaaggatga

SEQ ID NO: 1494 - DNA, 858 bp, Arabidopsis thaliana
atggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttag

SEQ ID NO: 1495 - DNA, 1413 bp, Arabidopsis thaliana
atggatttgcagagaggctttgtgttcttgtctttggttctatcttttatgataatcgaaacgacggcgtatcgagagagacagctgctgctgctgcaaccaccgcaagaaacggcgatagataccgcaaacgcggtggtgacggttcaagatcgaggtttgaagacgcggcgaccggagcataagaacgcatacgcaacgatgatgtacatggggacgccaagagactacgagttctacgttgcgacacgtgttttgatcagatcgttgagaagtcttcacgtggaagctgatctcgtcgtcatcgcttctctcgacgttcctctccgatgggttcaaaccttggaagaggaagatggagctaaagtggtgagagttgaaaatgtggataatccatacaggagacagaccaacttcaacagtagattcaagcttactctaaacaagctctacgcttgggctttgtctgattacgaccgtgtggtcatgctagatgccgataacctctttcttaagaaagccgacgagttgttccagtgtgggcgcttctgtgcggtcttcattaacccttgtatcttccacactggtctcttcgtgttgcagccatcagtggaagtgttcaaggacatgctccatgagctacaagttggaagaaagaatcctgatggagctgatcaaggttttcttgtcagttacttctctgatcttcttgaccaacctctctttagtcctccgagtaacggatctgtacttaatggtcacttgagacttcccttaggctaccaaatggacgcttcttatttctccgaaatgcctttggttataatccaagcaatgttttaccttggaatcatagtggttacacgactagctcgtcctaacataaccaagctatgttatcgccgctctgaccgcaacttaacaacgatccaagctggttttaagttgatcgcgcttctctctgtagttgcagcctacatcttcccattcttcaccatccctcacactatccacccactcatcggctggtcgctctacttgatggcttcttttgctctctcttccatttcaatcaacactctcctcctcccaacgctccctgttctcactccatggctaggaattctcggcactctccttgtcatggccttcccttggtaccctgatggagtggtcagagccttgtcagttttcgcatacgcattttgttgcgcaccctttgtgtgggtttcattccgcaaaatcacatcgcacctccaggttttgattgagaaagaggtgttgttcccgcgattgggagactcaggggtcacttcaggcttcagcaaattctccgaaacacacttgtatgcacctactcatcacagaaagatattgaacaaaataatgaatcattcactagaaaaactgtag

SEQ ID NO: 1496 - DNA, 2532 bp, Arabidopsis thaliana
atggaagagtttcgttttctctatttgatatattcagcagcatttgcattgtgtctcgtcgtttctgttcttgctcaagaccaatcaggtttcataagcatcgattgtggaattccaagtggatcatcgtacaaagacgacacaacaggtataaactacgtctcagattcatcctttgtcgaaaccggagtctccaaatcgatccctttcacagctcaaagacagcttcaaaacctgaggagctttcccgaaggttcaagaaactgctatacattgattccaatacaagggaagggcaagaaatatctcataagagctagtttcatgtacggtaactacgatggagaaaatggttcaccggagtttgatctgtttcttggtggcaatatttgggataccgtcttgctcagcaatgggtcgagcattgtttccaaagaagtcgtttacttgagccaatctgagaacatatttgtgtgtttgggaaacaaaggcaaaggaactccatttatctcgactttagagcttaggtttctcgggaacgacaatacgacatatgattctccaaacggtgctctcttcttctctagacgctgggacttacgctctctcatgggttcacctgttagatatgatgatgatgtgtacgacagaatctggatacctcgcaactttggctattgtagagagatcaatacctcactccccgtgacctcagacaataatagttatagtctttcaagtttggtgatgagcacagcgatgactccaataaacacaacaagacccatcacaatgactttggaaaacagtgatccaaatgtcaggtactttgtctacatgcacttcgcagaggttgaagatcttagtctcaaaccgaaccagacaagagagttcgacatcagcattaacggagtgacagttgctgctggattcagccccaagtatcttcagacaaacacgttttttctaaaccctgagagccaatcgaaaattgcgttttcactcgttcgaaccccaaagtccactcttccgccaattgttaacgctctagagatctacgtcgcaaatagtttctcgcagtctctcactaaccaagaggatggtgacgcggttacgagtctaaagacgagttataaagtgaagaagaactggcacggagatccttgtttgcctaatgactacatttgggagggccttaattgcagttatgatagtcttactcctccaagaatcacatcactgaacttatcatcaagcgggttaacgggtcatatatcttcctccttctctaacctcacaatgattcaagagctagacttatcaaacaatggcttaaccggagacattccggagttcctctcaaaactgaagttcttgagggttttaaatctagaaaataacactcttaccggttcagttccatccgagttattagaaagatcaaacaccggatcattctcgctaaggctaggagaaaatccaggactctgtactgagatttcttgcagaaaaagcaacagcaaaaaactcgttatcccgcttgtcgcatcatttgcagcattgttcatcctcttgttattgtctggtgtgttttggagaatcagaaaccggagaaacaatccaatggcgaaatcggagaacaaattactgtttacctttgcagacgttataaagatgacaaataacttcggtcaagtcctcggcaaaggagggtttggaacagtctaccatggcttctatgacaaccttcaagtagctgttaaacttttatcagaaacatcagctcaaggattcaaagagtttcgctctgaggtcgaagttcttgtgagggttcatcatgttaacctcactgcgctgatcggttatttccatgaaggtgaccaaatgggattgatctatgagttcatggctaacggcaacatggcggatcatctcgcgggaaagtatcagcacacattgagctggagacaaaggcttcagattgcacttgatgcagcacaagggcttgagtatcttcactgtggatgcaaacctccaatagtccacagagatgtgaagacttcaaacatattgttgaacgagaaaaacagagcaaagcttgcagatttcggactctcacggagttttcatacagagagtcgttctcacgtatccaccctagtcgctggaactcccggatatctcgatccgctatgctttgagacaaatgggctaaacgagaagagtgacatttacagctttggagttgttctgttggagatgattacaggcaaaaccgtgatcaaagagtcacaaacgaaacgtgttcatgtgagtgattgggtgatatcgatcttgaggtctacgaatgatgtgaacaatgttatagattcaaagatggcgaaagattttgatgtaaactctgtatggaaagttgtggagcttgcattatcctctgtttcgcagaacgtctctgataggccaaacatgccacatattgttagaggattgaatgagtgtcttcaaagagaagagagtaacaagaactattga

SEQ ID NO: 1497 - DNA, 2052 bp, Arabidopsis thaliana
atggaacatgtcagagttatcttcttctttgcttgtttcctaacgcttgctccatttcatgcctttgctcaggtagattcctatgagtttgatccagatttcaactgtgttgatcgtggcaacttcacggcgaacagcacttttgccgggaatctcaaccgccttgtctcctccctctcctcactcaaatcccaagcttatggcttctacaacctctcttctggagactcatctggagaaagagcttatgcaattggtctgtgtagaagagaagtcaaaagagatgattgtgtcagctgtattcagacagctgcaagaaacctcaccaagcagtgtccgctgacaaaacaagctgttgtatggtacacgcactgtatgtttcgttactcaaacaggacaatctacggaagaaaagaaacgaacccgactaaggcttttattgctggtgaagagatatcagcaaacagagatgactttgagcgtctgcagagaggactattggacagactcaaaggaattgcggctgctggtgggcctaataggaaatacgctcaaggaaacggttcagcttcggctgggtaccggagattctatggaactgtgcaatgtacgccagatttgtctgaacaggattgtaatgattgtttagtttttggttgtaacttccggtttgagacgtggagattctacgagtttgatgccgacctagagccagatccacctgcaattcagcctgctgattcaccacaatcagctgcaagaactgagaggacaggaaagggcaaaggtggatctaaagtcattatcgcgatagtcatcccgatacttcttgttgcgttactcgcaatttgcctatgcttggtcttgaagtggaggaagaacaagtctggatataaaaacaaaggtaacacagtgttcttcttcgtgttatcgttatcttttcttgggaaatcacctttgtcgggttcaattgccgaggatgagttctcgaacacagaatcactcttagttcattttgagactctaaagacagcaacagataacttttcttcagaaaacgaacttggacgtggtgggtttggttcagtttataagggtgtgttccctcaggggcaagaaatcgcggtgaagagattatcgggtaattctggacaaggagacaacgagttcaagaacgaaatattactacttgcaaagcttcaacataggaacttggtcaggcttataggtttctgcatacaaggagaagaaagactccttgtctatgagttcatcaagaacgctagtcttgaccaatttatcttcgatactgagaagcgtcaacttttggattgggtagtgcggtacaaaatgatcggaggaattgctagaggactcctttatcttcatgaagactctcgtttccggataattcatcgtgatcttaaagctagcaacattcttttggaccaagaaatgaatccgaaaatcgcagattttggattagctaaactctttgactcaggccaaaccatgacacatcgattcacaagcaggattgcaggaacttacggatatatggctccggaatacgcaatgcatggacaattctctgtgaaaacagatgttttcagcttcggtgtattagtcattgagatcattacaggtaaaagaaacaacaatggtggatcgaatggtgacgaagatgcagaagatcttcttagttgggtaagtacagtatccaaaaccaagctagtaaatggggtgtggagaagctggagagaagacactatactaagcgtgatcgatccgagtttaaccgcaggatcaagaaatgagatcttgagatgcatacacattggtcttttatgtgtgcaagaaagtgcagcgactagaccaacaatggctacggtttctctcatgctcaatagctattcttttaccctcccgacgcctttgaggcctgcgtttgtgttggagagtgtcgtcataccttcaaatgtttcttcttcaacggaagggttacaaatgtcgtcaaatgatgttactgtttctgagttttctcctcgttaa

SEQ ID NO: 1498 - DNA, 966 bp, Arabidopsis thaliana
atggcagcttctaagcgactagttgtctcttgcttgttcttagttttgttgtttgctcaagccaattcgcaaggtttgaaagtaggtttctacagcaaaacatgcccacaactcgagggtatagttaaaaaggtcgtgttcgatgcgatgaacaaagcaccaacacttggtgctcctttgcttagaatgttcttccacgactgcttcgttcggggatgtgacggatcagttttgttagataaaccaaacaatcaaggtgagaagagtgcagttcctaacctaagtcttcgagggtttggcatcatagacgattccaaggcggctctagaaaaagtgtgtccgggaattgtttcttgctctgatatcttggcacttgtcgctagagacgcaatggttgcacttgaaggaccatcatgggaagttgaaacgggaagaagagacggtagggtttctaacatcaacgaagtcaacttgccatcaccttttgataacatcaccaagcttatcagcgattttcgctcaaagggcctcaacgagaaggatctagtcattctctcgggtggtcacacaattggaatgggacattgtcctttattgacaaaccggctttacaacttcaccggaaaaggagacagcgacccaagtttggactcggagtacgccgctaagctcaggaagaaatgcaagcccaccgatacgacgacggctctagagatggatccggggagtttcaaaacatttgacttgagctacttcacgctagtggctaagagaagaggacttttccagtcggatgctgctctactcgacaactccaagactagggcttatgtcttgcaacagataagaactcatgggtcaatgttctttaacgactttggtgtctctatggtgaaaatgggtcggactggagttcttacgggtaaggccggggagatccgtaagacgtgtcggtctgctaattaa

SEQ ID NO: 1499 - DNA, 1509 bp, Arabidopsis thaliana
atggaagatatcatcatcggcgtggtggctctcgccgcggttctccttttcttcctctaccaaaaaccgaaaaccaaacggtacaagctacctccagggccatcaccacttccggtgatcggaaacctccttcagcttcagaagcttaacccacaacgcttcttcgctggatgggccaaaaaatacggtccaatcttgtcatacaggataggaagcagaacaatggtggtgatatcttcagctgagctagctaaagagcttctcaagacgcaagatgtcaactttgcggaccggcctccacatcgtggccatgagttcatatcctacggcaggcgtgacatggcattaaaccactacacaccgtattaccgagagataaggaagatggggatgaaccacttgttctcaccaacacgtgtggccacctttaagcatgtacgagaggaagaggctaggaggatgatggataagatcaacaaggccgcggataaatccgaagtagtcgatataagtgagcttatgttgaccttcacgaactcggttgtgtgtagacaagcgttcgggaagaagtacaatgaagatggagaagagatgaagaggttcatcaagattctttatgggactcaaagcgttttggggaagatctttttctctgattttttcccatattgtggctttcttgatgatttatcaggcctcacagcttatatgaaagagtgtttcgaaagacaagacacttatattcaagaggttgtcaatgagacgcttgatcctaagagagtcaagcccgaaaccgagagcatgattgatctcttgatggggatctacaaagaacaacctttcgcttctgagtttactgtagataatgtcaaagccgtcatcttggatattgtagtggcgggaacagatactgcagctgcggcggttgtgtgggggatgacgtatctaatgaagtacccacaagtgttgaagaaagctcaagcagaagtgagagagtatatgaaagagaaaggttcaacgttcgttactgaagacgatgtcaagaaccttccttacttcagagccttagttaaagaaaccctaaggatcgaaccagtgattcctctccttatccctcgtgcttgcattcaagataccaagatcgccggttacgacatccccgcaggaacaacggtcaacgtcaacgcgtgggccgtgtcacgtgacgagaaagaatggggaccgaaccctgatgagtttaggcccgagaggtttcttgagaaggaagttgacttcaaaggcacggactacgagtttataccgttcgggtcaggccggagaatgtgcccgggaatgcgtcttggggccgcgatgcttgaggttccttatgcgaaccttctcctcagcttcaactttaaacttcctaatgggatgaaaccagatgatatcaatatggatgtcatgactggtcttgctatgcacaagtcgcagcatctcaagcttgttccagagaaagtgaacaagtattag

SEQ ID NO: 1500 - DNA, 1827 bp, Arabidopsis thaliana
atggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatga

SEQ ID NO: 1501 - DNA, 534 bp, Arabidopsis thaliana
atggagaatatgggaactagagtgatagagccattgataatggggagagtggtaggagatgttcttgatttcttcactccaacaactaagatgaatgttagttataacaagaagcaagtctccaatggccatgagctctttccttcttctgtttcctccaagcctagggttgagatccatggtggtgatctcagatccttcttcactttggtgatgatagacccagatgttccaggtcctagtgacccctttctaaaagaacacctgcactggatcgttacaaacattcccggcacaacagatgctacgtttggcaaagaggtggtgagctatgaattgccaaggccaagcatagggatacataggtttgtgtttgttctgttcaggcagaagcaaagacgtgttatctttcctaatatcccttcgagagatcacttcaacactcgtaaatttgcggtcgagtatgatcttggtctccctgtcgcggccgtcttctttaacgcacaaagagaaaccgctgcacgcaaacgctag

SEQ ID NO: 1502 - DNA, 1977 bp, Arabidopsis thaliana
atgggcacggaggactacacattccctcaaggagcggaggagcttcaccgccgccaccacacggtggaggctccacaacctcaaccgttcttgaagtcacttcagtactcagtgaaggaaactctgtttccagacgacccttttagacaatttaagaaccaaaatgcatcaagaaaatttgtgttaggcctcaaatacttcctcccgattttcgaatgggcaccacgctacaatctcaagttcttcaaatcagatctcatcgccggaatcaccatcgctagtctcgccatccctcagggcatcagttacgccaaacttgctaacttgcccccaattcttggcctttattcgagttttgtaccgccattggtatacgcggtgctagggagttcaagggacttagcggtgggaacggttgcggttgcgtctctgttgacaggtgcgatgctgagcaaagaagttgatgctgagaaagatcctaagctttaccttcaccttgctttcaccgccacttttttcgccggcgttctcgaagcctctcttggaattttcagggttagggttcatagtggactttctatcgcatgcaacgatagtaggattcatgggaggagcagcgacggtggtgagtctgcaacagcttaagggtattttcggacttaaacatttcacagactctaccgatgttatctctgtcatgcgttccgttttctcccaaactcacgagtggagatgggaaagtggcgttcttggatgtggttttctattctttcttctctccaccagatatttgagcatcaagaaaccaaaattcttttgggtggcggcgatggctcctttgacctcagtgattcttggaagtctcttggtttacttcactcacgctgagagacatggtgttcaagtgataggggacctgaagaaagggttgaatccactctccggttctgatctcatctttacttccccttacatgtccacagctgtcaaaactggcctcatcactggcatcattgctctcgcgaaggagtagcagtggggaggagttttgcgatgttcaagaactacaacatagacgggaacaaagagatgatagcgtttggaatgatgaacatcgttggttccttcacatcttgttacctcacaaccggaccattttcaaggtcggcagtgaactacaacgcgggttgcaagaccgcaatgtccaacatagtgatggcgattgcggttatgttcacactcctcttcctcacaccgctttttcactacacaccactcgtcgtcctctctgccatcatcatatccgcaatgctcggactcattgactatcaagctgccatccatctctggaaagttgacaagttcgacttcctcgtctgcatgagcgcctacgttggggtcgtattcggcagtgtagagattggactcgtcgtagcggtggcgatatctatagcgaggttgttgctgtttgtgtcgaggccaaaaactgcggtgaagggaaacataccaaacagcatgatctataggaacactgagcagtacccatcatcaagaaccgttcctggtattctcatcttggagattgatgctcccatctactttgctaatgccagttacttgcgtgaaagaatcataaggtggattgatgaagaggaagagagagttaaacaatcaggagagagcagcttacaatatattatactcgatatgtcagctgttggtaatatcgacacaagcggtattagcatgatggtggaaattaagaaagtcattgacaggagagcgttaaagttggtattgtcaaatccaaaaggagaggtcgtgaagaaattaaccagatccaaattcatcggtgatcatttgggcaaagagtggatgttcttaacggtaggagaagcagtggaggcttgtagctacatgcttcacacgtttaaaaccgaaccggcctccaaaaacgagccttggaacaacgtatag

SEQ ID NO: 1503 - DNA, 603 bp, Arabidopsis thaliana
atgactcgctcctctagattccttggtacggcgtcgcctccaccaccggaagaaatcctcgccgccgaaaccgacatggttgtgattctctcagcacttctctgcgctctcgtatgcgtagccggtttagccgccgtagctcgctgcgcttggctccgccgtctcaccggagttaatcccgccgccgtcggagaagctccaccgcctaacaaaggcctcaagaaaaaagcacttcaagctctccctaaatcaacttacaccgcctctgcctctaccgccgccgccgctgacgatctaccgtgctcttcagtcggagacggagattcatccaccgagtgtgcaatatgcataacggaattttcggagggcgaagaaatcagaatcttaccgctgtgtagtcacgccttccacgtggcgtgtatagacaagtggttgacttcacggtcgtcgtgtccgtcttgtcgtcggatactggtgccggtgaagtgtgataggtgtgggcaccatgcttcgacggcggagactcaggtcaaagatcaacctcctcatcaccaacatccttcacagttcacttccgccattattcctgcttttcttccttga

SEQ ID NO: 1504 - DNA, 2580 bp, Arabidopsis thaliana
atgttcggagaacttagggatctgctcaccggcggcggaaatgagacgacgacgaagaaggtgaaaggaacggtggttctgatgaagaagaacgtcctcgatttcaacgatttcaatgcttcgtttctcgatcgtcttcatgaatttctcggaaacaaaatcactcttcgtcttgtaagctctgatgttactgattcagaaaacggttctaaaggcaaactagggaaggctgctcacttggaggattggatcacaacaatcacgtcgttaaccgcaggcgaatccgctttcaaggtcacgttcgattacgaaaccgatttcggttaccctggagcattcttgatcagaaacagccatttcagtgagtttcttctcaaaagtctcacacttgaagacgttccaggccatggcagagtccattacatctgtaattcttggatttaccctgctaaacactacactacagaccgagtcttcttctccaacaagacttatcttccacatgaaacaccagcgacgctgctcaagtatagagaagaagagctagtgagtttgagaggaaccggcgaaggagagcttaaggaatgggacagagtatatgactatgcttactacaatgatttaggcgtcccaccaaagaacccacggcctgtacttggagggacacaggagtatccttacccaagaagaggaagaaccgggcggaaaccaactaaagaagatcctcaaaccgagagcaggctaccgatcacatcgagcctagacatatatgttccacgagatgagagatttggacacttgaagatgtctgatttccttgcttatgctctaaaagcgattgctcagttcatccaacctgcacttgaggctgtattcgacgatactcctaaagagtttgattcttttgaagatgttcttaagatctatgaagaaggaatcgatctaccaaaccaagctttgattgatagtatcgttaagaatataccgcttgagatgttaaaggagatattcagaacagatggccagaaattccttaagtttccagtgcctcaggtcatcaaagaggacaaaactgcatggagaacagatgaggaatttgctagagaaatgttggctggactaaaccctgttgttattcaacttcttaaggagtttcctccaaagagtaagcttgacagtgaatcatacggtaaccagaacagtacaatcactaaaagccacatagaacacaatttggatggactcactgttgaagaggctctggagaaggagaggttgtttatattagaccaccatgacacactgatgccatacttgggacgcgtaaacaccaccacgaccaagacttatgcaagcaggacacttctgttcttgaaagatgatgggaccttgaagccgttggtgatagagctgagcttgcctcatcctaatggagacaaatttggagcagtgagtgaagtatatacgcctggtgaaggtgtctacgactcgctatggcagttggctaaggcttttgtcggtgtaaatgactccggaaatcatcagcttattagccactggatgcaaacacacgcatcgattgaaccgtttgtgattgccacaaacagacagctgagtgttcttcacccggtctttaagctccttgaacctcacttccgtgatacgatgaatatcaatgcacttgctaggcaaatcttgatcaatggtggtggtatatttgaaatcactgtgtttccttctaaatacgccatggagatgtcatctttcatttacaaaaaccactggaccttccctgaccaagcattaccagcagaacttaaaaagagagggatggccgttgaggatccagaagcaccacacggattacgtctgaggataaaagactatccttacgcagtggatgggcttgaggtttggtatgctattgaatcatgggtccgagactacattttcttgttctacaagatagaggaggatatccaaaccgacacagagctccaagcctggtggaaggaggtgcgcgaggaaggtcatggagacaaaaagtcagaaccatggtggcctaaaatgcaaacccgtgaagaacttgttgagtcttgcaccatcattatttgggtggcttctgctcttcatgcagctgttaacttcggacagtatccagttgctgggtacctcccaaacagaccgactataagccgtcagtacatgccaaaggaaaacactccagagtttgaagaacttgagaagaatcctgataaagtgtttttgaagaccatcacagctcagcttcagacacttctagggatatctctgattgagattctctctactcattctagcgacgaggtctatttgggacagagagattctaaagaatgggcggctgagaaagaagcgttggaggcgttcgagaagtttggagagaaagtaaaggagattgagaagaacattgatgagaggaacgacgacgagactctcaagaacaggactggtttggttaagatgccatacactttattgtttccgagcagtgaaggcggagtcaccggcaggggaattccaaatagcgtctctatctga

SEQ ID NO: 1505 - DNA, 939 bp, Arabidopsis thaliana
atgccaccggccggagaactccgacatcaatctccatcaaaggagaaactatcttccgttacccaatccgatgaagcagaagcagcgtcagcagcgatatctgcggcagctgcagatgcggaagctgccggattatggacacagatcaaggcggaagctcgccgtgatgctgaggcggagccagctttagctagctatctatattcgacgattctttctcattcgtctcttgaacgatctatctcgtttcatctaggaaacaagctttgttcctcaacgcttttatccacacttttatacgatctgttcttaaacactttttcctccgatccttctcttcgtaacgccaccgtcgcagatctacgcgctgctcgtgttcgtgatcctgcttgtatctcgttctctcattgtctcctcaattacaaaggcttcttagctattcaggcgcatcgtgtatcacacaagctatggacacaatcacggaagccattagcattagctctacactcaagaatctccgatgtattcgctgttgatatccatccagcagcgaagatcggaaaagggatacttctagaccacgcaaccggagttgtagtcggagaaacagcggtgattgggaacaatgtttcaatccttcaccatgtgacactaggtggaacaggtaaagcttgtggagatagacatccgaagatcggtgacggttgtttgattggagctggagcgactattcttggaaatgtgaagattggtgcaggtgctaaagtaggagctggttctgttgtgctgattgacgtgccttgtcgaggtactgcggttgggaatccggcgagacttgtcggagggaaagagaagccaacgattcatgatgaggaatgtcctggagaatcgatggatcatacttcattcatctcggaatggtcagattacatcatataa

SEQ ID NO: 1506 - DNA, 1563 bp, Arabidopsis thaliana
atggagtcttctatatcacaaacactaagcaaactatcagatcccacgacgtctcttgtcatcgttgtctctcttttcatcttcatcagcttcatcacacggcggcgaaggcctccatatcctcccggtccacgaggttggcccatcataggcaacatgttaatgatggaccaactcacccaccgtggtttagccaatttagctaaaaagtatggcggattgtgccatctccgcatgggattcctccatatgtacgctgtctcatcacccgaggtggctcgacaagtccttcaagtccaagacagcgtcttctcgaaccggcctgcaactatagctataagctatctgacttacgaccgagcggacatggctttcgctcactacggaccgttttggagacagatgagaaaagtgtgtgtcatgaaggtgtttagccgtaaaagagctgagtcatgggcttcagttcgtgatgaagtggacaaaatggtccggtcggtctcttgtaacgttggtaagcctataaacgtcggggagcaaatttttgcactgacccgcaacataacttaccgggcagcgtttgggtcagcctgcgagaagggacaagacgagttcataagaatcttacaagagttctctaagctttttggagccttcaacgtagcggatttcataccatatttcgggtggatcgatccgcaagggataaacaagcggctcgtgaaggcccgtaatgatctagacggatttattgacgatattatcgatgaacatatgaagaagaaggagaatcaaaacgctgtggatgatggggatgttgtcgataccgatatggttgatgatcttcttgctttttacagtgaagaggccaaattagtcagtgagacagcggatcttcaaaattccatcaaacttacccgtgacaatatcaaagcaatcatcatggacgttatgtttggaggaacggaaacggtagcgtcggcgatagagtgggccttaacggagttattacggagccccgaggatctaaaacgggtccaacaagaactcgccgaagtcgttggacttgacagacgagttgaagaatccgacatcgagaagttgacttatctcaaatgcacactcaaagaaaccctaaggatgcacccaccgatccctctcctcctccacgaaaccgcggaggacactagtatcgacggtttcttcattcccaagaaatctcgtgtgatgatcaacgcgtttgccataggacgcgacccaacctcttggactgacccggacacgtttagaccatcgaggtttttggaaccgggcgtaccggatttcaaagggagcaatttcgagtttataccgttcgggtcgggtcgtagatcgtgcccgggtatgcaactagggttatacgcgcttgacttagccgtggctcatatattacattgcttcacgtggaaattacctgatgggatgaaaccaagtgagctcgacatgaatgatgtgtttggtctcacggctcctaaagccacgcggcttttcgccgtgccaaccacgcgcctcatctgtgctctttaa

SEQ ID NO: 1507 - DNA, 1416 bp, Arabidopsis thaliana
atggctatagaagaaaaccgaagtcacaacgattatcttaggaggatgacttttgcagcgttcttgaaatctggttctctcgccgccgaggaagaaacttaccacagcgacggtgatcatcataaccaaagcacctttagcagcaacagcgattctcagcggccaagcaacgcttcaagtgctagtagcgattcgtcatcaccaatctacccattatctccatggaaccaaacttactacccaagcaacgacaacacgacgtcgttttcatctgttactcaatcaccatggaaccaaacttactctccgtaccacaaatctccatggatttaccaaaccaggaacagtgatttcgaggatgatcctgataacggtttgatcggtacggtcgtgagacaagaaggacacgtgtactctctcgctgcttcaggtgatcttcttttcaccggttctgattccaagaacattcgggtttggaaagatcttaaagatttctccgggtttaaatccacaagcggttttgttaaagccattgtagtaaccagagataaccgggttttcaccggtcatcaggatggtaaaatccgggtatggagaggatcaaagaagaaccccgagaaatattcacgagtcggaagtttaccaactcttaaagaatttctcaccaaatcggtaaatcctagaaactacgtcgaagtccgtcgccggaaaaacgttttgaagatccgacatttcgacgctgtgtcttgtctgagcttaaacgaagatctcggtttgctctactccggttcttgggacaagactcttaaggtctggagattgtccgattcaaaatgtttagaatcaatcgaagctcacgacgatgccgttaacacggtggtttccggtttcgacgatttggtatttaccggttcagccgacggaacgttgaaagtatggaaacgtgaggtacaaggcaaagagatgaagcatgttttggtacaagtgttaatgaaacaagagaacgcagtaacggcgttagctgttaatttaacggacgctgttgtttactgtggttcgtctgacggaaccgttaacttctgggaacggcaaaagtatttgactcacaaagggacgattcacggccaccgtatggcggttttgtgtctcgccaccgccgggagtttgcttttgagcggtggagctgataagaatatttgcgtttggaaaagaaacggggacggatcgcatacgtgtctctctgttttgatggatcatgaaggaccggttaagtgtttagcggcggtggaagaggcggaggaagatcataacgacggagacgacggtggagagaaaggggatcaacggtggatagtgtatagtgggagtttagacaactccgttaaagtgtggcgcgtgacggattacgcttcgtaa

SEQ ID NO: 1508 - DNA, 1479 bp, Arabidopsis thaliana
atggagcgatctcgctcagaaacgccatcgtctcgctcacgattgaagctgtgcttcataaactcgccgccatcatcgatattcacggggtccaagatcgaagctgaggatggttctccgcttgtgatcgagctcgtggacgccaccacaaacactctagttagtacgggaccgttctcgtcttctcgggtcgagctcgtgccgctgaacgctgatttcacggaagaaagctggaccgttgagggatttaatcggaatattctcacgcaacgtgaagggaaacgtccgttgctcactggagacctaacggtgatgcttaaaaacggtgttggagttataaccggagatatagctttctcggataactcgagctggactaggagtcggaagttccggttaggtgctaagttgaccggagatggagccgtggaggcgagaagtgaagcttttggatgtagagaccaacgaggagaatcttataaaaaacatcatcctccgtgccccagtgatgaggtttggagactagagaaaatcgcgaaagatggagtttcggcaacgcgtttggctgaacgcaagattttaaccgtcaaggattttcgccgtttgtatactgtaaatcgaaatgagttacacaacataattggtgcaggggtctcaaagaaaacatggaacacaattgtatcacatgccatggattgcgttttggacgaaacagagtgttacatttacaatgcaaacactccgggcgtaacacttctcttcaactctgtttatgagttgataagagtgtcattcaatggcaacgatatccaaaaccttgatcagccaattctagaccaattaaaggccgaagcttatcaaaaccttaaccgcattacagcggttaacgataggacctttgtgggtcatccacaaaggtccttacagtgcccgcaagatcctggatttgtcgtaacatgttctggatcgcagcacatcgactttcaaggaagtttggatccatcaagctcttcgatggctctttgccacaaagcttcaagctcaacggtccaccctgatgtcctgatgagttttgataactcatcaaccgcgaggtttcatatcgacaaaaagttcttaccgactttcggaaacagcttcaaagtaagtgaactcgatcaagtacacggaaaatcacaaactgttgtgacaaaaggttgtatagagaataacgaggaggatgagaacgcgttttcttatcatcaccatgatgacatgacctcaagctggtcacctggtacgcaccaagccgttgaaacgatgtttcttaccgtgtctgagacggaagaagctggaatgttcgatgttcattttgcaaacgttaatttgggatctccaagagccaggtggtgtaaggttaaggcagctttcaaggttagggcagcttttaaggaagtccggagacacacaactgccagaaatccgagggaaggcttgtaa

SEQ ID NO: 1509 - DNA, 1227 bp, Arabidopsis thaliana
atgggatctcaagacccttgtatatacagagtgccaagccagttgcgtgaagtgaatccagaagcttatagacctcggatgcttctcatcggccctcttactcattccaagaaacctaaagttcatacggattcaaggtatctagaatataagatgatggaggaccaaaaggtgttgtacaaagacgctttcaccaaaaggctagatactgatattgctattcttgaggatatgaagaccaccataaaagacgaagaagtaaatattcgagcaagctatgcggtatcgactgcatggatattatccgatatattcgtggagcttatacttaacgattcaatttttatcgtggagttcattctcagaatgtatgaaagtcatgaaaaaattggtgacatgattgtggacaaacctttttacacttccacggttcttgatgaccttaccttgctcgagaatcagcttccttacttctgtttaagtaagttgttaaaccccattacaaagagattttgtggagatcagtcgctggaccaagtcatcctccagttattttcagtcaatgatagtggcatgatcaatgagaatacaaagttcaatcacttcacagatttattccggtgtgtttacaaggaatcacttggccagaatctagagttgaacaactcgaaaagccagatcgtggatatgaagagcgcgaatatgctatacagtgtaggagtggacttcaaggtagtgaagcgtgagtattcactgaatgtatcattcgaggaaggttgcttaatattgccgagttttcctgccgatgaatcttctaatatcatccttagaaatgtcatcgcatatgagcaatgccatgatcctgaaaatgcctttactacaaattacataaatttcatgaatttccttattacctccgatgaagacgtggctatactcacttcagcaggagtgctaacaaacggtgtggggcggtcaagcatggtactgaagatggtgaataacttagctataggagtgttgctatcgaatcagagccaatatcacgacattgttgagaaactcaacattcaccatagttctcgtaggaaaaggatatgggcgaaactaagaaaagtctacttcagcgacttatggacgacaacagctacgttagctgccatatctcttttgctactgactctagctgggacagtggcttccatttttcaagctatcaagagctaa

SEQ ID NO: 1510 - DNA, 1572 bp, Arabidopsis thaliana
atggatgatgataagtcaacgggtggatacgcgttgagagggcttttctcgtattctgcttctaatttcatcatcttggtattaccttgtgtgggtggtgatgctctaagtgcactgaaaaacagtttagccgaccctaataaggtgcttcaaagttgggatgctactcttgttactccatgtacatggtttcatgttacttgcaatagcgacaatagtgttacacgtgtgcgtcttaataacaatagcttatctggagaaattccaaggtctttgactgctgtcctgacgctacaagttctttttgccaacaccaagttgactccccttcctgcatctccaccgcctcctatctctcctacaccgccatcacctgcagggagtaatagaattactggagcgattgcgggaggagttgctgcaggtgctgcacttctatttgctgttccggccattgcactagcttggtggcgaaggaaaaagccgcaggaccacttctttgatgtaccagctgaagaggacccagaagttcatttaggacaactgaagaggttttcattgcgtgaactacaagttgcttcggataattttagcaacaagaacatattgggtagaggtggttttggtaaagtttataaaggacggttagctgatggtactttagtggccgttaaaaggctaaaagaggagcgcacccaaggtggcgaactgcagttccagacagaggttgagatgattagtatggcggttcacagaaacttgcttcggcttcgtggattttgcatgactccaaccgaaagattgcttgtttatccctacatggctaatggaagtgttgcctcctgtttaagagaacgtcccgagtcccagccaccacttgattggccaaagagacagcgtattgcgttgggatctgcaagagggcttgcgtatttacatgatcattgcgacccaaagattattcatcgagatgtgaaagctgcaaatattttgttggatgaagagtttgaagccgtggttggggattttggacttgcaaaactcatggactacaaagacacacatgtgacaaccgcagtgcgtgggacaattggtcatatagcccctgagtacctttccactggaaaatcatcagagaaaaccgatgtctttgggtatggagtcatgcttcttgagcttatcactggacaaagggcttttgatcttgctcgcctcgcgaatgatgatgatgtcatgttactagactgggtgaaagggttgttaaaagagaagaaattggaagcactagtagatgttgatcttcagggtaattacaaagacgaagaagtggagcagctaatccaagtggctttactctgcactcagagttcaccaatggaaagacccaaaatgtctgaagttgtaagaatgcttgaaggagatggtttagctgagagatgggaagagtggcaaaaggaggaaatgttcagacaagatttcaactacccaacccaccatccagccgtgtctggctggatcattggcgattccacttcccagatcgaaaacgaatacccctcgggtccaagataa

SEQ ID NO: 1511 - DNA, 1179 bp, Arabidopsis thaliana
atgtcgccgtcaatgatagctccggtgatggaagaagagaacaagaaataccaaaaaggcgtgaaacatctttgtgaaaatggtctgaccaaagtaccaaccaagtatatatggcctgaacctgaccgacccatcttgacaaaatcggacaagctcatcaaaccaaacaaaaacctaaagctccccctcatagatttcgctgagctccttggacctaaccggcctcatgttctacgaaccatagccgaggcctgcaaaacctacggcttctttcaggttggttctctaaaccctaaagcacatgcggtgatatctagatttcttgctaaacaagtaagctatggtaatgggcaggttgtgaatcatgggatggaaggagacgtgagcaagaatatgatagacgtgtgtaagagattctttgagcttccgtacgaggagagatccaagtacatgtcgtcggacatgtcggctccagtacgatacggcacgagtttcaaccagatcaaagacaatgtcttttgttggagagacttcttgaaactctatgcacatccactccctgactatcttcctcattggccttcttctccttctgacttcaggagttcggcggctacatacgctaaagagacgaaagagatgttcgaaatgatggtcaaagccatcttagaaagtcttgaaattgatggcagtgatgaggcggctaaggagttggaagagggaagtcaggtggtggtggtgaactgttatccaccgtgtccggagccagagctgacgctagggatgccaccgcactcagactacggcttcttgacgcttctacttcaagacgaagtcgaaggtcttcaaattctgtatcgtgacgagtgggtcaccgttgatcccatccctggctcttttgttgtcaacgtaggcgatcatctcgagatatttagcaatgggaggtataaaagcgtgctacatagggtattggtgaactctacaaaacctaggatatcggtggcgtcgctacacagcttccctttgacttctgtcgtaaagccatcgccgaaactcgtcgataaacataatccatcacagtatatggacactgattttaccacttttcttcagtatataacttctcgtgaacccaaatggaagaattttcttgaatcacgcaagattcaccatgtatga

SEQ ID NO: 1512 - DNA, 1410 bp, Arabidopsis thaliana
atgccacttcaccgtcaaatatatgtagattcgcgccggatccatcttattgtagatcggttcttccaaaccagcccggagatatatattcctacggacgtttgtctctacgaagatccctctcacgagcccgccggggctctcgaagactgcaaattcctagccagcctgactatggactacctccttagtagctcacagacggctgattccaccaaaacactgtcgttatctagggccgaggatgttcatacatttctgagtgctgccatcaccaatgagcagacttgtcttgaaggacttaaatcaacggcgtccgaaaatggtctttccggtgatcttttcaacgatacaaaactctatggggtgtctcttgcccttttctccaaaggtataaacaaaagttgggtgccaagaaggcaaagatcgagaccgatttggcaaccacaagccagcgacattgtgacggtgatccagaacgggacgggaaacttcacgaccataaacgccgccattgcagctgcaccaaataaaactgacggtagtaacggttacttcttgatctacgtaacggcgggattgtacgaggaatacgtggaagttcccaagaacaagagatatgtgatgatgatcggtgacggcatcaaccagaccgttatcaccggaaacaggagtgtcgttgatggatggacaactttcaattcagccacatttattctatcaggtcccaactttattggtgtaaacataacaatccgcaatacggcaggaccaaccaaaggccaagctgtggcattgaggagtggtggggacttgtctgttttctacagttgtagttttgaagcctatcaagacacgttatacacacattctctcagacagttttatcgtgaatgtgatgtctatggtactgttgattttatatttggtaacgctgcagtggtattacaaaactgtaatttgtatccacgtcaacctcgcaaaggtcaatcgaacgaggttacggctcaaggtcgtactgatccgaaccaaaacactgggacggcaattcatggttgtactataagaccggcagatgatttggctacgagcaactatacagtgaagacttatcttggtcgaccatggaaggaatattctagaaccgttgtcatgcaaacttacatagacgggtttctagaaccgagtggttggaatgcatggtctggtgattttgcattgagcacactttactacgcggaatataataataccggacctggttctgacacgacaaaccgagtcacttggcctggttatcacgtcatcaacgcaactgatgcttccaatttcacggtcaccaatttccttgttggtgaaggttggattggacaaaccggagtgcctttcgtgggtggactgatcgcataa

SEQ ID NO: 1513 - DNA, 828 bp, Arabidopsis thaliana
atggcggaagaacataagcatgatgaatctgtgatcgctcctgagccagctgttgaggttgtggagagagaatcgttgatggataagatatcggagaagatccatcacggtggtgattcttcttcgtcttcttcatcttctgatgatgaagacgagaagaagaagactaagaagccctcttctccttcgtcttctatgaaatcgaaagtttaccgcttgttcggacgagagcagcctgttcataaggttctcggcggtggaaagccggctgatatattcatgtggaagaacaagaagatgtctggtggtgtacttggtggtgctacagctgcttgggttgtgtttgaattgatggagtaccatcttctcactctgctttgccacgtgatgattgttgttctcgctgtgctgtttttgtggtctaatgccactatgttcattaacaagtcccctccaaagattcctgaagttcatatccctgaagaacctattcttcagcttgcgtctgggctcagaatcgagatcaaccgtggattctcttctctccgtgaaattgcatcaggaagggatctcaagaaattcctcattgctattgccgggttatgggttctctcaatcttgggcggttgcttcaacttcttgacattggcatacatagctcttgtgttgctcttcacggttcctcttgcctacgacaagtatgaagacaaagtcgacccattaggtgagaaagcaatgatcgagctcaagaagcagtatgcagtgttggatgagaaggtgttgagcaagatcccacttgggccgttgaagaacaagaagaaagattag

SEQ ID NO: 1514 - DNA, 540 bp, Arabidopsis thaliana
atggagaaggcattaacgaaagtgacgagctttaaagtgggaagttcatggatctctaagaaagctaaagaagagctctcaaacatcaccaatgacctcactacattctccagtacggttgaagagaaagcaaaatggattttcaacaagcttaaaggaaaaccactgaaaagcttaccagacctcctcaaagaatacaacttaccaccaggactcttcccacaaaacataatctgctacgaattcgatgagacgaagaataaactcaccgtcttcttctcttcaccatgtgaagtcacattcaaagatggatcagcgataagatatgcaacgcgtgtgaaagggattttgcttagagggaagctgatgggtgtggaaggaatgaagacaaaagtgttggtgtgggttaaagtcacaacaatctcagtcgagagctccaagtctgacaagctctggttcactgctggtgtcaagaaatctcgatctaaggatgtttatgacacacctcatgatgctatcaaagtcattggagagttctaa

SEQ ID NO: 1515 - DNA, 1173 bp, Arabidopsis thaliana
atgtctcacagaaagtttgagcatccaagacatggttctttgggtttccttccaaggaaaagagctagccgacaccgtgggaaagtgaaggccttccctaaggatgatccaactaagccttgcagactcacctccttcttgggatacaaagctgggatgactcacattgtgagagatgttgaaaaacctggatcaaaactacacaagaaggaaacatgtgaagctgtgacgatcattgagacacctccaatggtggttgttggtgtggttggttatgtaaagacacctcgtggtctgcggtctctatgcactgtgtgggctcagcatctgagcgaagaattgagaaggaggttctacaagaactgggccaagtcaaagaagaaggctttcactagatattctaagaaacatgaaactgaagaagggaaaaaagatattcaaagtcaattggagaagatgaagaagtactgctctgtcatcagagttcttgctcacactcagataaggaaaatgaaagggctgaagcagaagaaggcacatctgaatgagattcagatcaatggtggagatatagcaaagaaagttgactatgcctgcagtttatttgaaaaacaagtcccagttgatgccatcttccagaaagatgaaatgattgatatcattggtgtcaccaaaggaaaaggttatgaaggtgtggttacaagatggggagtgacccgacttccaagaaagactcatcgtggtcttcgcaaggttgcttgtatcggtgcttggcatccagctagagtctcctacacggtggctagagctggacaaaacggttaccatcaccgtactgaaatgaacaagaaggtataccgggttgggaaagttggccaggagactcactcagccatgaccgagtatgacagaaccgagaaggatatcacaccaatgggaggatttccccactatgggatagtgaaggaagattatttgatgatcaagggatgttgcgtggggcctaagaaacgtgtggtgactttaagacagactttgcttaagcagacgtctaggcttgctatggaggagatcaagcttaagttcattgacgctgcttccaatgggggacacggtcgtttccagacttctcaagagaaggccaagttctatggtagaaccatcaaagcttag

SEQ ID NO: 1516 - DNA, 1854 bp, Arabidopsis thaliana
atggagtcacagttgacacgtccttatggtcatgagcaagcagaagaaccaatcagaattcaccatccagaagaagaagagcatcatgagaagggagcatccaaagtgttgaagaaagtaaaagaaaaggctaagaaaatcaagaacagtctcactaaacatggaaatggtcatgatcacgatgtggaagatgatgatgatgagtatgacgagcaagacccagaagttcacggcgcaccagtgtatgaatcctctgccgtgagaggtggtgtaacgggtaaacctaagtctcttagtcatgccggagaaactaatgttccggcatcggaggagattgttcctccagggacaaaagtttttcctgtcgtgtcttctgaccacaccaaacccattgagcctgtatcattacaagatacctcttacggacatgaggcactggctgatcctgtaagaacgacggaaacatcggactgggaagcgaaaagagaggcaccgactcattatcctctcggagtgtcagaattttcagacagaggagagagcagagaggctcatcaagagccattgaacactcctgtgtctctgctttcagcaacagaggacgtgactaggacgtttgctcctggtggtgaagatgactatctcggtggtcaacggaaagtcaacgtcgagacgccaaaacgtttggaggaagatccggctgctccaggaggaggatcggattatctcagtggtgtatctaattatcagtccaaagttactgatcccacgcataaagaagctggagtaccagagattgctgagtctcttggtagaatgaaagtgactgatgagtctcctgatcagaaatcaagacaaggacgcgaagaagactttccgacgagaagccatgagtttgatctgaagaaggaatctgatatcaacaagaattctccggcaagatttggaggggaatcaaaagctgggatggaggaagattttccgacaagaggtgatgtgaaagtagagagtggattgggaagagacttaccgacgggaactcatgatcagttctcaccagaactatctcgtcccaaagagagagatgattctgaggaaaccaaagatgagtcgacacatgagacaaaaccaagcacctacacagagcagttagcttcagctacatcagccataactaacaaagctatagccgcaaagaacgtcgttgcctcaaagctaggttacaccggagagaatggcggcgggcaaagcgagagccctgtaaaagatgaaactccgagatctgttactgcttacgggcagaaagtggcgggaactgttgctgagaagttgactccggtttacgaaaaagtcaaagaaacaggatcaacggtgatgacaaagctacctctctccggaggtggaagtggagtgaaggagacgcaacaaggggaagagaaaggtgtgacggctaaaaattatatatcagagaagctgaaacctggagaagaggacaaagctttatcggaaatgatagctgagaaacttcattttggaggaggaggagagaagaagacaacggctacaaaggaggtggaagtgacggttgagaagataccttccgaccagatagcggaggggaaaggacatggtgaggcggttgcagaggaaggaaaaggtggagaaggaatggtggggaaagttaaaggagcggtcacttcttggctcggtggtaaaccgaagtcgccacggtccgttgaagagtctccacaatcacttggcaccaccgttgggactatggggttttcggattccggtggaagtgagttgggaggcagtggcggaggtaagggagttcaagattctgggaactga

SEQ ID NO: 1517 - DNA, 1371 bp, Arabidopsis thaliana
atgggagagaaagcgaaagcaaatgtgttagtcttctcatttccgatacaaggtcacataaaccctctcctccaattctcaaaacgcctactctctaaaaacgtcaacgtcacattcctcaccacttcctccacccacaactccatcctccgccgtgccatcaccggcggagccactgctcttcctctctcttttgtccccattgacgatggattcgaggaagatcacccatctacggacacatctcccgactacttcgcaaagttccaagaaaacgtatctcgaagcctctcagagcttatctcctcgatggacccaaaaccaaacgccgtcgtttacgactcgtgcctgccttatgtcctcgacgtttgccggaaacatcctggcgttgctgcggcgtcgtttttcactcagtcctccaccgtgaacgcgacctatattcatttcttgcgtggagagtttaaggagtttcaaaatgatgtcgttttgcctgcaatgcctccgctgaagggtaatgacttaccggtgtttctgtacgataacaatctctgccggccgttgtttgagctcattagtagccagttcgtgaatgttgacgacattgacttcttcttggttaactctttcgacgaactcgaagtcgaggtgctacaatggatgaaaaaccaatggccggtcaagaacataggaccgatgattccatcaatgtacttagacaaacgattagcaggtgacaaagactacggaatcaacctcttcaatgcccaagtcaacgaatgccttgattggcttgactcaaaaccgcccggttcagtgatctacgtgtcttttggaagcttggccgtcttaaaagacgatcaaatgatagaagtcgcggctggtctaaaacaaactggccataacttcttatgggttgttagagaaactgaaacaaagaagcttccaagcaattacatagaggacatttgtgacaagggattgatagtgaattggagtcctcaattacaagttcttgcacataaatcaatcggttgtttcatgactcattgcgggtggaattcgactttagaggcattgagcttaggagttgctttgataggaatgccggcttatagcgaccagccgactaatgctaagtttattgaagatgtgtggaaggttggggttagggttaaggcagatcaaaatgggtttgttccgaaggaagagattgtgagatgtgttggagaagttatggaagatatgtcggagaaagggaaggagattagaaaaaatgctcggaggttgatggagtttgcaagggaagctttgtctgatggaggaaattctgataagaatattgatgagtttgttgctaaaattgtgaggtaa

SEQ ID NO: 1518 - DNA, 987 bp, Arabidopsis thaliana
atgggtttggttagatcattgtgcttattaataaccttccttaattgtctcatcatctcggttcatggccaagccaccgcaaggcctggtcctgtttccggcactaggattgggttttacttaactacgtgtcctagagctgagactattgtccgaaacgccgtgaatgctggtttcagttctgaccccagaatcgcacccggaatactgagaatgcatttccacgactgttttgtccaaggttgtgacggttcgatccttatatccggagctaacaccgagagaaccgccggtccgaacctcaatctccaaggatttgaagtcatagacaacgccaaaacgcagctcgaagccgcgtgtcctggagttgtctcttgtgctgatattttagcattagccgctcgtgacacagtcattctcactcaaggaacaggctggcaagtaccaacgggacgtagagatggtagagtttctttggcttcgaatgctaacaatctccctggtccccgtgactccgttgccgttcaacaacagaaattctccgccttgggactcaatactcgtgatctcgtcgtcctcgtcggaggacacacgatcggaacagcaggatgtggtgtattcaggaacaggctattcaataccaccggacaaaccgcagatccaaccatcgacccaacatttttggcgcagcttcaaacacaatgtccccaaaacggcgacggttcagtgcgcgtggatctcgacaccggaagcggaagcacttgggacacttcttactacaacaacctaagccgtgggcgtggagttctccaatccgatcaagtcctttggaccgatccagccactagacccatagtgcaacaattgatggctcctagaagcaccttcaacgttgagtttgcgaggtcaatggtcagaatgagtaatatcggtgtggttaccggagctaatggggaaatccgtagggtttgctctgcggttaattaa

SEQ ID NO: 1519 - DNA, 2013 bp, Arabidopsis thaliana
atgagagggagatctgatggaggcctaaagaagcggcttattgcttcggtctgtgtcgtggctctattcgtctgtttcttgtttatgtactatggttcctctagccaaggtgcatcagcattggaatatggaagatctttgagaaaactcggatcgtcttatttgagtggagatgatgataatggtgataccaaacaggatgattctgtggctaatgcagaagacagtcttgttgtcgccaaaagttttcctgtaagtttgatcagattctcaggtctggtttgtgatgaccggcactcggaaatcatcccttgcttagataggaatttcatctaccaaatgaggttgaagcttgatctctctttaatggaacattatgaacggcattgtcctcctcccgaaagacggtttaattgtttgattcctccaccatctggatacaaggtgctatatttgctttcttgttttgctttgatttgtgattggttcctggttcctattaagtggcctaagagtagagatgaagtgtggaaagcaaacatacctcacactcaccttgcaaaagagaagtctgatcagaactggatggttgagaaaggcgagaaaatttcttttcccggtggaggcactcatttccattacggtgctgataaatacattgcatcgatcgcaaatatgcttaacttttcgaacgatgtattgaatgacgaagggagattaagaacggttcttgatgtcggatgcggagttgcgagttttggagcttaccttctcgcgtctgatataatgacaatgtcactagcccctaatgatgttcatcagaaccaaatccagtttgcgttagaaagaggaatccctgcttatcttggtgttttaggtaccaaaaggcttccttacccgagcagatcattcgagtttgctcattgttctcgatgtaggattgattggcttcaaagagacggacttcttcttcttgagctcgatcgggtactaagaccgggaggttatttcgcgtattcgtctcctgaagcttacgcacaagatgaagagaatttgaaaatctggaaggagatgagtgctcttgttgaaagaatgtgttggagaattgccgttaaaagaaaccaaactgtggtttggcagaaaccgttgagtaatgactgttacttggagagagagcccgggacacagcctcctctctgtcgctcagatgctgatcctgatgcggttgcgggtgtttcaatggaagcttgcatcactccttactccaagcgaattaggaccagatcttttgttttgtatgccatatgtcacagtcatgctttgttttttttaaatacagatgaccataaaaccaagggaagtgggttagctccttggccagctaggttgacttcttctcctccccgtcttgcggatttcggttattcaaccgacatgtttgagaaggacacggaactttggaaacaacaagtggacagttactggaatctgatgtcatcgaaagtcaaatcaaacactgtgaggaacataatggacatgaaagctcacatgggttctttcgcagctgctcttaaagacaaagatgtgtgggtgatgaacgttgtctctcccgacggtcccaacactctaaaactgatctacgaccgtggtttaatcggaacaaatcataactggtgtgaggctttctctacatatcctcgaacatacgatctgttgcacgcgtggtctatattttcagacattaaaagcaaaggatgcagtgcagaggatctactaatcgagatggatcggattcttagacctacgggattcgttatcatcagagataagcagagtgttgttgagtcaatcaagaagtatttgcaggctttgcattgggagactgtggcatcagagaaggtaaatacaagttcagaactcgaccaagacagtgaagatggtgagaacaatgtcgttttcattgtccagaagaaactttggctcaccagtgaaagccttagggacagcgagtaa

SEQ ID NO: 1520 - DNA, 480 bp, Arabidopsis thaliana
atggcagagcagacggagaaggcgtttcttaagcaaccaaaagttttcttaagctcgaagaaatctggtaagggaaagaggcctggtaaaggaggtaatcgtttctggaagaacattggccttggtttcaaaactccaagagaggctattgaaggaacatacattgaccagaaatgtccctttactggtacggtttcaatcaggggtcgcatcttgtctggaacttgtcacagtgcaaagatgcagaggacgatcattgttcgtagggactatcttcattttgtgaagaagtatcgaagatatgagaaaagacactcaaacattcctgctcatgtttccccgtgcttccgtgtcaaagaaggagatcgtgttaccattgggcaatgcaggccattgtcaaagacggtgaggttcaatgtcctgaaggtcattccggctggaagctcttctatcgggaaaaaagcattcactggaatgtaa

SEQ ID NO: 1521 - DNA, 1332 bp, Arabidopsis thaliana
atggaattctcaaccacattagctctgttcttcactctctccatattcttggtcggagcacaagccaaagttcccgtcgacgaccaatttcgagtggtcaacgaaggaggctacaccgattacagtcccatcgaatacaaccccgacgtacgtggcttcgtccccttcagcgacaacttccgtctctgtttctacaacacaacccaaaacgcatacactctcgctcttagaatcggaaacagagcccaagaatccactctaagatgggtctgggaagcaaacagaggctcaccagtcaaagaaaacgccacgttgactttcggcgaagatggaaaccttgtacttgctgaagccgatggccgcgtggtctggcaaacgaacacggctaacaaaggcgtcgtggggatcaaaattttggagaatggcaatatggtaatatatgattcaaatggaaaattcgtatggcaaagctttgactctccgaccgacacgcttctcgttggacagtctttgaaactcaacggtcaaaacaagctcgtaagcagactttctccatcggtcaacgcaaacggaccgtacagtctcgtgatggaagccaagaagctagtcttgtactacacgacaaacaaaactccaaaaccaatcggttactacgaatacgaattcttcaccaagatagctcagttacagtctatgacgttccaagctgtggaggatgccgacaccacgtggggtctacacatggaaggtgtcgactctggttctcaattcaacgtctcgacgttcctctcgcggcctaaacacaatgcgacgttgagttttcttcggttagagtcagacggaaacatcagagtttggagttacagtacgttggcgacttccacggcttgggacgtaacgtacacggcgtttactaacgacaacactgacggtaacgatgagtgtaggatccctgagcattgtttggggtttggtttgtgtaagaaaggtcagtgtaacgcttgtcctagcgacatagggcttcttggttgggatgagacttgcaagattccgagtctcgctagttgcgatcccaagacatttcactatttcaagatcgaaggagctgatagttttatgacgaagtataacggtggatcaacgacaacggagagtgcgtgtggggacaaatgtacgagagattgtaagtgtttagggtttttctacaataggaagagttcgaggtgttggttgggttatgagctcaagacattgactaaaaccggagatacttccctagttgcttatgtcaaggctccgaatgctagcaagaagtcagctcttgccatttga

SEQ ID NO: 1522 - DNA, 1326 bp, Arabidopsis thaliana
atgaaattttcaatcacattagctctatgcttcactctctccatcttcttgatcggatcacaagccaaagttccagtcgacgaccaattccgagtggtcaacgaaggtggctacaccgattacagtcccatcgaatacaaccccgacgtacgtggcttcgtacccttcagtgacaacttccgtctctgtttctacaacacaaccccaaacgcatacactctcgctctcagaatcggaaacagagtccaagaatccactctcagatgggtctgggaagcaaacagaggctcaccggtcaaagaaaacgcgacgttgacttttggcgaagacggaaacctcgtactcgctgaagccgatggacgcttggtatggcaaacgaacacagctaacaaaggcgccgtggggatcaaaatcttggagaatggcaatatggtaatatacgattccagtggaaaatttgtatggcagagctttgattctcccaccgacacacttctcgttggacagtctttgaaactcaacggtcggaccaaactcgtaagcagactgtctccatctgtcaacacaaacggaccgtacagtctcgtgatggaagccaagaagctagtcttgtactacacgacaaacaaaactccgaaaccaatcgcttattttgaatacgaattcttcaccaagataacacaattccagtcaatgacgttccaagctgtggaagattccgacacaacgtggggtctagtcatggaaggtgtcgattctggttctaaattcaacgtttcaacgttcctctcacggccgaaacacaacgcgacgttgagttttattcggttagaatcagacggaaacatcagagtttggagttacagtacgttggcgacttccacggcttgggacgtgacatacacggcgtttaccaacgccgacactgacggtaacgacgagtgtaggatccctgagcattgtttggggtttggtttgtgtaagaaaggccagtgtaacgcttgtcctagcgacaaagggcttcttggttgggacgagacatgtaaatctccaagtctcgcaagttgcgatcccaagacatttcactacttcaagatcgaaggagctgatagtttcatgacaaaatataacggtggatcatcgacgacggagagtgcgtgtggggacaagtgtacgagagattgcaaatgtttagggtttttctacaatagaaagagttcgaggtgttggttgggctacgagctcaagacattgactagaaccggagattcttccctggttgcttatgtcaaagctcctaatgcaaacaaaaagtcaactctttga

SEQ ID NO: 1523 - DNA, 1593 bp, Arabidopsis thaliana
atgagacaacggcaactattttccgtgtttttgcttctcttagctttcgtttcgttccagaagctttgctactgtgacgatcaaacggttctgtatgaatcgttcgatgagccttttgatggccgctggatcgtttcgaagaatagtgattacgaaggtgtatggaagcatgcaaagagtgaaggacatgaggattatggacttctcgtgagtgagaaggctaggaagtatggaattgtgaaagagcttgacgagcctctaaacctcaaggaaggaactgttgttcttcagtacgaggttcgtttccaggaaggacttgagtgtggtggtgcttacttgaagtacctccgtcctcaggaagctggatggacacctcagggattcgatagtgaatccccttactctatcatgtttgggcctgacaagtgtggaggtacgaacaaagtgcatttcatcttgaagcacaagaatcccaagagtggcgagtacgttgaacaccatctgaagttccctccctctgttccttatgacaagctttcccatgtctacaccgccatcttgaaacccgacaacgaggttagaattttggttgatggagaggagaagaaaaaggccaatttactctctggtgaagactttgagcctgcattgatccctgccaagaccatccctgaccctgaagacaagaaaccagaggattgggacgaaagagccaagattcctgatccaaatgccgtgaagcctgaggactgggatgaggatgcacctatggagattgaagatgaggaagctgagaaacccgaaggatggttagatgatgagcctgaggaggtcgacgaccccgaagcgaccaagcctgaagattgggatgatgaggaagatggtatgtgggaggctcctaaaattgacaaccccaagtgtgaagcagcacctggttgtggtgaatggaagagaccaatgaagaggaatcctgcttacaagggcaaatggagctcacctcttattgataacccggcttacaagggaatctggaaacccagagatatccctaaccctgactactttgagctagacagacccgattacgaacccattgcagccatcggtattgagatctggacaatgcaagatggtatcttgtttgacaacatcttgatagcgaaagacgagaaggtcgctgagacttacagacagaccacttggaagcccaaattcgatgttgagaaagagaaacaaaaggcagaagaggaagctgctggctctgcagatggtctcaagagctaccagaaggttgtattcgacctcttgaacaaggttgcagatttatctttcctaagtgcctacaagtctaagatcacggaactgattgagaaagccgagcaacaaccaaacttaaccattggtgtcctcgtcgccattgtggttgtattcttctcgctcttcctcaagcttatctttggtggcaaaaaggcggcggcacctgtggaaaagaagaaaccagaagtagcggagagttcaaagagtggggatgaggcggagaagaaggaagaaaccgcggcaccacgcaaaaggcaaccgagacgtgataattag

SEQ ID NO: 1524 - DNA, 1077 bp, Arabidopsis thaliana
atggaagcaaaaggggcagcacagtggagctctatcctagttccatccgttcaagagatggttaaggagaagacgatcacgaccgttcctcctaggtacgtccggtctgatcaagacaaaactgaagtcgatgatgattttgatgtgaaaattgagatcccaatcatcgatatgaagcgtttgtgttcttcaaccaccatggattctgaggttgagaaactcgacttcgcttgcaaagagtggggatttttccagcttgtaaaccatggaatagactcaagtttcttggacaaagtaaagtcagagattcaagatttcttcaaccttcccatggaagaaaagaagaagttctggcagcgaccagatgagatagaaggtttcggacaagcttttgtggtttcagaagatcagaaactagattgggcagacttgttcttccataccgtgcaaccagttgaattacgcaagcctcacttgttccccaagctacctcttccctttagagatacactggagatgtattcttctgaagtgcagagcgtagctaagatcttaatagcgaaaatggcaagagccctagagatcaaaccagaggaactggaaaagttgtttgatgatgttgattcggttcaaagtatgaggatgaattactacccaccatgcccacaaccagatcaggttattggtctaaccccgcattctgattcggtcggactcactgtactgatgcaagtgaatgacgttgaaggtctccaaatcaagaaagatgggaaatgggttcctgttaaacccctcccaaatgctttcattgtcaatattggagacgtcttagagatcataactaatgggacataccgaagcatagagcatcgcggagttgtgaattcagagaaagagaggctctctattgcaacgtttcacaatgtgggaatgtataaagaagttggtcctgcaaaaagcctagttgaaagacaaaaggttgcaagattcaaaaggctgaccatgaaagagtataacgatggtttgttctctcgtactctcgacggaaaagcttatctagatgctttgagaatctaa

SEQ ID NO: 1525 - DNA, 657 bp, Arabidopsis thaliana
atggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagtaccttgaggagcttttggggtcttctgaaaatagtgggacttggtga

SEQ ID NO: 1526 - DNA, 945 bp, Arabidopsis thaliana
aatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatgggatccttttttagaatggaatcttcattatgtttgtaaaactgagaaacgagggaaaacaaaacaaataagttctgtaaaaaaggtttacctttctactttgccggaaaactcaactcacggtggcgtccggcgagttttcagaccaaaaagaaggttggaagaaatgaagatgaagaggagaggacaaaagatagagatggtggttgaacaaaagaagagtaaagaggacgaagacgctctaagtctaagccaagggggagaagaagagaagaggtatgaggaggaaccatacttttgtta

SEQ ID NO: 1527 - DNA, 861 bp, Arabidopsis thaliana
atggcgatgatcagttactccaccattgtggttgctctgcttgcttcttttatgatttgctctgtttccgccaattttcaacgagacgtagagataacttggggagacggacgtggacagatcacaaacaacggcgatcttcttacactctctctcgacaaagcttcaggctcaggattccaatccaagaacgaatatttgttcggtaaaatcgacatgcagatcaaactcgttgccggaaactccgctggaactgtcaccgcttactatttgaaatcccctggatctacatgggacgagattgactttgagttcttgggaaacctaagtggtgatccttacacacttcatactaatgtctttacgcaaggaaaaggcgatagagaacaacaattcaaactctggttcgatcccactagtgatttccacacttactctatcctctggaacccacaacgcatcatattctccgtggatggaactcccataagagaattcaagaacatggaatctcaaggaactctgtttcctaagaaccagccaatgagaatgtactctagtctatggaacgctgaagaatgggccacaaggggtggtctcgtcaaaaccgactggtctaaagctcccttcactgcttcctaccgcggcttcaacgaagaagcttgcgtcgtgatcaacggccagtcttcatgccctaacgtgtcaggacaagggagtactggttcgtggttgtctcaggagctagactcgacgggtcaagaacagatgagatgggtacagaataactacatgatttacaattactgtacggacgctaaaaggttccctcaaggtcttccacgcgagtgcttagctgcgtaa

SEQ ID NO: 1528 - DNA, 978 bp, Arabidopsis thaliana
atggctgatggaggaaaggtggtctgcgtaaccggagcttccggttacatagcgtcttggatcgtcaagcttttgctcttccgtggctacaccatcaatgccaccgttcgagacccaaaagatcgaaagaaaacagatcaccttctagcacttgacggcgcaaaagaaagactcaaattattcaaagcagatcttctagatgaaggttcttttgagctcgcaattgatggatgcgagactgtcttccacactgcttcaccggttgcaatcactgtcaagactgatcctcaggttgagctgatcaatccagccgtcaatggtactattaacgtcctaagaacttgcactaaagtgtcttctgtcaagagggtcatcttaacatcgtccatggccgcagttcttgcgcctgagaccaagttgggaccaaacgatgtagtagacgaaaccttcttcactaatccaagttttgctgaggagagaaagcaatggtatgtactttctaagactttggccgaagatgcagcatggcgatttgccaaggacaatgagatcgacttgatcgtactgaatccgggacttgtgactggaccaatcttgcagccaactcttaatttctcggtagctgtgattgtggaacttatgaaaggcaagaatccttttaatactacacatcataggttcgtggacgtgagagatgttgctctagctcatgtaaaggcactcgagactccttcagccaatggcagatatatcattgatggtccggttgtgacaataaaagacattgaaaacgttttgcgcgaattctttcctgatttgtgtattgctgataggaatgaagacattactgagctgaattcagtgactttcaatgtgtgtctggataaagtgaaaagtttgggaataattgagttcactcctacagaaacaagccttagagacactgttcttagtctcaaggagaaatgtcttgtgtga

SEQ ID NO: 1529 - DNA, 1077 bp, Arabidopsis thaliana
atgcctgctatgttaacagatgtgtttagaggccatcccattcacctcccacactctcacatacctgacttcacatctctccgggagctcccggattcttacaagtggacccctaaagacgatctcctcttctccgctgctccttctcctccggccaccggtgaaaacatccctctcatcgacctcgaccacccggacgcgactaaccaaatcggtcatgcatgtagaacttggggtgccttccaaatctcaaaccacggcgtgcctttgggacttctccaagacattgagtttctcaccggtagtctcttcgggctacctgtccaacgcaagcttaagtctgctcggtcggagacaggtgtgtccggctacggcgtcgctcgtatcgcatctttcttcaataagcaaatgtggtccgaaggtttcaccatcactggctcgcctctcaacgatttccgtaaactttggccccaacatcacctcaactactgcgatatcgttgaagagtacgaggaacatatgaaaaagttggcatcgaaattgatgtggttagcactaaattcacttggggtcagcgaagaagacattgaatgggccagtctcagttcagatttaaactgggcccaagctgctctccagctaaatcactacccggtttgtcctgaaccggaccgagccatgggtctagcagctcataccgactccaccctcctaaccattctgtaccagaacaataccgccggtctacaagtatttcgcgatgatcttggttgggtcaccgtgccaccgtttcctggctcgctcgtggttaacgttggtgacctcttccacatcctatccaatggattgtttaaaagcgtgttgcaccgcgctcgggttaaccaaaccagagcccggttatctgtagcattcctttggggtccgcaatctgatatcaagatatcacctgtaccgaagctggttagtcccgttgaatcgcctctataccaatcggtgacatggaaagagtatcttcgaacaaaagcaactcacttcaacaaagctctttcaatgattagaaatcacagagaagaatga

SEQ ID NO: 1530 - DNA, 1827 bp, Arabidopsis thaliana
atgggtggtttaatcgatctgaacgtgatggagacggaggaagacgaaacgcaaacgcaaacaccgtcttcagcttctgggtctgtctctcctacttcgtcttcttcagcttctgtgtctgtggtgtcttcgaattctgctggtggaggggtttgtttggagctgtggcatgcttgtgctggaccccttatctctctaccaaaaagaggaagccttgtgttgtatttccctcagggacatttggaacaagcccccgatttctccgccgcgatttacgggctccctcctcacgtgttctgtcgtattctcgatgttaagcttcacgcagagacgactacagatgaagtttatgctcaagtctctcttcttcctgagtcagaggacattgagaggaaggtgcgtgaaggaattatagatgttgatggtggagaggaagattatgaagtgcttaagaggtctaatactcctcacatgttttgcaaaacccttactgcttctgatacaagcacccatggtggtttctctgttcctcgccgagctgctgaggattgcttccctcctctggactatagccagccccggccttctcaggagcttcttgctagggatcttcatggcctggagtggcgatttcgccacatttatcgagggcaacctaggaggcatttgctcactaccgggtggagtgcgtttgtgaacaagaagaagcttgtctctggtgatgctgtgcttttccttagaggagatgatggcaaactgcgactgggagttagaagagcttctcaaatcgaaggcaccgctgctctctcggctcaatataatcagaatatgaaccacaacaatttctctgaagtagctcatgccatatcgacccatagcgttttcagcatttcctacaaccccaaggcaagctggtcaaacttcataatccctgcaccaaagttcttgaaggttgttgactatcccttttgcattgggatgagatttaaagcgagggttgaatctgaagatgcatctgagagaagatcccctgggattataagtggtatcagcgacttggatccaatcaggtggcctggttcaaaatggagatgccttttggtaaggtgggacgacattgtggcaaatgggcatcaacagcgtgtctcgccatgggagatcgaaccatctggttccatctccaattcaggcagcttcgtaacaactggtcccaagagaagcaggattggcttttcctcaggaaagcctgatatccctgtctctgaggggattcgcgccacagactttgaggaatcattgagattccagagggtcttgcaaggtcaagaaatttttccgggttttatcaacacttgttcggatggtggagccggtgccaggagaggccgcttcaaaggaacagaatttggtgactcttatggtttccataaggtcttgcaaggtcaagaaacagttcccgcctactcaataaccgatcatcggcagcagcacgggttgagccagaggaacatttggtgtgggccgttccagaactttagtacacgtatcctccccccatctgtatcatcatcaccctcttccgtcttgcttaccaactcgaacagtcctaacggacgtctggaagaccatcacggaggttcaggcagatgcaggctgtttggtttcccattaaccgacgaaaccacagcagttgcatctgcgacggctgtcccctgcgttgaagggaattccatgaaaggtgcgtcagctgttcaaagcaatcatcatcattcgcaaggaagggacatctatgcaatgagagacatgttgctagacattgctctctag

SEQ ID NO: 1531 - DNA, 213 bp, Arabidopsis thaliana
atggtgatgatgatgatgatgaggattgtgtgtgaatggagcgatgaagattgcatgaaggttgatgaagacaagcttgatgtgtcttttgttatccctcgtttgggcaacttcgatcctttggcaagcttcggttcccctcggaatcagcagattatgattactatagctcttatatgtttatgttccgtgtttactttgtttccggtttag

SEQ ID NO: 1532 - DNA, 1170 bp, Arabidopsis thaliana
atgggtgagacgcagaagattttgcaagggccacgtcaccacacatctctgaagaagcccttatgggttgttttgacagtctcagtgaccagcatgcttctaatctgtactcacatgtatccaaaacatggcaagagctcctcgtgtcacggcctctatagcaccagaggctgtgaggatgctctctctaagtggctacctgttcatgtcaggaaattcactgatgaggagatagcagctcgagcagtggttagagacatactaagaacgcctcccttcataaccaataactccaaaatcgctttcttgttcttgactcccggtactttgccatttgagaagctctgggatgaatttttcaagggtcatgaagggaaattctcgatatatatccacccgtcaaaggaacgaccagttcacatcagccgtcacttttctgatcgagagattcacagtgatgaggttacttggggaaggatttctatggttgatgctgagaagcggttactggttagcgctcttgaagatcctgacaaccaacactttgttcttgtttcagagagttgtattccgttgcatacttttgactacacttatagatatttgttgtactccaacgttagcttcattgagagttttgtggatccgggtccacatggaaccggtagacatatggaacacatgttaccagaaatcgccaaggaagattttagaaagggtgctcagtggttcacaatgaagcgacaacacgcgattatagtgatggccgatggtctttactactcaaaattccgcgagtattgtggacctggaatagaggccgacaagaactgcattgccgatgaacattacttgccaacattcttcaatatgattgatcccatggggatctcaaattggtcagtgacgtttgttgattggtctgaacgaaggtggcatccaaagacatacggaggaaacgagatttcattagaatttatgaaaaatgtcacatccgaggacatgagtgtacatgtcaccagtgtggggaagcatggagatgagctgcattggccttgtacatggaacgggattaaacggccttgctatctatttgcaagaaagttccatcctgatactctcgacacattggtcaacctcttcccaaactacacaaacacagctgtctga

SEQ ID NO: 1533 - DNA, 1392 bp, Arabidopsis thaliana
atgtcagagccaatcaaaaacatagttctggtaggccgtactggtaatggaaaaagcagcacagggaacacccttcttggtacaaagcagttcaaatctaaaaaccaggcaaaaggcgttaccatgatatgtgaaatgtacagagctgcaatacaagatggtccaataatcaatgtcattgacactcctggtttgtgcgactcgttcgtgcccggagacgacataagtaacgaaataatcaattgcttaacaatggcggaagaaggtatacatgctgtgttgcttgttctatctgctaggggtcgcatttcaaaggaggaggagtctacagttaataccttgcagtgcatattcggcagccaaattcttgactattgcattgttgtgttcactggcggtgacgatttggaagaagacgatcagacattagacgattatttcagagctggttgccctgaattcttgacgaaagttctcagactctgtggtggacggaaggtgctatttgataacaaaagtaaagatgaaaagaagaaggttgagcaagttaagcagcttctagcccgtgtggaaaatgtaggagagcaaactggtggaataccgtatacttatcagttgcaccgtaagataaaggaagaaaatgatgaaaggctaagggaagaagaaagggtgattgaatctaaaaaccgtgctgaagcagaactagcagagatgcaacagaatttactaatggaaaaggagaagttacaaatggaggaggcgaaaaacaaacagttgattgcacaagcggaagcaaatgaaaagcttatggaacaagaaagggccaaaaaccgtgctgaaaccgaactagctgcagtaatggtggagaagttacaaatggaagaggagaaaaacaagcagttgattgcacaggcgaatcgcatgatctgcgcaagggatcttaacatcgaatggtctcatagcgaagagcattggaaatgggtaaatctggatcacaacatatcaagcaatacattcgtcgaagttgctgagcttctaggagtttattggtttgacgtaagtggaagtttggacacgacggaaatggcaccatggacacattacgaggttctgttcgttgttaatttaaaagactcagcttttaaatggaatgcagcggtgaaaatgaacctgttttacatcaacagtaggccaggaggtccaggaacgcaagagcgagctgttgacatgaggcagcatattgggaaaggatgggtaactatacacgccggtgaattcattacgacaccggagaatgtcggactgattgggttccgcatgtctgaggtcgactccggcgataacaggggagggctcattgtcaaaggtgttttaattcgtcctataaactaa

SEQ ID NO: 1534 - DNA, 1773 bp, Arabidopsis thaliana
atggcatttggttattctccttcctattgttcgttttggcgcacccttctcgggttatattgtttatttacacttgtgcacacggtaatctcaacaccacccgaagatcctgttaaatgtgtgtcaggaaacacgaactgtatagtcaccaactcattaggagccttcccagaccgctccacgtgtagagccgccaacgtggcttacccaacaactgaagccgagcttgtatctatcgtcgctgcagctactaaagccggacggaaaatgcgtgtaaccactcgatattcccatagcatccctaagctcacgtgcactgatggaaacgacggattgttcattagcacaaagtttctaaaccacacggtgcaagccgatgcgaaggccatgactttgacagttgagagtggcgtgacgcttaggcaattaatcgctgaagcagctaaagttggattggcgttgccttatgcaccgtattggtggggagtaaccgtgggtggtatgatggggaccggtgctcacggtagctcattgtggggtaaaggaagtgcggtccatgattacgtgaccgagatcaggatggttagtcctggttcggtcaacgacgggtttgcaaagattagagttttaagcgagactacgactcctaacgagtttaacgcagctaaggtttctcttggcgttcttggcgttatctctcaggtgacttttgaattacaaccgatgttcaaaagatcgttaaagtatgttatgagaaacgatttagatttcaatgatgaagctctaacattcgggaaaaaacatgagtttgcggattttgtatggctaccgagccaaggtaaagttgtgtatcgaatggacgaccgagtagcggtcaatacgttgggcaacggcttgtatgatttctttccgtttcgttcacaactctctgcagtactagccaccacaagatcatcagaggagacgcaagagacattgagagatgcccatgggaagtgtgtgacagcaacaacaatttcatctacgctgttttctacctcatacggtttgacaaacaatggtattacattcaccggctatccggtcattggaagccaaaatcgcatgatgtcgtcaggatcatgtctagatggtctggaagataaattgacctcagcttgtgcatgggactcacgtgttaaaggcgtattttatcatcaaacaacgttcagtattcctctcacacaagttaaaagtttcatcaacgacatcaaatctcttctcaagatcgattcaaaatctctatgcgggcttgaactctactatggcatcctaatgcgttatgtcacatcctctccggcttatcttggaaaagaaacggaagccatagactttgatataacatattaccgagccaatgatccgttaacaccgcgactctatgaagattttatcgaagaaatcgagcaaattgcgttgctcaagtataatgcattaccacattggggtaagaatagaaacttagcgtttgatggagtgattaaaaagtacaagaatgctccagcattcttgaaagtaaaagagagttatgatccgaatggtttattctcgagcgaatggacggatcagatcctagggatcaaaggaaacccgacgatagtaaaagatggatgtgcattggagggtttgtgtatatgttcagatgatgctcattgtgctccgtccaaaggctatttgtgtcgaccaggaaaagtttacaaagaggctagagtctgtacacatgtacctaagtaa

SEQ ID NO: 1535 - DNA, 933 bp, Arabidopsis thaliana
atgccattacatatgaaaatccaaccgatcgacgaatccgatgtatcggaagaggtaccttacccggagacgatgagacagatgccgaaatcgaggctgaagcgtctctttgagcgtcagttcactaataagaacgtttcggagaaatttaccggctcagatgttgaggcaccgctttcgagaggtaactctggagattttgagccgagctctgtttgtttggccaagatggttctaaattttatggaggacaacaacggcggcgagaaacagcggtgtggacgtagccgatgtaactgttttagcgggagtggtacagagagctctgatgatgaaactgaatgttcttctggtgaagcttgtgagatcctcaagagtttggttctctgtaagagcatccgtgtgaggaatttgctgactgatgtgaccaagattgcggaaacaagtaagaattgcaagcttaaagatggatcgtgcttgaaaagtgtggctaatgggttagtgagtttaggttatgatgcggctctatgcaaatctcgctgggagaaatctccttcttgtcctgctggggaatatgagtatgtggatgtgataatgaaaggtgaaagactgttaatcgacatagatttcaaatcgaagttcgagattgctcgtgcaacaaaaacgtataagtcgatgctacaaactctgccttacatatttgtggggaaagcggataggctgcagaagatcatcgttctaatatgtaaagcggcaaagcagagcttaaagaagaaaggacttcatgtaccgccatggaggagagctgagtatgtgaaatccaagtggctgtcttctcatgttcgtgtagaccaaaactcaaatggagaagtcaagcaggaatcagtagaggtgatcgctgagtcggtcagttccatagtcttcggtgtctga

SEQ ID NO: 1536 - DNA, 2547 bp, Arabidopsis thaliana
atggctatggatcatctctgtttcgtactaccgacagaatccggcgagttaaagccaccggtgatggtcgaggagaccacagaagaagaagaggagaagaagagtcgtgattgtggacgtcaagttgtgagtttaatcggagatttattccggcgattacacggctctaagttggtgaagagcttgaatctctgtagtatcaacgagagtaaagattcgatttcaatggagatcaataaatcattcactgacatggaaggtgttcagctttccagcaaagtcggttgcgagaatccaagaatctttggatactctgagctttatatcggaactaatggtttcagcgacgaactgatcctcggaagcggcggtttcggccgcgtttacaaggcgttgttaccgagcgacggaaccaccgtggctgttaaatgcttggcggagaagaaaggagaacaattcgagaaaactttcgcggcggagcttgttgcggtggctcagctccgccatcgaaatcttgtgaagttaagaggttggtgtctacacgaagacgagttgcttcttgtttacgattacatgcctaaccggagcttagatcgtgtgcttttccgacgaccggaagttaactccgattttaaaccgttggattgggatcggaggggtaaaatcgtcaaaggactcgccgccgcgttgttctacctccacgagcagttagagactcagatcattcacagagatgtgaagacgagtaacgttatgttggattctgagtttaacgctaaactcggagattttggtttagctcggtggttagaacacaagattgatgaaacagagcatgattcgagttacgactctgtttcttccttccgtaaccaccagttccgagtcgcggattcgactcggatcggtgggactatcgggtacttaccaccggagagtttccggaaaaaaaccgttgccaccgctaaaacagatgttttcagctttggtgttgtggttttagaggttgtctccggtagacgagccgttgatctttcgttctcggaagataaaatcattttacttgattgggttcggagattatccgataaccggaaattactcgacgccggggattctcggttagcaaaaggatcttatgatctctctgatatgaagagaatgattcatcttgctctgctctgttctttaaacaatccaacgcatcgtcccaacatgaaatgggttatcggagcactttccggcgagttttccggtaacttaccggcgttaccttcgtttaagagccatcctctttatattcctttatcttctttaaaatcaacctcaacttcggcgactacgactactacaagaacaacgatgaccaccaccacctccacaactagcttcaatgcgtcgtcggagtcaacgccgtcatcaaattacgttactgcccttgaggattctatttaccagacggcggagactggagaaaatccgtactttaattacaacagccggagagtgatgtcatcaaagtctttcgtattggacacgccaagagagatttcatacaacgaccttgttttagccactgataatttctctgatgcacgtcgcgttgctgaggttgattttggtacggcttattatggtttactaaatggagaccaacatattgtggtgaaacgtctcggtatgactaaatgtccggcgcttgttacccggttctccactgaactacttaacctaggccggcttcgacaccgtaacctagtaatgctccgtggttggtgcaccgaacacggagaaatgcttgtagtgtacgattattccgcgaatcgtaagctaagtcatcttcttttccataatcatatacctggaaactctgttttgcgatggaaaagtcggtacaacgtgatcaaatcgcttgcttgcgctgtacgttatctccacgaggaatgggacgaacaagtcattcaccgaaacattacttcttcaactatatttcttgatagagatatgaatccgcggctttgcggattcgcattggcagagtttttgtctagaaacgacaaggctcatcaagctgcaaaaaagaaaggatctgctcaagggatttttggttatatggcaccagaatacatggaatccggcgaggctacaaccatggcggatgtatacagctttggcgtggtagtgctcgagatggttacggggcagccagcagtggattacaagaggaaaaaagaagatgctcttatggtgttgcgaatccgcgaagtagttggtaaccgaaaaaaactcttggaggagattgcagatattcatttggatgatgaatacgagaatcgagaattggcaaggctattacggttagggttagtttgcacgagaaccgatccgaagttaaggcctagcattagccaagtggtgagtatattggatggaagcgagaggttcttcgaagaggaaggaggaaaggaaggtgacgttagccgcaagcaaatgtatgattcgtctatgttgatgattagacaaatgcaagcgcttgggatccattga

SEQ ID NO: 1537 - DNA, 2592 bp, Arabidopsis thaliana
atgcagagagtgagctttgaagtaaaggacacagaggcggagaagagcagcagcgagatactgagcggatctttgccgtcgacctaccgaaatccggcgatggaaaacgttggaaacgcggtggatgatggatcgagcgtgaagaacaatccgaaacttgatatgcagaaacagaacggtttggtgaagtggttcaagaagtgcttgacaatggtatctggagagagtaaggcacctcgattggaccggtcgaagtcaacggccggtcaggccttgaaagggctcaagatcatcagtaagaccgacggtaacgctgcctggaccgtcgtggagaagcggtacttgaagatcacggccaatactgatggattgctgcttcggtcgaaattcggtgaatgcatagggatgaactcaaaagaatttgccttggaattgtttgacgccttagctagaaaaagtcacttgaaaggggatgtgattactgagaccgagttgaagaaattttgggaacaaataaatgataaaagctttgattcaaggcttatcacgttctttgacttgatggataaagactcggatggtagacttacggaagacgaagttagagagatcatcaagcttagttcttctgccaatcatctgtcatgcatccaaaacaaggcagatgaatatgcagcaatgataatggaagagcttgaccctgatcatatgggatacatcatgatggagagtctaaagaaattgcttctgcaagcggaaacaaaatctgtaagcacagatattaatagtgaagaaagaaaggagctgagcgacatgctaactgagagtctcaagcctacacgtgaccctaaccatttgaggagatggtattgtcaactaagattctttgtattggatagttggcaaagagtttgggtgatagcgttatggctcacgattatggccatcctcttcgcgtacaagtatattcaatacaagaatagagcagtgtatgaagtgttggggccttgtgtgtgcttggctaaaggtgcagcagagacgctgaagctaaacatggccctaattctgttacctgtttgcagaaataccatcacatggcttagaaataagactaggttgggtgtttttgttccttttgatgacaacctcaattttcacaaggttatagcggtgggaattgcgataggagtagccatacactctgtgtcccacttggcgtgtgattttccactgctaatcgcggcaactccagcggaatacatgcctctcggaaaattcttcggagaggagcaaccaaagagatacttgcattttgtgaagtcaacagaaggaataacagggcttgtaatggttttcttgatggttattgcttttacactggctatgccttggtttagacgggggaagctagagaaaaagctaccagggccactaaagaaacttgcgagcttcaatgccttctggtacactcaccatttgttcgttatagtctacattctccttgtccttcacggatactacatatatctcaacaaggaatggtacaagaaaacgacgtggatgtacttggcagtaccagtagctctttatgcatacgagagattgatacgagcattcaggtccagcatcaggacagtaaaagtccttaagatggcagcttatcctggaaaagtattgactttgcagatgtcaaagcctacaaacttcaaatacatgagcggccaatacatgtttgtaaattgtccagcagtttcaccgtttgagtggcatccattttcaataacttctacaccacaagacgactatctgagcgttcatataaaagcattgggagattggacagaggctatccaaggagttttctcagagagtcgggaaaagatagttgagaagcatcatgttatatttcaggtgtctaagccacctccggtcggagacatgttgaatggtgcaaatagtccccgtttccccaaaattatgattgatggtccgtacggcgcaccagctcaagactacaagaagtacgaggtggtcctgctgataggtcttggcattggagccaccccgatgatcagcattatcaaggacattattaacaatacggagaccaaggaacaactcagccaaatggagaagggatcgccacaagagcaacaaggtaataaagaaactttcaagactcgaagggcttacttctactgggtaacaaaggagcagggcacatttgattggttcaagaacatcatgaacgagatcgcagaacgggacaaaagtaaagtcatagaactacacaatcattgcactagtgtctacgaagaaggagacgttcgttccgcgctcatacggatgcttcagtctcttaattatgccaagaatggtttagacattgttgctgggacaagggtcatgtcccatttcgcccgacctaattggaaaaacgtctacaaacagatagccatggatcaccctggcgctaatgttggagtgttctattgtggagcaccggtattgacgaaggagttaaggcaattagctttggaattcacacacaagaccagtactagattctctttccacaaagagaacttctaa

SEQ ID NO: 1538 - DNA, 1233 bp, Arabidopsis thaliana
atgctttcttcaatcaaaccatcttcgtcttccttctccaccgctatctccggcagcgtaaggcggtcaattcctacaaagctcaagttttctcctttactcatcatcaaaaactgccataaccaaagctttaacgctaatgttgtctcccatcaaaagcctctacacatttcatctgcttcgaatttcaagcgtgaggtcaaagtcgaagcttacgaggccgatcgttcccgtccactggacatcaacatcgagcttcccgatgaacaatccgcgcagaaactgaaaatcggaatctacttcgcaacttggtgggcacttaacgttgtcttcaacatctacaacaagaaagtcctcaatgcttttccttacccgtggcttacttcgacgttgtctctcgcttgtggttctttgatgatgcttgtctcttgggctactagaatcgcagatgctcctaaaactgatctcgagttctggaaaactctgttcccggtcgctgtagcacacacgataggacacgttgcagcaacagtgagtatgtcaaaagtagcagtttccttcacacacatcattaaaagtggtgaaccagctttcagtgtcttagtctcaagattcttcatgggagagactttccctcttcctgtctatctctctctcttaccaatcatcggaggctgcgctctcgcggccatcaccgagcttaacttcaacatcactgggtttatgggggcaatgatatcgaatttggcatttgtgttccggaatatcttttcgaagaaagggatgaaagggaagtcagtgagcggaatgaactactacgcttgcttatcgatgatgtctcttgtgatcctcactccattttctattgccgtggaaggtcctcaaatgtgggctgctggttggcaaaatgcggtttctcaagtcggaccaaactttgtctggtgggtagtggcacaaagtgtgttttaccatttgtacaatcaggtctcatacatgtcattagaccagatttcgccgttaactttcagtatcggtaatacgatgaagcggatttccgttattgttgcatcgatcatcattttccataccccgattcaaccggttaatgccctcggtgctgccattgcgatttttggaactttcctctactcacaggtaaacaaacaaacttattcttgtttacctacctctagtacttggttctttagtgaacaatttctagttctaatataa

SEQ ID NO: 1539 - DNA, 483 bp, Arabidopsis thaliana
atggagagtgaaggaaagattgtgttcacagaagagcaagaggctcttgtagtgaagtcttggagtgtcatgaagaaaaactcagctgaattaggtctcaaactcttcatcaagatctttgagattgcaccaacaacgaagaagatgttctctttcttgagagactcaccaattcctgctgagcaaaatccaaagctcaagcctcacgcaatgtctgtttttgtcatgtgttgtgaatcagcagtacaactgaggaaaacagggaaagttacggtgagggagactactttgaagagacttggagccagccattctaaatacggtgtcgttgacgaacactttgaggtggccaagtatgcattgttggagacgataaaggaggcagtgccggagatgtggtcaccggagatgaaggtggcttggggtcaggcttatgatcaccttgttgctgccattaaagctgaaatgaatctttccaactaa

SEQ ID NO: 1540 - DNA, 834 bp, Arabidopsis thaliana
atggctaaacccacatcacgaaatgaccgatttgcccttttcttcataaccctaattttcctgatcctaaccgtttccaaaccggtcgcctctcaaaactgtggctgcgcctctgacttctgttgcagcaaatatggctactgtggtacgaccgatgagttctgcggcgagggctgccaggcaggaccttgccggagcagtggaggcggtggagatcctgctgtttcactagaaggaacggtgacacctgacttctttaactctatactaaaccaaagaggtgattgtcctggcaaaggattctacactcacgacaccttcatggccgcagctaattcttaccctagcttcggtgcttccatctccaaacgcgaaatcgcggcgtttttcgctcacgtagcccaagaaacagggttcatgtgttacattgaggaaattgatggaccagccaaggccgcatccggagagtactgcgacacagagaaaccagagttcccatgtgcacaaggaaagggctactatggccgtggtgcaatccagctctcttggaactacaactacggtctctgtggcaaagccttggacgagaacttattggcttcaccagagaaagttgctcaagaccaggttcttgccttcaagaccgctttctggttctggaccactaatgttcgcacgagttttaaatcgggctttggcgcaacaatcagggcagtgaatagtagggagtgtagcggaggagattctacagccaaagccgccaacaggattaagtatttccaagactattgtggcaagcttggagttgcacctggagataacctcacttgttaa

SEQ ID NO: 1541 - DNA, 1548 bp, Arabidopsis thaliana
atgcatgtttcaattcaacacatttacaaattcttagatctaaatatggaaacctatttcctacttttatctctcgccttcttccttttcatttctgttaaacttttgtttggtaaacggcttagcaagtttaacctaccaccaagtccggctaggcccctgccgttgattggacaccttcacctcctgaaactcccgcttcaccgcacattcctctctttctctcaatccttaggtggcgccccaattttctgcctccgcctcggaaaccgtctcacggttgtagtctcttcatactccatcgctgaagaatgttttacaaaaaacgacattgttttcgccaataggccagagttaattctcgggaaacatattgagtacaactccaccactatgactagtgcgccttatggtgaccactggcgaaacttgcgccgcattgctaccctggagatcttcgcatcacataagctcaacggcttcttatctgtccgtaaggatgagatccgtcagttgctactacgtctctccaaaaactcgagacatgggtttgcgaaggtggagatgagacatttgctttttgagttgactatcaataacgtttttagaatggtagccgggaaacgattttatggtgagggcacagagcaagacgaagttgcgcagcaagtgagacatctgatggacgagattgtgaccagcgctggcgccgggaatgcagccgactatttaccaatcatgcgttggttcacaaattttgagaaacgcgtcaagaatttagcgattcgtatcgataagtttttgcagagtcttgtggatgagaaacgtgcggataaagaaaagggtaccactatgatagatcacttgctttctctccaagaatctcagcctgattactatacagatgtcactcttaaaggaattataattgtaatgataattgctggatctgaaacaatagcatggactttagaatgggcgatgctgaatgtgttgaaccatccagaagtattaaagaaagctaggaccgaaatcgatacgaaaatcggttttgaccggttaatggatgaagctgatactaaaaatctgccttatctccaatggattgtgttggagaccttacgtcttcacccggcagctccaacaaatgttccacatagtacgtcagaggattgcatgttggcaggatatgatgttccacgtggttcgatgttattggtgaacatatggtccatgcatagagacccgtctatatgggaagacccagaaatgttcaagccagagaggttcaaaaatgaaaagctaaatcaaaagttgttgtcgtttgggatgggacgacgagcctgtcccgggtatggcctagctcatcgggtagtgagcttgactcttggatcgatggttcagtgtttcgaatggcagagaattggacaagaatatgttgacaatagtgaagacaaaactgtggtcttgatgcgtcctacgacaccgttgctagccatgtgtaaagctcgtcccattgtccatgagattcttgatgcttttgcttga

SEQ ID NO: 1542 - DNA, 954 bp, Arabidopsis thaliana
atggcggtgaaagcaacaaaggcggagaagaagatcgtttacgattcaaagctttgtcagcttttgaatgagtactctcagattcttgtcgttgcagctgacaatgttggatcaactcagcttcagaacataaggaaaggtttacgaggtgattcagttgttttgatggggaagaacacaatgatgaagagatctgtgaggattcatgctgataaaactggcaatcaagctttcctcagtctccttcctcttcttcaggggaatgttgggttgatcttcactaagggtgacttgaaggaagtcagtgaagaggttgctaagtacaaggttggagctcctgctcgtgtaggtttagtcgctccaattgatgtggtcgtgcaaccaggcaacactggtcttgacccttcacagacctccttcttccaggtgcttaacattccaaccaaaatcaacaaaggtacggttgagatcataacccctgtggagctcatcaagaaaggcgacaaagtcggttcatccgaggctgcgcttcttgccaagcttggaatcaggcccttttcgtatggtctcgttgttgagtcagtctacgataatgggtcagtgtttaaccctgaagtgcttaacctcactgaagacgaccttgttgagaagtttgcagctggtgtctcgatgatcactgcgctttctcttgcaatctcttacccaaccgtagcagctgcgcctcacatgttcctcaatgcttacaagaacgttcttgctgttgccttagctactgagtactctttccctcaggctgagaatgtgaaggagttcctaaaggatccaaccaagtttgcagttgcagtggctgcaccggtttcaggagagtctggtggagcagtggtggcagtagctgttgaggaagaagctgcagaagagtctgatggggacatgggatttgatctgttcggttaa

SEQ ID NO: 1543 - DNA, 945 bp, Arabidopsis thaliana
atgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaagcaaacatgtttcacatttgtaggggagtataattgtaactatttaggtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatga

SEQ ID NO: 1544 - DNA, 1023 bp, Arabidopsis thaliana
atgaagctaggaagccaaggccttgaggtatctgcgcaaggccttggctgcatggccctctccgctcgatacggtgctcccaagccggaaactgacgccatcgctctcctccaccatgctattaactccggtgttactttctttgacacctctgacatgtatggtcctgaaaccaacgagttgctcctcggaaaggctctgaaagatggggtgaaggagaaagtggagcttgcgaccaaatttggattctttatagtagagggggaaatttctgaggtaagaggagatcctgagtatgtaagggcagcgtgtgaggctagtttaaagaggctagatattgcctgcattgatctttattatcagcatcgaatcgatactcgtgtccctatcgaaatcactatgagagaactgaagaagctagttgaagagggtaagataaagtatattggtctgtcagaagcttcagcttcaactatcagaagagcacatgctgttcacccgataactgcggtgcaaatagaatggtccttatggtcgagagacgcggaagaagatatcattcctatctgcagggaacttgggattggaatcgtagcttatagccctctaggaagaggcttcttagcagcaggacccaaacttgctgagaatctggaaaacgatgacttcagaaaggcaactactactctaccaagattccaacaagaaaacgtagaccacaacaagattctctttgagaaagtttctgcaatggctgagaagaaagggtgcactccagcacaactagccttagcatgggttcatcaccagggagatgatgtttgccccattccaggaaccactaagattgaaaacctcaaccagaacattagagctttgtcagtaaaactcactcctgaagaaatatctgagctcgactcccttgccaaaccagagtctgtgaaaggagaaagatacatggcctcaatgtccaccttcaagaactccaacactccaccgttgtcttcctggaaagccacttaa

SEQ ID NO: 1545 - DNA, 1257 bp, Arabidopsis thaliana
atgcttgatcaaatatctggaaaccacacgcatgaaaaactctctgtggaaactgcagaacctcatcatctgaatgatagagtccacattgttgaggagatcccgaaagcttctgtgattccaatcactgaaatttgtgacgaggctgaagagaaatgcagtccaagcactatttctaggaagagagtcacttttgactccaaagtcaaaacctatgaacacgttgtttcagaagaatctgttgaactctcagaagagaagaacgaagaggttgaatccgaaaagaggtcattaaagtcaagcaagactgatgatcagatcattgaggttgcctccaactcctcagggtcgtatcctgaaaaccacagatacaagaattgcagagaaagtgatgatgacatagaggaggatgagtttgactgcagtgacagcgatctagatgaagatgaagaatattacagtgatgttggatttagtgaggatagcttgcataacccaaccaaggaagtttatactcaagatattggggataaaacagaggagattgattcaaagctgagaaggtctaacgagactgttagagatggaaaccactatgatggccaaggagtacttaaccctgttgagaatcttactcagtggaaatccgctaaatccaaagggagaacaaagcagaaacagtctcaaaaggagaactctaacttcatcgcagatcaagaagaaaaaagggattcctcttctttcggtacagaccctcagattgatgatataacactcagcgtcaaaccgaaatgcagaattgaacccaagaaactgcgaaaccaagaactggccgttgatgctagcctttcaacatggttatcaacatctgagtctggtagtgaatgcaacagcgcctctatgtataccttaacacccgagaaactcaagtctaccagctgctactcaaaaccgcttagaatcaatcatgacgatagacctgtattatgcgcattgacattggaggatatcaaacagttctcggctacatctacgccaaggaaatcaccgagcaaaagccctgatgagacacctattataggcacagttggtggttactggggtaatcgctcaaaggcaatagattgcggctctgcatcttcattcaagggaataccaaacaccagtagcaagtacagagaggataagagcgtaaattggcattcaacaccatttgaggcaagactggagaaagctttgaacaacatagacaaataa

SEQ ID NO: 1546 - DNA, 441 bp, Arabidopsis thaliana
atggttacaagtaaacagaccaagaatatattccttcctggaactcccattcgtattcctgctgcagagttcaccaactcaccggctcttatatactttgtggtagcattatccgtggcatgcttttacagcattgtatctacatttgtcaccgtatctgctttcaagaagcattcctgctctgcggttctcttgctaaatcttgccattatggatgcggtgatggtggggatagtggcctcagcaaccggggcaggaggtggagtagcttaccttggtctgaagggaaacaaagaagttagatggggcaaaatctgtcatatctacgacaagttttgccgtcatgttggaggagcaatcgccgtctcattgtttgcttcggttgtcctcctcctcctatccatcatctctgtcctctccctctacaagaaaatccgttga

SEQ ID NO: 1547 - DNA, 1272 bp, Arabidopsis thaliana
atggacgaagtttctcctgcagtcgctgttccattcagaccattcactgaccctcacgccggacttagaggctattgcaacggtgaatctagggttactttaccggaaagttcttgttctggcgacggagctatgaaagattcttcctttgagatcaatacaagacaagattcattgacatcatcatcatctgctatggcaggtgtggatatctccgccggagatgaaatcaacggttcagatgagtttgatccgagatcgatgaatcagagtgagaagaaagtacttagtagaacagagagtagaagtctgtttgagttcaagtgtgttcctttatatggagtgacttcgatttgtggtagacgaccagagatggaagattctgtctcaacgattcctagattccttcaagtttcttctagttcgttgcttgatggtcgagtcactaatggatttaatcctcacttgagtgctcatttctttggtgtttacgatggccatggcggttctcaggtagcgaattattgtcgtgagaggatgcatctggctttgacggaggagatagtgaaggagaaaccggagttttgtgacggtgacacgtggcaagagaagtggaagaaggctttgttcaactcttttatgagagttgactcggagattgaaactgtggctcatgctccggaaactgttgggtctacctcggtggttgcggttgtctttccgactcacatctttgtcgcgaattgcggcgactctagggcggttttgtgtcgcggcaaaacgccactcgcgttgtcggttgatcacaaaccggatagggatgatgaagcggcgaggatagaagctgccggtgggaaagtaatccggtggaacggggctcgtgtatttggtgttctcgcaatgtcaagatccattggcgatagataccttaaaccgtcagtaattccggatccagaagtgacttcagtgcggcgagtaaaagaagatgattgtctcatcttagcaagtgatggtctttgggatgtaatgacaaacgaagaagtgtgcgatttggctcggaaacggattttactatggcataagaagaacgcgatggccggagaggctttgcttccggcggagaaaagaggagaaggaaaagatcctgcagcaatgtccgcggcagagtatttgtcgaagatggctttgcaaaaaggaagcaaagacaatataagtgtggtagtggttgatttgaagggaataaggaaattcaagagcaaatccttgaattga

SEQ ID NO: 1548 - DNA, 990 bp, Arabidopsis thaliana
atggttgtggtgaacaaaacgaatctcttattgcttcttctctctctatgtctcaccctcgacctctcctccgcacaactccgccgtaacttctacgccggaagttgtcctaacgtcgaacaaatcgttagaaacgccgtacagaaaaaagtccaacaaactttcaccaccattcccgccactctacgcctctatttccatgattgtttcgtcaatgggtgtgatgcatcagtgatgatagcgtcaacaaataataataaggcggagaaggatcatgaggaaaatttatcgttggccggagatggattcgacaccgtcattaaagctaaagaagctctcgatgccgtcccaaattgtcgtaacaaagtttcatgcgctgatattctcacgatggccactcgtgacgtcgttaatcttgcgggtggaccacaatacgacgtggaattgggaaggctagatggactatcatcaacagcggctagcgtcggagggaagttgccgcatccgaccgacgatgtcaataaactcacttcactcttcgccaaaaacggccttagccttaacgacatgatcgctctctccggggcacacacattaggattcgcgcattgcacaaaagtgttcaatcggatatacactttcaacaagacaactaaagtggatcccacggttaacaaagattacgtgacagagctaaaagcgtcgtgtcctcgaaacatagatccaagagtggctattaacatggacccaacaacaccaagacaattcgacaacgtttactacaaaaacttgcaacaagggaaaggattgttcacgtcggatcaagtcttattcacggatcgtcggtcaaagccaaccgttgacttatgggctaataatggacagttgtttaatcaagcttttattaactcgatgatcaagcttggtcgtgttggtgttaaaactggtagtaatggtaatatccgtcgtgattgtggagcttttaattga

SEQ ID NO: 1549 - DNA, 978 bp, Arabidopsis thaliana
atggcgatcaagaacattctcgcccttgtggttcttcttagcgtggttggagtttctgtcgccattccacagttgcttgacctcgactactaccggtctaagtgtcccaaggcagaggaaattgttcgtggtgtcacagtacaatatgtttctcgccagaaaacccttgccgctaaacttctaaggatgcatttccatgattgtttcgtcagaggatgtgatggttccgttcttctgaaatctgcaaagaatgatgcggaaagagacgctgtccccaacctgaccctgaaaggttatgaagtggtggatgcggccaagacagcgctggagaggaagtgtcctaatctcatttcttgcgctgatgttcttgccttggtcgccagagatgccgtggcagtgatcgggggaccatggtggccggttccattgggccgcagggatggacgcatctcgaaattgaacgatgcattgctaaatttaccatctcctttcgccgacataaagacgctgaagaagaactttgccaacaagggtcttaacgctaaagaccttgtggttctctcagggggtcacaccattggaatctctagttgcgctctcgtcaacagtcgtctctacaacttcacaggaaagggcgattctgacccatccatgaaccctagctacgtgagggaattgaagagaaagtgcccgcctacagatttcagaacctcactgaacatggacccaggcagtgcgttgacattcgacactcactacttcaaggtcgtggctcagaagaaagggctcttcacatctgactctacgcttctcgatgacattgagaccaaaaactacgttcagactcaggccattctccctcctgtgttttcttctttcaataaagatttctccgattccatggtcaaacttggtttcgtccaaattcttaccggcaaaaatggtgagatcaggaagagatgcgccttccctaactaa

SEQ ID NO: 1550 - DNA, 1497 bp, Arabidopsis thaliana
atgaagttcactcacgagaagaccttcacgccagaaggtgaaacccttgagaaatgggagaagctccacgttctctcatacccacactccaagaacgacgctagcgttccggtgttcgtcatgttaccgctcgacacagtaacaatgtcagggcatttgaacaaaccacgagccatgaacgctagtttgatggccctgaaaggagctggtgtggaaggtgtgatggtggatgcttggtggggattggtggagaaagatggacctatgaattataactgggaaggctatgccgagcttatacagatggttcaaaagcacggtctcaaactccaggtcgttatgtcattccatcaatgtggaggaaacgtaggagactcttgcagtatccccttgcctccatgggtgcttgaagagatcagcaagaaccctgatcttgtctacacagacaaatctgggagaaggaaccctgaatatatctccttgggatgtgattctgtgcctgtcctaagaggaagaacacctatccaggtctactcagatttcatgaggagcttccgtgaacgatttgaaggctacataggaggagttattgcggaaattcaagtaggaatgggaccttgtggagaattgagatacccatcataccctgagagcaacgggacctggagattccccggaattggagagttccagtgctacgacaagtatatgaaatcgtcacttcaagcatatgctgagtcaatcgggaaaactaactggggaacaagtggacctcatgatgccggcgagtacaagaacctcccagaagatactgaatttttcaggagagacggaacatggaatagcgagtatggaaagtttttcatggaatggtactccgggaagctgctagaacatggagaccaactcctatcttcagcgaaaggtatctttcaaggaagcggagcaaagctatcaggaaaggtagctggaattcactggcactacaacaccaggtcacacgcagctgagctaaccgctggatactacaacacaagaaaccatgacgggtatctgccaatagctaagatgttcaacaaacatggagttgtgctcaacttcacctgcatggagatgaaagacggggagcaacctgagcacgcgaattgctcaccagaaggtctggtcaagcaagtacagaacgcgacaaggcaggccggaaccgaactagcaggggagaacgcgctagaacgatatgactcaagcgcattcggacaagtggtagcaacaaataggtcagattctggaaatgggttaaccgcatttacttacctaagaatgaacaagcggttatttgagggtcaaaattggcagcagttagtggagtttgttaagaacatgaaggaaggtggtcatgggaggagactctcaaaagaagacacaactggaagtgacctttatgttggatttgtcaaaggcaagatcgctgagaatgtggaggaggctgctttagtgtaa

SEQ ID NO: 1551 - DNA, 792 bp, Arabidopsis thaliana
atgagtgaggagaagaggaagcaacacttcgtgctagtacatggtgcgtgccacggcgcatggtgctggtacaaggttaagcctcttctcgaggctttgggccatcgtgtaaccgccttagacctagctgcttccggtatagacacaaccaggtcaatcactgacatttctacatgtgaacaatattctgagccattgatgcagctaatgacttcattgccgaatgatgagaaggttgtactcgttggtcatagctttggaggtttgagtttagccttagccatggataagtttcccgataaaatctctgtctctgtcttcgtgactgcattcatgcccgacaccaaacactcaccatcgttcgtcgaggaaaagtttgcaagcagcatgacaccagaaggatggatgggctctgagctcgagacatatggttcagataattccggcttgtctgtgttcttcagcaccgacttcatgaagcaccgtctctaccaactttctcctgtggaggatcttgagcttggattgcttctaaagaggcctagttcattgtttattaatgaattatcgaagatggagaacttttctgagaaagggtatggatctgttcctcgagcttacattgtgtgcaaagaggacaacattatctcggaagaccatcaacgatggatgatccataattatccggcgaatttagtgattgagatggaagagactgatcatatgccaatgttttgcaaacctcaactactaagtgaccatctattggcaatcgctgacaatttctgttaa

SEQ ID NO: 1552 - DNA, 1563 bp, Arabidopsis thaliana
atggatcgagagagattaacggcggagatggcgtttcgagattcatcatcggccgttataagaattcgaagacgtttgccggatttattaacgtccgttaagctcaaatacgtgaagcttggacttcacaactcttgcaacgtgaccaccattctcttcttcttaattattcttcctttaaccggaaccgtgctggttcagctaaccggtctaacgttcgatacgttctctgagctttggtctaaccaggcggttcaactcgacacggcgacgagacttacctgcttggttttcctctccttcgttttgaccctctacgtggctaaccggtctaaaccggtttacctagtggatttctcctgctacaaaccggaagacgagcgtaaaatatcagtagattcgttcttgacgatgactgaggaaaatggatcattcaccgatgacacggttcagttccagcaaagaatctcgaaccgggccggtttgggagacgagacgtatctgccacgtggcataacttcaacgcccccgaagctaaatatgtcagaggcacgtgccgaagctgaagccgttatgtttggagccttagattccctcttcgagaaaaccggaattaaaccggccgaagtcggaatcttgatagtaaactgcagcttattcaatccgacgccgtctctatcagcgatgatcgtgaaccattacaagatgagagaagacatcaaaagttacaacctcggaggaatgggttgctccgccggattaatctcaatcgatctcgctaacaatctcctcaaagcaaaccctaattcttacgctgtcgtggtaagcacggaaaacataaccctaaactggtacttcggaaatgaccggtcaatgctcctctgcaactgcatcttccgaatgggcggagctgcgattctcctctctaaccgccgtcaagaccggaagaagtcaaagtactcgctggtcaacgtcgttcgaacacataaaggatcagacgacaagaactacaattgcgtgtaccagaaggaagacgagagaggaacaatcggtgtctctttagctagagagctcatgtctgtcgccggagacgctctgaaaacaaacatcacgactttaggaccgatggttcttccattgtcagagcagttgatgttcttgatttccttggtcaaaaggaagatgttcaagttaaaagttaaaccgtatattccggatttcaagctagctttcgagcatttctgtattcacgcaggaggtagagcggttctagacgaagtgcagaagaatcttgatctcaaagattggcacatggaaccttctagaatgactttgcacagatttggtaacacttcgagtagctcgctttggtatgagatggcttataccgaagctaagggtcgggttaaagctggtgaccgactttggcagattgcgtttggatcgggtttcaagtgtaatagtgcggtttggaaagcgttacgaccggtttcgacggaggagatgaccggtaatgcttgggctggttcgattgatcaatatccggttaaagttgtgcaatga

SEQ ID NO: 1553 - DNA, 1530 bp, Arabidopsis thaliana
atggagatatcagagagagttcgagctcgattagctgttctctcaggtcatttatcggaaggaaaacaggattctccagcgatcgagcgatggtgcacgtcggcggatacgagtgtcgcaccgcttggatctttgaagggaacactgacgatcgtcgacgaacgcaccggaaaaaattataaagttccggtctcagatgatggtaccgttaaagccgttgatttcaaaaagatagtgacggggaaggaagacaaggggcttaagttatacgatccaggttacttgaacacggctcctgttcgatcttcgatttcttacatcgatggagatgaagggatccttcgttaccgtggctacccaattgaggaaatggctgagaacagtacttttctggaggtggcttatcttctcatgtatgggaatctgccctctgaaagtcagctatctgattgggagtttgcagtttctcagcattcagctgtgccacaaggtgtattagatattatacagtctatgcctcatgatgcacacccaatgggagttcttgtgagtgcaatgagtgcgctttccatctttcatcctgatgctaatcctgctcttaggggccaggatatttacgattcaaaacaagttagagataaacaaattatccgcattattggaaaggcaccaacaattgcagcagctgcttatctgaggatggcaggaaggcctcctgttcttccttcaggaaaccttccttatgcagataatttcctctatatgcttgattccctgggaaatagatcctacaaacctaatcctcggctggctcgggtgttggacatcctcttcatactgcatgcagagcatgaaatgaactgctccaccgctgctgctcggcatcttgcctctagcggtgttgatgtctacactgctgttgctggagctgtgggagcgctttatggtccacttcatggtggtgcaaacgaggctgtgcttaagatgttgtcagagattgggactgttgaaaatattccagagttcattgagggtgtgaagaacaggaagaggaagatgtctggttttggacaccgtgtgtacaaaaactatgaccctcgagctaaagtcatcaagaacctggctgatgaagtattttccattgttggaaaggatcctctaattgaggttgctgttgcacttgagaaggcagctctctctgacgattactttgttaagagaaagctgtatccaaatgttgacttctactctggattaatatacagggcaatgggatttccaccggagttcttcacggtcttattcgcgattcctcgcatggctggatacttgtcacattggaaagagtcactggatgatcctgacaccaagatcatgagaccacaacaggtgtacacaggcgtgtggctgaggcattacacaccagtgagagagagaatagtgacggatgactcgaaagagtcagacaaattgggtcaagtcgcgacttcaaatgcatcaagaagacgtttggctggatcttcagtttag

SEQ ID NO: 1554 - DNA, 486 bp, Arabidopsis thaliana
atggcttcaaagaactcagcctctcttgctcttttctttgcgctcaacatcctctttttcaccttaaccgttgcaacaaattgcaactgcaagccaagtcctaaaccaaagccagtcccaagtcctaagcccaagccggtccaatgtcctcctccaccccgtccttcagtcccaagtcctaatcctaggccggtcacacctccacgcacccctggttcatccggaaacagctgtcctattgatgctctcaagctcggtgtatgtgcaaatgtcttaagcagtctactcaacatccagttgggacagccatcctctcaacaatgttgctcgctcatccaaggtttggttgacgtcgacgctgcgatttgtctatgcactgctctgagggctaacgttcttggtatcaaccttaacgttccgatatctctcagcgttcttctcaacgtttgtaacagaaagcttccatctggtttccaatgtgcttga

SEQ ID NO: 1555 - DNA, 1341 bp, Arabidopsis thaliana
atgaagaagaagaagaagattcttcttcattccgatgattccaagaagaaggagcgtcatattgttacttggtctcctgaggaggatgatatactaaggaagcaaatcagtttacagggaactgaaaattgggcgatcattgcatccaagtttaatgataagagcacaaggcagtgtagaagaagatggtatacatacttgaactctgatttcaagagaggaggttggtcccctgaagaagatacacttttgtgtgaggcacagagattgtttgggaataggtggactgagatagcaaaagtggtctcaggaagaacggataatgctgtgaagaacaggtttactacactgtgcaagaagagggctaagcatgaagctatggcgaaagagaacaggattgcttgttgtgttaactcagacaacaagagactgttgttcccagatggtattagtacaccgctaaaagccgaaagtgaatctcctcttactaagaaaatgaggagaagtcatattccaaatcttacagagattaagagctatggggatagatcacatataaaggttgaatcgactatgaatcaacagagaagacatccattttctgtagtagcccacaatgccacaagtagtgatggtacagaggagcagaaacaaataggcaatgtgaaagagagtgacggtgaggataaaagtaaccaagaggtgtttcttaagaaggatgattcaaaggtgacagctttgatgcaacaagctgaacttctcagttcattggcccagaaagttaatgcagacaacacagaccaaagcatggagaatgcctggaaggttctacaggatttcttgaataagagcaaagaaaatgatctatttagatatggaatcccagatattgatttccaactcgatgaatttaaagatcttgttgaggacttgaggagtagtaatgaagatagtcaatcatcttggaggcaacctgatctccatgattcaccagcaagctctgaatatagctcaggatcaggatcaggatcaaccataatgacgcatccttctggtgataaaacccaacaacttatgtctgatactcagacaacatcacatcagcaaaatggtggggagttactacaagataatgggattgtgtctgatgcaactgtggaacaagtgggtttactctcaactggtcatgatgtgttaaagaactctaatgagactgtgcctatcccgggtgaagaagagtttaactcgcctgttcaagtcactccattgttcagatctctagcagcaggcatcccaagcccacaattctctgaaagtgtaagtatccacctaacaaattga

SEQ ID NO: 1556 - DNA, 1101 bp, Arabidopsis thaliana
atgtcaagaaagccatgttgcgtcggagaaggcttgaagaaaggagcatggaccaccgaggaggacaagaaactcatctcttacatccacgaccacggcgagggaggctggcgcgacattccccaaaaagctgggttgaaacggtgtggaaagagttgtagactgcgatggaccaactaccttaaacctgagatcaaaagaggcgagtttagttcagaggaagagcagattatcatcatgcttcatgcttctcgtggcaacaagtggtcggtcatagcgagacatttacctagaagaacagacaacgagatcaagaactactggaacacgcatctcaaaaaacgtttgatggaacagggtattgatcccgtgactcacaagccactggcttctagttccaaccctacggtcgatgagaatttgaattccccaaatgcctctagttccgacaagcaatactcccgatcgagctcaatgccttttctgtctcgtcctcctccatccagttgcaacatggtttccaaggtctccgagcttagcagcaatgatgggacaccgattcaaggcagttccttgagttgcaagaaacgtttcaagaaatcaagttctacatcaaggctcttgaacaaagttgcggctaaggccacttccatcaaagatatattgtcggcttccatggaaggtagcttgagtgctactacaatatcacatgcaagcttttttaatggcttcactgagcagattcgcaatgaagaggatagttctaacacatccctgacaaatactcttgctgaatttgatcccttctccccatcatcgttgtaccccgaacatgagatcaatgctacttctgatctcaacatggaccaagattacgatttttcacaatttttcgaaaaattcggaggagataaccacaatgaggagaacagtatgaatgatctccttatgtccgatgtttcccaagaagtctcatcaactagcgttgatgatcaagacaatatggtaggaaacttcgagggatggtcaaattatcttcttgaccataccaattttatgtatgacaccgactcagactcgcttgaaaagcatttcatatga

SEQ ID NO: 1557 - DNA, 2484 bp, Arabidopsis thaliana
atgaattctggcgcccttatctattcatttcgttccgttcctgttctatccaaagcctttccttttaggttaaagtacattggattaggttcccgggtcaacttttcaacccgaccagagagatctcaacccgaattcgcgcggcgaagtggagctggaggagagattcgcgcgtccaagagcttgattgaggatgaggcagagcttagtgattgggtgagcgatttgaggactagttcgttgcgcgggaagttcacgagcgacgaagataacgcggatccagaggtggttcgtagaaacgtagacagggacaccagtaggggtccaaggagaggaagggaaggccaatctgataggttcggtggtgcgaaaaggggaaaggaaggtgaaatggataggtttgggagtccgaacaggaggagaaccagcggcgagcctgctgattcgttcgggaacaagcggttaggtgatcgagaaggttcaaggaacggtcgtgttcaaggaaagagtagtgagtcgtcttttcgtggaaggagtgatagaaatgtagattcagggtcgtcttttcgtggaaggagtgacaaaaatgttgactcagggtcgtcttttcgtggtaggaatgatagaaatgtagattcagggtcgtcttttcgtggaaggagtgatagaaatgtagactcagggtcgtcttttcgtggaaggagtgatagaaatgtagactcagggtcgtcttttcgtggtaggaatgatagaaatgtagactcagggtcgtcttttcgtggtaggaatgatagaaatgtagaatcagggtttaggagagagccaggttccgaaaacaacaggggcttggggaaacagacaagaggcttaagcctggaagaggaagatagtagtgacgatgacgagaacagggttggattgggaaacatcgatgatttgcctagtgaagatagtagtgatgaggatgatgaaaatgatgagcctcttattaagaaagcggcttctgctaaggctgttcagactgataagccaactggtgaacatgtcaaaacttcagattcttacttgtctaagacaagatttgatcaattcccactctctcccttatcgctaaaagccatcaaggatgcgggatttgagacaatgactgttgtgcaggaggctactcttcctatcattctccaaggtaaagatgtcctagccaaggccaaaacaggcactggtaaaaccgttgcatttttgcttccagcaattgaagctgttatcaaatctcctcctgcaagccgggatagtaggcaacccccaattattgtgcttgtggtatgtcctactcgggaacttgccagtcaagctgcggcagaggcaaataccttactgaagtatcacccctctattggtgttcaagttgtgattggaggcacaaagcttcctacagagcaaaggcgtatgcaaacgaatccttgccagatccttgtggctacacctggaaggctcaaagaccatattgaaaacacttctggattcgcaacaagattgatgggtgtgaaagtccttgtgcttgacgaagctgatcatctcttggacatgggtttccgaagggacattgagaggataattgccgctgttcctaagcagagacaaacatttttattttctgccaccgtacctgaagaggtccgccaaatatgccatgttgctctgaaacgggatcatgagttcatcaattgtgtccaagagggctctggggagacacatcaaaaggtcacacaaatgtacatgattgcatcactggatagacatttttcgcttctacatgtgcttcttaaagaacacatcgcagataatgtggactataaggttatcattttctgtacaactgctatggtgacaagattggtggctgatctgcttagtcagctaagcctgaacgtcagagagatccattctagaaaaccgcagagttacagaaccagagtttctgatgagttccgcaagtccaaggctattatcctagtcacatctgatgtatctgctcgtggtgtggattaccctgatgtgtcattggtcgtacagatgggattgccatcagacagggagcagtatatacatagacttggcagaaccgggcggaaagggaaggaaggggaaggagtcttattgttggcaccatgggaagagtactttatgtcatctgttaaagacttgcccatcaccaagtctccactaccgccaatagacccagaggctgtgaaaagggtgcagaaagggctgagccaagtggaaatgaagaacaaggaggcggcgtatcaggcgtggttgggttactacaaatctcagaagatgattgcaagagacacgaccagactggtggagctggccaatgagtttagccgcagcatgggacttgacagcccaccagctatccccaaaaatgttcttggcaagatgggtctcaaaaacgttcctggtcttagaaccaagtag

SEQ ID NO: 1558 - DNA, 77 bp, Arabidopsis thaliana
ggcagtgatgattaaaaccagttctgcttcagataattcctgatcgaagaaactgtataccaaaaaacttctgagcc

SEQ ID NO: 1559 - DNA, 1308 bp, Arabidopsis thaliana
atgccagagatcgagattgccgccggcagcggcgacaacaacgacgccttattcggtaaatatgagctcggaaagcttctcggatgcggcgcattcgccaaagtcttccacgcacgtgatcgtcgtaccggccaaagcgtcgccgtgaaaatcctcaacaagaaaaaactcctcacaaatccagctctagccaacaacatcaaacgcgagatctcaatcatgagaagattatctcatccaaacatcgtcaagctccacgaagtaatggcgacaaaatcaaagatcttcttcgcaatggagtttgttaaaggaggagaactattcaacaaaatctcaaaacatggacgtcttagcgaagatttaagccggagatatttccagcaactgatctccgccgttggttattgccacgctcgcggtgtttaccaccgcgatctcaaaccagagaatctattaatagacgaaaacggaaacttaaaagtttccgatttcggtctaagcgcgttaacggatcagatccgacccgatgggttgttacataccttgtgtggtactccggcgtacgttgcgccggagattctatctaaaaaaggatatgaaggtgctaaagttgatgtatggtcttgtggaatcgtcttgttcgttctcgtcgccggttatttaccgtttaacgatccgaatgtgatgaatatgtataagaagatttataaaggagagtatcgttttcctcgttggatgtctccagatctgaaacgattcgtttctcgtcttttagatattaatcctgagactagaatcaccattgatgagattttgaaagatccttggtttgttagaggaggttttaaacagatcaagttccacgatgacgagatcgaagatcagaaagtggaatcgtcactagaagctgtgaagagtttaaacgcgtttgatttgatttcttactcgtcgggattggatttgtcgggattgtttgctggttgtagtaattcgagtggtgaatcggagaggtttttatcggaaaagtcgccggagatgttggcggaggaagtggaggggtttgcgagagaggagaatctgaggatgaagaagaagaaggaggaagagtatgggtttgagatggaggggcaaaatgggaaatttggtatcgggatttgtatttcgcggttgaatgatttgcttgtggtggtggaggcacggcggagaggtggtgatggtgattgttataaggagatgtggaatggtaaactcagggttcaacttattcgcgtttgcgatcagacgtcgtcaacaaacgcggctatttaa

SEQ ID NO: 1560 - DNA, 2739 bp, Arabidopsis thaliana
atggatgcagtgagagaggaaggaacttccttcgtaactgctgtccaggagcagtcatctaatggatatttgcttattgcagctagtggaggccttaaccaacaaagaacaggaataactgatgcagtggttgttgcacggattcttaatgctactttagttgtacccgagttggatcaccattcttactggaaagatgacagtgacttcagtgacatttttgatgttaactggttcatatcttctctcgccaaagatgtgactatagtaaagagagttcccgacagagtcatgcgtgcgatggagaaacctccttataccacacgtgtgcctcgaaagtctactcttgagtattatcttgaccaagtattgccaattctcacgaggagacatgttttacaattgacaaagtttgactacagactagcaaatgatctagatgaagacatgcaaaagttgcgctgcagggtcaactatcatgctttaagattcacaaagcggatacaatcagttgggatgaaagtggtcaagaggatgagaaagatggccaaacgttttattgctgtccatttgagatttgagcctgacatgctagccttttctggttgtgactttggtgggggtgaaaaagagagagctgagctagcagaaataagaaaacgatgggacacattgcctgatctggaccctcttgaagaaagaaagcgtgggaaatgccctcttacacctcatgaagtgggcttaatgctgcgcgctcttggttttacaaacgacacatatatctatgtcgcatctggagaaatatatggtggtgaaaagacactgaaaccactgagagagctgtttccaaacttttacaccaaggaaatgcttgccaacgatgagctcaagcctctgcttccctattcttcacgccttgctgccattgactacattgttagtgacgaaagcgatgtgtttatcactaataataatggaaatatggccaagattcttgcaggccgaaggaggtacatgggtcacaagaggaccatcaggccaaatgcaaagaagctcagtgcattgttcatggaccgggaaaagatggagtggcaaactttcgccaaaaaagtgaaatcttgtcaacgtggattcatgggtgatccagatgagttcaaaccaggacgcggtgaattccacgagtacccgcaatcttgcatttgtcagagacccttctcttacgacaaaacctcaacggatgatgaagaagaagacatgtcagaagagaaccacaacagcaccagccctggacatatatttagctggttagtggtgttattgtcattgatctcattagtccctgttccatcggaatcggctgttttgagtgtagatctaggttcagaatgggttaaagttgccgtagttaatctgaaacgaggacagagtccaatctctgtagccattaatgagatgtccaagaggaaatccccagctttagtagcatttcaatctggagaccggttactaggcgaggaggctgcgggaataacggctcgttatccgaataaagtttattcacaactgagggatatggtgggaaaacctttcaaacatgttaaggatttcattgattctgtctacttgccttttgatattgtagaagattctagaggtgcagttggtattaagatcgatgacggttcgactgtttactcagtggaggagttgttagctatgatcttgggttatgcctcaaatctagctgagttccatgctaaaatcccagtgaaggatatggttgtttcagttccaccttactttggacaggctgagagacggggtttgatccaggcttctcagttggctggggttaatgtcctctccctggttaatgagcattccggtgctgctttgcaatatgggattgataaggattttgctaatgggtcgagacatgtcatattttatgacatgggttcaagtagtacttacgcagcccttgtctattactcagcttacagtgagaaggaatatggcaagactgtttctgtcaaccaatttcaggtcaaggatgttagatgggacttgggacttggaggacagagtatggagatgcgcttggtagagcactttgcagatgagtttaataaacagctcggtaatggagttgatgtgaggaagttccccaaagcaatggctaaattgaaaaaacaagtcaagcgtacaaaggaaattttgagtgcaaacactgcggctccaatatctgtggaatctcttcatgatgatcgtgacttcaggagcacaattacccgtgagaagtttgaggaactgtgtaaagatctgtgggagagatctcttacacctttaaaagatgtgctcaagcattcaggtttgaagattgatgatatatctgcagtggaactaataggaggagctactagagttcccaaactacagagcacaatccaggaatttattgggaaacaacagttagacaaacatctagacgctgatgaggctattgtcctcggctcagcactacatgctgctaacttgagcgatggaattaaattgaaacgtaggctaggtatagttgatggttccccctatggttttctggttgagttggaaggccctaatgttaagaaagatgagagcacaaagcagcaactcgtaccacggatgaaaaagctacccagcaaggtaccgcattacattcaaaatctgtttaagcttagaaacatttctgtcttgtaa

SEQ ID NO: 1561 - DNA, 2391 bp, Arabidopsis thaliana
atggcggggagagtagaatcatccattggtggtggtgagattgatgaagaaggtgatgagagaggtagtatgtgggatttggatcagtcacttgatcaacctatggatgaagaagctggtcgcctcaggaacatgtatagagaaaagaaattctcggcgtttttgcttctgcagctttcatttcagagtcttggtgttgtttatggagatttgggaacttctcctctatatgttttctataatacatttcctcgagggatcaaagaccctgaagatatcattggagctttatcgctaatcatatattccctcacactcatccctctcctcaaatatgtgttcgttgtatgcaaagcaaacgataatgggcaaggtggtacatttgctctctattctttgctctgtagacatgcaaaagttagcacaattccgaaccaacaccgtactgatgaagagcttactacttatagtcgtactacatttcatgagcgttcttttgctgcaaaaaccaagagatggttagagaacggtacctctaggaaaaatgcgctacttattctcgttcttgttggtacgtgcatggtgataggcgatggaatccttactcccgccatttcggttctatctgctgcgggtgggctcagggtaaacctacctcatataaacaacggtattgttgttgttgtggctgttgtgatattagtgagcttgtttagtgtacaacattatggaacagacagagtcgggtggcttttcgcgcccattgtatttctctggtttctctttattgcaagtatcggtatgttcaatatatggaaacatgacccaagcgttttgaaagcgttttccccggtttatatatttcgatattttaaaagaggaggccaagatcgttggacctcgcttggaggcattatgcttagtatcacagggattgaagctctctttgcggatctctctcattttccagtctcagctgtgcaattcgcttttactgtaattgtgtttccttgcctccttttggcttatagtggacaagctgcataccttagaaagtacccgcatcatgtcgaagacgcgttttatcaatccattccaagtttagtatattggccaatgttcataattgcaactgctgctgcaatagttgcaagccaagctacaatatccgcaacattctcgttgatcaagcaagctcttgctcatggatgtttcccgagagttaaagtcgtgcatacttcccggaaattccttggtcagatttacgttccagacatcaattggatcctcatgatcctttgcatagctgtcactgctggattcaagaaccagaaccagataggaaatgcttatgggactgcagttgtgattgtcatgctcgtgacaacgcttctcatgatgctgatcatgatacttgtttggcgatgccattgggttctagtcctcttatttactcttctatcccttgttgtggaatgcacttacttctcggcggtgctcttcaaggttaaccaaggtggatgggttccgctggtcattgcggctgcgtttcttgtcatcatgtatgtttggcattatggaaccctcaagaggtatgagtttgaaatgcatagtaaagtctccatggcttggattctcggactcggtcctagccttggtcttgtccgtgttcctgggattggccttgtttacaccgagctagctagtggagtccctcacattttctctcatttcatcacaaacctgccggcaactcactctgtcgtgatctttgtctgcgtcaagaaccttcccgtatacaccgttccccaggaagaacggttccttgtaaaaagaatcggacccaaaaactttcacatgttccgctgcgttgcgaggtacggatacagagacttgcacaagaaagatgacgactttgagaaacggctctttgaaagcctcttccttttcctccgcctcgaatcgatgatggaaggctgctcagattccgaagattacagcgtctgcggaagccaacaacgacagtccagagatggggtcaacgggaatgggaacgagattaggaacgtgtcgacgtttgatacatttgattctatagagtcggttatagctcccactacaacaaaacggacaagtcacacagtgacggggtcgagccaaatgagcggaggaggggacgaagtggagttcataaacgggtgcagagacgcaggagtggtgcatataatggggaacacagtggttcgagccaggagagaggcaaggttctacaagaggatagccattgattatgtttatgcgtttcttaggaagatttgtagagaaaacagtgccatcttcaatgttcctcaggagagccttttaaatgttggccagattttctatgtgtaa

SEQ ID NO: 1562 - DNA, 426 bp, Arabidopsis thaliana
atgaccgcggcagcagttccagcaactggatctttccagaaacaagacgaggagtggcgtgcggttctgtctcctgagcagtttagggttctcagactaaaaggcacagataaacgaggcaaaggagagtttacaaagaagttcgaggaagggacttatagttgtgctggttgtggaactgctctttataaatcgaccactaagttcgactccggttgcggttggcctgcgttcttcgacgccatccccggtgctattaaacaaactccagaagcaggtggaagaagaatggagataacatgtgcagtgtgtgatggacatttaggccatgttttcaaaggcgaaggttactctactccaaccgatcaacgtcactgcgttaacagtgtctctctcaaattctcttctgctggttcctcccaataa

SEQ ID NO: 1563 - DNA, 405 bp, Arabidopsis thaliana
atgggttttaagagattcgtggagattgggagagtggcgctcgttaactacggcgaggattatggaaagctcgtggttatcgtcgatgtagtcgaccaaaacagggcacttgtggatgcccctgacatggagagaatccagatgaatttgaagaggttgtctcttactgacatcgtcattgatatcaacagagttcccaagaagaaggttttgattgaggcaatggagaaggctgatgtgaagaacaagtgggagaagagttcatggggtaggaaacttattgtgcagaagagaagagctgccctcaatgattttgacaggttcaagatcatgttggccaaaatcaagagggctggtattgtgaggcaggagcttgctaagctaaaaagggagatcgctgcttga

SEQ ID NO: 1564 - DNA, 927 bp, Arabidopsis thaliana
atgggttctcttgacttgccttacgcttcatcgttcaagggaggaagtgaaacctttctccagaatgtatttgaaagtatactgaaaacgtatttgaggaagaacccgatggcgaagacgatatgggaactagttaagtcggtggacaacgaaaagatctcttacgaccacttctttttcaggacatttaaggtcgatggttatggaattgattccctggcgagttttttcatggattatggatataaagttggaggcagacttgattttccaaagaagaaagtacaagttctctggctttctcctccggatgttcacttccccgataatggttacggtattggcaatggccctttgccaagacttgttatagctgagcttcttgtggaggaactaagccctgagtcacaggagataataaggaagtatttgaaaccggaaggtggtaagcaagctgttctttcaagtactttggggtctttaatttgggagaagccaacatccaccgatttcaatcaacttgccaaagaaagcgaatttgccgcatggacgcttgtctacggctacacaatgaaccatcttgctttcgcggttcatcgtcttaaacaccgtttcagcgacatcaaatgcgtcaaagagtattttgaagaaaacggtttcgaactcaacaaggatggaggagtcctcaaagtgagtgaagacagtctactgttacaagtgtcggctatgtcggagaaacttgtggttgaatttgcagacggagtaactcaaatcgtcccggcttcatacattgagttcgttgaacgtctagttcttccacagttcaaagatatgccgtgtgatgagatcaaagagtttcatagacgcgagggcttggagcaagctagcgcctaccacataatggaaagcacccgtttcacagcgtaa

SEQ ID NO: 1565 - DNA, 468 bp, Arabidopsis thaliana
atggggctacaaggtcagctaagtgacgtctcttccgattcaatccctcttatgctcctctctctcctcgccgtcttcatcaaccatctccgatctttcctcctccgtctcacctctaaatcaaatcctaatctccccgtagacgatgtctctatagcatcgggactagccaacataatcgttctcgccgatcagcttagtttgaatcggttattctcgtaccggtgcggtgacggaggtggtggcggctccgattgtgttgtgtgtttgtcgaagttaaaggaaggtgaagaggtgaggaagctggaatgtcgacacgtgttccacaagaagtgtttggaaggatggcttcatcaattcaatttcacttgtcctctttgtagatctgctttggtttccgatgattgcgtctctaaaacgcagcgtagcgttgggagggatttgatctcgtgtttctctctccactga

SEQ ID NO: 1566 - DNA, 1212 bp, Arabidopsis thaliana
atggcttatctccggcgagcagccaccgcattggttctcattttccagctccatctctttctctctctctcaaatgcacataacataacccgaatcttggccaaagaccctgatttctccactttcaaccactatctctcagcgactcatctcgccgacgagatcaaccgccggcaaacaatcaccgtcttggccgtcgataactcagcaatgtcctccatcctctctaacggatactcactctaccaaatccgcaacattctctctctccacgtcctggtcgattacttcggcaccaagaaacttcaccagatcaccgacggctccacctccactgcctccatgtttcaatccaccggatccgccaccggaacttctggatacatcaacatcaccgatataaaaggcggtaaagtcgcttttggtgtccaagacgacgatagcaagctcacagctcactacgtcaaatccgtctttgaaaagccttacaacatctctgttcttcacatcagccaagtcttaacctcgccggaagcagaagctcccacggcgagtcccagcgacctcatcctcaccacaatcctcgaaaaacaagggtgcaaagctttctccgacatcttgaagtcaaccggcgccgacaaaacgttccaagataccgtagacggaggcttaacggtgttctgtccctccgacagcgctgtcggtaagttcatgccgaaattcaaatccctttctccggcgaacaagactgcgttagtgctttaccacggcatgccggtttaccagtcgttacaaatgcttagatcaggtaacggcgccgttaacacgttagcgacggaaggtaacaacaagtttgatttcaccgttcaaaatgacggagaagacgtgacgctggagacggacgttgtgacggcgaaggtaatggggacgttaaaggatcaagagccattgatagtttacaagatcgataaagtgttgttgcctagagaaatctacaaggccgttaagacgtccgctccagctcctaagtcgagtaagaaaaagcctaagaacgcggaggctgacgccgacggacctagcgccgatgctccgtcagatgatgatgttgaggtggctgacgataaaaacggcgccgtatcagcgatgattactcgaacaagtaatgtcgtaacggccattgtcgggctctgtttcggagtttggcttatgtga

SEQ ID NO: 1567 - DNA, 495 bp, Arabidopsis thaliana
atggctcaattcttagagaaggcaacttcggctctcagcgaagccaaagaatccgttacaagcaccgctgaatccgtcacggcttctctcactgatgctgagaaaaccgttaaccaaaccgccaggagcactctaactgacgccgagacaaccgttgcagcatctgttgaaacggtcaagaccgaggctgcagccgcaccagacaaagcgtctggtgtgtctacacaggctaaggatgcagtggacaaagctttttctagaggtatagaaggagccaaatctttgcttcaaactttcgaagcgaagagcagcgatatttcctcaaagcttgttggaggtgttaccaatcttgtgagtggagcatcgagcagcaccgtggcaaaccgagaccttccagtatctacagacaaccagcctctgctagcgtctggtgaaaagacgccgtggtggaagaattgttgtggagttcttgatcttttcaagaaagatacttaa

SEQ ID NO: 1568 - DNA, 732 bp, Arabidopsis thaliana
atgataagaacagaggaagaagaagactatacaagtccaccgtggctaatgccaatgctacgagggagttacttcgtcccttgttccatccatgtcgattcaaacaaaaacgaatgcaatttgttctgtcttgattgtgctggaaatgccttttgctcttactgtttagtcaaacataaagaccatcgtgttgttcagatacgaagatcttcgtaccataacgttgtgagagtgaatgagatacagaagttcatagacatcgcttgtgttcagacatatattatcaacagcgcaaagatcgtgttcctcaatgaaagacctcagcctagaatcggtaaaggtgttacaaacacttgtgaaatctgttgcagaagtctccttgattctttcaggttctgctctctcggctgcaagcttggaggaatgaggagaggagatttatctctaaccttctctttgaaaggaaagcatgggagagagtaccttggtgggtcggaatcagatgaagctactacaccgactaagatgcgtaagaccaatgctttcaaccgtctgatgagtggtctctcgatctcaaccgttagattcgatgactacggtcccaatggtgatcaaaggtcttcaagctctggtgatgaaggtggttttagtttctctccgggaacacctccgatctataatcaccggaattcaagcagacgaaagggtgtccctcaccgtgctccgttctaa

SEQ ID NO: 1569 - DNA, 1119 bp, Arabidopsis thaliana
atggcagaacaagaaactacgtcaaacataaacaccattaatgatcaagcagaagaagaaacaagaacaaaatctcagccattgatttcaggtctaccaaatgatatagctgagctttgtcttcttcgtcttccttacccataccatgctctatatcgctctgtttcatcttcatggaacaaaaccatcacaaaccctagattcctcttctccaagcaatctctttctatctcttctccttacctatttgtcttcgctttcaacaaatcaacggctaggattcaatggcaatcccttgaccttgcatctggccgttggtttgttttacctcccatgccaaactctttcaccaaaatctcgtctcctcacgcactctcatgcgcgtcgatgccacgtcaggggaagctttttgtactcggcggcggagatgtaaaccgctccgccgtcgtttacactgctctaacgaatcgttggtcgtgtatatctccgatgatgagcccgagaacgtacttcgtctccgggaatgttaacggtaaaatcatggccgttggtgggagtgtgggcggaaacggagaagcaactacggaagttgaatcgtatgatccagataatgacacgtggacggttgtgaagaagttgccgatggtgttggcgaagtatgactcagccgtgatcgggaaagagatgtgtgtaacagaaggatgggcgtggccgttcatgtttccaccgatgggacaagtgtacgactccgacgaaggcacgtggcgagagatgagcggtgggatgaaagaagggtggacgggtgtgagcgtcgtgatccgcgacaggctgtttgtgatctcggagcacggtgattttccgatgaaggtttattgttcagatgatgacacgtggaggtacgtgagtggtgagaagctacagggggagaagatgcggcgtcctttcgccgtgacgggagctgatgatcgtgtgtttgtggtggccagtgggattaacgtagcggaagggagagtgagtgaagggcaaaatggggattttagtgttgagtggaggatggtttcgtctcctaaaagttctattcagttttcacctgctagttgtcatgtgctatatgtttga

SEQ ID NO: 1570 - DNA, 3093 bp, Arabidopsis thaliana
atgtcgaacttgctaagggatttcgaggtggaggctaagaatccgtcgctggaagcgcgtcaaagatggaggtcgtccgtgtctatcgtgaagaaccgtactcgtcgtttccgtaacattcgggatctcgataagctcgctgactacgagaacaagaagcaccagatccaggaaaagatccgagttgctttctttgttcaaaaggcagctcttcatttcattgatgctgctgctaggccggaatacaagctcactgatgaggttaagaaagccggattttctattgaagcagatgaacttgcatctatggttcgcaaaaatgacactaagagcctggcacagaaaggtggagttgaagaacttgctaaaaaagtatctgtatctctctctgaaggcattcgttcgagtgaagtgcccattagggaaaagatatttggagaaaatcgttatactgagaaaccagccagatcattcttaatgtttgtgtgggaagcgctccacgacataacccttatcattcttatggtctgcgctgtagtatcaataggtgtgggtgttgctacagaaggatttccaaggggaatgtatgatgggacagggatcttgctaagtatactcttggtggtcatggttactgcgatcagtgattacaagcaatctttgcagttcagagacttggatcgagagaagaagaagattattgtccaggtcaccagagatgggagcagacaagaaatctccattcatgacttggtcgttggagatgtagttcatctatctattggggatcaagttccagctgatgggatttttatatctggatacaacttggagatagacgagtcaagcttatcgggtgagagtgaaccgtcacatgtgaataaagagaagccttttctgctttcaggaaccaaagtacaaaacggttctgcaaaaatgctggtgacaacagttggtatgaggactgagtggggaaagttgatggaaacgctggttgatggtggagaagatgagacgcctctgcaggtgaagctaaatggggttgcaacaatcattggtaagattggtttaagctttgctgtgcttacatttgtggtattgtgcataaggtttgtcttggacaaagcaacgtctggtagcttcaccaactggtcatctgaagatgcattgacgctacttgactactttgcaatttctgtaactatcattgtcgttgccgtgcccgaaggtttgccactggcagtgaccttaagtttggcatttgctatgaagaagctgatgagtgacagggcacttgtgaggcatcttgctgcatgtgagactatgggttcttctacttgcatctgcactgataagacagggaccttaactactaatcacatggtggtcaacaaagtatggatctgtgataaggttcaagagaggcaagagggaagtaaagaaagctttgagttggaactatcggaagaagttcagagcactcttttgcagggtatatttcagaacactggttcggaagttgttaaggataaagatggaaacactcagatcctaggatccccgacagaaagagcaatactcgaattcggtttacttttaggtggtgattttaacacgcagcgtaaagagcataagatactcaagattgagccgttcaattcagacaagaagaaaatgtctgttcttatagctcttcctggaggtggtgcacgggctttctgcaaaggggcatctgaaatagtgttgaaaatgtgtgagaatgttgtggattcaaacggagaatcggttccgctaactgaagaacggattacgagtatctctgatatcatagagggttttgcctcagaggctctgaggactctctgcttggtttacaaagatctagatgaagctcccagtggagagctccctgatggaggctatacaatggtagcagttgttggaatcaaggatccagtacgtccgggtgttagggaagccgttcagacttgtcaagctgccggaatcaccgtccgtatggtcactggagataacataagcacagccaaagcaattgctaaggaatgtggcatatataccgaaggaggcttagctatagaaggttcagaattccgggacttgtctcctcacgaaatgagggccattatccccaaaattcaggtaatggctcggtctctgccattggacaaacatactttagtcagcaacttgaggaaaattggagaggtagttgcagtgacaggggatgggacaaacgatgcccctgcgttgcatgaggcagacattggactagcaatgggaatagctggaacagaggttgcgaaagagaatgctgatgtgatcataatggacgataacttcaaaacaatagtaaatgtggctagatggggacgtgctgtatatataaacattcagaagtttgttcagttccagctaactgttaatgtggttgctctgatcatcaactttgtctctgcttgcatcacaggatctgctccactcactgctgtgcaactgctttgggtcaacatgatcatggacacacttggtgcattggctctagcaacagaacctcccaatgaaggtttaatgaaacgtgcaccaatagctagaaccgccagctttatcaccaaaaccatgtggagaaacatcgctggtcaaagcgtttaccagttgattgtcttaggaattctcaatttcgcaggcaaatcacttctcaaactagatggccctgactccacagccgttcttaacacagtcatcttcaactccttcgtcttttgccaggtgttcaatgagatcaatagccgggaaatagagaagataaatgtgttcaaaggaatgttcaatagctgggtgttcacttgggtaatgactgtgacggtagtgtttcaagtgatcatagtggagtttcttggagcatttgctagcaccgttcctctgagctggcaacattggttactatcaatcttgataggatcattgaacatgattgtagccgttatcctcaaatgcgtacctgtcgagtctcgtcaccatcacgatggctacgacctgcttccttctggtccttcttcttccaactctgcctga

SEQ ID NO: 1571 - DNA, 1344 bp, Arabidopsis thaliana
atgggtcttcctctaatgatggagagatcatcaaacaacaacaacgtcgagctttctcgagtggcggtttcagacactcacggcgaagactcaccgtacttcgccggctggaaagcttacgacgaaaatccttacgacgaatctcataacccttccggtgtcatccaaatgggtctcgctgagaatcaggtctcgtttgatcttcttgaaacttacttggagaagaagaatccagaaggttcgatgtggggatcaaaaggagctcctgggttccgtgaaaacgcattgtttcaagactaccacggtctcaaaactttcagacaagccatggctagtttcatggaacagattcgaggaggcaaagctagatttgatcctgaccggatcgtcctcaccgccggagccaccgccgctaacgaactcttaactttcattctcgccgatcctaacgacgcccttctagttcccacaccgtattatccaggattcgatagagatttgagatggagaaccggagtgaaaatagtacccatccactgcgacagctcgaaccatttccagataaccccggaggcgctagagtcggcgtaccaaacggctcgtgacgcgaacattagagtccgaggagtgctcataaccaacccatcgaacccattaggggcgacggtccaaaagaaggttctagaagatctccttgacttctgcgtacgcaagaatattcacttggtctcagacgagatctactccggctccgtcttccatgcctccgagttcacaagcgttgccgagatcgtagaaaacatagatgacgtgtcagtaaaggaacgagttcacatcgtctacagtctctccaaggatcttggtcttcctggtttccgcgtgggaactatatactcgtacaacgataatgttgttcggacagcgagaaggatgtcgagcttcacgcttgtctcgtctcagacacaacatatgctggcttctatgttgtcggatgaggagtttacggagaagtacattaggataaaccgggaaagacttagaagacggtacgataccattgtggaagggcttaagaaggcagggattgagtgtttgaaagggaacgcagggctattttgttggatgaatttgggtttcttgctcgaaaagaaaactaaagacggcgagctccagctttgggatgtgatcttaaaggagctgaacctgaatatatctccgggatcttcgtgccactgctcggaggtcggatggtttagggtttgttttgctaatatgagtgagaacactttggagattgcgttgaagagaatacatgagttcatggaccgacgaaggaggttttga

SEQ ID NO: 1572 - DNA, 1554 bp, Arabidopsis thaliana
atgaaactttactctctactttccgttttcttggtcatcctcttggcaacaagcgacagtgatgcctttaccagaaacaattttccaaaggatttcctctttggagccgccacttctgcttatcagtgggaaggagctgttgctgaagatggaagaactcctagcgtctgggatactttctcacacacttgtaatttaggtaatggagatataacatccgatgggtatcacaaatacaaggaagatgttaagctgatggcagaaatgggcttagaatcattcagattctctatctcctggtcaagacttatacctaatggaaggggactcattaacccaaaaggtctactgttttacaagaacctcatcaaagaactaataagccatggaatcgaaccacatgttacactttaccactatgatcttcctcagtctcttgaagatgagtatggaggctggatcaaccgcaaaatcatagaagacttcactgcttatgcagatgtatgtttcagagagtttggggaggatgtgaagttatggactacaataaacgaagctacaattttcgccattggttcttatgaccaaggaatctcgccccctggacattgttctcctaacaaattcatcaattgtactagtggaaattcttctacagaaccatatcttgcaggccataacatattgctagctcatgcctctgcttcaaagttgtataaactaaagtacaagagtacgcagaaaggatccatagggcttagtatatttgcattcgggttatctccatatacaaactccaaggatgatgaaatcgcaactcaaagagctaaagctttcttctatggctggatgttgaagcctttggtatttggagactatccggatgaaatgaagagaactgttggatcgagattaccggtgttttcggaggaagagtcagagcaacttaaaggatcatctgactttataggaattattcactacacgacattttatgtcacaaacaaaccctcaccttctatctttcccagcatgaatgaaggcttctttaaagacatgggagtatatatgatttccgctgcgaattcttcatttcttctgtgggaggctactccatggggtcttgaaggtattcttgagtatataaagcagagctataacaatcctccaatctatattcttgaaaatgattcttcaacttgcaattttttaaatataaaaacaggtatgccgatgggacgcgactcgacattacaagacacacaaagaattgaattcattcaagcttacattggtgctatgctcaatgccatcaagaatggatcggacacgagaggttactttgtatggtcgatgattgatttgtatgagttactgagtggatatacgaccagcttcggaatgtactatgtgaatttcagcgatcctggtcgcaagaggactccaaagctctctgcttcttggtacactggtttcctcaatggtacaattgatgttgctactcaagatactattcagttgcagagcaacatctctggctcttcttcattgtaa

SEQ ID NO: 1573 - DNA, 1464 bp, Arabidopsis thaliana
atggctgaggtgggaaaagttctggctagtgatatggagttagaccattcaaatgagactaaagcagtggatgatgttgttgccactactgataaagcggaggtcataccagtggctgtaactagaactgaaaccgttgttgaaagtttggaatctactgactgtaaggagcttgaaaaacttgttccacatacggtagcttcgcagtcggaagtagatgttgcttccccggtatccgagaaagcaccgaaggtttctgaaagtagcggtgcattatctttgcagtctggttcggaagggaatagtccttttattcgtgagaaggttatggaagacggatacaactggcggaaatatggacagaaacttgtgaaaggaaatgagtttgtaaggagctattacaggtgcactcaccctaactgcaaagcgaaaaaacagttggaacggtctgcgggtggacaagtcgtggataccgtttactttggggaacatgatcacccaaagcctcttgctggtgctgttcctatcaatcaggataagcgaagtgatgtcttcacagctgttagtaaaggtgaacaaagaatagatatagtttctctaatttataagctgtgcattgtttcttatgatatcatgtttgtagagaaaacatctggatccagtgttcagacacttcgtcaaaccgaaccaccaaagatccatggaggattacatgtttcagttattccaccagctgatgatgtgaaaactgatatttcacaatcaagtaggataacgggggacaacactcacaaggattataatagtcctaccgcaaagcgaaggaagaaaggagggaacattgagctgagtccagtggagaggtcaaccaatgattcacgcattgtggttcacactcagactctgtttgatattgtgaatgatgggtaccgatggcgtaaatatggtcagaaatcagtaaaaggcagcccatatccaaggagctactatagatgttcaagccctggatgccccgtcaagaaacacgtagagaggtcatctcatgacacaaagttgcttataacaacttacgagggaaaacacgaccacgatatgcctccaggaagagttgttactcataataacatgctggactcggaagttgatgataaagaaggagatgccaacaagactccacagagctcaactcttcaatccattacaaaagaccagcatgtcgaagatcacttaagaaagaaaacgaagactaatggctttgagaaaagtcttgatcaaggtccagttttggatgagaagctgaaggaggaaataaaagagagatcagatgcaaacaaagatcacgcagccaatcacgccaagccggaagcaaagtcagatgataaaaccactgtttgtcaagagaaggcagtaggaaccctggagagcgaggaacaaaaacccaagacagagcctgcccaaagctaa

SEQ ID NO: 1574 - DNA, 1752 bp, Arabidopsis thaliana
atggtgaattcgaatgaagaagacgaaaggagaattcttgacgttgaagaatctcttcttacacaggaggaagtgaacaatcacttgaccggattgtcttctacagctgaagatggttctattgacatttatggaaacccaccatcgaagaagaagacaggaaactggaaagcttgtccctttattcttggaaacgaatgttgtgagagattagcttactatggaattgccaagaatctaatcacttactacacaagtgaattacacgagtccaatgtttctgcagctagtgacgttatgatttggcaaggaacttgctatatcacacctctcattggagctgttatagctgattcttactggggaagatactggaccattgcttctttctctgctatttatttcattggaatggctttgttgacactctcggcttcacttccggttttaaagccagcggcatgtgctggcgttgctgcggctctatgctcaccagcaacaacggttcagtatgcggttttctttacagggctttaccttattgctcttggtactggaggtatcaaaccatgtgtatcatcttttggtgctgatcagtttgatgatactgacccgagggaacgagttagaaaagcttctttctttaactggttttacttctccatcaacattggttcatttatctcatccactttgttagtttgggttcaagaaaatgtcgggtggggactcggtttcttgattcccaccgtgtttatgggagtctctattgcgagtttcttcattggaactccgctttatcggtttcagaaaccgggaggtagtccgattactagagtttgccaagttcttgtagctgcataccgtaaattgaagcttaatctccctgaagatatctcatttctgtatgaaacacgagagaaaaactccatgattgctggaagcaggaagattcaacacactgacgctgctgttatctcagaatatgaatctaaatccggtgctttttccaacccatggaagctatgtactgtaactcaagtcgaagaagttaagactctaatccgtatgtttccaatctgggcctcggggatcgtctactcggtcctatattcacagatttccactctattcgtgcaacaaggacggtccatgaaccgaataatccgttctttcgagatccctcctgcttcattcggggttttcgacacacttatcgtgctcatatccatcccaatatatgaccgtttcctcgtaccctttgtaagacggttcacagggataccaaaagggttaactgatctgcagcgaatgggcattggtctttttctctctgtcctaagcattgcagctgcagctattgttgagacagtgcggttgcagcttgctcaagactttgttgcaatgagcatattttggcagatccctcagtacatactaatgggaatagcagaggtctttttcttcattggtcgagttgagtttttctatgatgaatctcctgatgcaatgagaagtgtatgcagcgctttggcactactcaataccgcagtcggaagctacctgagctcgttgatcctcactcttgtggcgtatttcacagctcttggaggtaaagatggttgggttccagacgaccttaataaaggacatcttgactacttcttctggcttttggtctctcttggacttgtcaacattcctgtttatgccttgatttgtgttaagcacacaaagaagaaggctttgtaa

SEQ ID NO: 1575 - DNA, 1632 bp, Arabidopsis thaliana
atgggaaaagcgtcccggtggtttaggagtctattcggagttaagaaacccgacccgggttatccggatctatccgtcgagacgccttctcggtcaacttcctctaatctcaaacgccgatggagtttcgtcaaatccaaacgagaaaaagaaagtacaccgattaatcaagttcctcatactccatcgctaccgaattcgacgcctccaccgccgtctcaccaccaatcgtcgccgagacgacggagaaaacaaaagccgatgtgggaggatgagggaagtgaagattcggacaagcatgctattgcggtggctgccgcgactgctgcggttgctgaagctgcagtcgccgccgctaatgctgctgctgcggtcgtcaggctgacgagcacaagtgggaggtcgactcgaagtcctgttaaggcacggtttagcgacggattcgacgacgtggtggcgcatggtagcaagttttatggacacggccgtgacagttgtgaacttgcggtgattaagatacaatctatatttcgcggatacttggcaaagagagcgttaagggcactcaagggtttggttaggcttcaagcgatagttagaggccatatcgaaagaaagagaatgtcagtccatctgcgcaggatgcacgctttggttcgagctcaggctcgtgtgcgtgccactcgggttattgtcacgcctgaatcttcttcttctcaatccaacaataccaaatcttctcacttccaaaaccctgtaagccttgtaaaattccctatgattgttccttttaacctaaaacatggtccaccaactccggaaaaactcgagcattcgatctcttctcgcagctccaaactcgctcattctcatcttttcaaggtattacattttcagttgctgtttgtttcttctgtttttgttgcttgtggtcccattagttcaaaatttcagagactatacaagttactgacattgctttatgttcaaaacaaatccaatctcaagaattggaatggttcgaaggcaagcgacaacaacagactgtaccctgctcacagggagacattctcagccacagacgaagaagaaaagattcttcaaatcgacaggaaacacatcagttcttacacaagacgcaacagaccagacatgttctactcatcccacctcatcctagacaatgctggcctgtctgaaccagttttcgccacgccttttagcccgtcctcgtcgcatgaagagattacaagccagttttgcactgcagagaacagtcctcagttatactcagctacttctagaagcaaacgcagtgctttcaccgctagttctatagcaccgagcgattgcacaaaaagctgctgtgatggtgaccatccaagctacatggcttgtacagagtcctctagggctaaggctaggtccgctagtgccccgaagtctcgaccacagttattttacgagcggccttcatcaaaacggtttggatttgttgatttgccgtactgtggtgatacaaagtccggtccccagaaaggctctgctctgcatactagttttatgaacaaggcttatcccggttcaggtcggttggaccgtctcgggatgccaattgggtataggtactga

SEQ ID NO: 1576 - DNA, 1374 bp, Arabidopsis thaliana
atgagtgaagcaaagaagggtcacgtactgttttttccatatccattacaaggccacattaacccaatgatccaactcgctaaacgcttatccaaaaagggcatcaccagcacactcatcatcgcctccaaagaccaccgtgaaccttacacctccgacgactactccatcaccgtccacaccatccacgacggtttctttccacatgaacaccctcacgccaagttcgtagatcttgaccgtttccacaactctacttctcgaagcctgaccgatttcatctctagtgcgaagttgtcggacaatcctccaaaagctctgatctatgatccatttatgccctttgcattggacatagccaaggacttggatctatacgtagtggcatatttcactcaaccatggttggctagtcttgtttactaccatatcaacgaaggcacctacgatgttcccgttgatagacacgagaacccaacacttgcatcgtttcctggtttcccattgttaagccaagatgatctgccttcgttcgcctgcgaaaaagggtcgtaccctcttctacacgagtttgtggttaggcaattctctaatttattgcaagctgattgcattctctgcaacacttttgatcaacttgaaccaaaggtagtgaaatggatgaatgatcaatggccggtgaagaacattggaccggtggttccatcgaagttcttggataaccggttgccagaagacaaagattacgaactcgagaactccaagacagagccagacgagtctgttttgaagtggttgggaaacaggccggcgaagtcggtggtttacgtggcgtttgggacattggtggctttgagcgaaaaacagatgaaggaaattgcaatggcgattagccaaaccggatatcacttcttgtggtctgttagagaatccgagagaagcaaactaccctctggttttatcgaagaggcagaggagaaagactctggacttgtggctaagtgggttcctcagctagaggttttagcacatgaatcaatcgggtgtttcgtgtcacactgtggatggaactcgacattggaggcactatgcttaggggttccaatggtgggcgtgcctcagtggactgatcagcccacaaatgctaagtttatagaggatgtgtggaagattggggttagagtgaggaccgatggagaagggctttcgagtaaagaagagattgcgagatgcattgttgaggtcatggaaggagagagagggaaagagataaggaagaatgttgagaagcttaaggtgttggctcgcgaagctatctctgaaggaggtagttccgacaagaagattgatgagtttgttgctcttttgacttaa

SEQ ID NO: 1577 - DNA, 2211 bp, Arabidopsis thaliana
atggccggaaacaactcggaatcgagtctctaccaggttttggtggagtggtgtcagaggatggagacgagtcaagcgagactaagggaggatgttgatgacttattgcttcaggaggagagtcgaaccggtaaggaatcggcgacgggattggagacggacacggagaaagaggctgaggtagaggtggaagcggaggcggcggattcctgggataatccgacggcgacttgggagagagctgtttcaggattctatttcgctgatagtgcgtatcggactttgatggattcaatgggacacgcgattcatgtaacatcagctgcgtctggagaaattacattctggagtcgttctgctgagaatctgtaccattggtatgctgaggaagttgttggctacagaactattgatgtgcttgtaaccgaagaataccgtaattcccttactggtatcaggaatagggtgtgccgtggagagacttggactggtcagtttccgtttcagaagaaaactggtgaactatttatggctttggtgactaaaagccctgtgtatgaaaacggtgagctggttggtgttgttactgtctcgagcgatgcaacccttttcaataggatgcatccactaagtaatgagcatcaacaacaagctcgtagtaataatagacatgaatcaaacttgagaaaacatcagtggcacctcccgaggcctcagatcgctgcagcatcacaggttccagttgtcccacaatattcatcagctgttgcttcaaacctgaaggcgtcgaagcttctaccacagagaaatggagatgattccttcaatggaaatcataattcgaggagccgagatgaaaatgttccggttgttgcctccacaactttcgagaagtatggctcactggcggataagtttttggggaagctgcaaaggaagattactggcagccaaggaaccgaagataatgagcctatcttaagaaacggtatcaataagtcagcatgtggcagtggaggtagttctaaggcttctaatgcagttacctgcacggctttcagagacaatggcaatggaaaaccaaaaagggctgaagttagaatttcagatgtctatggaaatggagctgagggtttgatacataatggagatcgctttcagtatattgggaacctgggacaaagtaaacctcccagaggactagagagtggtttggtgtctggcatgcggggaacaaaaatgtcggacctaaatggtgagatagaagatgcttggaatactcgtcttagtgttgatcccttgccaattctaggagtcaacagcggtaggcaacaaagtcctgtcaaccaaaggaataatagattagttactgattcgtcatgtgagatacgatgggaagatctacaacttggggaggaggtcggaagaggttcatttgctgcggttcatcgtggagtttggaatggatcggatgttgctattaaggtttacttcgatggtgattacaatgcgatgactttgacggagtgcaaaaaggagatcaacattatgaagaaactgagacatccgaatgtgctactatttatgggagcagtatgtacagaagaaaaatctgccataatcatggaatatatgccaagagggagtctcttcaaaatacttcataatacgaatcagccattggacaagaaacgccgtttaagaatggcccttgatgttgctaggggaatgaattacttacaccgcagaaatccgccaattgtacatagagacttgaaatcttccaatctactcgtggacaagaactggaatgtcaaggttggagactttgggttatcaaagtggaagaacgcaaccttcttgagtactaaatccgggaaaggaactccgcagtggatggctcctgaagttctcagaagtgaaccttcgaatgagaagtgtgatgtgttcagctttggagtcatcttatgggagctaatgactacgttagtaccatgggaccgtttgaactctattcaggttgttggagttgttggtttcatggatcgacgattagacttacctgaaggattaaatccccggatcgcatccataatacaggattgttggcaaactgatccagcaaaacgaccgtcgttcgaggaattaattagtcagatgatgagcctgttccgcaaaccagggtcaggtgcgcaagaagaagacgattga

SEQ ID NO: 1578 - DNA, 1593 bp, Arabidopsis thaliana
atggctccgacgatattcgttgatcactgtatcctcacaacaacgtttgtcgcatccttgttcgcgtttctgcttctatacgtcctgcgtcgccggagcaagacgattcatgggtctgtcaatgtccgtaacggaaccctaacggtgaaatctggaacagacgttgatattatcattgtcggtgctggtgtcgccggcgctgcccttgctcataccctcggcaaggaaggaagaagagttcacgttatagaaagagacttaacggagcctgatcgaattgtcggtgaattacttcagcctggtggttacttgaagttaatcgaactcgggcttgaagattgtgtgaaggatatagatgcgcagagagttcttggttatgctctctttaaagatgggaaacacactaaactctcttacccgttggatcagtttgattccgatgttgcgggtcgtagctttcacaatgggagatttgtgcagaggatgcgagagaaagcttctttacttcccaatgttcgaatggagcaaggaacagtgacatcgttggtggaagaaaacggaataatcaaaggtgttcaatacaaaaccaaagatggccaagagcttaagtcatttgctcctctcactattgtatgtgatggttgtttctccaacttgcgtcgatctctctgcaaacctaaggtgtgtaacatggttgtggaggtgccatccaatttcgttggtctggtattggagaattgcgaactcccgtttccgaaccacgggcacgttgttcttggcgatccgtcacccattttattctatcctatcagcagctcggaagtccgttgcttggtagatgtaccaggttcaaaacttccttcagttgcaagtggtgaaatggctcaccatctcaaaacaatggttgcaccgcaggtaccacctcagatccgtgatgctttcatttctgcagtcgaaaaaggtaacataagaacaatgccgaacagaagcatgccagctgatccaattcatacacctggagctttgcttttaggtgatgcgttcaacatgcgccatcctcttactggaggtggtatgaccgttgcattgtctgatatagtcatcctccgtgatctattgaacccgctcgtcgacttaaccaacaaagagtccttatccaaatacatagaatcattctacacattgcggaaaccggttgcttcgactatcaatacactcgcaggcgctctttacaaagtctttttagcatctccagacgatgcaagaagcgaaatgcgtcgagcttgcttcgattatcttagcctcggaggggtttgctcatcaggacctgtggctttgctatctggtttgaacccacgacctatgagccttgttcttcatttcttcgcagttgcgattttcggggttggtcgtttgcttgtacctctcccgtccgttaaacggttatggcttggagctagactaatctcgagtgcttcagggatcatatttccaataataaaagcagaaggtgtgaggcaaatgttcttccctcgaactattcctgccatttacagagctcctcctactccttcttcttcttctcctcaatga

SEQ ID NO: 1579 - DNA, 450 bp, Arabidopsis thaliana
atggcttcaagaaccacaaaatctttagctcttttcttgatcctcaacttccttttcttcacaacaatatccgcctgcggtaactgcggttgcccttctcccaagccaaaacataaacctagcccctctcccaagccaaaacctaaccctaaacccaagccaacaccacaccctagtcctagcccggcaatagccaaatgccctagagacgcccttaagctaggagtttgcgccaacgtactcaacggcctactaaacgtaacccttggcaagccaccggtcgagccatgttgcaccctcatccaaggactcgctgatcttgaggctgcagcttgtctttgcactgcgctcaaggctaacatcctcggtatcaacctgaatatcccactctctctcagtcttcttctcaatgtttgcagcaaaaaagttcctcgtggcttccaatgctaa

SEQ ID NO: 1580 - DNA, 2313 bp, Arabidopsis thaliana
atggcgatggggaagtattcccgtgtagacgggaagaaatcatcgagctatggtttaaccattaccattgttctgttactttccctctgtttagttgggacatggatgttcatgtcttcttggtcagcccctgctgattctgctggctactcctcaactgatactgctaaagatgtttctaagaatgacttgagaaaagaagaaggcgatcgagatccgaagaacttttctgatgaaaagaatgaagaaaatgaggctgcgactgagaacatccaagtgaagactgattctgagaactctgctgagggaaaccaggtcaatgagagctctggcgagaaaactgaagcaggcgaggaaagaaaagagtctgatgacaacaatggtgatggagatggggagaaagagaagaatgtgaaagaagtaggatccgaaagtgatgaaacaacgcagaaagagaaaacgcaactggaagagagcacagaagaaaataagtccgaggatggtaatggcaacgaagagaaggctgaagagaatgctagtgaaactgaagaaagcacggagaagagtagcaaggaagtctttccagctggtgaccaggctgaaattacaaaagagtcgagcactggagatggagcttggtcaacccaattggttgagtcgcagaacgagaagaaagcacaacagtcctcgatatctaaggaccaaagtagctatggatggaaaacgtgcaatgtgactgctggtccagactacatcccttgccttgacaattggcaggctatcaaaaagcttcatactacaatgcactatgaacatcgcgagcgccattgtcctgaggaatctcctcattgtcttgtgtctctgcctgatggttataagcggtccatcaagtggccaaagagcagggaaaagatctggtacaacaatgttccccacaccaagcttgcagagatcaaggggcatcaaaattgggtgaagatgagtggtgaacatctgacgttccctggtggtggtactcagtttaagaatggtgctcttcattacattgatttcatccaacagtcacatcctgctattgcatggggaaatagaacccgtgttatattggatgtcggatgtggagttgctagctttggtggttaccttttcgaaagagatgtgcttgctttgtcatttgctcccaaagatgagcatgaggcgcaagtgcaattcgcgctggaacgtggtattcctgcaatgttaaacgttatgggaaccaaaagattaccgtttcccggttctgtttttgaccttatccattgtgctcgttgtagagtcccttggcatattgaaggtggtaaacttcttttggaattgaaccgtgctttgaggccgggtggtttctttgtctggtcagcgactccagtctatagaaagaacgaggaagattctggtatatggaaagcaatgtcggaactcacaaaggcaatgtgctggaagctggtgacaattaagaaagacaaactgaatgaggttggtgccgccatataccaaaagccaacttcaaataaatgttacaacaaaagacctcaaaatgagccacctctctgcaaggattccgatgatcaaaatgcagcctggaatgttccacttgaggcatgtatgcataaagtgacagaagattcatcaaagcgaggagcagtgtggccaaacatgtggccagagagggttgaaactgcgcctgagtggttggattcgcaggaaggtgtttatggaaaacctgcaccagaagatttcacagcagaccaagagaagtggaaaactattgtctcaaaggcataccttaatgacatgggaatcgattggtctaatgtgagaaacgtgatggacatgagagcagtctatggaggatttgctgctgcgttgaaggatttgaagttatgggtgatgaacgtggttcctgtggatgcgccagatacacttcccatcatatatgaacgtggtttatttggaatctatcatgactggtgtgaatcattcaacacttatcccagaacttacgaccttctccatgccgatcatcttttctctaccctgaggaagaggtgcaatttggtgtcggtaatggctgagattgatcggattcttaggccacaaggaactttcatcataagggatgacatggaaacattaggagaagttgagaaaatggtgaaatctatgaaatggaaggttaaaatgacgcagtccaaagacaatgaaggcttgctttcaattgaaaagtcatggtggcgtcctgaagaaactgagacaatcaaatcggcaatcgcttaa

SEQ ID NO: 1581 - DNA, 807 bp, Arabidopsis thaliana
atggaagtaacttcccaatctaccctccctccagggttcagatttcatcctaccgacgaagaactcatcgtttactatcttcgaaaccagaccatgtctaaaccatgccctgtctccatcatcccagaagttgatatctacaaattcgacccatggcaattacccgagaaaacagagtttggagaaaatgagtggtatttcttcagccctagagaaagaaaatatccaaacggagtcagaccaaaccgggcagctgtttccggttattggaaagcaaccggtacagacaaagccattcacagcggttcaagtaacgtaggtgtcaagaaagctctagtcttctacaaaggtagacctcctaaaggaatcaaaactgactggatcatgcatgagtatcgtctccatgattcacgtaaagcatcaacgaaacgtaacggttccatgaggttagatgaatgggtactgtgtaggatatacaagaagagaggagcaagtaagcttctgaatgagcaagagggtttcatggacgaagtactaatggaggatgagacaaaagttgtagttaacgaagcagagagaagaactgaagaagagataatgatgatgacgtcgatgaaacttccaaggacgtgttcgctggctcatttgttggaaatggattacatgggacccgtctctcacattgataattttagtcagttcgatcatcttcatcaacctgattcggagtctagttggttcggggaccttcagtttaaccaagacgagatcttaaaccatcatcgtcaagcgatgtttaagttttag

SEQ ID NO: 1582 - DNA, 456 bp, Arabidopsis thaliana
atggcgagcttgctagataaagccaaggacttcgtggcggataaactcaccgcgatccctaaaccggagggttcagttacggacgttgacctcaaagacgtgaaccgtgactcagttgagtacttggccaaagtctctgtcaccaatccttacagtcattcgattccgatctgtgagatcagtttcactttccacagcgccggcagggagattggaaaggggaagataccggacccgggttctctgaaagctaaggacatgacggctcttgatattcccgtggtggtgccgtatagtatactgtttaacctggctcgagacgttggtgtggactgggacattgactacgagctccaaatcggtctaaccatcgaccttcctgttgtaggggaatttactatccctatctctagtaagggagaaatcaaacttcctacttttaaagatttcttctga

SEQ ID NO: 1583 - DNA, 210 bp, Arabidopsis thaliana
atgcctaagcaaatccacgagatcaaggacttccttctgacagctagaaggaaagatgcacgatctgtgaagatcaagagaagcaaggatattgtcaagtttaaggtcagatgctcgaggtacctctacacgctctgcgtctttgaccaagagaaagccgacaagcttaagcagtctcttcctccaggtttgagtgtacaagacctttga

SEQ ID NO: 1584 - DNA, 1362 bp, Arabidopsis thaliana
atggcaccagctcctagtccaatcaattctcaacacgtggcggtgatcggagccggagcagccggtttagtagcagccagagagcttcgtcgtgaaggtcacaccgtcgttgtccttgaccgagagaaacaagtaggtggtctttgggtttacacacctgaaaccgagtccgacgagcttggtcttgacccgacccgacccatagtccactcgagcgtctacaagtctctccgaaccaatctccctagagaatgtatgggttacaaggatttccctttcgtgccacgtggcgatgatccgtcaagagactctagaaggtatccgagtcacagggaagttcttgcgtaccttcaagactttgctacagagtttaacatagaggagatgatccggttcgagactgaggttcttcgtgttgaaccggttaatggtaaatggagggtccagtctaaaaccggcggcggtttttccaacgatgagatctatgacgccgttgtaatgtgttgtggacatttcgcagaaccaaacatcgctcaaattcctggtaaaatatcaaaattttcttatactttatttcaaaaaaaactattggtggtggtagtaatcgggaattttgcgagtggagccgatatcagtagagacatatctaaagtcgcaaaagaagttcatatcgcatctagagcaagtaaatccaacactttcgaaaaacgtcctgtacctaataacaatctctggatgcactctgagatagacaccgcccacgaggatggtaccattgtttttaaaaatgggaaggtggtacatgctgataccattgtccattgtaccgggtacaagtattactttccatttcttgagaccaataattatatgagagttgatgacaatcgcgttgaacctctctacaagcatatttttccacctgcgctagctcccggactttctttcattggtttacctgcaatgggtctacaattctatatgtttgaagtccaaagcaaatgggttgctgcagtcttgtctggacgagttacacttccttcggtagatgaaatgatggacgatcttaagttgtcgtatgaaacacaagaagcgttaggtattcccaaaagatatacacataagttgggtaaatctcagtgtgagtacctcgattggatcgcagacctgtgtggattcccacatgttgaacattggagagatcaagaagtaactcgcggttaccagagacttggtaatcaaccagaaactttccgtgatgaatgggatgatgatgatctcatggaagaagcatacgaagattttgctagactaaatctgatcaattttcatccttctcgttttctcgaatccggaagatga

SEQ ID NO: 1585 - DNA, 573 bp, Arabidopsis thaliana
atggcggaggagcaaaagacgagtaaggttgacgtagaatctccggctgttttagctccggcgaaggaaccgactcctgctccggtggaagtcgcggatgagaaaattcataatccacctcccgtcgagtccaaagctcttgccgttgtagaaaaacccatcgaggagcatacacctaagaaagcttcatctggttcggccgatagagatgtgatacttgccgacttggaaaaagagaagaaaacgtcattcatcaaagcatgggaagagagtgagaagtcaaaggctgagaacagggcacaaaagaagatctctgatgtgcatgcttgggaaaatagcaagaaagcagccgtagaagctcaacttaggaagatcgaggaaaaattagagaagaaaaaagcgcagtacggtgagaaaatgaagaacaaagtagctgcaatccacaagttagcagaagagaagagagcaatggttgaagctaaaaaaggagaagagcttctcaaagctgaagaaatgggtgctaagtatagagccactggtgtagtaccaaaggcaacgtgtggatgtttctaa

SEQ ID NO: 1586 - DNA, 1857 bp, Arabidopsis thaliana
atgtctcattctagaagactttcgttggaacctgctatagattcaatcactggtcgatttcgtgatttacagagaaatgatgatgacgtcaacaaacctgattttcgagaactcgatctaggttctcctgtttctaccttaatgccacgtggctctgcttcttcttccgctgctgcgactcctactagcagctctggctcttctggctctgcttctggtaaaccgtcggtgagttctcagatggctaaacggttagatgatgcttacaagagtcattccggtgagctttctagccccggatccggaatgccgaccacgacccggattcttaaaccgggtcatagaagatcttcttctactggcacgcctttgatcttctctggctctagctttacttcagcaacgagtcacacctcgccacaaggaggtggtagcggtgctacgtcggcagtgtctcccaatactggcgttttaccggcgggaaatatttgtccgtcgggtcggatcttgaaaactggaatggcgtctcggacttcaagtaggactgagactctatgcacaggaactggtaattacggacatggaaacgttgtacgcagcggcggaggaggaggaaccagcggaaaggcggtgagagtggcggagaatggcgaaaacccggaggagttgaagagaatggggaatgatatgtataggagagggagtttctctgaagctctgtcgctttatgacagagcaattttgatttcaccgggaaatgcagcttacagaagcaaccgtgccgcggctttaacggcattgaggcggttaggagaagccgttaaagaatgtcttgaagctgttaggattgatccttcttactccagagctcaccaaagacttgcttctctctatctcagattgggtgaagctgagaatgcaagacgtcacatttgtttttctggtcaatgtccggatcaagctgatctccaacggctacagacgctggagaagcatctccgacgatgctgggaggctcgaaagattggagattggaaaaccgcgattaaggaaaccgatgcagccattgcaaacggcgctgattcgtctcctcagcttgtagcttgtaaagcagaagcctttttgcgtcttaagcaaatagaggattcggatttttgtgtatcttgcattccaagattggatcatcattaccattctcaaccgcaggtgaaactctttggtatggtagttgaagcttatgtgctctgtatccaagctcaagttgatatggcattaggaagatttgagaatgcggttgtcaaggcagagagagctgcgatgcttgatcaaaccaatcctgaggttgtatcagttttaaacaatgtgaagatggttgtgcgggcacgtactcgtggtaatgagctatttagttcggggagattctcggaagcgtgtgtagcttatggagacggtctcaagcaagatgactccaattcggttttgtactgcaacagagcagcgtgttggtataagctcggtttgtgggagaaatctgttgaagattgtaaccatgcgctcaaaagccagcctagttacatcaaggcacttctacgtagggctgcttcatatggaaagcttggtaggtgggaggatgcggttaaagattatgagttcttgagaagagaacttccaggagacagtgaagttgcagagtctctagagagagcgaaaacagtgctaatgaacagaagccaagaatctaaaagcctaggtttcaataatgaagttgaagcggtttcgactttggataagttcaagaaatccgtagcacttcccggtaagtctaatgagaaacttcaatttgtctcaaaaggttga

SEQ ID NO: 1587 - DNA, 213 bp, Arabidopsis thaliana
atggcttttgttgtaacatccctgatattcgctgtcgtaggcatcattgcttcgatatgcactagaatctgcttcaacaaaggcccctccaccaatctgttacatcttacattggtcatcaccgcaactgtctgctgttggatgatgtgggcaattgtatacattgcgcagatgaaccctctcattgtccctatcttaagcgaggtggagtag

SEQ ID NO: 1588 - DNA, 2760 bp, Arabidopsis thaliana
atggccttagctaaagagttaatgggttatcctctcatcacagaaaggtcatcacttgtctcgtcggcgtcgcatttcaagaagaggacacagtcaacacagttctcgatcaacccttttgaccggagaccaagaaaaaccaaatccggcgtcgttgcagccatcagcgaggatttggtcaaaacgctgcgtttttccacaacgaccggagacagaaagagcgaagaggaggagaaagcggcggtgaagttcaaggtgagagctgtggttactgtgaggaacaagaacaaggaggatttgaaagagactcttgttaagcatttggatgcttttgctgataaaattggtcgaaacattgtcttggagcttatcagcacccaacttgatccaaaaacgaagttgccgaagaaaagcaatgcagcagttttaaaggattggtcaaagaaatcgaaaactaaggcggagagagttcactatacggcggagttcacggtggatgcagcgtttggctcgccgggagcaatcaccgtcatgaataaacaccaaaaagagtttttcttggagagcataaccattgaaggcttcgcacttggtcctgttcactttccatgcaattcttgggttcagtctcaaaaagatcaccctgataaacgaattttcttcactaatcagccgtatttgccgaatgagacaccaagcggattaagagtattgagggagaaagagttgaagaatctacgaggagatggaagtggagtgagaaaattatcagacagaatttacgactttgatgtttacaacgaccttggaaatcccgacaaatcatccgagctctctcgccccaaactcggtggcaaagaggttccttaccctagacgttgtcgtactggtcgccaatcaacagtttctgataaagacgcggagagccgagtagagaagccattacctatgtatgtgccacgagacgagcaatttgaagagtcgaagcaggacacttttgctgcagggaggctaaaagcagtcttacaccacctaattccgtcgctcaaagccagtattgtagctgaggactttgcagacttcggcgagatcgatcgtctttataaagaaggcttgttactcaagttagggtttcaagatgacatctttaagaagtttcctctccctaaggtcgtagttgataccctccaagaatctactaaaggactcctcaaatacgacactcccaaaatattatcgaaggataaaaacgcatggttaagagatgacgaattcgcacgtcaagccatagctggaatcaatccagtgaacattgagagagtcaagacttttccaccggtcagcaatcttgaccccaagatctacggtccacaacactccgctcttactgacgaccatatcattggtcacctcgacggattctccgtacaacaagcgttggaagagaatagattgtatatgttggattaccatgacatattcttaccgttcctagaccggattaatgcgctagacggacgcaaagcctatgctactcgaactatcttcttcttgactcgtctaggcacacttaagccggtagccattgagctaagcctccctccccatggtccaaaacatcggtccaagcgtgtgcttacacctccagtcgatgcaacctctaattggatgtggcagctcgctaaagcccacgttagttctaacgatgctggtgtccatcagcttgtcaatcactggttacggacacatgcatgcttggagccatttatattagctgcacacaggcaattgagcgctatgcatcccatattcaagctactggatccacacatgagatacacgttggaaatcaatgctttggctagacaatcgttgatcagtgcagatggtgtgatcgaaggaggcttcactgctggtgcatacggcatggaaatgagtgccgccgcatacaaaagcagctggcggttcgacatggaaggcctccctgccgatctaattcgcagaggaatggcaattcctgatgcaacacaaccacatggtcttaaactcctaatcgaagactatccgtacgccaacgacggtcttttactctggtcagcaatccaaacctgggtccgaacctatgttgaacgctactatccaaacccgaaccttatcaaaacagactctgagctccaatcttggtactcagaatcaatcaacgtcggccacgctgacctccgcgacgctgattggtggccggagttatcaaccgtcgacgacctcgtgtcgattctaaccactctaatctggctcgcctctgctcaacacgccgctctaaactttggacaatacccttacggtggctacgtcccaaaccgaccaccgttgatgcggcggttaatccccgacgagtcggatccagagtacgcgagtttcatctcccatccggagaagtattacttctcgtcgatgccaagtttggcgcagacttcgaagtttatggccgtggttgatactttgtcgacgcattcgccggatgaggagtatattggagagagacaacagccgtcgatttggacaggagatgcggagattgttgaagcgttttatggatttgcggcagagatcggacggatagagaaagagattgagaaaaggaacgctgatcctgaccgtagaaataggtgtggggctggtgttttgccttatgagttgttggttccgagttctgagcctggtgttacgtgtagaggtgtacctaatagtgtatctatataa

SEQ ID NO: 1589 - DNA, 201 bp, Arabidopsis thaliana
atgtcagagaccaacaagaatgccttccaagccggtcaggccgctggcaaagctgaggagaagagcaatgttctgctggacaaggccaaggatgctgctgctgcagctggagcttccgcgcaacaggcgggaaagagtatatcggatgcggcagtgggaggtgttaacttcgtgaaggacaagaccggcctgaacaagtag

SEQ ID NO: 1590 - DNA, 888 bp, Arabidopsis thaliana
atggtgaggacaccatgttgcaaagaagaaggaataaagaaaggagcttggactcctgaggaagatcaaaagcttattgcttatcttcacctacatggtgaaggtggatggcgtactctccctgaaaaagctggattgaagagatgtggaaagagttgtagattgagatgggctaattacttaagacccgacattaagagaggagagtttagtcctgaagaagacgacactatcatcaagcttcatgctcttaagggtaacaagtgggccgcaatcgccactagcttggcgggacgaactgacaacgaaataaaaaactattggaacacaaatctcaagaagcggttgaagcaaaaaggcatcgatgcaatcactcacaaaccgatcaattcaaccggtcaaaccggtttcgaaccaaaagtaaataaaccggtatattcatccggttccgctaggcttcttaaccgcgtcgcaagcaaatacgcggttgaattaaaccgggacttactgaccgggatcatcagtggaaactccaccgtcgccgaagattcacaaaactccggcgacgttgattctccgacctccacattgctcaacaaaatggcggcaacatcagttttgatcaacactacgactacatattccggcttctccgacaactgttctttcactgatgaattcaacgaattctttaacaatgaagagatctccgatatttacacgactgtcgataattttgggtttatggaagagttaaagagtattttaagctacggcgatgccagcgccggagttattgaaaattcgccggaggtcaatgtagctgatgcaatggagttcattgattcctggaacgaagatgacaatatggttggagtctttgtctga

SEQ ID NO: 1591 - DNA, 2469 bp, Arabidopsis thaliana
atggatttcgattcacagcagaagccggagtcggaactgatctcactcattgagaaaataatctttgtcggcaaaccggagtcgcaattggtggtatcactcgtgacgcaaacaatctctctcatcagatctatagattcagatccggatacaaagcaggactcggagccggagctcatgtcactcatttctcaaatatactcgtatctcgaatctaggaattcagatgagctttcatcactccttgatcaaatagtctctctcgtcgagtctacatactcggagccgccagagatgaagctcgcctcactcattaagaaactaatgcctctcatagatacacagatcccaccaatctttacgggaaagtctctcacatacgatgcgaagcttctcctctatacgaagacgttagcgagccgggatgcaaatgtcgtatcactcatagttgaaattgtcactctggtcaactctacggatttggattcgctgccggagtcggagctcatgtctgtcgttactcaaacaatctctttcttcaactctatggatctggattcccagccggagccgctaaggaagcttatatcaatcttttctcaaaaatatttttcggattcagagttggagctggccctggattgggacttcatgtcgctcgttgataaaacattgacttttgagccggagccgaagctcatatcactcatccttgagatagtcacccttgtcttctccatgtatacacagtgggacaagcttatttccttatgtcctcgcttaaatgttagtttgaaagaggaaaagtttcatgtggagcccaaatacaagatgtggaacggcaagctggagtgtctccctttcaactggcagaaattctggttaacaagaggagaactcgcttcccattttctctgccaaggttgcaacggcaagaaccataaagaatataacaaggctccagctgagatcaaacacccttttcatcctaaacatcctcttctcctcgtctccttgcaaatgcttagtagcacgaggaaatgctattgttgcgatgaagatctcaagaatatcttttattattgctccgcttgcgagtttgctgttaattttgcttgtgtgcagaaaccaccagagttgtctatgcaccatcccaagtggcatgagcatactcttgctctgtttccaacgcagactccatttccttgcagcatctgtgccttgacacattcaagcggtcctttctatacatcaagcggtcctttctatacatgtcccccttgtgactttgttatccatcaaaagtgtttcagcttaccacgtgtcataaggatatctcgccatccccatcgtatctcgtttactccttcttttgaccctgaaaaatattggtcttgtggtgtttgtcgcagaaagatcgagaatgattatgggtgctattcttgcgtcaaggacggctgttcctatgcggctcattcgaaatgtgccacacagaccaatgtgtgggatggtaaagaacttgaaggagagccagaagaagacatggatgaagaagtcgagtcgtttgtgacgataagcgatggaattatacaacatttcagtcatgagcatcatcatatgagacttgatgtgaacacagacagagattacgacgagaataagttgtgtcaagcatgtaccacgcctatctattttggtaacttcttctcctgtatgcaatgtgatttcattctccatgagaaatgtgctaattttcgtcgtaaaatacatcatccgacacatcctcatctgctcactctatccagaacatacgaaggtgagcatcatgcgtttgcatgttcagcttgttctgtgtggtgcactgctggtttcttctatgagtgcaatgaagaagcatgttattttaaggtacatgtgcagtgcgccacaatttctgagccgttagtccacgaaagtcatatgcatcctttattcctaacatccaaaccagaagaggagcaaagaacatgtaatgtttgccataatttaagaaggggtggtagtgaaacattcaattgcattgaggagtgtaacttttctttgtgctttggatgtgctactatacctcataaggcgaggtataagcatgataagcatatgctcactatttcttatggggagaagactagtaccatgacgtattggtgtgaagtttgcgagggaaaaatagatccaaaggagcggttttacatgtgtgatgagtattgttgtgtcaccttacacatgccatgtatgcttggttgggacttatacatgaagcccggttcatcgtggataagaggcagtaaaaaagtatatgctttgccgaacaatcatcatatgtctagacctatttgcccccgttgtgagaggcgctgtccatacaaaacagttctcaaagagaatgaattagcattttgttccatattatgtattatgtggaagaagtaa

SEQ ID NO: 1592 - DNA, 2352 bp, Arabidopsis thaliana
atgaagtttggtaaagaattgtcgtcacaaatggtacaagagtggcaacaagcttacgtaaactacgattatctcaaaacccttctcaaagaaatcatcaaactcaaagaaaaaaccaaccctcctccacctccacatcatgccgtccccggtgaaggaattagtcggaaaatgactctataccgagcatttagcggtcttgtccaaacgccgggaaagaaaagacaaagctctcgtcaatccaactattcttcggaaatagacatagaagaaggtaaagctccaatacttgttagcaaatcgactcatggattagagacaacatttctaatgacggcagaggaaggaggagagtatgaattggtatttttccggcgactcgacgatgagtttaatagagttgaaaaattctataaagagaaagttgaagaagtaatgaaggatgcaattatgcttaataagcaaatggatgctcttattgcgtttagggttaaggtggagaatcctgttgggtggggatgggaggaacggacggtggagatgactcgtttggcctccgatatcgcgacttcgactgcggctatcgctgcttctacacccgccagaacccgaaccatgaatcctcgagctcaagctcacatggaggcaattcaagaaggaagcttcagcagagaaaacgaagacgaagatcacggctccgtccgcggagcaaccggcgacgtgaaaacgagcagcttgaacacgatgagaggtgcgaggccagcaccaatcgaagttctagatcacattaagatcaacaacactaaagcaacacctagatccaccattaaaggcgttctcaattcctcaagccaaaacgagatcatattcaatagacagaatctaaacgaagtcgaagagaaactcaaattcgccttcgtcgagttttaccagaagcttcgtctcctcaaaagctacagttttttgaacgtgttggcgttttcgaagatattgaagaagtatgataagcttatgaaactcatacaacgtgttgaatccacattcataaagcattttgcgaatggtcatagaagaaagggaatgaacattttacgacctcagatgaaaagagagaaacaccgagttacattctccaccgggttctctgctggttgtatattttctcttatcgtggctcttgttgccatcatacgcacccggaaaaccatgccggaggcagagcataatacttacatgaatactatgttccctctctatagcttgttcgggttcatcgtgcttcacataactatgtatgctattgatatatactattggaagcgttatcgagtaaattatgccttcatatttgggtgcaagcaaggaactgaacttggttacagacaagttctatttcttggattcaccattggaacgtttgcgttgctttgtgttcttggaaatcttgatatggaagtaaaccccaaaaccaaaaatttcaaaccattaaccgaacttcttcctcttttccttcttgttgctctgtttgtagttttaatcatgccattccattttctctaccgctcaactcggttcttcttcctcacatgtctgttacactgtcttgctgctcctctttacaaggtaacgttacccgatttcttcttaggagatcaattaactagccaagtacaagctcttcgaagcatcaacttctacatatgctactatggttggggagacttcaaaaaaagacaaaacacctgcgaagcctcagaaatctacatatattccttatacattgttgcatcactcccatatctttcccgtcttcttcagtgcatgcgacggatgattgaggaaagaagccttgatcaaggatacaacggagtcaagtacttgttgacagtcatagctgtttctttaagaacagcctatggttatgaagtaaaaaacacgaagaatcctacatcacaccttaaagtgttagctggttcttcctcgattcttgctgctgttttctgtacatactgggactttgttcatgattggggacttctgaacaaaacatctaaaaaccgatggcttcgggataaacttctcatcccacagaaaaaagtatacttcatcgcaatgatcttgaacgttgtgttgagattcgcgtggttgcaaacgatactgaacttcgaattcgagttcttgcacaagcagacaacgcttgcggttgtggctagtcttgagattatgcgccgtgggatgtggaatttcttcagggtagagaatgagcatttgaataatgttgggaagttccgagctttcaaatcagttccattaccgttcaactacgacgaagacgatgaaaaggacgactaa

SEQ ID NO: 1593 - DNA, 315 bp, Arabidopsis thaliana
atggaagttaatggagaagaagagagaagaagtagaagagaagatgaagaaaaagaagattactactactctcttctcaactctccatgttctgtttgtaacaaatttgttcaagccatattgaagtgtcttggtcttgagtcatcatcaataccaccatcttcatcatcatcatcaccatccttagtagaagaagaagattcaggaactgaaactgttgaagaaacaggatttatggcgaggataacagcagtgttaagaaggagaccaagaccaccaccttatagctcaggacgacctggtcaaaacaattga

SEQ ID NO: 1594 - DNA, 3210 bp, Arabidopsis thaliana
atgagtggacaattcaataattctccacgaggggaagacaaggacgtggaggctggaaccagcagcttcaccgaatatgaagatagtccgtttgacattgccagtactaagaatgctccagtggagcggctacgccgttggaggcaagctgcgcttgttcttaatgcttctcgtcgatttcgatatacgctggacttaaaaagggaagaagataagaaacagatgctgaggaagatgagagcgcacgcccaagcaataagagctgcacacctttttaaagcagctgcaagccgcgtgactggaattgcaagtccacttccaactcctggcggtggtgattttggtatcggacaggagcagattgtgtcaatatcaagggatcaaaatataggagctcttcaagagcttggaggggtaagagggttatctgacctgttgaaaacaaacttggagaagggtatacacggggatgatgatgacatattgaaaaggaaatctgcttttggatcaaacacataccctcagaagaaagggaggagtttctggaggtttgtatgggaagcttctcaagatcttactttgatcatactgattgtagcagcagttgcttctttggcattgggaataaagaccgagggtatcgaaaagggatggtacgatggtatcagcattgcttttgccgttcttcttgtcattgtggtgacagctaccagtgattatcggcaatctcttcaattccagaacttaaatgaagagaaaagaaatatacgtctagaggtaacccgtgatgggagaagagtggagatttcaatttatgacattgtagtaggcgatgtcatacccctcaatattggtgatcaggtacctgcggatggagttttagttgctggacattcccttgcagttgatgagtccagcatgactggagagagcaaaattgttcaaaaaaactctactaagcatccattcctaatgtctggctgtaaagttgcagatggcaatgggacaatgttggttactggggtaggggtcaacactgaatggggcttactaatggctagcgtctcagaggacaatggtggagaaacaccattgcaggtgcgcttgaatggtgtagcaacatttatcgggattgtcgggctcacagttgctggcgttgtattatttgtcctagttgtccgttactttaccggtcacacgaagaatgaacagggaggcccacagtttattggagggaagacaaaatttgagcacgtgctagatgatcttgttgaaatcttcactgttgcagttacaattgttgtagtggcagtgcctgaagggcttcctttagctgttaccttgactcttgcgtattccatgagaaaaatgatggcagataaagctttggtgcgtaggctttcagcctgtgaaaccatggggtctgcaacaacaatttgcagtgataagactggaactttgaccttaaacgagatgaccgttgttgagtgttatgctgggttacaaaagatggattctcccgacagcagctcaaaattgccatctgcttttacatccatacttgttgagggtattgctcacaatacaaccggcagtgtgttccgatctgaaagtggtgagattcaggtttctggatctcctacagaaagagcaattctcaattgggcgataaagttgggtatggattttgatgctcttaagtctgagtcttctgctgtacaattttttccattcaactcagagaagaaacgaggaggtgtagcagtgaaatcaccagattcgagtgtccatattcactggaaaggtgctgccgaaattgttttgggatcctgcacgcactatatggatgagagtgagagttttgtagatatgagtgaagataagatgggtgggttaaaagatgctatcgatgatatggctgcaaggagtctgcgctgtgttgcaattgccttccgaacatttgaagcggataagattccaactgatgaagagcaactctctagatgggaattacctgaggatgatcttatattgttggctatcgttggtattaaggatccatgtcgcccaggtgtcaaaaattcagttttactgtgtcaacaagctggagtcaaggttcgtatggtgactggtgataacattcagactgccaaagcaattgcactggagtgtggtatattagcttcagactcagatgctagtgagcctaatctgattgaaggaaaagtatttcgatcctattcagaagaagaaagagataggatttgtgaagagatatctgtaatgggtagatcatcacccaatgacaaacttcttcttgtgcaatcgctgaagaggaggggacacgtcgtggctgtgactggtgatggaaccaatgatgctcctgcactgcacgaggcagatataggtctcgcaatgggtatccaaggcaccgaagttgcaaaggaaaagtcagacatcattatcttggatgacaactttgaatccgttgtgaaggttgtccgttggggtcgatctgtgtatgcgaatattcaaaagttcatccagtttcagctcacggttaatgtcgcagctcttgtcatcaatgtggtggctgccatatccgcgggtgaagttcctctaactgcagtacagctcctttgggtcaatcttataatggatactcttggggctcttgctttagccactgagccaccaaccgatcacttaatggatcgagcgcctgttggcagaagagaacctctcatcacaaatatcatgtggagaaacttgtttatacaagcgatgtaccaagtgacagtcttgttaatcctcaatttccgtggaataagtatcctgcatctgaagagtaagccaaatgctgagagagtgaagaatacagtcatcttcaatgcctttgtcatctgccaggtattcaacgagttcaatgcacggaagccagatgaaataaacattttccgaggagttctcaggaatcacctttttgtgggcatcatctctatcaccattgtgctccaggtagtcatcgtcgagttccttggaacatttgcctcaacgactaagcttgattgggagatgtggctcgtctgtatcggaatcggttctatcagttggcctttggcggtgatcggaaaattgataccggttccagaaactccggttagtcaatactttagaataaaccggtggagaaggaactcatcaggttaa

SEQ ID NO: 1595 - DNA, 1536 bp, Arabidopsis thaliana
atggaggagatgactcccgcagttgcaatgactcttagcttagcagccaacaccatgtgtgaatcatcacctgtcgagatcactcagctaaagaacgttactgatgcagctgacttgttatctgattctgaaaatcaaagcttttgcaacggagggactgaatgcactatggaagatgtttctgaactggaagaggtaggtgaacaggatttgttgaaaactttatccgatacgagaagcgggtcttccaatgtttttgatgaagacgatgtattgtctgttgtggaggataatagtgctgtcataagtgagggcttgttagttgttgatgcaggctctgaattaagcttgtctaatacagctatggaaatagataacgggcgagttcttgcaaccgcgattatcgtaggcgaatcaagcattgagcaggttcccaccgcggaagttcttatcgcgggtgtaaatcaggataccaatacttcggaggttgtcattagattgccagatgaaaatagtaatcatctggtgaaagggagaagtgtttatgaactagattgtataccgctttggggcacggtttccattcaagggaatagatctgagatggaggatgcttttgccgtgtcacctcattttctgaaactacccatcaaaatgcttatgggggaccatgagggtatgagtccaagcctcacacacctcaccggtcattttttcggtgtttatgatggtcatggaggccataaggttgctgactattgccgagatagactccattttgctttggctgaagaaatagaacgtataaaagacgaattatgcaagaggaatacaggagagggtaggcaggtgcagtgggataaagtcttcacgagttgttttctaactgtcgatggtgagattgaaggaaaaattggtagagccgttgttggttcttctgataaggttcttgaggctgttgcgtctgagaccgtaggatcaactgctgttgttgccttggtttgctcatcacatatagtagtttctaactgcggtgattcgagggcggttttattccgtggcaaagaagccatgcccttgtcagttgatcacaaaccagatagagaggatgaatatgcaagaatagaaaatgctggaggcaaagttatacaatggcaaggcgcacgtgtttttggtgttctcgccatgtctaggtccatcggtgacagatatctgaagccatatgtgatcccagaaccggaagtgacattcatgcctcggtcaagagaagacgagtgtctcatactagccagtgacggtctttgggatgtaatgaacaaccaagaagtctgcgaaatagcaaggagacggatattgatgtggcacaagaagaacggtgcaccgcctctagcagagagaggcaaaggaatagatccagcttgccaagccgcagctgactacctctcaatgcttgctctacaaaaaggaagtaaagacaacatctccatcattgtgattgacttgaaagctcaaagaaagttcaagaccagaacctga

SEQ ID NO: 1596 - DNA, 960 bp, Arabidopsis thaliana
atgggcttggtccgatcatttgctttggtcatagtcttccttagttgtctcatcgccgtttatggccaaggtacgaggatcgggttctactcgactacgtgccctaatgccgagacaattgttcggaccactgtggcatctcactttggttcagatccaaaggttgcacccgggttactgagaatgcacaaccatgattgctttgtccaaggttgtgatggttcggtgcttttatcgggacctaactctgaaagaaccgctggcgcaaacgttaacctccatggttttgaggtcattgacgatgccaagaggcagctcgaggcagcatgtcctggtgttgtctcttgtgctgatatcttggccttagcggctcgtgattcggtttctctcacaaacggacaaagttggcaagttccaacaggacgtagagatggaagagtttccttggcatcgaacgttaacaatcttccttctccaagtgactctctagccattcaacaaaggaaattctccgcttttcgcctcaacactcgcgatctcgtcactcttgttggaggaggacacacgatcggaacagctgcatgtgggtttatcacgaacaggatattcaactcgagcggaaacacagcagatccaacaatggaccaaacatttgtaccacaacttcaaagactttgtccccaaaacggcgacggatcagcacgtgttgatcttgacaccggaagtggaaacacttttgacacatcttatttcatcaatctcagccgtaacagaggaattcttcaatccgatcacgttctttggactagtccggccacaagatccatagtgcaagagtttatggcacctagaggcaacttcaatgtccagttcgcaaggtcaatggttaaaatgagtaatattggtgtgaagacggggacaaatggagaaattcgtagggtttgctctgcggttaattaa

SEQ ID NO: 1597 - DNA, 1419 bp, Arabidopsis thaliana
atggcgatctggtttgctagatccaaaacccttgtttctagcttgagacataatctaaatttgtcgacaattctcataaaacgtgattactctcatcgtcccatcttctatacaacttctcagttatcttcaacggcgtatttgagtcccttcggtagcctccgtcatgagtctacggccgtggagacacaggctgatcatttggttcagcagattgatgaagtcgatgcccaggaactggatttcccaggaggcaaagtcggttacacatcggagatgaaattcataccggaatcatcttcaaggaggattccatgttaccgggttcttgacgaagacggacgaatcatccccgatagcgattttattccggtgagtgagaaactcgctgttagaatgtacgaacaaatggcgacgctacaagtaatggatcacatcttctacgaagctcaacgtcaaggaagaatatctttttatcttacttccgtcggagaagaagccattaacatcgcttcagcagctgctctcagtcctgacgacgtcgttttacctcagtaccgagaacctggagttcttttgtggcgtggcttcacgttggaggagtttgctaatcagtgttttgggaacaaagctgattatggcaaaggcagacaaatgccaattcattacggttccaatcgtcttaattacttcactatctcctctccaattgccacgcaacttcctcaagctgctggagttggttattctttgaaaatggacaagaagaatgcttgtactgttacattcatcggagatggtggcacaagcgagggagattttcacgccggattgaattttgcggccgtaatggaagctccggttgtgtttatatgtcggaacaacggttgggcgattagtactcatatctcagaacagtttagaagtgatggaatagttgtgaaaggtcaagcttacggtatccgaagcatccgtgtggacggtaacgatgcacttgcggtttatagtgctgtacgctcagctcgagaaatggctgtaacagaacaaagacctgttctcattgagatgatgacatatagagtaggacatcattctacatcagatgattcaactaagtacagggcggcggatgaaatccagtactggaaaatgtcgagaaaccctgtgaatagatttcggaaatgggtcgaagataacggatggtggagtgaggaagatgaatccaagctaagatctaacgcaagaaaacagcttctgcaagcgattcaggctgcggagaagtgggagaaacaaccattgacagagttgtttaacgatgtatatgatgttaaaccgaagaacctagaagagcaagaacttggtttgaaggaattagtaaagaaacaacctcaagattatcctcctggctttcatgtttga

SEQ ID NO: 1598 - DNA, 1587 bp, Arabidopsis thaliana
atgaatgagaatcacattcaaagtgatcacatgaacaacaccattcatgtaacaaacaaaaaactcccaaacttcctcttatccgtacgtctcaaatatgttaaacttggttaccattacctaatctcgaatgccgtctacattctcatactccccgtcggcctcctcgccgcaacctcctcctcctttagtctcaccgatctcacactcttatacaaccaccttctcaaattccacttcctctcttccactctcttcgccgctcttcttatctttctaaccaccctctacttcacaactcgtcctcgcagaatctttctcctcgatttcgcttgttacaaacccgactcttctctaatatgcacacgagaaacgttcatggaccggtctcagcgtgtcggtatcttcacagaagacaacctcgctttccaacaaaagatcctcgaacgttccggtcttggacaaaagacttacttcccggaggctctcttacgtgtcccgcctaatccttgtatgtctgaagcaaggaaagaagccgagacggttatgtttggagctatagacgcagtgcttgagaaaaccggagtgaatcctaaggatattgggatacttgtcgtgaattgtagcttgtttaatccgacgccttcgttatcggctatgatcgtgaataaatataagctcagaggaaacgttttgagctataaccttggtggaatgggttgtagtgctggtcttatctccattgatctcgctaaacagcttcttcaggttcaaccaaattcatatgcactagtagtgagcacagagaacataaccctaaactggtatttaggcaacgaccgatcaatgcttctctcaaactgcatcttccgaatgggtggcgccgccgttctcctctctaaccgctcctccgaccgctgccgctccaaataccaactcatccacaccgtccgtacacacaaaggatctgacgacaacgcctttaactgcgtttaccaacgcgaagacaacgacgacaacaaacaaatcggtgtctcactttccaaaaacctaatggctatagctggagaagctctcaagacgaacataaccactctgggaccgctagttctaccaatgtctgaacaacttctctttttcgcaacactagtggcgcgaaaagtctttaatgtgaagaaaataaaaccttatattcctgatttcaagctagctttcgagcacttctgcatccacgcgggaggcagagcagtgctcgatgagattgagaagaatttggatttatctgagtggcatatggaaccttcgaggatgactttgaaccggtttggaaatacttcgagtagctcgctttggtatgagcttgcgtatagtgaggctaaaggaaggattaagagaggagataggacttggcagattgcttttggatccggttttaagtgtaatagtgcggtttggagagctttgagaactatcgatccgtccaaggagaagaagaagaagactaatccttggattgatgagattcatgagtttcccgtgccggttccaaggacatctccggtgacatcttcctcggaatctcgatag

SEQ ID NO: 1599 - DNA, 2862 bp, Arabidopsis thaliana
atggctacgattacaccttcttctattagcaatgcctggctcattcctggagcttcttttactgtaaagaagagtgattgttccatcaaatgtagcttttcgcgtaaagctgggaaacagattctatcatcaacgcagagacttgtgttacctttgtcgacttcacttagattgtttcctacacatggaaggcagtttgtgttgcatcctcatcgtagagctactgggactgatgttgtggcggctgtagaggaacaagattctactcctgttgttgcggaggataaagaaaccgtggctagtgagaagtcagatgctcctgctccaacatctcagtcaaggggaacagcaagacctggaaggaagagtgagatgcctgcggttaagaacgaggagctggttcctggagctactttcactgggaaagtacgagctattcagccttttggagcttttgttgattttggtgcttttactgatggattagtccatgtttctcaattgagtgacaactttgttaaggatgtttcgagtgttgtcactattggacaagaggtgaaggtaaggctagtggaagctgacattgagtcaaaacgtatttctttaactatgcgtgagaatgatgatcctcctaagcgtcagtctggtggtagtgataagccgagatcaggagggaaaagggatggttctaaaggaggaggacagaggaagggagaagggtttaactcaaagtttgccaaagggcagatgttggatggagtggtcaagaatttaacgaggtcaggagcgtttataactataggagaaggcgaagaagggtttttaccgacggctgaggaagcagatgatggtattggaagcatgatgatgggtggctcttcgttgcaagctggacaagaggtgaaggttcgtgtgttgaggatagcaaggggacgtgttactttaacaatgaaagaggaagatgatggtaagtttgatgaaacaaccactcagggagttgtgcatacagccacaaatccgtttatgcttgctttccgtaagaacgaagagattgctgcgtttcttgacaagagggaggaagaggcagagaagccacctgttgagacaccagtagagcctgaagctgaagcctctgtcacctcagctgaagtcgaggaatcggtatgtgtcccagctgaagtaacaagtgaagaggttccctcgtcagaaactcccaaggtagtagaagaagaagtgatagctaccaaagctgaagatgattcgccggaaaaagaagagcaaacggaaacacttgctgcagcagctgaagctgaagaggtggttcctccaattccagaaaccaaaagtgaagaggaaattgttgagaactctattcctccaaactcagccactgatgaagtttcatctccagaagctttagcaagtgaagaggttgagaaggagcaagtggttgccgaaacacctgttgatgaagtcaagactcctgcacctgtagtcacagaagcttcttctgaggaaagtggcaacaccgctactgctgaaagcatcaaaggcatttcaccagctctagtgaagcagctgagagaagaaacaggggcaggaatgatggactgcaagaatgctctttcagagagtgagggcgatatggtcaaagctcaagagtacctccgcaagaagggactagcgagcgcagataagaaagcaagcagagccacatccgagggaagaattggtgcttatatccacgacagcagaatcggtgtcctcttggaggttaattgtgagactgattttgtctcacgtggcgacattttcaaggaacttgttgatgatctggcgatgcaggtggctgcgtgtcctcaagtagagtatcttgtaacagaagatgtttcagaagaaattgtgaagaaagaaaaagagatagagatgcaaaaggaagatcttttgtcgaaaccggaacaaataagggagaagatagtggacggtcggataaagaaaaggctagattcacttgcattgcttgagcaaccatacattaaagacgataaggtgatagttaaggatcttgtaaagcagaggattgcaaccattggagaaaacatcaaagtgaagagatttgtgaggtacactctcggagaaggccttgagaagaaaagccaggactttgctgctgaggttgctgcccaaactgcagctaaaccgaaagctaaagaagagccaaaagctgaagaggccaaggaagctgttgcaagcccaccaactacagtggtttcagctgctcttgtaaagcaactgcgtgaagagacaggagctggaatgatggattgcaagaaggcattggcggcgacaggaggagatcttgagaaagcacaagaattcctcagaaagaagggtctctcatcagctgataaaaaatcaagccggcttgcatcagaagggagaatcggttcgtacatccacgattctcggattggagttctgatagaagtgaactgtgagactgactttgtcggaagaagcgaaaaattcaaggaattggttgatgatcttgcaatgcaagcagtggctaatccacaggtgcaatatgtttcaatagaggacattccagaggagataaagcagaaagaaaaagagattgagatgcaaagagaggatcttttgtcgaaaccagagaacataagggagaagattgtggaaggaagaatctcaaagaggcttggagaatgggcattgcttgagcagccttacatcaaagacgacagtgttctggtgaaggatctggtgaagcaaacagtggctactcttggggaaaacatcaaagtcagaaggtttgtgaagtttactcttggagaagataactga

SEQ ID NO: 1600 - DNA, 2520 bp, Arabidopsis thaliana
atggttaaagtaaggaagatggagatgattttattactaattcttgtgattgtggtggcggcgacggcggcgaatgtgacttatgaccaccgtgcattagtaatcgacgggaaacggaaagttctaatctctggttctattcattatcctcggagtactcctgagatgtggccagagcttatacagaaatctaaagacggtggtttagatgttatagagacgtatgtgttttggagtggtcacgaaccggagaaaaataagtataattttgaaggaagatatgatttagtgaaatttgtgaagcttgcggctaaagctggtctctatgttcatttaagaattggtccttacgtctgtgctgaatggaattacggtggtttcccagtgtggttgcattttgttccaggaattaagtttcgaactgataatgagccatttaaggaagaaatgcagagatttaccacaaagattgttgatttgatgaagcaagaaaagctttatgcatcacaaggaggtccaatcattctctcgcagattgagaatgaatatggaaatattgactcagcttatggtgcggctgctaaaagttatatcaagtggtctgcttctatggctctttcgttagatactggagtaccatggaatatgtgtcaacaaacagatgctcctgatcccatgatcaacacatgcaatggtttctactgtgaccagtttacacctaactcaaataataaaccaaagatgtggaccgagaactggagtggatggttccttggttttggagatccttctccttacagaccagttgaagatcttgcatttgcggtcgcgcggttttaccaacgaggtggaacgttccagaactattacatgtatcacggtggaacaaactttgatagaacaagtggaggaccattaatctctactagttatgattatgatgctccaattgatgagtatggactacttagacaaccaaaatggggacacttacgagatctacacaaggctatcaagctttgtgaagatgcattgattgccacagatccaacaattacttctctaggttcaaatttggaggctgctgtatataaaacagaatctggatcatgtgctgcttttcttgcaaatgttgacacgaagtctgatgcaactgtgactttcaatggaaaatcatataacttgcctgcatggtccgtaagcatcttgccggattgcaaaaatgtagctttcaataccgcaaaggtaaagttcaatagcatctctaaaactcccgatggtggttcgtctgcggagttaggttcacaatggagttacattaaagaacctattggaatttccaaagctgatgcattcttgaaacctggattgctagagcagattaacacaacagctgataaaagcgattacttgtggtactcactaaggacggatataaaaggcgatgagactttccttgacgagggatctaaagccgtccttcacattgaatctcttggtcaagtggtctatgcttttataaatggaaaacttgcaggaagcggacatggcaaacagaagatttctttggatataccgattaatcttgtaaccgggacgaacacaatcgatctccttagtgttaccgtagggcttgcgaattatggagctttctttgacttagtgggagcaggaataaccggacctgtgacacttaaaagcgctaaaggtggtagctcaattgatttggcttcacagcaatggacttatcaggttggactcaaaggagaagacacaggtttggcaactgtagattcttctgaatgggtttcaaagtctcctttgcctactaaacaaccacttatttggtacaagacgacatttgatgctccttctgggagcgagccagtagctatagacttcacgggtacaggaaagggtattgcatgggtgaatggacagagcataggtaggtactggccaactagtatcgctggaaatggcggttgtacagaatcatgcgactatagaggttcttaccgtgcaaacaaatgcctcaagaactgtggaaaaccttcacagacattgtatcatgtacctcgctcgtggctaaaaccgagcgggaacatacttgttctgtttgaggagatgggaggagatccaacacaaatatcatttgcgacaaaacaaacaggaagcaatctttgtctaacggtgtcacagtctcatccaccaccggtggacacatggacttccgactcaaagatctcaaacagaaacagaaccaggccggttctttcgttgaaatgccctatctctactcaggtgatattttctataaaatttgcaagctttggtacacccaaaggtacttgcggtagcttcacacaaggccattgcaatagctctcgatctctctccctcgtccaaaaggcatgtattggattgaggagttgcaacgttgaagtatcgactagagtgttcggggaaccttgtcgtggcgtcgtcaagagcttagctgttgaagcttcttgttcatga

SEQ ID NO: 1601 - DNA, 807 bp, Arabidopsis thaliana
atgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaaggcaagtgcaagcgccagtgtgagcgccacagattcagttgaagcagagcaatggaacggaggaggaggggattgcaatatggaggagtggatgaatatgatgatgatgatggattttgggaatggagattcttcagattcaggaaatacaattgctgatatgttccagtga

SEQ ID NO: 1602 - DNA, 408 bp, Arabidopsis thaliana
atggtgaaatgtatgaagccaggaaaagccgtgatccttttacaaggacgatacaccggtaaaaaggcggtgatcgtgaaatccttcgatgacggtaccgttgagaagaagtacggtcactgtctcgtcgccggattgaagaagtacccaagcaaagtcattcgcaaggattcggcaaagaagacggctaagaaatcgcgcgtgaaatgcttcttcaaggtcatcaattaccagcacgtgatgcctacgcgctacactcttgatttggatctgaagaacgttgtctccgccgacgcgatctcgtccaaggataagaaagtgacggctcttaaggaagcgaaggcgaagtttgaagagaggtttaagactggcaagaacagatggttcttcaccaagcttaggttttga

SEQ ID NO: 1603 - DNA, 960 bp, Arabidopsis thaliana
atggctcttcctctcgagctcgaaagcctcactgaagccatctcagctgggatgggaatgggagttgatgagaatgcattgataagcacactggggaaatcgcaaaaggaacatagaaaattgtttaggaaagcaagcaaaagtttctttgttgaagatgaggaaagagcttttgagaaatgtcatgatcacttcgtcagacacctcaagcttgagttctcccgcttcaatactgcggtggtgatgtgggcaatgcatccatgggagagagatgcaaggttggtgaagaaagctttgaagaaaggagaagaagcttacaacctcatcgttgaggtctcatgcacacgctctgctgaggatctcctcggtgcacgtaaagcttaccactctctcttcgaccaatcaatggaagaagacattgcctctcacgtccacggtcctcagcgcaagttgcttgtggggctcgtgagtgcttatagatacgaaggaaataaggtgaaggatgattctgccaaatccgatgctaagattctagccgaagcagtggcttcttcaggcgaagaagccgtggagaaggatgaggttgttaggattttgaccacaagaagcaaacttcatctccaacatctctacaaacactttaacgaaatcaaaggctctgatcttcttgggggtgtatctaagtcttctcttctcaatgaagcattgatttgtttgctcaaaccggctctgtatttcagcaagattttggatgcgtctctgaacaaagacgcagacaagactaccaagaaatggttgacaagagtgttcgttacaagagcagatcatagtgatgagatgaatgagatcaaagaagagtacaataacctttatggtgagactttggctcaaagaatccaagagaagataaaagggaactacagagatttcttgctcacacttctctccaaatccgattga

SEQ ID NO: 1604 - DNA, 870 bp, Arabidopsis thaliana
atgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactag

SEQ ID NO: 1605 - DNA, 2283 bp, Arabidopsis thaliana
atgtcagacgctctttctgcgattccggccgcagttcatcgcaatctctccgataaactctatgagaagcgcaaaaatgctgcgcttgagcttgagaatattgtgaagaatctaacttcttcgggtgatcatgacaagatctcgaaagtcattgagatgttgattaaggaatttgccaaatctcctcaagctaatcatcggaagggtggtctaattggcttagctgctgtaactgttggtttgtctacagaagctgctcaatatcttgagcaaatagtgccacctgtgattaattccttttctgatcaagatagccgagttcggtactatgcatgtgaagctctctataacattgcaaaggttgtgcgaggcgatttcattattttcttcaataagatatttgatgccttatgcaaactctcagcagattctgatgccaatgtccaaagtgctgctcatcttttggatcgccttgttaaggatattgtgacggaaagtgatcagttcagtattgaggaattcatacctcttttaaaagagcgaatgaacgttctcaacccttacgtccggcaatttctggttggatggatcactgttcttgatagtgttccagacattgacatgcttgggtttctgccagactttctcgatgggttattcaatatgttgagcgactctagtcatgaaatacgacagcaagctgattcagctctttcagagtttcttcaagagataaaaaattcaccatctgtagattatggtcgcatggctgaaatactggtgcagagggctgcttctcctgatgaattcactcgattaacagccatcacgtggataaacgagttcgtaaaacttgggggagaccagctcgtgcgttattatgctgacattcttggggctatcttgccttgcatatctgacaaagaagagaaaatcagggtggttgctcgtgaaaccaatgaagaacttcgttcaatccatgttgaaccctcagatggttttgatgttggcgcaattctctctgttgcaaggaggcagctatcaagtgagtttgaggctactcggattgaagcattgaattggatatcaacacttttaaacaagcatcgtactgaggtcttgtgcttcctgaatgacatatttgacacccttctaaaagcactatctgattcttctgatgacgtggtgctcttggttctggaggttcatgctggtgtagcaaaagatccacaacactttcgccagctcatcgtatttcttgtccacaatttccgagctgataattctcttttggaaaggtatctggaaagaacatattatttagttggtcaaaacatatctcgttataggcgcggtgcccttattgtccgaagaatgtgtgtacttttggatgccgaaagagtctaccgagagctctctacaattcttgagggagaagataatcttgactttgcttctaccatggttcaggcattgaatttgattttgcttacttccccggagttatcgaaactgagagaactattaaaaggttcactcgtcaatcgcgaagggaaagaacttttcgttgccttgtatacttcatggtgccattcacccatggcaattataagcctctgcttattagctcaggcttaccagcatgcgagtgtcgtgattcaatcattggtagaagaagacattaacgtcaaatttctagtacagcttgataaattgatccggcttctggaaactccaatctttacttaccttagattgcagcttctggaaccaggaaggtacacatggttgctgaaaacactttatggtcttcttatgttacttcctcagcaaagtgcggcgttcaagatacttaggacaagactcaaaactgtgccaacgtactcattcagtactggaaaccaaataggcagagcaacttcaggagttcctttctctcagtataagcatcaaaacgaggacggtgacttagaagacgataacatcaacagttctcaccaaggaatcaattttgctgtgcggctacaacagttcgaaaacgtacagaatctacatcgtggccaggcaaggactagagtgaactactcatatcactcttcctcttcttctacatcaaaggaggtgaggagatctgaagaacaacaacagcagcagcagcaacaacaacagcaacaacaacaacaacaacgaccaccaccttcttcgacatcatcatcagttgcagataacaatagacctccatcaagaacttcaagaaaaggccctggtcaattacagctttaa

SEQ ID NO: 1606 - DNA, 477 bp, Arabidopsis thaliana
atgcagtcgatgaaagaaacagcttcgaatattgcagcttctgcaaaatctggcatggacaaaaccaaagctaccttggaggaaaaggcggagaagatgaagacacgagaccctgttcagaaacagatggctacacaggttaaagaagataagatcaatcaagctgagatgcagaagagagaaacgcgtcagcacaacgcggccatgaaagaagcggctggagccggaaccggtttaggtttggggacggccactcactcgaccactggacaagtcggacacggcactgggacacatcagatgtcggctctgcctggtcacggaacgggacaactgaccgaccgcgttgtggagggcacggctgtgaccgacccgattggaaggaacactggaactggtcggacaaccgctcataacactcacgttggtggtggtggtgccaccgggtacggaaccggcgggggatatactggataa

SEQ ID NO: 1607 - DNA, 1377 bp, Arabidopsis thaliana
atgagaaacaatttcgtccctataattctctccttcatcatcttcttgactccatcaatcgcagaacaagaaccttcaattctttctcccgtcgatcaactcctcaacaaaacaagctcatacctcgatttttcaacaaaattcaaccaaccaagaatcgaactaacaacatcaacgatcatcgccggcttactctctttcctagcttcatcaatctcaagcgccggtggaatcggcggtggaggtttatatgttccgataatgacaatcgtggccggtctcgatctaaagacagcttcaagcttctcagcttttatggttactggtggatctatagctaacgtgggatgcaatctattcgttagaaaccctaaatctggtggcaaaaccctaatcgacttcgatttagctcttttattggaaccatgtatgcttcttggagttagtattggtgtgatctgtaatcttgtttttccgaactggttgattacgagtctcttcgctgtgtttcttgcgtggtcgacgttgaagacttttggaaatggactttattattggagattggaatcggagatggtgaagattagagaatcgaatagaattgaagaagatgatgaagaagataagattgagagtctaaagttgcctctcttggaggattatcagagaccaaagaggtttccatggattaagcttggagttttggtcattatttggctttcttacttcgcagtttatcttcttcgaggaaacaaatatggcgagggaatcatatcgatcgagccatgtggaaacgcctactggctcatttcatcgtctcaaataccactaactctcttcttcactctctggatctgcttcagtgacaatgttcaaagccaacaacaatcagattaccatgtctcagtaaaggatgtagaagatttgagatcaaatgatggagcaagatcaaacaagtgtatgttccctgtaatggctctattagctggagttttgggtggtgtttttggtattggaggtggaatgctcattagtcctcttcttctccaagttggtatcgctcccgaggtaactgcagcgacatgttctttcatggttcttttttcatcaacgatgtctgcgattcaatacttattactaggcatggaacataccggaaccgcaagtatatttgcggttatatgttttgtggcatcactcgtgggactaaaggtggttcaaaaggtaataaccgagtatggaagggcttcgatcattgtgttctcggttggtatcgtcatggcattgagtattgtgttgatgacaagctatggagctcttgatgtttggaatgattatgtctctggtcgttacatgggtttcaagttaccttgttga

SEQ ID NO: 1608 - DNA, 1467 bp, Arabidopsis thaliana
atgggtcttgaagttgggtccttatgcttcaaacttaaagacggaggcttgacatcaagaaccaacagtttcaagagagacgatactaataggcaccagaattctcctaagagtactatggagcggtcgttgagtttcaacagctgggaggttcctaaagagaccaagactgattcagattttgaggtcttggagacaaagaagtcaacgcctaacactttgaatggaagaaactgtgagagaatccaaatcaagaaacctacagttactccaccagagccatttgtgttcttctctcctagacctgtcaccgagcttgatgcagctgcaactacgttacaaaaggtgtacaagagttacaggaccagaaggaacttagcagattgtgcggtcgttgttgaggagctctggtggaggactttggaaggtgcagctttggatttgagctctgtgtctttctttggagaagaaaaacatgagaccgctgtttcgaaatgggcacgagctagaaaacgagctgctaaggttgggaaaggcttatctaaagatgaaaaggctcagaaattagctcttcagcattggcttgaagctattgacccacgtcatcgttacggccacaacttgcacttctattatgatgtctggtcagcgagcaagagcacacaaccattcttttactggttggatataggagacggcaaagatgtaaatcttgagaaacaccctagaagtgttctgcaaaaacaatgcatcagatacttaggaccgatggagagagaagcatatgaagtgatagtagaagatgggagactaatgtataaacagggcatgactctgatcaattcaacagaggaagccaagtcgatttttgtacttagtactactagaaacttatacgtagggattaaaaagaaaggtcttttccagcactctagtttcttatctggaggtgccacaaccgcagcaggaaggttagtcgcccgcgatgggatccttgaggctatatggccatatagtggacattatctcccaacagaagacaacttcaaggagttcataagtttcttagaggagcacaatgttgatctcaccaatgttaagagatgttctgtgaatgaggaatattcgtcattcaaatcgactgcagatgaagaagaagaaaggaaggaagtctcagaagaagttgagataccttcagagaaagaagagagagcgagaccagtgtttgatcctgtaaagagactgtcttgtaaatggacaagtggatatggtccaagaattgggtgtgttagagattatccaatggagctacaagcacaagcactggagcaagtcagtctgtctcctagggtttcaccagctaattcttacggaccaattccatctccaaggcctagtcctaaagtgagggtgtctccacgcttggcatacatgggaatcccaagccctagggctgtaaagtgttaa

SEQ ID NO: 1609 - DNA, 582 bp, Arabidopsis thaliana
atgaattctcaccagaatcaaaccggagtgcaaaagaagggaataacggagaaaatcatggagaagctaccaggtcatcatggacctactaacactggtgttgttcaccacgagaagaaagggatgacggagaaagttatggagcagctgccaggtcatcatggtgctactggtaccggtggtgttcaccacgagaagaaaggaatgacggaaaaagttatggagcagctgccaggtcatcatggatcacaccaaactggaaccaacacaacttatggtactactaacactggtggtgttcaccacgagaaaaaaagtgtgaccgaaaaagttatggagaaactaccaggtcatcatgggtcacatcaaactgggactaacacggcttatggtactaacactaatgtcgttcaccatgagaaaaaaggtatagcagaaaagattaaagagcaactgccaggtcatcatggaactcacaaaactggaaccaccacaagttatggtaatactggcgttgttcaccatgaaaataaaagtacgatggataagattaaagagaagcttcccggtggtcatcactag

SEQ ID NO: 1610 - DNA, 1302 bp, Arabidopsis thaliana
aatgggccaaatgggctactcttgtatcgggtcaggaacggaatcgatcgatattgaaggagagaagatgcctggtttaacatgtaacgcgtgtaacatggagttcaaggacgaagaagaacgtaaccttcattacaaatccgattggcaccgctacaatctcaagcgcaaggtggctggagttcctggagttacagaagccttgtttgaggctagacaatctgctcttgctcaggagaagaataaatcaaatgaagcacctatgctttatacttgtgcaatctgtgctaaaggttacaggagttccaaggctcatgagcagcatcttcagtcgcgtagccatgttttgcgggtttcacaagggacatcaatcaacggagaggaggatatagcgattatcaggcaacttcctcgccgtgttcaacacaggggttccattgatgatgatagtgaagatgaatgggtggaggttgattctgacgaggaattggctgctgaagaagcctctgattctttgtctaagttgaatgtgaatgagtctggatctgctgaagatatggatgatgatggtgatgcagataagtatgagctggatccaacctgctgtttgatgtgtgacaaaaaacataagaccttagagagctgtatgcttcacatgcataagcatcatggtttctttattcccgatattgagtatctcaaggatcctgaagggcttctcacttaccttggtcttaaggtcaagagagacttcatgtgtctgtactgcaatgagctgtgccgtccattcagcagcttagaagctgtaagaaaacatatggaagcaaagagtcattgcaaactgcattatggtgatggtgatgatgaagaagatgctgagctagaagagttttatgactacagcagcagctatgttgatgaagctggaaagcaaattgttgtatctggtgaaacagacaatactgtagaactcgttggtggttctgagctcttgatcacggagaagtccgagaacacaacaacgtctaaaactctcgggtcccgtgaattcatgcgttactacagacagaagccacgcccaacttctcaagacagcaaccagataattgcctctttatcttcaaggtttgttttctccaaacccgttaatcatccgagtctatccaatcagataatcggcaaggtacaagagcctgggtctgaagacagtaccgtcgaaagaggagactttgaggatgaaagtgcgcaaggagatgagcaagagaggcgagacaatgcgtaccaagatcggagtgaagagta

SEQ ID NO: 1611 - DNA, 624 bp, Arabidopsis thaliana
atgcttgccgttcaccgtccttcttccgccgtatcagacggagattccgttcagattccgatgatgatcgcgtcgtttcaaaaacgttttccttctctctcacgcgactccacggccgctcgttttcacacacacgaggttggtcctaatcagtgttgctccgccgttattcaagagatctccgctccaatctccaccgtttggtccgtcgtacgccgctttgataacccacaagcttacaaacactttctcaaaagctgtagcgtcatcggcggagacggcgataacgttggtagcctccgtcaagtccacgtcgtctctggtctccccgccgctagctccaccgagagactcgatatcctcgacgacgaacgccacgtcatcagcttcagcgttgttggtggtgaccaccggctctctaactaccgatccgtaacgacccttcacccttctccgatctccgggaccgtcgttgtcgagtcttacgtcgttgatgttcctccaggcaacacaaaggaagagacttgtgacttcgttgacgttatcgtacgatgcaatcttcaatctcttgcgaaaatagccgagaatactgcggctgagagcaagaagaagatgtctctgtga

SEQ ID NO: 1612 - DNA, 594 bp, Arabidopsis thaliana
atgaaatgttacaaaagctcatcaattctctcaaccaatcaccacccattcttctacaaacaacaaccaatctcctctcttcaaccaacttcaatcccaacaactatctcttacccaacccgaacccgattctcctccacccggatccaatctcgattaacccacgacgatccagtaaaacaatcggaagacttatccttctacgatcttctcggcgtcaccgaatcagtcacactcccagaaatcaaacaagcttataaacaactagctcgaaaatatcaccccgatgtttctcctccggatcgtgtcgaagaatacacagatcggtttattcgtgttcaagaagcttacgaaactctctccgatcctcgccggagagttttatatgaccgtgatttgtctatggggttttctttttctttctccggtcgacgccagaaccgttacgatcaggaagtggtggaagagaagagtgagtggaaagcaaaatggcaaactcagctctcagggttaaggagaagaagcaatcagaaagataataacacgatgtcttgggctgcaagaatgcgtcgtcaacaacaagaatcttcttaa

SEQ ID NO: 1613 - DNA, 1254 bp, Arabidopsis thaliana
atgtggccaagacttgtggccaacaagatcctaaggaaaagcctcgggagcaacaacttcgttgccgatttcccacctaatactgatcagaagcttatagaagcttccggattagctgatgaacgatctaaatcaattctccacaaccaacacaaaaccactcttctcaactacaaggtttttgtaagcacatggaacgtgggtggtatcgtaccggacgatggacttgacatggaggatctactggaaacacataaaacaccgtgcgacatatacgtgcttgggtttcaagaggttgtgcctctacgagcttcgaatgttttgggatcagataacaacaaagtctctacaaaatggaactctttgataagagatgctttgaacaagagagcaagacctcatcgagacgaagacttgtcggaatcaaagggcattaatggtatttcacaagattttagatgtatcataagtaaacagatggtcggaatcttgatcaccgtttgggtccgaggtgatctctggccgtacatccgttatcctagcgtttcatgcgttggttgcggcatcatgggttgcttaggaaacaagggatcagtatcggttagatttcaattgcacgaaacgacattttgtttcgtttgtagccatctagcttctggtggccgcgaccgagatgaaagacagagaaactccgacgtcaacgagatcttagctagatctagttttcctcgaggctcatctctagatttacccaaaaagatccttgatcacgatcgggtgatttttttgggagacttgaattatagaatttcattaccggaggagaagacaagattattggtggaaagcaaaaaatggaacatcttactagaaaatgatcagctgaggatggagatcatgaacggccagattttcagagggtggcaagaaggaattgtcaaatttgctccaacgtataaatacgttccaaattcggatttatattacggatgcattacatacaaaaaagacgagaagaaacgagctcctgcatggtgtgatcgaataatatggtacggaaatggactgaagcaacatgaatatacaagaggagaaacgaagatatctgatcataggcctgtcaaagcaattttcaccacagaaattactgtaacacggcgtggtaaaaagattcgtaatttctttttctcggacagatttgaagaaagaattggtgacatagattctaaagactactcgtggatatctacatag

SEQ ID NO: 1614 - DNA, 1488 bp, Arabidopsis thaliana
atgttactaatcatatcattcaccatcgtctccttcttcttcatcataatattctcactctttcacttactcttccttcaaaaactacgttactgcaactgcgagatctgtcatgcttatctcacttcaagctggaaaaaagacttcatcaatctcagtgattggtacactcatcttctccggcggtctccgacgtcaacgatcaaagtacacgtcttaaacagcgttatcacagcgaatccatcaaacgttgaacatatcctcaaaaccaatttccacaattacccaaaaggcaaacaattctctgttatcctcggtgatcttttaggccgtggaatcttcaattccgatggtgacacgtggcgtttccagagaaaactcgcgagtttggaacttggaagtgtttctgtaagagttttcgctcatgagattgttaagaccgagatcgagacacgtcttcttccgatattgacttcgttttccgacaatcctggttctgttttggatctacaagatgtgtttagaagattctcgtttgatacgattagtaaattgtcgtttgggtttgacccagattgtctccggttaccttttccgatatcggaattcgccgtcgctttcgatacggcgtcgttgttatcggcgaaacgagctttagctccgtttcctctgttatggaaaaccaaaaggcttttaagaattggttctgagaaaaagcttcaagaatctatcaatgtgataaaccggttagctggtgatttaatcaagcaacggaggttaaccggtttgatgggtaaaaatgatttgatttctagattcatggcggttgtggcggaggacgatgatgagtatctccgagacatcgttgtgagttttctattggctggtcgggatacggtagctgctggtttaaccggatttttctggttattgacccgtcatccggaagtggagaaccggatccgggaagaactggaccgggttatggggaccggttttgactcagtcactgctcgttgcgatgaaatgagagagatggattatttgcatgcgtcgctgtacgagagcatgagattgtttccgccggttcaattcgattccaaattcgctttaaacgatgacgttttgtctgatggtacatttgtgaatagtgggactagagtcacgtaccatgcttatgcaatgggtcggatggaccggatctggggcccggattacgaagagtttaaaccagagaggtggttggataacgaaggtaagttccggcccgagaatccggttaagtacccggttttccaggccggagctagggtttgtatcgggaaagagatggctatcatggagatgaaatccatagctgtggcaatcattaggaggttcgaaacacgggtcgcaagtcccgaaacaaccgagacactccggtttgcgcctggtttaactgcgacggttaacggtggattgccggttatgatccaagaaaggagttag

SEQ ID NO: 1615 - DNA, 717 bp, Arabidopsis thaliana
atgataatgagaagcgcgtcttcactggaccttaacctacgcgccgcccagaaaccgtctgttccaagggtggtaaccacggctcgaaccgtctctgctgctactcctcgtgttgctaaaccgattacaagagcttcttcagatggaaacctctacaagattcagtcgccggagagcataacgaaaaccatcagcgtatatcacgaagaaacggcgtctttgagggttttggaaggatctcgactcccccaaggaggttccaacggtggatttggtggtagaggcggagatggtgccggaggtggcggtggaggtggaggtgggagcgtagatggttattacgaagagatgatccaacgttatcccggagacactctccttctctctaactacgctcgtttcctcaaagaggtgaaaggagatgggagaaaagcggaggagtactgtgagagagcgatgttgtctgagagtggaagagatggagagttactgtctatgtatggagatttgatatggaaaaatcatggagacggtgttcgtgctcagtcttactatgatcaagctgttcaatcttctcctgatgactgtaatgttcttgcgtcgtatgctcggtttctatgggatgctgaagaagaagtggaagaggaagagagtaaacatcatgaggatggtttctctgactctacctataacccatctgtatcagttgtgtcttga

SEQ ID NO: 1616 - DNA, 1728 bp, Arabidopsis thaliana
atgacggagtatgagaatgggaagaagaggaaagtacgaaacaaacaacaagtaaaagtacagttcttgtctcaaaggtatctaatcttatgcttttgttgtttcttcgtcttgctcttcttcttatcttccgaccgaatctccacactctctgttcgttccgattctctgagaccgtctcttcgtgttcctactctctccgttttatcatcatccatggattcgtttcaccgtggtagattccctccgttgagtgttgaagacagagttcaattccctgaccatttattgctgattctttcgcacggaattgggaaaggtgaaaaaaacctagtttgtgtttatcgtggagtaaaggaagagactttggtgttgccctcgatttctagtgatgaattcgatgagtttaggtcgattgttcgatgtcctaatgctcctttgaactattcttcatctgttgatttgcaattccgtggagatttggtgaagaagaagatgaagaaacagagccgtcgtgttcataattgggaaaaggttggttatgaggcggtgattgacggcgacacggtggttgtgtttgttaaaggattgactcgaagacctcacaaggaatcagatccttcttactataagtgtcaatttgagattgagaattcggaggagaaagaggtgactcaagctattgctgctgcgcaagaagttgtgaggtgtggtttgcctgagagtttgaagctaaatccagagatgatgtttcgagtgagtgtaattcacattgatcctagaggaagaactacccctgctctgccttcggttgcgagaatctacggttctgattcgattgagaagaaggagaagaagagtggagttaagcatgagctttgtgtttgtacaatgttatggaaccaagctccgttcttgcgtgaatggatcatgtatcactcgtggctcggtgtcgaacgttggtttatatatgataacaacagcgatgatggtatacaagaggagattgagttgcttagttcggagaattacaatgtgagtcgacatgtttggccttggatcaagactcaagaagccggtttttcgcattgtgcggttagagcgaaagaagaatgcaattgggttggattcttcgatgtcgacgagttctactacttccctacgcatcgctctcaaggcttaccgagcaaaaacgctttgaagtcgcttgtatcgaactacacttcttgggatttggttggagagatcagaacggactgtcatagctacggtccatccggtctgacctcggttccatcacaaggcgtgaccgtaggttacacttgtagacaagcgaaccccgagagacacaagtcgataatccgccctgagttgctcacaagctcattgctcaatgaagtacatcattttcagttgaaagaaggagtggggcatatgagtttggtggagagtgttgcggtagtgaaccattacaagtaccaagtttgggacactttcaaagctaagttttacagaagagtggctacttatgttgttgactggcaagagaatcagaatcaagggtctaaagatcgagctccagggctcgggacagaggcaatcgagccgccggattggaaacgacggttctgtgaagtgtgggacactggattgaaggatttggttatgtcgaattttgctgatcaagtgactggttatctgccgtggcagaggcaacaacaagaatga

SEQ ID NO: 1617 - DNA, 1845 bp, Arabidopsis thaliana
atgatgggaagcatattattgttactattattcttttctctggtccaatcacgttcagacacgtcatattcaaaaattcaacttcccggcgattctctgaccctctccgttaccgatttcggtgctaccggcgatggtatcaactacgatacttctgcgattcagtcaaccattgacgcctgcaatcgtcactacacatctttttcttccatctgccgcgtcgttttcccttccggcaactatttgaccgctaagctccatctccgatctggcgtcattctcgatgtgacggagaacgccgtgcttctcggtggaccgagaatcgaggattattatccggcggagacttcgtcggattggtacgtggtggtggcgaataacgctacggatgttggaatcactggcggaggagcgattgatggccaaggatcgaagttcgtggtcagattcgacgagaagaagaacgtgatggtgagctggaaccaaaccggagcttgcttgggtgatgagtgtagacccaggcttgttggattcgttgattctataaacgttgagatctggaacatcacactacgagagcctgcgtattggtgtttgcacattgtgagatgtgagaacacatcagtccatgatgtatcgatccttggggacttcaatactccaaataacgatggaatcgacattgaagattccaacaacactgttataactcggtgtcatatcgatactggagatgatgcaatctgtcccaagacttacactggtccactttacaacttaaccgctacagactgttggatccggaccaaatcctcagccattaaactcggtagtgcgagctggtttgatttcaaaggtcttgtctttgataacatcactatttttgaatctcacagaggacttggcatgcaaatacgcgatggaggaaatgtgagtgacgttacattttcaaacataaacattagtacaagatactacgatccttcttggtggggaagagcagaaccaatctatataacaacttgccctcgtgactcatctgcaaaggaaggctcaatctcgaatctcctattcgtaaacataacaatcgattccgaaaacggagtctttttatcaggttcaccaaacggactactctcagatataaagttcaagaacatgaaccttactttcagaagatggagtaattacagtgcagggcttgtggactatagacctggatgtcaaggtctagtgaaccatagagccacgtctggaatcattatggagcatgtgaacgggtttcgcgttgagaatgttgacctgaaatggtcagatgatgatgatgtgaatgctgcttggaatgttcctctcgaatttagaccttccactgtgaataatgtctcgtttgttggtttcacttctggtctttacacgaaattgtttgagtctgattacgttatgagtttatttacgtctaatcatcaatatatcactgagagtgaaatcggaatcacaaaaatggcgtcgacgaagccattgattgtcgcagcgaagacgctccgaaaccggatccacttccgatctggatccacatctactggtccaagccggtgggcgacaccgggtcacgaagaacgacccaaaggatatttcatgaaccggactccgccgcctccaggacagtcgcgcaagtgggaagattgggagcttccatgttacatcacaagcttcctcacgattgtaatcctcggagtgggtctcaatgccaaacctgatctttcaatcgagacctgggctcaccagaaagctcttgagcgcctcgagatggagaagcttgcatctgccggagattcatctggttaa

SEQ ID NO: 1618 - DNA, 1290 bp, Arabidopsis thaliana
atgattcatcatggccaagaagtagtgatcgttggaggggctcatccattacatcgtcatgagaagttagctatagccgtctcaaaagctatgcgtgggcattcccttcaggaaacgaagaaggacggaagatttcatgtgcataccaaaacatacctagatggtgctatcctcaaagaagagatggaaaggtcgactgatgttctagctgctggtttgctcgacgtgtctgaccctgggctttctaataaatattttctccgccagagctgggatgatgaatctgaaggttcaagtgattccatagtaaagcacagacctctctggtcatcttatagctccaaacttcagaagggaaagaaaaagaaggccgttaagaaaaaaggcgatctctaccgcacttatggaacaagagttattccagtgtttatactctcactagccgatgtagatccaatgctcatgatggaagatgagagcctcgtgtgggcgagcagtgatgttgtcattgtgcttcagcatctaaatgagaaaatacctttgagttatgtttctgaaacagagagacagcatgctgtcccatcacaggtacagcgacatgtacttgcaggtatagcttctgctttaggcggtgtaagtgcaccatatgaaaagacctcacacgcgcatgaaagacctatcaccaattggctttgggcagccggttgtcacccgtttggaccattctcaaacgtctccctgatcagtcaaatgcttcaagatgttgcactgaggaatactatttatgctcgggttgattctgctctacgcaaaatccgtgaaacatcagaggcagtacaaaactttgcatccgaataccttaagactccacttggcgagccagtgaaagataaaaagaacaaaaccaaaacggagctatgggtcgagaagttctacaaaaagacaacaacattgcctgagcctttcccacacgagctagtcgaaagattagagaaatatctagacactgtagaagaacaactggtggatctatcttctttgctatacgaccacaagctatacgatgctcacctcaacagctcagagattcttcaaaccaccatgtttacacaacagtacgtagaacatgtactggaaacagaaagggagaacatgagatgctgtaagatagagtacaaatacacagttggagtaaagtcttaccaaacgttggtgtacggaggaatacttgtggctggttttctcgtttatttccttgtcattttcttctcttctcctccttctcgctag

SEQ ID NO: 1619 - DNA, 723 bp, Arabidopsis thaliana
atgagttgcaatggatgtagagttcttcgaaaaggttgcagtgaaacatgcatccttcgtccttgccttcaatggatcgaatccgccgagtcacaaggccacgccaccgtcttcgtcgctaaattctttggtcgtgctggtctcatgtctttcatctcctccgtacctgaactccaacgtcctgctttgtttcagtcgttgttgtttgaagcgtgtgggagaacggtgaatccggttaacggagcggttggtatgttgtggaccaggaactggcacgtatgccaagcggcggttgagactgttcttcgcggcggaactttacgaccgatatcagatcttcttgaatctccgtcgttgatgatctcctgtgatgagtcttcagagatttggcatcaagacgtttcaagaaaccaaacccaccattgtcgcttctccacctccagatccacgacggagatgaaagactctctggttaaccgaaaacgattgaagtccgattcggatcttgatctccaagtgaaccacggtttaaccctaaccgctccggctgtaccggttccttttcttcctccgtcgtcgttttgtaaggtggttaagggtgatcgtccgggaagtccatcggaggaatctgtaacgacgtcgtgttgggaaaatgggatgagaggagataataaacaaaaaagaaacaaaggagagaaaaagttattgaacctttttgtttaa

SEQ ID NO: 1620 - DNA, 2427 bp, Arabidopsis thaliana
atggcaaacgctgaacgtatgataacgcgcgtccacagccaacgtgagcgtttgaacgaaacgcttgtttctgagagaaacgaagtccttgccttgctttccagggttgaagccaaaggtaaaggtattttacaacaaaaccagatcattgctgaattcgaagctttgcctgaacaaacccggaagaaacttgaaggtggtcctttctttgaccttctcaaatccactcaggaagcaattgtgttgccaccatgggttgctctagctgtgaggccaaggcctggtgtttgggaatacttacgagtcaatctccatgctcttgtcgttgaagaactccaacctgctgagtttcttcatttcaaggaagaactcgttgatggagttaagaatggtaatttcactcttgagcttgatttcgagccattcaatgcgtctatccctcgtccaacactccacaaatacattggaaatggtgttgacttccttaaccgtcatttatcggctaagctcttccatgacaaggagagtttgcttccattgcttaagttccttcgtcttcacagccaccagggcaagaacctgatgttgagcgagaagattcagaacctcaacactctgcaacacaccttgaggaaagcagaagagtatctagcagagcttaagtccgaaacactgtatgaagagtttgaggccaagtttgaggagattggtcttgagaggggatggggagacaatgcagagcgtgtccttgacatgatacgtcttcttttggaccttcttgaggcgcctgatccttgcactcttgagacttttcttggaagagtaccaatggtgttcaacgttgtgatcctctctccacatggttactttgctcaggacaatgttcttggttaccctgacactggtggacaggttgtttacattcttgatcaagttcgtgctctggagatagagatgcttcaacgtattaagcaacaaggactcaacattaaaccaaggattctcattctaactcgacttctacctgatgcggtaggaactacatgcggtgaacgtctcgagagagtttatgattctgagtactgtgatattcttcgtgtgcccttcagaacagagaagggtattgttcgcaaatggatctcaaggttcgaagtctggccatatctagagacttacaccgaggatgctgcggttgagctatcgaaagaattgaatggcaagcctgaccttatcattggtaactacagtgatggaaatcttgttgcttctttattggctcacaaacttggtgtcactcagtgtaccattgctcatgctcttgagaaaacaaagtacccggattctgatatctactggaagaagcttgacgacaagtaccatttctcatgccagttcactgcggatattttcgcaatgaaccacactgatttcatcatcactagtactttccaagaaattgctggaagcaaagaaactgttgggcagtatgaaagccacacagcctttactcttcccggattgtatcgagttgttcacgggattgatgtgtttgatcccaagttcaacattgtctctcctggtgctgatatgagcatctacttcccttacacagaggagaagcgtagattgactaagttccactctgagatcgaggagctcctctacagcgatgttgagaacaaagagcacttatgtgtgctcaaggacaagaagaagccgattctcttcacaatggctaggcttgatcgtgtcaagaacttgtcaggtcttgttgagtggtacgggaagaacacccgcttgcgtgagctagctaacttggttgttgttggaggagacaggaggaaagagtcaaaggacaatgaagagaaagcagagatgaagaaaatgtatgatctcattgaggaatacaagctaaacggtcagttcaggtggatctcctctcagatggaccgggtaaggaacggtgagctgtaccggtacatctgtgacaccaagggtgcttttgtccaacctgcattatatgaagcctttgggttaactgttgtggaggctatgacttgtggtttaccgactttcgccacttgcaaaggtggtccagctgagatcattgtgcacggtaaatcgggtttccacattgacccttaccatggtgatcaggctgctgatactcttgctgatttcttcaccaagtgtaaggaggatccatctcactgggatgagatctcaaaaggagggcttcagaggattgaggagaaatacacttggcaaatctattcacagaggctcttgacattgactggtgtgtatggattctggaagcatgtctcgaaccttgaccgtcttgaggctcgccgttaccttgaaatgttctatgcattgaagtatcgcccattggctcaggctgttcctcttgcacaagatgattga

SEQ ID NO: 1621 - DNA, 1800 bp, Arabidopsis thaliana
atgtcgtctctctcctgccctacctaccgctcccgcacttcgtcttcgtctcctttcttgtcgaatcatcatcattcttcgctgatcaatgttgttgacccacgccgctcactctccttccactacgcttctcctcaggggcttaatctagctgagctctgtgttgttagatcgcagaggaggtccgttcagagttctgttgtcgtgcaagatggatcagtagccaccgagtcaagctcgtccgaggaggcgaaagatgtaggggtgttaacgattccttcacttgaagctgacaaggttgtagcagagtctgatggcggtgaacaactttcaacagttagtatcacggtggtgggagcttctggtgatcttgccaagaagaaaatattcccagctcttttcgcactttactatgaaggctgtcttcctgagcattttaccatttttggctatgcaaggagtaagatgacagatgctgaacttagagttatggtcagcaaaacattgacatgtagaattgataagagggcaaactgcggtgaaaagatggaagagtttctcaagagatgtttttaccattcgggtcagtatgattctcaggaacattttgttgcattggacgagaagctcaaggagcatgagggtggaagactttcgaaccgtcttttctatctttcaatccctccaaatatctttgttgacgcggtgaaatgtgcaagctcatctgcttcatctgtcaatggatggactagggtcattgtcgagaaaccttttggccgggactccaaaacctcggctgcattaacaaagtctcttaagcagtacctggaggaagaccaaatatttaggatagaccattacttagggaaggagctggttgagaacttgtcggttcttcgattctcaaatcttatatttgaaccgctatggtcaaggcagtatataaggaacgtgcaattcattttttctgaggatttcggcactgaaggacgcggagggtacttcgacaattacggaataataagagatataatgcagaatcatctgcttcagatattagctcttttcgccatggaaacacctgtgagtttggatgcagaggatatcagaaatgaaaaggtaaaggtactacgttcaatgagaccaataaaacttgaagatgtggtgataggacagtacaagagccacagcataggaggagtcacttatccaagctatactgatgataaaactgtgccaaaaggtagtctgaccccgacatttgcagctgctgcactcttcatcgacaatgcaagatgggatggtgtaccttttctaatgaaagctgggaaagcactaaacacccgaagtgcggagataagagtccagttcaggcatgtgcctggaaatttatataaccggaattctggtactgatcgtgatcagaccacaaatgagcttgtcatccgcgtccaacctgatgaagctatctatttgaaaatcaacaacaaggtccctggtttaggaatgagattagatcagagtaacttaaatcttctctattcagcaaggtattcaaaggagattccagatgcatatgagaggcttttgttagatgcgatcgaaggtgaacgcagattgttcataagaagcgatgaacttgacgctgcttgggcgcttttcactccattgctcaaagagatagaagaaaagaagacaaccccagaattctatccttacggcagtcgtggtccagtcggtgcccattatctagccgcaaaacacaaggtccaatggggagacctaagtcttgatcagtga

SEQ ID NO: 1622 - DNA, 603 bp, Arabidopsis thaliana
atggcgattctctctctacgatcttcgagctcattgccgcttatttgttccacaatttctcctctgtgctcgaaacccatgttgtctcagttaccatcgaatttctcatcgtcgattgcttctgttcctgtcaccaaattaaaatccagttacagttcctccgtttcaccgattagtaggcctcgtgtggtttccgcgagagctgccactgagtccttcactgattacagagaagatatcggtgagatactcggcgatgtctctatctttactgcttcaggccaacgcgtgcaattcagtgatctctgggatcagaaagatggaattgctgccgttgtactcttgaggcatttcggatgcgtttgctgttgggaacttgctactgctttgaaagaggctaaaccgagatttgatgcggctggtgttaaattgatagctgttggagttggaactcctgacaaggctcgtatacttgcaactcggggaggtacgtttgtgttcagaggcaagaaattattgtacggtcgaaaagacgaaggcacgggagatcatccatctctggatgatgtcattaatgtctgctgcaaagccactgttgcttga

SEQ ID NO: 1623 - DNA, 1575 bp, Arabidopsis thaliana
atgggacccaagggtcgtaatgtcatcatcgaacaaagctggggtgcaccaaaggtgacaaaggatggtgtgactgttgccaagagcattgagttcaaggatagaattaagaacgttggtgccagtcttgtgaaacaggttgctaacgccacaaatgacgtagctggtgatggaacaacgtgtgccacagtccttactagagctatcttcacggaaggttgtaaatcagttgccgctggaatgaatgcaatggacctaagacgtggtatcaaattggcagttgatactgttgtgacgaacttgcagagccgagcacgcatgattagcacctctgaagaaatcgcccaagttggaacaatatcagctaatggagatagggaaattggtgaactgattgcaaaggctatggaaactgtcggcaaagagggagtgatcacaattcaagatggcaagaccttgtttaatgagctggaagttgttgagggtatgaagattgacaggggatacatctccccgtacttcataactaacccgaaaacacaaaaatgtgaactagaagatcctctcattcttatccacgagaagaaaatttccaatataaacgcaatggtgaaagtattagaactggccctcaagaagcaaaggccgctgctgatcgttgctgaggatgtggagagcgatgctcttgccaccctaattctgaacaaacttcgtgctaatatcaaggtctgtgctgtgaaggcccctggttttggagagaaccgaaaggccaatttacatgatctagctgccctcactggagcccaggtaataacagaagagttgggtatgaatctagacaacattgacctcagtatgtttggaaactgcaagaaggtaacggtatccaaagatgatactgttgttctcgatggggctggtgacaagcaagcaattggggaacgatgtgaacagatacgatccatggttgaagcaagcacttctgattatgacaaggagaagttgcaagaaaggttggctaagctttcgggtggtgttgctgtactaaagattggaggagcaagtgagacagaagttagtgaaaagaaagatagagtaacggatgctctaaatgccactaaagcagccgtagaggagggtattgttccaggtggtggtgttgctcttttgtatgcttcgaaagaacttgagaagctttccacagctaactttgatcagaaaattggtgttcaaatcattcaaaacgcactcaagacacctgtttacacgattgcttccaatgctggagtcgagggtgcagttgtcgtaggcaagcttttggaacaagataatcctgaccttggttatgatgctgctaaaggagaatatgtggacatgataaaggctggtattatcgatcctttgaaagtgatcagaaccgcattagttgatgctgcaagtgtttcgtctttgttgacaacgacggaagcagttgtgactgagattccaacgaaagaggtagcatctccgggtatgggcggtggtggcatgggcggcatgggtggcatgggcggtatgggaggaatgggtttctga

SEQ ID NO: 1624 - DNA, 1542 bp, Arabidopsis thaliana
atgggagcctatgaaacagaaaaaccaactaaagatgcggcggctctagagacacagtcgccggaagatttcgatcaaccatctccgcttcgtaaaatcatctccgtcgcttccatcgccgccggtgtacagttcgggtgggccttacagctctctcttcttactccgtacgttcaactcctcggaatccctcacaaatggtcatctctcatttggctctgtggtccagtctccggcatgattgttcaaccaatcgtcggtttccacagtgaccgatgtaggtccaaatttggtcgccgtcgtcctttcatcgccaccggagccgcactcgtcgccgtcgctgttttcctcatcggttacgctgcggatttcggttataaaatgggagataaactcgaggagaaggttaaagttcgagctatagggatctttgctctcgggttctggatcctcgacgtagccaacaacaccttacaaggaccttgccgtgctttcttagccgacttagccgccggtgacgctaagagaacgcgagtcgcaaacgcgtttttctctttttttatggcggttggaaacgttttgggttatgcggctggttcgtacactaacctccacaagatgtttccgttcacaatgacaaaagcttgcgatatctattgcgccaatctcaagacttgtttcttcttatccatcactctcctcctcatcgtcaccgtcacgtctctttggtacgttaatgacaaacaatggtctccgccgccgcgaaatgccgacgacgacgagaagacctcaagcgttcctttgttcggtgaaatctttggagcattcaaagtcatgaaacgtcccatgtggatgcttctaatcgtcacggccttaaactggatcgcttggttcccatttcttttgttcgatactgattggatgggtcgtgaagtgttcggtggagattcagatggaaatgaacgatcgaagaaactatacagtcttggagtccaatctggtgcaatgggattgatgtttaactctatagttcttggtttcatgtcacttggtgttgaatggattggtcggaaattaggaggagctaaacggctttggggtattgtcaatttcatcctagccgctggtttggccatgacggttctcgttacgaaattcgccgaggatcaccggaaaaccgccggtgatttagccggaccgagcgctagtgttaaagctggagctttaagtctctttgctgttcttggtatcccattagctattactttcagtactccttttgctctagcatccatattctcaagctgctccggtgcaggccaaggactttcattaggagttttaaatttggcgattgtgataccacaaatgatagtctcactaggaggtggacctttcgacgccttgttcggcggtggaaacttaccggcgtttatcgttgcagcaattgcagcggcgattagtggagtattagcgttaaccgttttaccttcaccaccaccggacgcacccaaggcaacgaccatgggaggattccactag

SEQ ID NO: 1625 - DNA, 1323 bp, Arabidopsis thaliana
atgtataaatcaccattaacgttgctcacacttcttactatttgttttggattcttcgatctcagcagtgctctttatggatcttcgtcacctgtggttcagctcactgcttctaactttaagtccaaggttcttaattcaaatggagttgttttggtagagttctttgcaccatggtgtggtcattgcaaagctctaacacctacatgggagaaagtggctaatattctgaaaggagttgctactgtggctgcaattgatgcagatgctcatcagtctgccgcgcaggattatggtattaaaggtttcccaacaattaaggtttttgttcctggaaaggctccaatcgattaccaaggagcaagagatgccaaatccattgctaattttgcttataagcagatcaagggtcttttgagtgaccgtttggaaggcaaaagtaaaccaactggaggaggatctaaagaaaagaaatctgaacctagtgcatctgtggaactgaacgctagcaattttgatgatttggtcatcgaaagcaatgaactttggatcgttgagttttttgcaccttggtgtggacattgcaaaaagcttgccccggagtggaagagggctgcaaaaaatttgcagggaaaggtgaaattaggtcatgtcaattgtgatgttgagcagtcgataatgagcagattcaaagttcaaggattccctacaattttggtatttggtccagacaaaagtagtccatatccttacgagggtgctagatctgcttcagcgatagaatcttttgcttctgaacttgtggaatccagtgctggccctgttgaagtgactgaactaactggaccggatgtcatggaaaagaagtgtggttctgctgctatttgctttatctctttcttacctgacattcttgactccaaagctgaaggaaggaataagtacctcgagatgttattatcagttgcagagaagtttaagaagcagccttacagttttatgtgggtggcggctgtaactcaaatggatttggagaagcgagttaatgtaggaggatacggttatccagcaatggtagccatgaatgtgaagaaaggagtatatgctcctcttaaaagcgcctttgagcttcaacacctcttagaatttgtgaaagatgctggaaccggtggaaaaggaaatgtgccaatgaatggaacaccagagatcgtgaagacaaaggagtgggatggtaaagatggagagttgattgaggaagatgaattctcacttgatgagctcatgggaggtgatgatgctgttggttctaaggatgagttgtga

SEQ ID NO: 1626 - DNA, 1764 bp, Arabidopsis thaliana
atggatttgttcaagatccttcttcttgtgttcttcgtgaacataagtttctgcttcgctgcagatccatattctttctataacttcgaagtctcttacattactgcttctcctcttggtgtccctcaacaggtcattgctataaatggaaagtttcctggtcctacaatcaatgttacaaccaatgaaaatctggttgttaatgtcagaaacaagttagacgagggacttcttcttcattggaatggaatccaacagagacgtgtgtcatggcaagatggagttttaggaaccaattgtccaatcccaccaaagtggaattggacttatgagtttcaagttaaagaccaaattggtagtttcttctactttccatctctacatttccagagagcttctggtggttttggctcctttgttgtcaatcctagagctattattccagtccctttctctactccagacggtgatattaccgttaccattggtgattggtacataaggaaccacacggctttgaggaaggctttggatgatggtaaagatcttggaatgcctgatggagttctcattaatggaaaaggaccttaccgatacaatgacacgcttgttgctgatgggatcgatttcgaaacaatcacagtccatcctggaaaaacttatagacttcgagtgtcgaatgtgggaatctcgacgagtttgaactttaggattcaaggtcacaacttagttcttgcggaatcagaaggatcatacacagttcaacaaaactatacaagcttggatattcatgttggacagtcttattctttcttggttacaatggatcaaaacgcgagctctgattactacattgtcgcgagtgctcgggttgttaacgaaaccatatggagaagagtcactggagttggaatcttgaagtataccaactctaaaggaaaagctaaaggtcagttaccccctggaccacaagacgaattcgacaaaactttctccatgaatcaagcaagatccatcagatggaatgtatcagcaagtggtgcacgtcctaacccgcaaggatcatttaaatacggttcgatcaatgtaaccgatgtctacgttctaaggaacatgccgcctgtgacgattagtgggaagagaagaacaacgcttaatggcatatcgttcaagaatccttcaacacctattagactagctgataagcttaaagttaaagatgtgtataagcttgatttccctaagagacctttaactggaccagctaaagtggcgacttcgattatcaatggtacttatcgtggattcatggaagtcgttcttcagaacaatgacactaagatgcaaagctatcacatgagtggctacgccttctttgtcgtcggtatggattatggagagtggacagagaacagtagaggaacatacaacaaatgggatggtatcgcgcgttccactattcaggtgtatccaggggcatggtcagcgatattgatatcattagacaatcctggagcttggaatctaagaacagagaatcttgattcgtggtatcttggacaagaaacttacgttagagtggttaatccagacgaaaacaacaaaaccgaattcggacaccctgacaatgttctttactgtggtgctctcagcaaactacaaaagccacagaaggtttcatcgtcggcatcgaagagcattggattcacgagtctttctatggtggtaatggctttggtgatgatgatgatgcttcagcattga

SEQ ID NO: 1627 - DNA, 1359 bp, Arabidopsis thaliana
atgagaggagaaatcgatgaagctaatcttgctcctgaaacttcacttattaacaaagagaatcaagactcatcggcgacaataacaactactctcttgctcaccacttttgtagccgtgtctggttcctttgtctttggctcagctataggatattcatcacctgttcagtcggatttaaccaaggagttgaatctctctgtggcagagtactcgctcttcggttcgattctgacaattggagcaatgatcggcgcagctatgagtggacgaatcgccgatatgataggcagacgagctactatgggtttctcggagatgttttgcattctcggctggttagcaatctacctttctaaggttgcaatttggcttgacgttgggagattcttggttggttatggaatgggcgttttttcgtttgtggttcctgtatacatagctgaaatcactcctaagggtcttcgtggtgggtttacaactgttcatcagttactgatatgtttgggtgtctcagtcacatatctcttgggctcttttataggctggcgaattttagctttgatcggaatgataccatgtgttgtacaaatgatgggattatttgtcatcccagagtctcctagatggttggcaaaagttggcaaatgggaagaatttgagattgcattgcaacgattacgtggtgaatccgcagatatttcatatgagtctaatgagatcaaagattatacgcgaagacttacagatttatcagaaggtagtatagtagatctgttccagccacagtatgctaaatctctagttgtgggagttggtctgatggttttgcaacaatttggaggggttaatggaattgctttttacgctagctctattttcgaatctgctggggtttcttccaaaattggaatgattgcgatggtggtcgtacagatccctatgacaactttaggtgtactgttgatggataaatcaggaagacgaccattacttctaatttctgctactggaacatgtatcgggtgtttcctcgtcggtttatcattttcattacaggtgtacaccggatcattttcattagggatgggtgggattccttgggtcattatgtcagagatatttccaatagacataaaaggatcagccggaagcctcgtgactgttgttagctgggtcggatcatggattatatcttttacatttaactttctaatgaattggaatccggcaggaacgttttatgttttcgctactgtttgtggggctactgttatttttgtagcaaaactcgtaccagaaaccaaaggtcgcacacttgaggaaatccaatattcgattggttatgtagaattgtaa

SEQ ID NO: 1628 - DNA, 588 bp, Arabidopsis thaliana
atggcgagtgctaccttctccttctgtcccctctctcaatcccatccccattcttctctaatcaaaccgacaccgtttctcagatatggcaagaaactacaccatcttcaccaccacatcttcatcaccatctcttacccatctcaccattctcgctacttggccgtttcaagagacgatgccgcgacgcctctttcttcttccgaccaaacccaagagacagagaccaaagaagtggaagacactatagagaaacgaagaatggaggagaagtttgctgttctaaacactggaatctatgagtgtagatcatgtggttacaagtacgatgaatcagcgggtgacccatcgtacccgattccaccgggttttcagtttgataagttgcctgaagattggagatgtcctacttgtggagctgctcagagtttctttgagagtaaaatggttgagattgctggttttgctcagaatcagcaatatggacttggtggtaatgctcttacctctggtcagaagactggtttaatctttggctctcttttactcttctttgcgctttttttgagtggctatttcattcaatga

SEQ ID NO: 1629 - DNA, 2061 bp, Arabidopsis thaliana
atggaaaaagtggtgctacgggttcatgaccatcctttgttaccctttgaacgcttttattttggccgttgttccgggtgctcacgtgaaggctacttttatggaggctaccgttgcaatgagttggcgtgttttgcggtgttccataaggagtgcgctgagtccaaacccgagatcagccaccatgcccatcccaagcatctgcttaagcttggcaatagacgtcaacgttgtcatttgtgtgaacggccggtgggaattggttatttttgttcgatatgtgactttggtatgcatttggtttgtgcgaagtccccaccactctcacttcagccacaactctctagtattgagaattacaaggtgcatgaacatcctcttaaacctttcaaaacagcatggcttgcagaaactggcaattgcaaagggtgtaactacattatcggcaatggagatagcgctcctttttatgaatgtcgtcggtgtaaactttacattcatgtgacttgccttgagctctttttcaccacagatgcacgccacaactctcatctcaaacaccctctcaaatatctcaaaaatggacccccgagctacgccgaccataaatgccttctttgcggaagagagtttgaagatcaacaaggccaaaaatatgagctttatcactgtgatgtttgtaacttcagcatatgcatttcttgtcagggaaacccaccaccactagttgttgttactccgaagacccacgagcatcaacttcacctcattccaagacttcttgattttacttgcaatgcttgtgggacacaaggtgaccgaagcccttatttttgtcttcaatgcaatttcatgattcatcgaggttgtatcgacttaccccgcatcataaacatcaaccgccatgatcatcgcatctcttacatttgtcatctcggacaagggaatttgaaatgcggagtttgccgcaaaacagtggatgggttctacggggcttattcctgctcgaaatgttctagttacgttgttcattcattatgtgcaactagaaaagatgtatgggacatggtagaactagaaggaacaccggaagaagaagaaattgcgccattcgaggtggttgatgagaacacaataaagcacatgagtcatgatcatgatttaatattcaacaatgatggtataaatctccatgaaagcaagctttgtgaagcatgcgtctcccagatcaatactgatccgttctatagttgtgagctatgcggttttattttacatcaaacatgtgctaatatgcctaggaagaaaaggcatgttttgtgcaacatacccttctctctacaaacagacgatagcaaggattcttcacgcctaagaagaaaatgtagtctttgtctccaacatttcactggatttgcgtataatctgcatattgcgtataactcgcgtaccgaagttatggatatacgatgtggttcgatatttgaaccatttgttcatgaaaggcatccacatcctttatactacaagttcttcaccttttcggcggttgcgaagtgcgacatctgtcacataacaagaaggcatttgttatgttgtgaagagtgtgactttaggttggatttcaggtgcgcaactttaccaaaaaaagtaatgaagcaaaggtacgatgaccatccacttttcttgtcttatggtgaaaataatgtggatggtgaatactggtgtgacgtatgtgaaaaaagggtagatgcaaagacatggttctatacatgtgatgcttgtggggtcactttacatgtttcttgcgttgtgggtgacttctcctatcatatgccaggaccattatcaaccgtagttagcgaatacaaaatggtaccgcccgcggtagtaagcttatacaaagtggtgccaaacacttcgatttgtagaccactttgctccaggtgtcacactagatgcaaactcccttgcattcttgaaacctccgaggatggtgttaatgtttacttttgttctaatgattgtcataaaaatccttgggagtcgtcgtattattag

SEQ ID NO: 1630 - DNA, 660 bp, Arabidopsis thaliana
atgtcgggagcatcttctgtttcttctatttgttcctctaatgtatcattgatccctacgggacctcaagtgttcatcaatttccgggggaaagatttacgaaaaggcttcatgagctttcttaagcctgctttgaaaaaagaaaagatcaacgtgtttattgacgaacaagaggagaggggcaaatacctaatcagtctttttgatacgataggtgagtcgaaaatcgctttggttatcttttctgaaggatactgcgagtcacattggtgtatggacgagctggtgaaaatcaaggaatacatggatcaaaacagactcataatcattccaatattctacaggcttgatctcgatgtggtaaaagatcttacaggaaaatttggcgataatttttgggatttggtagataaatatcaacctgaaccaaaaaagctccataaatggacggaagctttgttctctgtttgcgaattgttttccttgatcttaccaaaacacagtgacatttcggatagagattttgtaaagtcaatcgtcaaggctgttaaaaaagtgcagaagaatttcttccaacgaagaaatggagaaatagaatatcaagatttctcagtccctgcatgtaaactcactatcactatgcacgagtcaccaaagtaa

SEQ ID NO: 1631 - DNA, 1638 bp, Arabidopsis thaliana
atggcttccattgatgaagaaaggtcacttcttgaagttgaagaatctcttatacaggaagaagtaaaattatatgctgaagatggttcaatagatattcatggaaacccaccattgaagcagacaacaggaaactggaaagcttgtccattcatttttgcaaacgaatgctgcgaacggttggcttattatggaattgccaagaatctcatcacgtacttcacaaatgaattgcatgagactaatgtttctgctgctagacacgtcatgacatggcaaggaacatgttacatcactcctcttattggagctttaatagctgatgcttactggggaagatattggactattgcttgtttctctgccatttatttcaccggaatggttgcattgacactctcagcttcagttccgggtcttaagccagcggaatgcattggctctctatgtccaccagcaacaatggttcagtctacggttttattttcagggctttaccttatcgctcttggcactggaggaatcaaaccatgtgtctcatcctttggtgctgatcagtttgataagaccgatccaagcgaacgagtcagaaaagcttctttctttaactggttttacttcactatcaacattggtgcttttgtttcatctactgttctagtttggattcaagagaattatggatgggaattaggattcttgatacctaccgtgttcatgggacttgctactatgagtttcttctttggcacgccgctttatagatttcagaaaccgagaggtagcccgattactagcgtctgccaagttcttgtagccgcataccgtaaatcgaatctcaaggtccctgaagactccacggacgaaggagatgcaaacactaacccgtggaagctatgtaccgtgactcaagtcgaagaagttaagattctgttacgtttggtccccatttgggcctcaggaatcatcttctcagttctccattcacagatttacactctctttgttcaacaaggacggtgcatgaaacgaaccatcggcttattcgaaatccctcccgcaactctcgggatgttcgacactgcaagtgttctcatatctgtcccaatctatgaccgcgtcatcgttcccttagtgagacggttcacaggcttagctaaaggattcaccgagctacaaagaatggggattggtctttttgtctctgttttgagcttgacatttgcagctatcgttgagacggttcggttacagttagctagagatcttgatctagtggaaagtggagacattgttccattaaacatcttttggcaaatccctcagtactttttaatgggcactgctggagttttcttctttgttgggaggattgagtttttctatgagcaatctccagattcaatgagaagcttgtgtagtgcttgggctcttctcactactacactaggaaactacttgagctcgttgatcattacccttgtggcgtatttgagcggaaaagattgttggattccttcagacaacattaacaatggacatcttgattacttcttctggcttttggtcagtcttggatctgttaacatacctgtttttgtcttcttctctgtgaaatatactcatatgaaggtttga

SEQ ID NO: 1632 - DNA, 1041 bp, Arabidopsis thaliana
atgtcaatgtatttgtttgtgtcttacctagcaatctttactcttttcttcaaaggctttgtctcctcgtttccttcgggatataacaatggttacaacaatggtcacggacatggactaactagcaatctcaactatcgattctatgaccggtcttgtccgcgtcttcaaacgattgttaagtccggagtttggagagcttttaaagatgattctcgaatcgctgcatctcttcttcgactccatttccacgattgttttgtcaatggatgtgatggatctatacttctgaacgattcagaggatttcaaaggagagaagaacgctcagccaaaccgaaactcagtccgtggattcgaagtcattgaagacattaaatctgatatcgaaagttcttgtcccttaacagtttcatgcgctgacatagttgctctcgcggctagagaagctgtcgtcctcactggaggaccgttttggcccgtgcctttgggacgaagggactcattaacggcgagtgagcaagcggcgaatacaaatctgccatctccgtttgaggcgttggagaatataacagccaagttcgtgacccttggactcgacctcaaggacgttgttgtcctctcaggagcacatactataggatttgctcaatgtttcgtgatcaagcatagactcttcaacttcaagggctcaggccagcctgacccaaacctagccgcttcctcagcacttctctctaagctaaaggacacgtgtcctaacgtggactcctcagactctaagctcgctgctcttgacgcagctagctcagtcaagtttgacaatgcttactacgtgaacttaatgaacaacataggactgttggattctgatcaaaccctaatgacagatcctacggctgccgccttggtgaagtcgtacagcgagaatccgtacttgttctcgagggatttcgcagtttcaatggttaaaatggggaatatcggagttatgaccggaagtgatggagtaattcgaggaaaatgtggatttccaggttaa

SEQ ID NO: 1633 - DNA, 2322 bp, Arabidopsis thaliana
atggttaaagaaatagcttcttggttattgatactatcaatggtggtgtttgtttctccggttttagctataaacggcggtggttatccacgatgtaactgcgaagacgaaggaaacagtttctggagtacagagaacattctagaaactcaaagagtaagcgatttcttaatcgcagtagcttatttctcaatccctattgagttactttacttcgtgagttgttccaatgttccattcaaatgggttctctttgagtttatcgccttcattgttctttgtggtatgactcatcttcttcatggttggacttactctgctcatccatttagattaatgatggcgtttactgttttcaagatgttgactgctttagtctcttgtgctactgcgattacgcttattactttgattcctctgcttttgaaagttaaagttagagagtttatgcttaagaagaaagctcatgagcttggtcgtgaagttggtttgattttgattaagaaagagactggctttcatgttcgtatgcttactcaagagattcgtaagtctttggatcgtcatacgattctttatactactttggttgagctttcgaagactttagggttgcagaattgtgcggtttggatgccgaatgacggtggaacggagatggatttgactcatgagttgagagggagaggtggttatggtggttgttctgtttctatggaggatttggatgttgttaggattagggagagtgatgaagtgaatgtgttgagtgttgactcgtccattgctcgagctagtggtggtggtggggatgttagtgagattggtgccgtggctgctattagaatgccgatgcttcgtgtttcggattttaatggagagctaagttatgcgatacttgtttgtgttttaccgggcgggacgcctcgggattggacttatcaggagattgagattgttaaagttgtggcggatcaagtaaccgttgcgttagatcatgcagcggttcttgaagagtctcagcttatgagggagaagctggcggaacagaacagggcgttgcagatggcgaagagagacgcgttgagagcgagccaagcgaggaatgcgtttcagaaaacgatgagcgaagggatgaggcgtcctatgcattcgatactcggtcttttgtcgatgattcaggacgagaagttgagtgacgagcagaaaatgattgttgatacgatggttaaaacagggaatgttatgtcgaatttggtgggggactctatggatgtgcctgacggtagatttggtacggagatgaaaccatttagtctgcatcgtacgatccatgaagcagcttgtatggcgagatgtttgtgtctatgcaatggaattaggttcttggttgacgcggagaagtctctacctgataatgtagtaggtgatgaaagaagggtctttcaagtgatacttcatatagttggtagtttagtaaagcctagaaaacgtcaagaaggatcttcattgatgtttaaggttttgaaagaaagaggaagcttggataggagtgatcatagatgggctgcttggagatcaccggcttcttcagcagatggagatgtgtatataagatttgaaatgaatgtagagaatgatgattcaagttctcaatcatttgcttctgtttcctccagagatcaagaagttggtgatgttagattctccggcggctatgggttaggacaagatctaagctttggtgtttgtaagaaagtggtgcagttgattcatgggaatatctcggtggtccctggctcggatggttcaccggagaccatgtcgttgctccttcggtttcgacgtagaccctccatatctgtccatggatccagcgagtcgccagctcctgaccaccacgctcacccacattcgaattctctgttacgtggcttacaagttttattggtagacaccaacgattcgaaccgggcagttacacgtaaactcttagagaaactcgggtgcgatgtaaccgcggtttcctctggattcgattgccttaccgccattgctcccggctcgtcctcgccttctacttcgtttcaagtggtggtgcttgatcttcaaatggcagagatggacggttatgaagtggccatgaggatcaggagtcgatcttggccgttgattgtggcgacgacagtgagcttggatgaagaaatgtgggacaagtgtgcacagattggaatcaatggagttgtgagaaagccagtggtgttaagagctatggagagtgagctccgaagagtattgttgcaagctgaccaacttctctaa

SEQ ID NO: 1634 - DNA, 1200 bp, Arabidopsis thaliana
atggctgggatttgttgcggtgttgttggagagactgaaccggcggcaccggttgattcaacttctcgagcttctcttagacggaggttagatctacttccgtcgatcaaaattgttgctgactccgccgttgctcctccgcttgaaaactgccgtaaacggcagaagcgtgagacagtagtgctctcgacgttaccgggaaatctagatctggattcgaatgtgaggagtgagaataagaaggctagatcagcggttacgaattcaaattctgttacggaagcagagagtttcttttccgatgtacctaagatcggtacgacgtcggtttgtggtagaagacgagacatggaagacgctgtctcgattcatccttcgtttcttcaacggaactctgagaatcatcatttctacggtgtctttgacggccatggctgctctcatgttgcggagaagtgcagagaacggttgcatgatatagtgaagaaggaagttgaagttatggcttccgacgagtggacagagacgatggttaagagttttcaaaaaatggataaagaagttagccaacgagagtgtaacttagttgttaatggtgctactcggagtatgaaaaattcttgtagatgtgaattgcagtctcctcagtgtgacgccgtcggatccaccgctgttgtatcggttgtcacgccggagaagatcattgtttctaattgcggtgattcacgggctgtgctttgtcgtaacggtgtagccattcctctctccgtagatcacaagccggatcgacccgatgaattgattcggatccaacaagctggtgggcgagttatatattgggatggagctagggttcttggagttcttgccatgtctagagcaattggtgataattacttgaaaccgtatgtgattccggatccggaggtaacagtgacggatcgaactgatgaggatgagtgtttgatcttggcgagtgatggactatgggatgttgtaccaaacgagacggcgtgtggcgtggctcgcatgtgccttcgaggtgctggtgcgggtgacgactcagatgcggcgcacaatgcgtgctccgatgcggcgttgctcttaacaaagttggctctagcaagacagagctccgataacgtgagcgtcgttgtggttgacttgaggaagaggaggaataatcaagcgtcgtcttaa

SEQ ID NO: 1635 - DNA, 675 bp, Arabidopsis thaliana
atggcggagaaagaagaggatgtgaagcttctaggtttttgggcaagcccttttactcgtagagttgagatggctttcaagctcaaaggcgtgccttacgagtacttggagcaagatatagtgaacaagagccctttgcttctccagataaatccggtttacaagaaggttccggttcttgtctacaaagggaaaatattatccgagtcacatgtgatcctcgaatacatcgaccaaatatggaagaacaatccaattcttcctcaagatccttacgagaaagccatggctttattctgggccaagttcgttgatgaacaggttggaccagtagcttttatgtctgtggcaaaagcagagaagggagtagaggttgcaatcaaggaggctcaagaactctttatgtttcttgagaaggaagtcactggaaaagatttcttcggtggcaaaacaattggatttttggacttggtcgcaggaagtatgatcccgttttgtcttgctcgaggttgggaaggtatgggaattgatatgattccagaggaaaagtttccagagctaaacagatggatcaaaaatttgaaagaaattgagatcgtgagagaatgtattcctcctagagaggaacaaattgagcatatgaagaaagttgtagaaagaatcaaatcagcctaa

SEQ ID NO: 1636 - DNA, 777 bp, Arabidopsis thaliana
atgacagaaggtggagaatattctccggcgatgatgtcagcagagccattcttgaccatgaagaagatgaagaagagcaaccacaacaagaacaatcagagaaggtttagcgacgagcagatcaagtcactggagatgatgtttgagtctgagacaaggcttgagccaaggaagaaggttcaattagctagagagctagggttgcagccgaggcaagtggctatatggtttcagaacaagagggctcgttggaaatccaagcagctcgagactgagtacaacattctcagacaaaactacgacaacttggcttctcagttcgagtccttaaagaaagaaaaacaagctttagtctctgagttgcagaggctaaaagaggcgacgcaaaagaagacacaggaggaggaaaggcagtgtagtggagatcaagcggtggttgctctaagcagcacacatcatgaatcagaaaacgaagagaaccggaggcgtaaaccggaagaggttagaccggagatggagatgaaagatgataagggtcatcatggggttatgtgtgatcatcatgattatgaagatgatgataatggttatagtaacaacatcaagagagagtattttggtgggtttgaggaagaaccagatcacttaatgaacattgttgaaccagctgatagttgtttgacatcatctgatgattggagaggtttcaaatcagatactactactctcttggaccaatccagcaacaattacccttggcgggatttttggtcatga

SEQ ID NO: 1637 - DNA, 1761 bp, Arabidopsis thaliana
atggttcgtttttcaatagttagtggagaagagagcaaagggagttggacagtggctgatgccgtagactacaaaggacgacctgccgacaaatccaaaaccggtggttggatcactgccgctctcattcttgggatagaagttgtggagaggctatcaacaatgggaatagcagtgaatttggtaacatatttgatggagacaatgcatctcccaagttcaacctctgccaacattgtcactgatttcatgggcacttccttcctcctatgcttgctcggtggttttctcgctgactccttcctcggccgtttcaaaaccatcggcattttctcaaccattcaagctctgggaactggtgctctagcggtagcaactaagctgccagagctacgtccaccaacatgccatcatggagaagcttgcatacccgcgaccgccttccaaatgacaattctttatgtttcgctttaccttatagcccttggaactggtggtcttaaatctagtatctctggatttgggtctgaccagtttgatgacaaagatcctaaagagaaagctcacatggctttcttcttcaacaggttcttcttctttattagtatggggacattattggctgtgactgttttagtttacatgcaagatgaagtgggaagatcttgggcttatggaatctgcactgtctctatggctatagctattgtaatattcttgtgtgggactaagagataccgttataagaagagccaaggaagtcccgttgtgcaaatatttcaggtcatagcagctgcgttccgaaagaggaaaatggaactacctcaaagcattgtttatctttatgaagataaccctgaaggcattagaattgaacatactgatcagtttcacttgttggacaaggcggccatagttgcagaaggagattttgaacaaacccttgatggagttgcaatcccaaacccttggaagctaagctcagtgaccaaagttgaggaagtaaaaatgatggttaggcttttgcctatttgggcaacaactataattttttggacaacatatgcccaaatgattacattctctgttgagcaagcttcaactatgagacgtaacattggaagctttaagatcccagctggttccctcaccgtgtttttcgttgcggctattctcataactctagctgtctacgaccgtgccataatgcctttttggaagaaatggaaaggaaaaccaggtttctctagcctacaaagaatagctattggattggtcttatcaaccgctggaatggcagctgcagctctagtagagcaaaagcgtttatccgttgcgaaatctagttcacaaaaaacattgcctataagtgtgtttttacttgttccacaattcttcttagtaggagctggggaagcctttatctacactggccaacttgatttcttcataacacaatcgcctaagggaatgaaaactatgagcactggactcttcttgaccactttatcactaggtttctttgtcagcagtttcttggtctcaatcgtcaagagggtcacttcaacttctactgatgtaggatggctggctgataacattaaccacggccgactcgattacttttattggcttttagtcattctcagtggaattaacttcgttgtctatatcatatgtgccttgtggtttaagccaacgaagggtaaagactcagtagagaaggaaaatggcaagggattttcagttgaagactgctga

SEQ ID NO: 1638 - DNA, 585 bp, Arabidopsis thaliana
atgaagaccattttgtcctcggagactatggacatccccgacggcgtcgccattaaggtaaacgccaaggtgattgaggtcgaaggtccacgaggtaaactcactcgtgacttcaagcatctgaatctcgatttccagttgattaaagaccaagtcactggaaaacgtcagcttaagattgattcttggtttggttctcgtaagacaagtgcttcgattagaactgctttaagccatgttgataatctcattgctggtgttactcaaggttttctttatagaatgagatttgtgtatgctcattttcctatcaatgcttctattgatggtaacaataagagtattgagattcgtaacttccttggtgagaagaaggtgaggaaggttgagatgttggatggtgttaagattgttcgatctgagaaggttaaggatgagattattcttgagggaaatgatattgagcttgtttcacggtcttgtgctttgatcaatcagaaatgtcatgtgaagaagaaggatatcaggaagtttcttgatggtatctatgtgagcgagaaaggcaagatcgcagtcgaggaatga

SEQ ID NO: 1639 - DNA, 1062 bp, Arabidopsis thaliana
atgactgttgagctgatgatgagcagctacagcggcggcggaggaggaggtgatggttttcctgcaatcgccgcggcggcgaaaatggaagataccgctttgagagaagctgcttctgcagggattcacggtgtggaggagtttcttaaactgatcggtcaaagtcaacaaccaacggagaagagtcagacggagataaccgcggtgactgacgtcgccgttaacagcttcaagaaggtcatttctctactcggtagatctagaaccggacacgctagattcagacgagctcccgcgtcaacgcaaacgccgtttaagcaaacgccggtggttgaggaggaggtggaggtggaggagaagaagccagaaacaagctccgtgttaacaaaacagaaaacagagcaatatcacggtggtggatctgcgtttagagtttattgtccaacaccaattcatcgtcgtcctcctctatcacacaataacaacaacaatcagaatcaaacaaagaacggttcgtcttcttcatctcctccgatgctcgcaaacggagcaccgtcaacgataaactttgcgccgtcaccaccagtctcagcgacgaactcattcatgtcttctcatagatgtgacaccgatagtactcacatgtcatcaggattcgagttcactaacccatctcagctctctggttcgagaggtaaacctcctttatcatcagcttcgttgaagagaagatgtaattcatctccctcaagccgttgccattgctccaagaaaaggaaatcaagagtaaaaagagtgattagagttccagcagtaagtagcaaaatggctgatataccatcagatgagttttcatggagaaaatatggtcaaaaaccaatcaaaggctctcctcatcctcggggatattacaagtgcagcagtgtaagaggttgtccggcgcgtaagcatgtggagcgtgcactagatgatgcgatgatgctaatcgtgacgtacgaaggagaccacaaccatgctttggttctcgagacgacgacgatgaatcatgacaaaactctttag

SEQ ID NO: 1640 - DNA, 1152 bp, Arabidopsis thaliana
atgacatcaagaacattcacaagacattccagtctcattcatgtttttctcctgctttctctcgttttctcagggaatatactacaaacagtaacgtctcttggcatcaattacggacaagttgggaacaatttgccttcaccggataaagtcattaacctcttgagatctttaaggatcacaaaaacaagaatttacgacactaaccctcaaatccttagtgcctttgcaaattcaaacatcgagatcatcgtcaccatcgaaaatcaggttttaccattactacaagatcctcaacaagctacccaatgggtagattctcacattaaaccctatgttccggccactaggattaccggaattatggtcggaaacgagcttttcaccgacgacgactctagtttaataggatacatgatgccggcgataatcaacatccacaaagccttggtccaattaggtttagatagatacattcaagtctcgtctccaagctctcttgccgtcctcggtgaatcttatcctccatctgccggaagtttcaagccggaggtttcctccgtgatgcaacaacttctagatttcttggaagccacgaaatctcctttttggataaatgcttacccttactttgcctacaaagataacccacaagaaatcccagtcgattacgttctattcaaccgtaacatcggcatgaccgatcccaacacaagactacactacgacaacatgatgtatgctcaagttgacgcagttgctttcgcggctgcgaaactagggtaccgtaacatagaagttagggttgcggaaacagggtggccttcaaaaggagatgtcggagagattggagcgtctcctgtgaatgctgccacgtataaccggaatcttatgatgaggcaattcgccggagaaggaactccagcgagacggaatgcaagactcgatgtttatatatttgcgttgttcaatgaagatatgaaaccaggtcctacttcggagaaaaactacggtatattccaaccagatggatcattagcttacaatttgggattctctacaatgtcgacaacgacggcaaattcagaatctgtcacttattcatcctctgccactaaggtacgattagtattatgtggtgaattttgttag

SEQ ID NO: 1641 - DNA, 1083 bp, Arabidopsis thaliana
atgagaatcacacaaaacgtcaagctcttactcttcttcttcttcttcatctccttcctcttcatcgccgtatccgccggcgagtctaaatgcgagtgttcacacgaagacgacgaggcaaacaaagccggagcaaaaaaatacaagatcgccgcaattccttccgttctggccgccggagttatcggcgttatgtttccgttactaggcaagttcttcccgtcgcttaaaccggagacgactttcttcttcgtgacgaaagccttcgccgccggcgtaatcctcgcaacggggtttatgcatgtgttgcctgaaggttacgagaagctgacgtcaccgtgtctgaaaggagaagcctgggagtttccgttcacaggctttatcgcgatggtcgctgcgattttgactctttccgttgactcttttgccacgtcgtatttccataaagcgcattttaaaacgtctaagaggattggtgacggtgaggaacaagacgctggcggtggcggtggcggtggagacgagctcgggttgcacgtgcatgctcacggtcacacgcacgggattgttggcgtggaatctggtgaatcccaggttcagcttcaccggactcgagttgttgcacaggtgttggaagtgggaataatagtacattcagtggtaataggaatatcactgggagcatcacaaagtccagacactgccaaagctctctttgctgctttaatgtttcatcaatgcttcgagggtcttggtcttggtggttgcatcgcccagggaaatttcaattgtatgtcaattacaataatgtcgatctttttctctgtaacgacgccggtaggaatcgcggttggaatggcaatttcaagctcttatgatgattcgagtccaacggctctgatcgtacagggagtccttaacgctgcatctgcaggcatcctcatctatatgtctctagtggactttctcgcagcagattttatgcaccctaagatgcagtctaacactagacttcaaatcatggctcatatctctcttcttgttggagcaggggttatgtcacttttagctaaatgggcttaa

SEQ ID NO: 1642 - DNA, 657 bp, Arabidopsis thaliana
atgatagcttcagagagtaccaagagctgggaagctagcgcagtcagacaagagaatgaagaagagaagaagaaaccggttaaagattccggtaagcatccggtttatcggggtgtccgaaagaggaactggggaaaatgggtgtccgagatacgtgaacctaggaaaaaatcccgaatatggctaggaacgtttccttccccggagatggcggcgcgtgcacacgacgtagccgctcttagcatcaaaggagcctccgctatactcaatttccctgacctagccggctctttcccacgccctagctcgcttagccctcgagacatccaggtcgcggctctcaaagccgcacacatggagacctcacagtctttttcttcttcttcttctttaacgttttcatcttcacagtcttcttcttcgctagagtctctcgtgtcttcctccgcgaccggctccgaggagctaggggagattgtagagctcccaagtttgggatcgagctatgatggtttgactcagctaggtaacgagtttatattctctgactccgcagacttatggccttatccaccgcaatggtcagaaggtgattaccaaatgattcctgcctcgttatcacaagattgggatcttcaaggactgtataattattaa

SEQ ID NO: 1643 - DNA, 2736 bp, Arabidopsis thaliana
atgccggtggtttctctggctaaggttgttacttctccggcggtggccggagatttagcggttcgtgttccgttcatttatgggaaacgactagtgtcgaatcgtgtttctttcgggaaattgaggcgccggagttgtataggtcaatgcgtaagaagcgaattgcaaagtcctcgtgtcttaggttccgtcacagatttagcgttggataattctgtggagaatggtcatcttcccaaaggagattcatgggctgtacacaaatttggaggaacttgtgtgggaaattctgagaggataaaggatgttgctgctgttgttgttaaggatgactctgagaggaagttggtggttgtgtcagcaatgtcgaaagtcactgatatgatgtatgatctcattcacagagcagagtctcgtgatgattcatatctgtctgctttgagtggtgttcttgaaaagcaccgagcaactgctgttgacttgcttgatggagatgaactctcaagtttcttggctcggttaaatgatgatataaataatctcaaagcaatgcttcgtgccatttacatagctggtcatgcaaccgaatctttctcagacttcgttgttggccacggagagttgtggtctgctcagatgttagctgctgttgtgagaaagagcggattggactgcacttggatggatgcaagggatgtgcttgttgttattccaacgagctctaatcaagttgaccctgactttgtggaatcagaaaaaagactggaaaaatggtttactcagaactcggcaaagattattatagcaactggtttcatagccagtacaccacagaacattccaacgactcttaaaagggatgggagtgacttctctgcagctataatgagtgctctgtttagatctcaccaactcacaatctggacagatgttgatggtgtgtacagtgcagatcccaggaaagttagtgaagctgttgtgctgaagactctttcttatcaagaggcttgggaaatgtcttactttggggcaaacgttttacatcctcggaccattattccagtgatgaaatatgacattccaattgtaataaggaatattttcaacctctctgcccctggaacaatgatatgccggcagattgatgatgaagatggattcaaattagacgctcctgtgaaaggatttgcgacgattgacaatttggctcttgtcaatgtagaaggaactggaatggctggtgttcctggtactgccagtgccattttttctgctgtcaaggaagttggagccaatgtgattatgatatcgcaggctagtagcgagcattctgtgtgctttgctgtacctgagaaggaagtgaaagctgtttctgaagcattgaactcaagatttcgtcaagctttggctggtggccgcctttcccagattgaaatcatccctaattgtagcatattagcagcagttggccagaaaatggcgagcactcctggtgtttctgccactttttttaatgcattagcaaaggccaatatcaacatccgtgctatagcccaaggttgctccgagttcaatattacagtagtcgtcaagcgtgaagactgcatcagggcattaagagctgtgcactcaagattttacctttcgagaaccactttggcagtgggaatcataggaccgggattaattggtggaaccttacttgatcagattagagatcaggcggcagtgctcaaagaagaatttaaaattgacttgcgtgttatagggatcacgggctcaagtaaaatgttgatgagtgaatcggggattgacttatcaagatggagagagcttatgaaagaagagggagaaaaagctgacatggagaagttcacccaatatgtgaagggaaatcatttcatcccaaactctgttatggttgattgtacagccgatgctgacatcgctagctgttactacgactggttgctacgaggaattcatgtggtcactccgaacaaaaaggctaactctggaccacttgatcagtatctaaagatcagagatcttcaacgaaaatcgtacacacattacttttatgaagccaccgttggagctggtcttccaattattagcaccttacgtggtctcctcgaaacaggggataaaatactgcgaattgagggaattttcagtggtactttaagttacctcttcaacaactttgtcggcaccagaagcttcagtgaagttgtagcagaagcaaagcaagcaggtttcacagaaccagatccacgagatgatctatctggaacagatgttgccagaaaagtaacaatccttgccagagaatcaggcttaaaattggatcttgagggccttccagtccagaatcttgtgccaaagccgttacaagcttgtgcatcagcagaagagttcatggagaagcttcctcagtttgatgaagaattatccaaacaaagagaagaggctgaagcagcaggagaagtcttgagatacgtaggagttgtagatgcagtagagaaaaagggaacagtcgagttgaaacggtacaaaaaagatcatccgtttgctcagctatcgggtgctgataacatcatcgctttcacaaccaaacggtacaaagaacagcctctgattgttcgtggacctggtgctggtgctcaagtcacagccggtggaatcttcagtgacattcttcgccttgctttctatctcggggctccgtcttaa

SEQ ID NO: 1644 - DNA, 711 bp, Arabidopsis thaliana
atgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttga

SEQ ID NO: 1645 - DNA, 1731 bp, Arabidopsis thaliana
atggatcaaaaagttagacagtttgaggtttgcactcaagacggtagcgttgatcgtcacggcaatccagctatccgagctaataccggcaaatggctcactgctattctcattctaggagtgaatttggttctgtttctgactcgagtgatgggacaagacaatgcagaagcggctaataatgttagtaaatggacaggaactgtctatatcttctctttgcttggtgctttcctcagtgactcttattggggacgttacaagacttgtgctatctttcaagcaagtttcgttgcagggttgatgatgttatctttatctactggtgcgttattgcttgaaccaagtggttgtggagttgaagattcgccgtgtaagcctcattcgacgtttaagacggttctgttttatctgtcggtgtatctaatcgcgttagggtatggtggttatcagccgaacatagctacttttggagctgatcagtttgatgcggaggattccgttgaaggacactcgaaaatcgcgtttttcagttacttttacttggctctgaatcttggatcgctcttctcaaatactgtcttgggttactttgaggatcaaggggaatggccgcttggattttgggcgtctgctggctctgcttttgcggggttagtgcttttcttgattggcacgccaaagtaccgacactttacgcctagagagagtccttggtctagattctgccaagtgttggttgctgcaacaagaaaggctaagattgatgtgcaccatgaagagttgaatctctatgattctgagactcaatacactggagataagaagattcttcataccaaaggcttcagattcttggatagagctgctattgttacacctgatgatgaggctgagaaagtagagagcggatcgaaatacgatccatggaggctctgctcggtgactcaagtcgaagaagtgaaatgtgtattaagactcttaccaatctggctctgcaccatcctctactctgtggttttcacccaaatggcttcactgttcgttgtgcaaggagcagcgatgaagacaaacatcaaaaacttccggattccagcttcaagcatgtctagtttcgacattctcagtgtcgccttcttcatcttcgcatacaggcggtttcttgatccactctttgcaagacttaacaaaacagaacgcaacaaaggtctcactgagcttcagaggatggggattgggcttgtgattgcgataatggcgatgatttccgcaggaatcgtagagatacacagactgaaaaataaggaaccggaaagtgctacttcgatctcaagctccagcactttgagcattttttggcaagtacctcagtacatgttgataggtgcatcagaagtgttcatgtacgttggtcaactcgagttcttcaacagccaagcaccaaccgggctaaagagctttgcaagcgcgctatgtatggcttcaatatctcttgggaactatgtaagcagtttgttagtttccattgtcatgaagatctctacaacagatgatgtgcatggctggattcctgaaaatctcaacaaaggacacttggagagattctacttccttttagctggtctaaccgctgctgatttcgtggtttacttgatttgtgccaaatggtacaagtatattaaatctgaagcaagtttctctgagtccgtaactgaagaggaggaagtctga

SEQ ID NO: 1646 - DNA, 2598 bp, Arabidopsis thaliana
atgatttctgactacttgagacattgtatctacttcacttgctgtagagatatggtatcaagatcttattcaaacctcttggatcttgcttctggtaacttccattcgttttctcgagaaaagaagaggtttccaagagtagcaactgtcactggtgtcttatctgagctagatgatgataacaacagcaacagtgtctgctctgatgctccttcttccgtcacacaagatcgaatcatcatcgttggaaaccagcttcctattaaatcacatcggaactctgctggtaaattgagttttagttgggacaatgactcgcttctcttgcagcttaaagatggtatgcgtgaagatatggaagttgtctacattggttgccttaaggaacagattgatacagttgagcaagatgatgtttctcaaaggttgcttgagaatttcaaatgtgttcctgcttatatcccacctgagctattcactaagtactatcatggattctgtaagcaacatctatggcctttgtttcactacatgcttcccttaactcctgatcttggtggtagatttgatcgttctttatggcaagcttatctttcggttaacaagatctttgctgataaagtgatggaagtgattagtcctgatgatgattttgtttgggttcatgactatcacttaatggttttgcctacatttctaaggaagaggtttaatagagtaaagcttggttttttccttcatagcccgttcccttcctctgagatttaccgtactcttccagtgagaaatgagctcttacgtgcactcctcaacgctgatttgattggctttcatacctttgactatgcaagacacttcctttcttgttgtagcaggatgcttggtttatcctatcagtccaaacgtggaaccatagggcttgagtattatggtcgaacgcttcagtcaattttaaacctcccagagactcagaccaaagttgctgagctaagagatcagttcttggatcagaaagttcttctcggtgttgatgacatggacatcttcaaaggaatcagcctcaaactcttggcaatggaacaacttctcacacagcatcccgagaagagaggtcgagttgtacttgtccagattgcaaaccctgcaagaggtcgtgggaaagacgttcaggaggttcagtctgaaactgaagccacggttaaaaggatcaatgaaatgtttggaaggccgggctaccaacccgtggttctgattgatacaccgcttcaattctttgagaggattgcttactatgtcattgcagagtgttgtcttgttacagcggtaagagatggtatgaatcttataccttatgagtacattatctgcaggcaaggtaatccgaaactcaacgagactataggccttgacccttctgctgcaaagaagagtatgcttgttgtctctgagtttattggttgttctccttctttaagcggcgccattagagtaaatccgtggaacattgatgctgtgactgaagcaatggactatgcattgatagtttcagaagcagagaagcaaatgcgtcacgagaagcatcacaaatatgttagcacacatgatgttgcttattgggcgcgtagctttatacaagatcttgaaagggcttgcggggatcatgtgaggaagaggtgttgggggattggattcgggttaggctttagagttgtggcgcttgatccgagttttaaaaagctttcgattgagcacattgtctcagcttataagagaaccaagaaccgagccattttgttggattatgatggcacaatggtgcagccaggttccattaggacaacaccaacccgcgaaacaatcgaaatcttgaacaacctgtctagtgatcccaagaatatcgtgtacctcgtcagtgggaaagacagaaggacactaactgaatggttttcttcatgtgacgatctcggtttgggtgcagagcacgggtattttataaggccaaatgatggaacagactgggaaacgtcgagtttggtatcaggttttgagtggaaacaaatagcagagccagtgatgagactttacactgagactacagatggatcaacaatagagactaaagagactgctctcgtttggaattaccaattcgcagatcctgattttggatcttgtcaagccaaagagcttatggaacacctcgaaagcgtgcttaccaatgatccagtctctgtcaagactggacaacaactcgttgaagttaaaccacagggtgtgaacaaaggtcttgtggcagagaggcttctaacaacgatgcaagaaaaagggaaacttttggatttcattctctgcgtcggtgatgatcggtctgatgaggatatgtttgaggtgataatgagtgctaaagatggtccagctttgtctcctgtggctgagatattcgcttgcaccgttggacaaaagccaagcaaagcaaaatactatttagacgatactgcggagataatcagaatgctggacggtctagccgctaccaacacaactatctctgatcaaactgattcaaccgccactgttccaactaaagatctgttttaa

SEQ ID NO: 1647 - DNA, 744 bp, Arabidopsis thaliana
atgagaggaatcatcatcgtaagcttgttaattttacagagccttgtcgtgtcttcgtctcaaacagaaccagacttcaatttcttctactgggtcaactactggccaggagcaatatgcgatagccaaaaaggatgttgccctccaacgaaaggcaacacagcgtcggattttatcatccatggactctggcctcagttcaacaatggcacttggcctgcgttttgcgaccaaaccaatctcttcgatatctccaagatatcagatctagtctgccaaatggaaaagaaatggacagagtggggagtgtgggcatgtccaagtaacgagacaaatctatgggaacacgagtggaataagcatggcacctgtgtccaatctatcttcgaccaacactcttacttccgtaccaatctcaaattcaaacacaaagtccatctcctcaacatccttatacaaaaaggtattaaaccaaatgatgggttttacagtttggacgagatcaaaaatgcgatcaaatgcgcgatcggatttgcaccgggtatcgaatgcaatgaagatgtaaaggggaataagcagcttttccagatctatatatgtcttgataattacgcaaaagagtttgtggaatgcccgtatgttccggataaatcatgtgcttccaagatcaagtttccaagtcttcctgagagagattctcttaatgagtctctaagtgtgatgtcctctgtttcaactacctaa

SEQ ID NO: 1648 - DNA, 1506 bp, Arabidopsis thaliana
atgaattcagaatcgctagaaaatcttcaccgtccattaatcgaatcatcgaagtcgttcgtcgattatcgtctcgagactgtgttaacagatcgagagttaccgtattttcgccggatttatctagcgatgatgattgagatgaagtttctctttcatctggcggctccggcgatctttgtttacgtcatcaacaacggcatgtcaattcttacacgtatcttcgctggacacgtaggaagcttcgaactcgccgccgcttcacttggaaacagtggtttcaacatgttcacctatggacttctgcttggaatgggaagtgcagtggaaacattatgtggtcaagcacatggagctcatagatacgaaatgcttggagtttacctccaaagatcaacagttgttctaatcctaacatgtctaccaatgtcatttctcttcctcttctcaaatccgatcctcacagcacttggagagccagagcaagtggcaacattggcttcagtattcgtctacggtatgatcccggtgatcttcgcttacgcagtcaatttccctatccagaagtttctccaatcacaaagcatcgtcactccaagtgcctacatatcagctgcaacgcttgtgatccatctcatactttcgtggatcgctgtgtatcgtcttggttacggtcttttggctttgtctttgatacatagcttctcgtggtggatcattgttgtggctcagattgtttatattaaaatgagtccgagatgtcgtcggacttgggaaggttttagttggaaagcttttgaaggtctttgggattttttccgattatcagctgcttctgccgtcatgctttgtcttgaatcttggtactctcagattcttgttttactcgccggacttctcaagaaccctgagcttgctttggattctcttgctatctgcatgtcaatttctgcaatctcattcatggtctccgttggattcaacgcagctgcaagtgtgagagtaagcaacgagctaggagccggaaacccgagagcagccgcgttctccacagtcgtgacaacgggagtatcattcttactatcggttttcgaagccatcgtggtcttatcgtggcgtcacgtcatcagctatgcgtttactgatagtccagcagtggctgaggccgttgcggatttatctccctttttagccatcacaattgtcctcaatggaattcagcctgttttgtccggtgtggctgttggatgtggatggcaagcatttgttgcgtacgtaaacattggatgttactacgttgtggggattccagtgggattcgttcttggcttcacttatgatatgggagctaagggaatatggactgggatgattggtggtactttaatgcaaacaataatcttagtgattgtcactttacgaactgattgggacaaagaggttgagaaagcttcgagcagattggaccagtgggaagagagccgtgagccgcttttgaagcaataa

SEQ ID NO: 1649 - DNA, 897 bp, Arabidopsis thaliana
atggccgacgattgggatctccacgccgtagtcagaggctgctcagccgtaagctcatcagctactaccaccgtatattcccccggcgtttcatctcacacaaaccctatattcaccgtcggacgacaaagtaatgccgtctccttcggagagattcgagatctctacacaccgttcacacaagaatctgtcgtctcttcgttttcttgtataaactacccagaagaacctagaaagccacagaaccagaaacgtcctctttctctctctgcttcttccggtagcgtcactagcaaacccagtggctccaatacctctagatctaaaagaagaaagatacagcataagaaagtgtgccatgtagcagcagaagctttaaactccgatgtctgggcatggcgaaagtacggacagaaacccatcaaaggttcaccatatccaagaggatactacagatgtagtacatcaaaaggttgtttagcccgtaaacaagtggagcgaaatagatccgacccgaagatgtttatcgtcacttacacggcggagcataatcatccagctccgacacaccgtaattctctcgccggaagcacacgtcagaaaccatccgatcaacagacgagtaaatctccgacgaccactattgctacttattcatcgtctccggtgacttcagccgacgaatttgttttgcctgttgaggatcatctagcggtgggagatcttgacggagaagaagatctgttatctttgtcggatacggtggttagcgatgatttcttcgatgggttagaggaattcgcagccggagatagcttttccgggaactcggctccggcgagttttgatctctcttgggttgtgaacagtgccgccactaccaccggaggaatatga

SEQ ID NO: 1650 - DNA, 1155 bp, Arabidopsis thaliana
atggagggtgttagtgcaactatgcataagttaaggccttatttgttaatgatctttttgcaatttggagcagcaggaacatatattgttattatggccactcttaaccaaggccagaaccgttacgtcgtaattgtgtatcgtaatcttgtggctgctcttgtccttgcaccttttgcactcatctttgaaaggaaagtgaggccgaagatgacactatcggttttgtggaaaataatggcacttggtttcttagagccagtcttggatcagggttttggttacttggggatgaacatgacatcagcaacatatacatctgcgatcatgaacattcttccttctgtcacatttataatagcttggattttaagaatggagaaagttaacatagcggaggtacgaagcaaagcaaagatcattgggacattggtgggtcttggaggggcactagtaatgacattgtacaaaggtccgcttattcctttaccgtggtctaacccgaatatggatcaacaaaacggacatacaaataattcacaagaccataacaattgggttgttggaaccttgttgattctcctcggttgtgttgcttggtctggtttttatgttttacagtcgataacaataaagacgtaccctgccgatctttcattatcagccttaatatgcctagccggggctgtccaaagcttcgcggtagcgcttgtggtggagagacaccctagcggatgggcggttggttgggatgcaaggctttttgcacctctttatacaggaatagttagctcggggataacgtactatgttcaagggatggttatgaagacgagagggccagtttttgttactgcctttaaccctctctgcatgattcttgtagctctcattgcctcttttattcttcatgaacaaatccatttcggatgtgtaataggaggggcagtgatcgccgcgggtttgtatatggttgtttggggaaaaggaaaagactatgaagtatccggattagatatccttgaaaagaatagcctccaagaattgcctatcacaactaaaagtgaggatgacaacaaattggtttcttctataagcgacaacagcaatgtgaccattcctggtggtgcgcatagtaacacatctggaatataa

SEQ ID NO: 1651 - DNA, 1134 bp, Arabidopsis thaliana
atggatttgaatataaacaagacgacccctgttcttagtgaccctactacaccagtaagtaaaacaagacttggatcatccttcccttcagggagattcatgatgaattctagaaagaagattcctaaactcgatgatgttcgatctaacggttggttggacgcgatgatatcttcgtctccaccgcgtaaaaggcttgtcaaggatttcaatattgagattgctcctgaagatgatttttctcaacgggcctggatgctcaagtatccttcagcgattacctcgtttgcgcatattgcagctcaagcaaagaacaagaagatagctgtgtttctagattatgatggaacactttctccaatagtcgatgaccctgatcgcgccatcatgtctgatgcgatgcgtgctgctgtgaaagatgtcgccaagtacttcccaacagcaataattagtggtagaagccgtgacaaggtttaccaattggtagggctaaccgaactctattacgcgggtagtcacgggatggacattatgactcctgtaaatccaaatggatcccctgaagaccctaattgtataaaaaccactgaccaacagggtgaggaggtaaacctctttcagcctgctaaagagttcatacccgtcattgaagaggtttataataacctcgttgagataactaaatgtatcaaaggtgcaaaagtagagaaccataagttttgtacttctgtacattaccgtaatgttgacgagaaggactggccacttgttgctcaacgcgttcatgaccacctgaaacgataccctcgtttgcgtataactcacggtagaaaggttttagaggtgcgtcctgtgattgagtggaacaaaggaaaagcagtagagtttctgttagagtctctcggattaagcaacaacgatgagttcctcccaatcttcatcggagatgacaagaccgatgaagatgcattcaaggtactgagggaagggaacagaggatttggaatattggtatcgtctgtaccaaaagaaagcaatgcattttactctcttagagacccttccgaggtgaagaagtttctcaagactttggtgaaatgggggaagatggaaagttcaaaaacaagtttttga

SEQ ID NO: 1652 - DNA, 1905 bp, Arabidopsis thaliana
atgtggcgctgcgtctctcgtggctttcgagctcctgcttcaaagacctcttcactctttgatggcgtctctggatctcgcttttccagattcttctccactggttctaccgatacgagatcctcttatacgatagtggatcacacttatgatgcggttgtggtgggagctggtggtgctggtcttagggcggcgattgggttatcggagcatggctttaacaccgcttgcattactaagcttttccccacaaggtcacatactgttgctgctcagggtggtattaatgctgcactgggaaatatgtccgaagatgactggagatggcacatgtatgacactgtcaaaggaagtgactggctaggtgatcaagatgctatccagtacatgtgtagagaggcaccaaaagcagtcattgaacttgagaattatgggctgcctttctctcgtactgaagaagggaaaatttaccagcgtgcatttggtggtcagagtcttgactttggaaaaggtggtcaggcctatcgttgtgcttgtgctgcggataggactggtcatgctctgttgcatactctctatggacaagctatgaagcataacacacagttctttgttgaatacttcgccttggatctgctcatggctagtgatggcagttgccagggtgtaattgcactaaacatggaagatggaacattgcatcgtttccgttcttctcaaacaattttggcaactggggggtacggcagagcatacttctctgcaacctcagcacatacatgcacaggggatggaaatgcaatggttgcacgggccggtcttccactgcaggacttggagtttgttcaattccatccaactggtatatatggggccggatgtctcatcaccgaaggatctcgaggtgaaggtggtatccttagaaacagtgaaggtgaacgttttatggaacgatatgctcctacagccaaggatcttgcatcaagagatgttgtctccagatccatgactatggaaatcagggaaggtcgtggtgtaggaccgcataaggatcatatctatctccatctgaatcatcttcctccagaagttctaaaagaaaggcttcctggaatctctgagaccgctgccatctttgctggtgttgatgttaccaaagagccaattcctgtcttacccacggttcattataacatgggtggtatcccaacaaactaccatggcgaggtagttaccatcaaaggcgatgatccagatgcagtgattcctgggctaatggctgctggggaggcagcttgtgcatctgttcatggtgccaacaggcttggtgcaaattcactgctcgacattgtcgtatttggtcgtgcttgtgcaaatagggttgcagagataagcaaaccaggggagaaacagaaacctcttgagaaggatgcgggtgagaagactattgcatggctggacaggttgagaaactcaaacgggtctctacctacttcaactatcagattgaacatgcagaggattatgcagaacaacgcagctgtgttccgcacgcaagaaacattggaagaaggttgtcagttgattgacaaggcctgggaaagttttggggacgtccaggtgaaagatcggagtatgatatggaactcggatttgatagagacattggaactggagaaccttttgataaacgcatccataacaatgcattcagcagaagcacgaaaggaaagcagaggagcacatgctcgggaagacttcacgaaaagagaggatggagaatggatgaagcatacattgggatattgggaagatgagaaagtgagattggattataggcctgttcacatggacactctcgacgatgagatcgacactttccctcccaaagctcgtgtctattga

SEQ ID NO: 1653 - DNA, 753 bp, Arabidopsis thaliana
atggccgcaagaaaaccgtcggtgaggcatccgagccacaaccatccattgcgcagtcacaaggcccaagttgaagaagagatcatttgctctggttgcgacctcgacctgataggtgcagctttcaaatgcacaaagtcagaatgcgattacttcttgcacaagtcatgttttgagcttccacgtgagactcgtcacaaggctcacccggatcaccctttgatactgctgtattccccaccttacgagtcaacttacacgtgtgatgcgtgcggtgagtatggatccggattcacttacaactgctctatctgccagtacgatgttcatgttggatgtgtgtccatgcctgagtccgtggagcgtgaaggacacgcacatccactcacattgctctaccgttctccttaccagaacggtttgatctttaactgtgatgtttgccaagagactgttccagataatctctggtcgtattattgcaaggaatgtgattatggcacgcatttacattcttgcgcggtagaggaagaagaagcagaagaagaagagccaaaaagaggaggaggaagtgcaagaggaaacacaaagagtggtgggaataaaggaggaaggggctcagcggcatcggagttagctgcaatgttggaagctcaaagagagatggagaagatgcagatagagttacatatggagatgcaaagagctaagattgctaagaaagcgagaaaggcttgtctcaagttgatctaa

SEQ ID NO: 1654 - DNA, 723 bp, Arabidopsis thaliana
atggagacagagaagaaaaatagcaaggaggtagcgctaaaacacctagcgttcgtgagaattgcaacgatccatattctggcttccgtctcaaatctctacgaatacgctaaacaaaactccggtcctctcaaatccgccgtggaaaaggtcgaaggagccgtcaccaccgtcgtcacccctgtctatcagaaattcaaagatgttcctgattctctcctggtctttctagatcacaaggtgggtgaagtttcgtacaagtttgatgagcatgctcctccaatggctaagaaagtggtgaatcaagcacatgtattgatctacaaggcgacagagaaagctcaaagctttgtgaaagaggctcgtaccggtggtcccaaagctgcgtttaactatgctgcaactgagtacaagtttttcgttgtgaccaactcggttaaagtctgggctaaacttaaccagtataaaccaatccatgcaatgggtgacaaagctttgcctgtggctgcacacttttccagtcggtacaacgatttggtgactgatatgactaatatgggttactctttggttggttatcttccgttggttcctgttgatgacattgttaaggcttatgaaaaggaagatgcaaggagaaagaaaggaggggatacggctggaaagaaaggagagactactgatgcggctgatggtgataaatcatcgtctgattcggagtag

SEQ ID NO: 1655 - DNA, 939 bp, Arabidopsis thaliana
atggctgggattaccagcagcaccgttggattcaacgccgtcttcaccggaataaccaaaacagtatcatcacattcactcttctctgttgattccaaactctgtagtcttcgtctctccaaaaccgaactgtctttcactaatctcactccttctcctcgccgtgctttcgccgtcacttgccgcttcggcggtggtggtggaggttatcgattctctggagacaatagaagaggtaggccgaaagaagctgaaattgatgaagctcttgatatctcctcaattaggtcagctactgttaggcttatcgatgggcaacaaaacatgcttggtttagtgtctaaagacgaagccgttcgaatggctgatgatgctgaacttgatctggttatactatcgcctgatgcagatcctccggttgttaaaatgatggactacagtaaatacagatacgaacagcaaaagaggaaaaaagatcagcaaaagaaaacaactcgcatggatttaaaggagcttaaaatgggttataatattgatcagcatgattattccgttcgtctaagggctgcccaaaagttcttgcaagatggtgacaaggttaaggtgattgtgagcatgaaaggacgagaaaacgagttcagaaatatcgctattgaactcctcagacgtttccaaaccgaaataggggagcttgcaactgaagagagcaaaaacttcagggacagaaatatgttcattatcttggtcccaaacaaagaaatgattcggaaaccacaagaaccacccacaagaaagaagaaaaaaacagcggaaaacgaagcttcagcttcagctgcagaaataacagctgagcctgagcctgagcctgagcctgagcctgaacctgagcctgagcctgagcctgagcctgagccagagcctctacagatcgattcttga

SEQ ID NO: 1656 - DNA, 1104 bp, Arabidopsis thaliana
atggaagctgttcttgtcgcaatgtccgtccccgccacaacggaagacgacggattttcgttaatcaccgataaactttcatataatctaacgccgacgtcggacgttgagatcgttacctccgataaccgtcggattccggcacactccggcgttctggcttcagcttcaccggtactgatgaacatcatgaagaaaccgatgagacgttacagaggctgtggatctaaaagagtcatcaagattcttggcgttccatgcgacgccgtttcggtttttatcaaattcctctactcttctaggttggtttgtttgacggaggatgagatggagagatatggaatccatcttttagcgttgtctcacgtctacatggtcacccagctgaagcaacggtgctcaaaaggcgttgtacaacgtttaactacagagaacgtagtcgacgtcctccagctagctcggctctgcgacgcacccgatgtttgccttcgatctatgcgtctgatccattcgcagtttaagaccgttgagcagactgaaggatggaagtttattcaagaacatgatcctttcctcgagctcgacattctccagttcatcgatgacgccgaatcgaggaagaaaagaaggcgacgacatagaaaggagcaggatctttacatgcaactaagcgaggcaatggagtgcatagagcacatatgcacacaaggttgtacattggtcggtccatcaaacgtagtagataacaacaaaaagtcaatgactgcggaaaagtcagagccttgtaaggcgttttccacgtgttatggtcttcagcttttgatacgtcactttgccgtatgcaagaggaggaataacgataagggttgtcttcgttgcaagcggatgcttcaactctttagactccattctttgatttgtgatcaacccgattcttgtcgcgtccctctctgcaggcaatttaggaaacggggagaacaagacaagaaaatgggtgaagacaccaagtggaagcttctggtgacaagggttgtgtctgcaaaagctatgacgtcgttgtgtcagtcaaagaagaacaaatgtgaacaagcacaaggggtttaa

SEQ ID NO: 1657 - DNA, 1503 bp, Arabidopsis thaliana
atggtgaagaatcttaaagtggatcctcttgctaaggtcactgcctccaccacttccatggtttctgcaaaagagaataagaatcagtcagaggcagagccatcatattatgaaactcttgagacatatcaaggcctgccttgtccttatggtggctactatggatactactatccaggtcttgatggttcagttggagaagcaaaggataatggatactatggttatggaacagaagttcagtacccggtaatgcaaggggaaaatgggtctgtgatctacttgatgccagggtttcagtcttatgatgcaagccaaacttatatgcctataaacccggttggtgtatcgagtcaagcacttcattcgccgatgtatgctgctcaggatgtttcatcgcccacatatttatgggaccctgttggagacaggtatgtgtatggtgttgcttcatataccccacccttgaaacagaacatatcttcttcaagtcataaccacaacaattattattcaaagagcaagaactccttcacgggtcacggcatgggagatcgtcctaaaacaccgcgaaaagcatcacagaacagctatgccccacccccactgcttaaccaagaaaaaggtcgcattgcttacccgatggacccagtaaagaaaaagtctggagctttaaatcgggatgaaacagagaaggcgaaagcgaggacaaaagaaaatggtacaagtatgaatgacttagcaaacggtcaagatcatattaccaatggagaatgtgagtcatgttcgttggatgctgaagggaatgaaagaagcaacggtgttggttctgtgatcagaagggatcaatataacctccctagctttcagaccaaatacgaggaagcaatcttttttgtgataaaatcgtatagcgaagacgacatacacaagagcatcaagtacaatgtctggtctagtactctcaatgggaacaagaagttagacagtgcatatcaagaatctcagaagaaggctgcagacaaaagtggaaagtgcccggttttcctgttcttctcggtgaatgcaagtggccaattctgcggtgtagctgagatgattggacgagttgattatgagaaaagcatggagttctggcaacaagataagtggactggctattttccggtgaagtggcacatcatcaaagatgttccaaatccgcaactacgacatatcatactagagaacaatgagaacaagcctgtaaccaatagcagagacacacaagaggtgaggttgcctcaagggaatgaagtgttgaacatctttaagaactacgcagctaagacatctattttagatgattttgatttttatgaaaacagagagaaggttatggtacagaagaagctaaggttccctccgaagaaagaagaagacttggttgctgattttaaaacaatggagatgtctaatacagtcgaagagggaaacacagagttaaccgggacagtgagctaa

SEQ ID NO: 1658 - DNA, 1080 bp, Arabidopsis thaliana
atgatgatcggagaatctcatcgtggttttaatccaacggttcatattcctccatggccactttctgaagatctaacggtgtctgatatttacggaagtccagacggaggaagtagtatgatggaagctttggctgagttacaacgttatcttccgtcaaacgaaccggatccggattcagatccggatctctcgggtccggattcaccaatcgatgcttatacatgcgatcattttcggatgtatgagtttaaagtgagacgttgtgctcgtggccggagccatgattggacggagtgtccttacgctcatcccggagaaaaagctcgccgtcgtgatccgaggaagtttcattactccggtacggcgtgtcctgagtttcgtaaaggttgttgcaagagaggagacgcatgtgagttttctcatggtgtttttgagtgttggcttcacccggcgcgttaccggactcagccgtgtaaagacggtggtaactgtcgccgtcgtgtttgtttctttgctcattcgccggatcagattagggttttgcctaatcaaagccctgatcgtgttgattcgttcgacgttttgtctcctacgattcgtagagcgtttcagttttcgatttctccgtcgtctaactcgccgccggtgagtccacgaggtgactcggactcgtcgtgttcgttactgagtcgttcactcgggtctaatctgggaaacgacgtcgttgcgtctctcaggaatctgcaacttaataaagtgaagtcttctctttcgtcgtcatacaacaatcaaatcggaggatacggatccggattcgggtcgcctcgtggatcggttttgggtcctggtttccgtagcttaccaactacaccgacccgacctggttttatgaacatttgggagaatggcttggaggaagaaccggcgatggaacgggtcgagtcgggtcgtgaactgcgagcgcagctgttcgagaagctgagcaaagagaattgcatgggtcggattgaaccggatccggatcagggagcgggtgatactcctgatgtcgggtgggtctctgacttggttatgtga

SEQ ID NO: 1659 - DNA, 684 bp, Arabidopsis thaliana
atggctgctgaacaacctctcaatggcgccttctacggtccatcagtcccaccaccagctcccaaaggctactaccgacgtgggcacggtcgtggctgtggctgctgcctcctcagcttattcgtcaaagtaatcatatcccttattgtcatcctcggcgtagccgctctcatcttctggctcatcgtccgacctcgtgccatcaagtttcacgtgaccgatgcgtcccttacccgctttgaccacacttccccggacaacattttaaggtataacctagccctcactgttcctgtccgtaacccaaacaagaggatcggactctactacgataggatcgaagctcatgcctactacgagggaaagcggtttagtaccatcacgttaactcctttctatcaaggacacaaaaacacaaccgttctcacaccaacgttccaaggccaaaaccttgttatttttaacgccggacagtctaggactttaaacgcggagaggatatccggtgtatacaatatagagatcaagttcaggcttagggttaggtttaagcttggggacttgaagtttaggaggattaagcctaaggttgattgcgatgatctaaggcttcctttaagtacctcaaacggaactacaactacctccactgttttcccgatcaagtgcgacttcgacttctga

SEQ ID NO: 1660 - DNA, 1386 bp, Arabidopsis thaliana
atggatccttgtccattcatccgtcttacaatcgggaacctagctttgaaagttccgttagcggcgaagacaacgagctccgtcgtgcatccgtcgtcttctccttgtttttgtaaaatcaaactcaaaaacttcccgccgcaaaccgccgcaatcccgtacattcctttggagacgactcagtttccggagatccaaaccctagccgccacgtttcatctcagcagctccgatattcaacgcttagcttccagatctatatttacttctaagccttgtcttaaaattttgatctacactggaagagccggcgctgcttgcggcgtacactccggtcgtcttctggcgaaagtctccgtaccgttggatctatctggtacgcaatcgaaaccgtgcgtcttccacaacggatggatatcagtcggaaaaggagctggaaaatcgtcgtcgtctgctcagtttcacctgaatgtgaaggcggagcctgatcctagattcgtttttcagtttgacggcgagcctgaatgtagtcctcaagtcgttcagattcaaggcaatatccggcaaccagttttcacatgcaaattcagttgccggcacaccggtgatcgtactcagagatcaagatcattgccgactgagacaagtgtttcacggagctggctaaactcgttcgggagtgagagagaacgtcctgggaaagagcgtaaaggatggtccataacagtccatgacttgtccggttcaccagtggccatggcgtcaatcgtcactccattcgtggcatctcctggaaccgatcgtgtgagccggtcaaaccctgggtcatggcttatactgcgtcccggagactgtacctggagaccgtggggaagacttgaagcatggcgggaacgcggtggagccactgatggtctaggttacagattcgaactcatcccagacggatcaagcggtgcaggaatcgtgcttgcggaatcaaccataagttctcacagaggtgggaaattctcaatcgagttgggatcgtcgccttcttcatcgtcgccaacaagtgtggtgaaccgatcgagaagccgtagaggtgggagtagtggaagcggtggaggagcatcgccggcgaatagtccgagaggagggagcggagattacggttacggattgtggccgtggaacgtgtacaaagggtttgtgatgtcagcaagtgtggaaggtgaagggaaatgtagtaagccttgtgtagaggtgagtgtgcagcacgttagctgtatggaagatgcggctgcttacgtggcgctttctgcagccattgatcttagtatggatgcttgcaggctgtttaatcaacggatgaggaaagagctttgccatgagtcactgagctga

SEQ ID NO: 1661 - DNA, 618 bp, Arabidopsis thaliana
atggagtcacggaagattaaagtaatggcgacagcaatagctttaataatggtggctatggtggtggatgccgccggagctgataaagggaaagacaaggaagagtgtacggcgcagctggtcggtatggccacatgtcttccttacgtgcaaggaaaggcaaaatctccgacgccagactgttgctccggcctcaaacaagttattaattccgacatgaagtgtctttgtatgatcatccaagagaggaatgatcctgatttgggtctccaggtcaacgtctctctcgctctcgctcttccttctgtttgccacgccactgctgacatcactaagtgccctgctttgcttcatttggacccaaattctccggatgcccaagtgttctatcagctagctaaaggtctgaacgaaacagtctcagcctctgctcccactggctcggcctctgagcccactagtatgtcttcgaccccaggatccagtgctggtaacaacagtggtcggacgacctctgtgccaggcacgaaccacgctcaaagcttctccaaacaatggctagggctcgaagttgttgcccatttcttcgtaattttttatattttcatcctcgtttag

SEQ ID NO: 1662 - DNA, 3750 bp, Arabidopsis thaliana
atggtagatgagatgatattctcttgtgtctgctgtggtggtcctggctgctgtggtgatagaggagaaggacctgttggtggtgccaggcagccagcggcggaagatgtggtgacggtcaaggatgctacttcaatgtcagcttcaacgaatcgccgccggctaaaagatataaacaccggcgccggtgaaaatccatcatctggtaaaaaaccattgaggtctgtaactccacttccgatctcaagcaaaaattcaaatcccgctcttcagaaatcattatccagcaaagagaatccgaatccgaagcttagtcaccgctcatttggatcgactcagaagccagtgctccggcctgtaccgcgcattgataagtccgccgtgagtggcgagggtcgggttacgcgatccacgtcatctggtttgcgaggtaggagttctagtccatctgatttgattagggttttctcggatttgagaaagagaaatgaatctagggttattggggaaaagggtgaatcgggtcaggataagaagtctgggctcaagagttctggattcaaacagggtacgagtgaaattaaggttgagccaagtagtgtttgtgagaaagcagatgaaggaagtagttgtccagtgaattcaagcaaatttgaaggttctagtgtggcgagaaattcaatttctgatccaaaggcacatgctttagttggttctggagagaaatctactgttgctttgaaatctgatagtaagattgaaaagactgggaaagggactagtgtagctttaagaaggaagtctttggataatgttgggaaggcaatggagatgtcaaaggatataagaggaaatgaaggaagcagcaatagtactgctaagtatccaagcaagctgcacgagaagcttgcttttcttgaaggaaaggttaagaaaattgcatcagatatcaagaagacaaaggatatgctggatttgaacaatccggattcgtctaaggttataatctctgatatacatcagaaaatcacagggattgaaaagtctatgagtcatgttattgatggtccagagaaaaacaaaactacgaaagcaaaaagttctgtgaaaggattaaataaggaagagctggaagacagactcttgcctcaccagaggttgctaaggagcagaactcagtccaaaacatcttcgcatgtctcaaaaggccatgattctgttgagtccaacaaggcagtgaatgctgaagaaaagccgtcagctcctgttgaggagaatgcgatagctctagagttcttggcctcacttgacaaggaaaaagtcacatttatgagtgatcagaatgcgctggaaaatctggaagtgcaggagatggatacagaggagccgtcaaaggaaaatgatgtctcaaaagacgtcaatctgacttccaacttaactgaaattcttagagcaaacgaagccctcgaggaaattgatgatgaagagaatagagaggagatggagctggaagaaatagatgatggatgcatgtatcaactcaatgacattgggtccaaaacttctacaggaggatggtttgtatcagagggcgaggcagttatacttgctcatgatgatggctcgtgttcctattacgatgtcgctaactctgagtttatggttaatgaatgtaattctctgtcaatctgggtgcgtttgtatgaagtgactggagtttttggctttgttcactatgtgaaatctgtgtacagtcctccagatggtatctcaccaaacacttggagagattgctgggtagttcgtgcaccgggtgctgatggctgctcaggcagatatgtcgtagctgcttctgctgggaataccttagaatctggcttttgttcatgggatttctacacgaaagacattaaggcactccacatcgaggacggatcttcaagagtttcaagaacagctcttgctcctctacccaataacacatcacatggtaggaacactccggcttgtgcagtggtaccagaaactcaacaatggtggtacagaccgtgtggtcctcttatagcatcaactggtagttttcaaagtatagtaaaggtttttgacatacgagatggggaacaaatcatgaaatggggtgtgcaaaatcctgtgtcagctttagattattcgagccctttacaatggaggaatcgaggaaaacttgtcatagccgaaactgaagcaatttctgtttgggatgtcaattcccttcaccctgaagcacagcacaccatttcctcttcagggcgaaaaatctcagcttttcatatcaacaacacagatgctgaagttgggggtggtgttcgtcaaagagtaagttccttggatgctgaaggaaacgacggagtattctgcactagtgattcaatcaacatcttagattttcgtaacccatctggcattggtgctaaaatccccaaactcggtgttaatgctcaatgtgtatcatctcgaggagattcagtgtttctaggatgtaccaatcagaaatcaactgtcaagaaacaaatggcttcttcttctcaggtgcagcaattctccataaggaaacagcgtctcgtgagcacatacagtctgcctgactcaaactctcacccgcaccactctgcaataacccaagtctggggaaattcaaattttgtcatggctacttctggtatgggactatttgtgtttgatactgcaaaagaagagaccttgcaacaacagccattgacaagtgactatggaagcgttcaaacagtaagagagatcatcggtccaaacgatatgtattgcccgtcatttgactactcaggggttttagctggatgtagtgatgctatagctcagaagatctctggagttaaacggattcagttccggagattgcttctccttatgtctggagaaaatgtgatgatctcttttgtgcagttgtatggctttgcttatggaggaccatttggtcactttttccacaaattgatggataccattttcaaagggaagaagggtaattcaactgttgccaaaaaggttttgtcttttgaaccaaactatcatcttcttgaatgctttttgaattcttggttatataacaagtcaaacacttgttttcccagaaggccatggaagctagtgaagcacaaacttggaaaagattaccctactatccagttaaccgcatggaaggtaataaatgagactcactaccatttcattttgttacacttttgtatgtgcctctccaattccgtgttttgttcagcagcttcgtcgcctcttgctgttggtgtaattaattggctactcactcgcctttataaacggagctggtctcgtcttggcttatacaaaaacaaacataacttaatacatacaaaaaaaacaaaagagatggggagtctcgttgttaacggagctgctctcttggctttgttgtggttcaatgtttttgtggtgaattatgtggctgcaagagaaggtgtgacctttggaaaagatgaagaggagaagaccatcataggcggaggaaagggctttggaggtggttttggtggaggatttggcaaaggaggtggaatcgctgccggggaagtggtggttttggaggtgccattggtggcattagtaaaggtggaggctttggtggtggaatcggcaaaggtggtgggattggaggcggcattggaaaaggtaaaggatggggctttggcggcggaatag

SEQ ID NO: 1663 - DNA, 278 bp, Arabidopsis thaliana
tggctttattctcacaacacttgtcctctttgtcgatcctctgtctccatctcctccaccaaaacctctgttgatgacgacaacgaccatccagattctcctcaaacgtcaccggtttgattcaaacccccgaaggaaataagcaaatacacaagttttgttagtgaatagatcgatacaagatgtaaatcttaattttgctgatacaagatatcaaaatgtaatccatcacattatatatattggttacacagattcattcaaaaaaaaaaaaaaaa

SEQ ID NO: 1664 - DNA, 165 bp, Arabidopsis thaliana
atggatttaacggaagttggctcatttgttgttgcagcttctggagcctctgcgccagccatggggaatgggatgcaaaaggcaatgcttgcgaaggacattgacgggtccctggtagagcttataatggcgtctaaggaacccaacaaagcgccgaagttatag

SEQ ID NO: 1665 - DNA, 513 bp, Arabidopsis thaliana
atggcaagcagcgacgtgaagctgatcggtgcatgggcgagtccctttgtgatgaggccgaggattgctctaaacctcaagtctgtcccctacgagttcctccaagagacgtttgggtctaagagcgagttgcttcttaaatcaaacccggttcacaagaagatcccggttctgcttcatgctgataaaccggtgagtgagtccaacatcatcgttgagtatatcgatgacacttggagctcatctggaccgtccattctcccttccgatccttacgatcgggccatggctcggttctgggctgcttacatcgacgaaaagtggtttgtcgctctaagaggtttcctaaaagccggaggagaagaagagaagaaagctgtgatagctcaactagaagaagggaatgcgtttctggagaaggcgttcattgattgcagcaaaggaaaaccgttcttcaacggtgacaacatcggttactcgacattgctctcgggtgcttcttggcttggttga

SEQ ID NO: 1666 - DNA, 2211 bp, Arabidopsis thaliana
atgggagagatagcaacagagttcacgccggttatggatgatgatgatgaccggtgcgttgtaccggaggtagagctcactgtacccaagaccgacgattcaactttaccggttttaacatttcggatgtgggttcttggtataggcgcgtgcattgtactctcctttatcaaccagtttttctggtacagaacgatgccgttgagtatcaccggaatctccgctcagatcgccgtcgtgccgcttggtcatctcatggcgagagtgcttccgacaaaaagattcttggaaggtacgaggtttcagtttaccttaaacccgggtgccttcaacgtcaaggaacatgttctgataactatctttgcaaattccggcgccggctctgtttacgctactcacatacttagtgctattaagctttactacaaacgttctcttcctttcctccctgcatttctcgtcatgatcaccactcagattcttggatttggttgggctggtctcttcaggaaacaccttgttgagcctggtgaaatgtggtggccaagcaatcttgttcaagtctctctctttggtgcgttacacgagaaagaaaagaaatcaagaggaggcatgagtagaactcaattcttcttaatcgtcctcgtagctagctttgcttactacatctttcctggttatcttttcaccatgttaacatcaatctcatgggtctgttggctcaatcccaaatcaattctggtaaaccaactcggttcaggtgaacatggtcttggcattggttccattggttttgattgggtcactattagtgcttatcttggaagccctttagctagtcctttgttcgcttccgtcaatgtagccattggtttcgtgctggttatgtatatcgtcacgcctgtttgttactggcttaacatttatgatgccaagaccttccctatcttctctagtcagctcttcatggggaatggctcacgttatgatgttttgagcattattgatagcaaattccatcttgaccgtgtggtttactctaggaccgggtccatcaatatgagcaccttctttgctgttacttatggtctcgggtttgctacattgtctgccaccattgtccatgttttagtcttcaacggaagtgacttgtggaagcagacaagaggggcgtttcagaagaataagaaaatggatatacacacgagaatcatgaagaaaaactacagggaagttccattgtggtggtttttggtaatccttttactgaatatcgcgcttatcatgttcatctccgtgcactacaacgctactgtgcagcttccttggtggggagtgttacttgcttgtgccattgccatcagtttcactcctttgatcggtgtcatagctgccaccactaatcaggcaccgggattgaatatcataacagagtatgttatcgggtatatctacccggaacgtcctgttgcaaacatgtgtttcaaggtctatggatacattagtatgactcaagcgctaactttcatttccgacttcaagcttggtcattacatgaagatcccgcctagatccatgttcatggctcaggtggctgggacacttgtggcggtggttgtgtacacaggaacagcctggtggttaatggaagagattcctcatctttgtgatacatccttgcttccttcagacagccaatggacttgtcccatggaccgcgttttctttgacgcctctgtgatttggggactagtgggaccacgcagggtgtttggagaccttggagaatactcaaatgtcaactggttcttcctcgttggagccatagctccactcttagtttggctagccacaaagatgtttccggctcagacatggatcgccaagattcatatccctgtccttgtgggagccaccgcaatgatgccaccagcaacagcagttaacttcactagttggctcatcgtcgcattcatctttggccacttcatcttcaagtacagaagagtgtggtggaccaagtataactatgtgttgtctggtggtttagatgctggctctgcttttatgaccatacttctgtttctagcactcggacgaaaaggaattgaagtgcagtggtggggaaattccggcgaccgagatacatgtcccttagcttcttgtccaactgctaaaggtgttgtcgtcaaaggctgtcccgtcttctag

SEQ ID NO: 1667 - DNA, 1752 bp, Arabidopsis thaliana
atggaggctgcaaaagtttacacacaagatggcaccgtcgacctccaaggccgtcccgtcctcgcctccaagaccggtcgttggagagcttgctctttcctcctcgggtatgaagcgtttgagaggatggcgttttatggaatagcgtcgaacttagtgaattatttgactaaaagacttcacgaagatacgatctcttcggttagaaatgtgaataattggtccggtgcggtttggatcactcccatagccggagcttacatcgctgactcatacatcggtcgcttctggacttttactgcctcctctctcatctacgtcctggggatgattctcttgacaatggcggtaacagtaaaatccctaagaccgacatgcgaaaacggggtatgcaacaaggcctcctcgttacaagtaacatttttctacatatccctctataccatagctattggagccggtggaacaaaacctaacatttccacatttggagcggaccaattcgacagttatagcattgaagaaaaaaagcaaaaggtttcattcttcaattggtggatgtttagctctttcttaggcgcgttgtttgcgacattggggctcgtctacatccaagagaatctcggatggggtttaggttatggcatccctaccgtaggactcttggtttctctcgttgtgttctatattggaacaccattttacaggcataaggttatcaaaacagacaatttggcgaaagatttggttcaagttcctatcgcggcattcaaaaaccgaaagcttcagtgtcctgatgaccacttggagctttatgagcttgactctcattattacaaaagcaatggtaagcatcaagttcatcacacgcccgtcttcaggttcttggataaagcggccattaagacaagttcaagagtgccatgtacggtgacaaaagtggaagtggcaaagcgtgtgctaggacttatctttatatggcttgtcactttgatcccaagcaccttgtgggcacaagtcaacactctcttcgtcaaacaagggaccacgctggaccgaaaaattggatccaacttccagatccccgcggcttcattgggaagctttgttacgctctccatgcttctctctgtgcccatgtacgaccaatcctttgttcccttcatgcgcaagaaaaccggaaaccctagagggattactttactccaaagactaggggtagggtttgcgatacaaattgttgcaatcgcgattgcttcggctgtggaggtcaagaggatgcgcgtgataaaggaatttcacataactagtccgacacaagttgtgcctatgagcattttctggttgctccctcagtactctcttctaggcattggggatgtgtttaacgcaattggtttgcttgagtttttctatgatcagtcacctgaggagatgcagagccttggaacaacgtttttcacgagtggaatcggtcttgggaatttcttgaacagctttttggtgacaatgattgataagatcacgagtaaaggtggagggaagagttggattgggaataatttgaatgattcgaggcttgattactattatggatttctagtggtgatttcgatagtgaacatgggacttttcgtgtgggcagcgagtaagtatgtttacaagagtgatgatgacaccaaggagtttagtggaggaggatgtgttcaaatggaggccaaagccttagacacatctcctcttagtatctaa

SEQ ID NO: 1668 - DNA, 1956 bp, Arabidopsis thaliana
atgccgtcacgatcaatctcggcaccggttccggttcttgctccggctccgatcgtttcctctttagtcccagcagcgccgtcaggacatcagaataagacaacgcgaatctttccaccgttcgtggtggctggagccggcgccggtttctctcttttcatcactctctccgtctgtttctgtaaattcagccggaaacgttcatcacctccggcggaaaacgcttcctcttcgcctcggagaccgtcgccacgtgagttttcatattcgtctctccgtcgcgccaccggttctttctcgcaggcgaatagactaggtcagggcggatttggcgtcgtgtttcgtggaactatctccggcggcgagaatgtagctgttaaagtaatggattcaggatctcttcaaggagaaggtgagtttcagaacgagttgttcttcgccgccaagcttgactcgcctcacgttgtccctgttattggtttctctcatgatcgaaaacgacgacgtttgcttcttgtttacaagcttatggacaatggtaatctccaagacgccttgcttcaccggagatgccctgagcttatggattggaatcggaggtttttggttgccgttaacattgccgatgggattaagcatcttcatagtcttgaaccacctgtgattcatggtgatattaagcctagcaatgttctattagatagtctcttctctgccaaaatcgctgattttggtttggctaggttgaaagcagagcaagtggagattagtgtagctccggagcgtgatggtgatggatctatggttgaagaagtagagagtgtggtaactactgtgactggttatgaagattttaactttgggttggttgatcagtctccggagagtgttgctaaggttcctgggtctgtgagtgcttctcctgaggcgacgacggttgtctctgtttctccggaaatgggagagaaaacggatgaggatggtggtagtgttgtggtgatgaagaaggggaaagagagtgagagcaaagattggtggtggaagcaggagagcaatgttgaaagagggagagtgaaagagtatgtaatgcaatggattggttcagaggtaaagaaggagagaccaagcagaagtgattggattgaggcggcagctttgtcttcttcgtcaagtaagaaacttgagaagaagactagcaagagactagattggtggttgtcattggaggaagaggatgagaataagaagaagaagaagcggaggatggttagagagtggtggaaagatgagtatcgtagagaactcgctaagaaaaggaagaagaagaagaagatgactttagaagccgagttttgtagtgatgatgggagtagtagtgtgagtcaatggcggcgtggtagtggtagtggtagcagcatagattggtggttagatgggttaagtggtgaacgatggttgagagcaaggggaaatagccatgactcggtgagcggtgagatagctaagagctgcggaattagtagcacgccgagcatgagagggactgtgtgctatgcagctcctgagtactgtaacttggacaacaacgtgtcagagaaatgtgatgtctatagctacggtgttctgttgttagttctgatttccgggaggcgcccgttggagatgacgggctccgcgagtgagatacaacgggcaaacctcatgtcttgggcgaggaagttggcgagaagaggaaaacttgttgatcttgtggatcaaaagttgcaaaacttagaccaagaacaagcagtgttgtgcataaaggtggctttgttgtgtctgcaaagattaccgatttcacgaccgtcaatgaaagaggtcttgggaatgcttaaaggagaagtgaatctaccagagttgcctagtgagttctcaccatcgccaccattaaagacaacgaggaagcagcgccgttga

SEQ ID NO: 1669 - DNA, 1473 bp, Arabidopsis thaliana
atggaatctggaagtatgaaaacacctctggtgaataatcaagaagaagcaagaagctcttcttccatcacttgtggtcttcttcttagtacctccgtcgctgtcactggctctttcgtttatggctgcgcttgttcctcatggatctcaactaacatgcctcagattggaatttttatttttttaatcaaaatctgttttgaatttgttgatgtcaacttgtggcctaattttgtgcactatcataatttgaagatgtcatattcatcgcctgctcagtccaaaatcatggaagaactgggactttccgttgcagattattcgtttttcacatcggtaatgacattgggaggaatgattacggccgcgtttagtggaaaaattgctgcagttattggtcgtcgacagacaatgtggatcgcggatgttttctgcatctttggttggctcgctgtagcctttgcacattattttttaataaagttaacatttcatttgctgtggtttattttcaaggataaaatgctgttaaatattggtcgaggcttcttggggtttggggttggtctcattagttatgtggttcctgtatatatagcagaaattacgcccaaagcatttcgtggaggattctctttttccaatcaacttctacaaagttttgggatatcgctcatgttcttcaccggaaacttttttcattggagaacattagctcttttaagtgcaatcccatgtggtatccaaatgatatgtttattttttattcctgaatcacctagatggctggtaattcacacacttaaagctatgtatggtagagaacgagagcttgaggttactttgaagaggctaagaggagaaaatggtgatattctcgaagaagcagctgaaatcagaattggattgggcctaatgctcttgcaacaattttgtgggagttcggcgataagtgcttatgctgctcgtattttcgacacagccggtaccgcaatctattattgtcatgtttgccgtcgaccgatgtggacgccgaccacttttgatgagctcttctatcggtctgtgcatatgttcatttttaattggcctctcttactatcttcaggtttagtcatcttaactattttattctttggttatgtcttatcctttggcattggtctaggtggactaccatgggttattatgtctgaggtgtttccggtgaatgtgaaaattaccgccggtagtcttgtaacagtgtcaaactggtttttcagttggattatcattttcagttttaatttcatgatgcaatggagtgctttcgaatattacacatctaacacaaaaatgctttatttcgacagaacatatttcatatttgctggagtttctctgatgtcattcgtatttgtatggactttggtgcctgagacgaaaggccgaacacttgaagatattcaacaatcactaggccaactttcataa

SEQ ID NO: 1670 - DNA, 378 bp, Arabidopsis thaliana
atgatgaagagaccgatcccaagttggccatggtggttattaggaagtagaaaagagaaagaaactgaagctcttaagtttcctacaaagatagctcgagtaaataagaggaaagagcttgaacttgagagctttggttcgtctggctctgaatctgtagatgttgttgctggtgatggacctgaatggtctgttggatggactgagccacatggacctgatttccaaagtgatgatgaaggaaatgatggtggcttcttagtgttggttccttgttatagagctgttgttgaaggctctagtaataataataaccagctcttgagtgctgtcaagaatctccccaatggtttgcctcctggtatgaatcacccctaa

SEQ ID NO: 1671 - DNA, 1641 bp, Arabidopsis thaliana
atgggtttccaaagatctatctcttcttcttctgcattaaaatggcttggatttgtaacagcggtttgggttcaatccatctccggcaacaactacactttttcaaactactccggtgctcttaagtctctcatgaatctcaaccagctcgagctcaacaacctctctgtcgctaaagacgtcggaaaagcctttgggatcctggctggccttgcctctgaccgtcttcccactccggtcatcctccttattggttgctttgaaggtcttcttggttatggtgtacaatggctcgttgttagccgcaccatccaaccaatcccttattggcagatgtgtatattcctctgtatgggagggaacagcacaacgtggatgaacacggcggttctagtgacttgcatacgcaattttcgacgaaaccgtggtccggtctccgggatattgaaaggatatgtcggtttaagcacagctatattcactgatctctgtactgctctgttctcaaacgatccggcgtcgtttttggttttactagccgtggtgccttttgccgtatgtctcacggcggttttcttcctccgtgagatcccaccagcatcttccgcagctgaggagaacgaagagactcgttactttaccatattcaacattgtggccgttgttgtcgccgtgtatcttcagtcttacgacatcattggaatcaaaactggagtgttctctgtcgctttcgcttctatacttctcttcctcttggcttctccaatagccattcctttccactccttcatcaagagcttgaactacggtgaacaagatgacttagaaggacggattcaagaaccgttgcttagatccgagatagcggcagcggagaaagaagtaatagttgtagctgcggtggcagcggaagaggaggagaagaagaggaagaaaccggttttgggagaagaccacactataatggaagcagtgttgaccgttgacttttgggtgctttttgtgtccttcttgtgtggtgtaggaactggtttagctgtgatgaacaatatgggtcagataggtcttgcccttggatacacaaatgtctcaatctttgtctccatgactagtatttggggattcttcggtcgcattctctccggtactctctccgaatactttctcaagaaagctggaacaccaagaccactatggaatgcagcctctcaaatccttatggccgtaggatatatactaatggctttagccgtgcctaattcactctacatcggttcaatggtggttggagtatgttacggtgtccgtctagccataactgtaccaacagcttccgaactctttggtctcaaatactacggtctcatctacaacatcttagtacttaacttgccacttggctcgtttctcttctcgggtctcctcgctggcttcctctacgatgcagaggcaacaccaactcctggtgggggcaacacgtgcgtaggagctcattgctaccgtctcatcttcatagtcatggcattagcttctgttatcggagtcggtttggatcttgtgttggcttataggactaaggagatttacgctaagattcacgctagcaagaagtcaaagaaatctggtggtagccttagttaa

SEQ ID NO: 1672 - DNA, 1191 bp, Arabidopsis thaliana
atgggattctggtcgttgttggaggtggcttctatgccggttattcaagttcttttcatgagtcttgtgggagctttcatggcctctgatcgttgcaagctcttccctgttgaagcccgtaattccatgaacaaggtggtgtttgtactatttgcaccggctctcatgtttgccaatctagctcagacggttacacttgaagacatcatctcatggtggtttatgccggtgaacatgggacttacatttctaatcggaggacttcttgggtggttggttgttaagattttgaaaccacctccttatcttgaaggtcttattgttgcaacttgttctgcaggaaatatggggaacctaccaatcatacttgtcccagcaatctgcgatgaggacaaaagtccttttggtaaccgaagtgtatgtagaaccgtcgggctctcttacgcgtctttctccatggcgctagggggtttctacatatggacatacacattccggctgattaaagggtccgcaatgaaagttcaagccatagaagaatctgagaaaatagcaattaaatcatccaatagtgacttagaagctgatcataagacccatctcctcggtgcaccggaagacaaggaaaacaaagtggtaaaggaaaagacagggttttggagaaaaggagtagacttcctccatgagatattggaggagcttcttgcaccacctacacttggtgcaattatcggtttcattttcggtgcagtaagatggctcagaaatcttatcataggtgatgatgctcctttacgaatagtacaaagcactgcaaaacttcttggagatgggaccattccctgtatgactattatactagggggaaacctcatacaaggtttacgttcttcggcagtcaaaccgatggttgtacttggaatagtctgtgttcggtacatagctatgccaattatcggtataggcattgtactaacagctgcaaatctcggatttcttccagctgatcctttgtttcagtatgttttgatgcttcagttcaccctcccgcctgccatgaatatcggtaccatgacacagctgtacaatgttgctcaagacgaatgctcagtgctcatgctttggacctacttggtcgcgatactggccctcactgtatggtccaccatcttccttcacttgttagtctaa

SEQ ID NO: 1673 - DNA, 2361 bp, Arabidopsis thaliana
atgatgagccatcttttgttggccataattggaacctttgccgttatagttggcgcccaaaaacaagaaggtttcatcagtttggattgcggatttcctattgaggaatctccttatagtgatccatctactggattaacattcacatcagattcaacatttatccagactggagaaagtggtagagtcgataaagagctcaacaaaatattccgaaaaccatatttgactctaagatactttccggaaggaaagcgtaattgctcactgaggaactctttccgggttcattgcagcacttctgatagcgaaataaggtatgatgatgactcctatgatcgtgtctggtatccattcttcagctcttcgtttagctatataacgactagtctcaatataaacaattcagatacatttgagataccaaaagctgcactcaaaagtgctgccacgcctaaaaacgctagtgcaccgctaatcataacttggaaaccaagaccctctaacgctgaagtttacttctatcttcatttcgctgagatacaaacccttgcagccaacgagacgagggaattcgacattgttttcaaaggaaactttaattattcagcttttagtcctaccaagttagagctacttacatttttcacaagtggaccagtgcaatgtgattcagatggttgcaatttacagctcgtaagaactccgaattcaacccttccacctttgatcaacgctcttgaggcttacactattatcgaattcccacagttggaaacaagcctaagtgatgttaatgctatcaaaaacattaaagctacgtaccggctaagtaaaactagttggcaaggagatccatgtctccctcaagaattatcctgggaaaatcttagatgcagttacacaaatagttctaccccaccaaaaatcatttcattaaacttgtcagcaagtggattaactgggagtctaccctcagtttttcaaaatctaacgcagatacaagagctggacttatctaacaacagtttgactggacttgtgccttcttttctggccaacattaaatcattatctttgttagacttgagtgggaacaattttaccggttcagttccacaaactcttcttgatagagaaaaggaaggacttgtcttgaaacttgaaggaaatccagagctatgcaagtttagctcatgcaatccaaaaaagaaaaagggattattggtaccggttattgcatcaatttcctctgtgcttattgtaatagtggttgtggctctcttttttgttctccgaaagaagaagatgccttcagatgcacaggctccaccaagtttgcccgtagaagatgttggacaagctaaacattcagaatcatcattcgtctcgaaaaagataaggtttgcttatttcgaggttcaagagatgacaaataactttcagagagttcttggtgaaggaggctttggagtcgtttatcatggttgtgttaatggtacccaacaagtagctgttaaattgctctctcaatcatcttcccaaggctataaacatttcaaggcagaggtggaacttcttatgagagtacaccataaaaatttggtgagtcttgttggttattgtgatgaaggagaccatttggccctcatctacgagtacatgcctaatggagacttaaaacaacatttatcaggaaagcgtggtggatttgtcttaagctgggaaagtagactaagagtagctgtcgatgcagcactaggtttggagtacttacacactggatgcaaaccaccaatggttcacagagatataaaaagtacaaacatacttttggatgaacgtttccaagccaaattagccgattttgggctttcgagatcttttcctaccgaaaacgaaacacatgtttcaactgttgtggctggaactcctggttatcttgatcccgagtattatcaaacaaattggttgacagagaaaagtgatgtttacagtttcggaattgtactattggagatcatcacaaaccggcctataattcagcaatctcgtgaaaagcctcacctagtagaatgggttggatttattgtaagaacgggagatattggaaatattgttgatccaaaccttcacggagcttacgacgtcggttctgtctggaaggctattgaactagctatgtcatgtgtgaatatttcttcggcaagaagaccaagcatgtctcaagttgttagcgatcttaaagagtgtgtgatatctgaaaattcaaggacaggagagagtcgagaaatgaactcaatgagttccatcgaattcagcatgggaattgacaccgaggtgatccctaaagcacgctag

SEQ ID NO: 1674 - DNA, 4551 bp, Arabidopsis thaliana
atgtggttgctttcgtcttctccatggctctctgagctctcatgttcatattcggctgttgtagaacatacgtcttcagttccagtaccaatccaatggctcagatttgttttactctctccttgccctcaacgcgctctcttctccgccgttgattttatattcctcctctgcttcgctcttcacaagctcttttcttctccttcttcttcttccgaaatcaacggacacgctgagattaggaaacctcttattggtatccgtggaagaaccccaaccagaacaaccgcatggttcaaaacgacggtcgcagtcaccgttctattgtcgttttgctccgtcgtgctctgcgttttggccttcactggcaagcgacggactcagagaccatggaacctcatagacccgctcttttggcttattcacgccgttacacacctagtcatcgccgttctcgtcctccaccagaagagattcgctgctctaaatcatcccttatctctacgaatctactggatttccagtttcgtcctcacgtctctcttcgccgtcactgggattttccattttctctccgacgccgccacgagtctgagagcagaagacgtcgcttcattcttctccttccctttaaccgcctttcttctcatcgcctccgtcagaggaatcaccggcctcgtcacagcggagaccaacagtcctacgaaaccatccgacgccgtttcggtggagaaatccgataacgtctctctctacgcgtctgcttctgttttctcgaaaacgttctggttatggatgaatcctttactcagcaaaggctacaaatctccactgacgctcgaacaagtccccacgctttctccagagcacaaagcagagaggctcgcgcttctcttcgaatcgagttggcccaaaccgtcggagaattctagccaccctatccgtacgactctactccgatgtttctggaaggagatcctcttcaccgcgattctagccatcgtccgtctcggcgtcatgtacgttggtcccgttctcatccagagcttcgtcgatttcacctccggcaagagatcctccccgtggcaaggttattacctcgtcctcatcctccttgttgccaaattcgtcgaggtcttgacgacgcatcagttcaatttcgattcccagaagcttgggatgcttataaggtcaactctaatcactgcactctacaagaaaggtttaaagctcacaggctctgcgcgtcagaaccacggcgtaggacaaatcgtgaattacatggccgtagatgcacaacagctctctgacatgatgcttcagctccacgcaatctggctcatgcctttgcaagtcactgttgcactagtgcttctctacgggagcctaggcgcgtctgttataaccgcggttattgggctgactggagtgttcgtcttcatcctcctggggactcagagaaacaacggataccaattcagcttgatgggaaaccgagattctcggatgaaggccaccaacgagatgctcaattacatgcgagtcatcaagtttcaggcttgggagaatcattttaacaagaggatcctcaaattcagggacatggagtttggttggctatccaagtttctttactccattgctggcaatattattgtcctctggagcacgccagtgcttatctctgctctcaccttcgccaccgcccttgccttgggagtcaagcttgacgctgggactgtgttcaccaccacaaccattttcaagatcctgcaagaacccatcaggacgtttcctcagtctatgatttctctctcgcaggcaatgatctctcttgggagactggactcatacatgatgagcaaagagctgtcggaagatgctgtggagagagccctgggttgtgatggtaatactgccgtggaggtcagagatggaagctttagttgggatgatgaggacaacgaacctgctctcagtgatatcaacttcaaggttaagaaaggtgagctcactgcgatagttggaaccgttggttcagggaaatcttctctgttagcttcggttcttggtgaaatgcacagaatctcaggccaggtgagagtttgtgggagcacaggttatgtagctcagacgtcgtggattgaaaacgggacggttcaagacaacatcttgtttggtcttccaatggttagagagaagtacaacaaagttctcaatgtctgttctcttgaaaaagacctacaaatgatggagtttggagataagactgagattggagaacgcggaatcaacctcagcggagggcagaagcaacgtatacagctcgcacgtgctgtctatcaggaatgcgatgtatacttgctcgacgatgtttttagcgcagtggatgctcataccggttcagatatattcaagaaatgtgtaagaggagctctgaaaggcaagaccgtattactcgttacccatcaagtggatttcttgcacaacgtggattgcatcttggtgatgcgggatggaaagattgttgaatcaggaaaatatgacgaattagtcagctccggattggattttggggaacttgtggctgcacatgagacgtcaatggagctggttgaagccggtgcagactctgcagcagtcgccacatccccaagaacaccaacgtctccccatgcaagctctccgagaacgtcaatggagtctcctcacttaagtgatctaaacgatgagcatatcaaatcatttctcggttctcacatcgtagaagatggctcgaagctcatcaaagaagaagaaagggaaaccggacaggttagcttaggagtttacaaacagtactgcactgaggcttatggctggtggggaattgtgcttgttctgttcttctctctgacgtggcagggatctctaatggccagcgattactggcttgcatacgaaacatcagccaaaaatgcaatatcatttgatgcttccgttttcattctcggatatgtaattattgcacttgtttccatcgttttggtgagcatccggtcatattacgtcacccacttgggactcaagacggctcagatctttttccgacagattcttaatagtatcttacacgctcccatgtcattctttgacaccacgccatcgggaagaattctcagtcgggcatcgactgatcagaccaatgtcgatatccttattccgtttatgctcggacttgtggtctcaatgtacaccactctgctgagcattttcatagttacctgccagtacgcttggccaactgcattctttgtgattccccttggctggcttaacatctggtaccggaactattacctcgcttcttcccgtgaattaacacgcatggactcaatcactaaggctcccatcatccaccatttctctgaaagtatagctggagtgatgacaatccgatcattcaggaagcaggagttgtttagacaagagaatgtaaaacgtgtaaatgataatctcaggatggacttccacaacaatggctccaacgaatggctcgggtttcggctggagctggttgggagctgggtgctctgcatctcggctttgtttatggtattgttacccagcaacgttatcagaccagagaatgtagggttgtccctgtcgtacggactgtccctgaactcggttctgttctttgccatatacatgagctgctttgtcgagaacaagatggtttcagttgaaaggatcaaacagttcactgatattccctcagaatccgagtgggagagaaaagaaacccttccaccttcgaattggcccttccatggcaatgtacatctcgaagacctcaaggtgcgctacagaccgaacactccacttgtgctcaaggggatcactcttgacatcaaaggaggagagaaggttggtgtggttggacggacgggaagcgggaaatcgacattgatccaagtcttgttcaggcttgtagaaccatcaggagggaagataatcatagacgggattgatataagcactctagggctacatgatctcaggtcaagattcggaatcattccgcaagaacctgtcctctttgaaggaaccgtgagaagcaacatcgacccgacagagcaatactctgacgaagaaatctggaagagcctggaacggtgtcaactcaaggatgttgtagctaccaagcctgagaagctcgattctttggtggttgataatggggagaactggagcgtagggcagaggcagcttctatgcttaggcagggttatgttgaaacgcagcagacttctcttcctagacgaagcaactgcatccgttgattcccaaaccgacgccgtgattcagaagatcatcagagaagactttgcgtcgtgcaccatcatcagcatcgcccaccggattcctacagtgatggacggcgatcgagtccttgtcattgatgctgggaaagcgaaagagttcgatagcccggctcgcttgctggagaggccgtctctgtttgcggcgctggtgcaagagtacgctctccgatctgccggaatatga

SEQ ID NO: 1675 - DNA, 1722 bp, Arabidopsis thaliana
atggcggtaattgtgtggtggctactaacggtggttgtggtggcgtttcactcggcgtcggcggcagtagtagaatcaacgtgggaggttgagtataagtactggtggccggattgtaaagaaggaatcgttatggccatcaacggccagtttccagggccaacgatagacgcagtcgccggagacacggtcattatccacgtcgtcaacaaactctccaccgaaggtgttgttatccattggcacggcatacgtcagaaagggactccatgggctgatggagcagcaggtgtgacccagtgtcctattaatcctggcgagactttcacttacaagttcattgtcgataaggcgggaacacatttctaccatggacactacggaatgcaaagatcatcgggactatacggaatgttaatagtaagatcaccaaaagagaggttaatttacgatggagagttcaatctcttgctcagtgactggtggcaccaaagcattcacgcgcaagaactcgctctttcttctcgtcctatgcgttggatcggtgaacctcaaagcttgttgatcaatggaagaggacagttcaattgttcacaagcagcgtattttaacaaaggaggagagaaagatgtatgcacgtttaaagaaaatgatcagtgtgcacctcaaactcttcgagtcgaacccaatagagtgtaccgtcttcgaatcgctagcacaactgctcttgcttccctcaacttggctgttcaaggacaccagctggtggttgttgaagctgacggcaactacgtcgcaccgttcaccgtcaacgacattgacgtttattccggcgaaacttattctgttctccttaaaaccaacgcacttccatcaaagaagtactggatctccgtcggcgttcgtggccgagaacccaaaactcctcaagcactcaccgtgataaattacgttgatgccactgagtcacgcccatctcatccaccaccggtgactccaatctggaacgacacagatcggagcaaaagcttctcgaagaagatcttcgccgctaaaggatatccaaaaccgccggagaaatcacatgaccagctaatcctcctcaacacacagaatctctacgaagattacacgaaatggtcaatcaacaacgtctcattatccgtaccggtgacgccgtacctcggatcaattagatacggtttaaaatcggcgtacgatttgaaatcgccggcgaagaagttaattatggataattacgatatcatgaaaccgccgccgaatccaaacacaacgaaaggtagcgggatttacaatttcgcgtttggaatcgtcgtcgacgtgattcttcaaaacgctaatgttttaaaaggtgtgattagtgagattcatccgtggcatattcatggtcatgatttctgggttttgggttacggtgaagggaaatttaaaccggggattgatgagaagacgtttaatttgaagaatccgccgttacggaatacggtggtgttgtatccgtttggatggacggcgataaggtttgtgacggataatccaggggtttggttttttcattgtcatattgaaccgcatttgcatatgggtatgggtgtggttttcgtggagggagtagaccggattggtaagatggagataccggatgaagcgcttggttgtggattaaccaggaaatggcttatgaaccggggacgcccttaa

SEQ ID NO: 1676 - DNA, 492 bp, Arabidopsis thaliana
atgaaaatctttaactcatctcaaaacctattcttggccataacctttttccttgttctcatagttcatctaaaagcccaagacagtcctcaagactttttggcagttcacaaccgagcacgagccgaggttggggtgggacccttaagatgggacgagaaggtggctgcttatgcccgtaactatgctaaccagcgtaaaggtgactgcgctatgaaacactcgagcgggtcctatggagagaacatcgcttggagcagcggtagcatgacaggcgtagcagcagttgacatgtgggtggacgagcaatttgactacgattatgattccaatacatgtgcatgggacaaacagtgtggccactatactcaggttgtgtggagaaactcggagaggttgggatgtgcaaaagtgagatgcaacaatggtcaaacctttatcacttgcaactacgatcctcccggtaactgggttggcgagtggccttactaa

SEQ ID NO: 1677 - DNA, 906 bp, Arabidopsis thaliana
atggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgattctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtag

SEQ ID NO: 1678 - DNA, 2217 bp, Arabidopsis thaliana
atgaaagtgcagcgtctgttcttagtagctattttctgcctctcttatatgcagctggtcaaggggcaaaccttgcctcgttgccccgaaaaatgtggcaacgttacacttgagtacccttttggcttttctccaggttgttggcgtgccgaagatcctagtttcaatctcagttgtgtgaacgagaatctattctataagggccttgaagtggtcgaaatatctcacagcagccagttacgcgtcctatatcctgcatcctacatttgctacaacagcaaaggaaagttcgctaaagggacttactactggagtaatctaggtaatttgactctctccggcaacaacacgattactgcattaggctgtaactcgtacgcttttgtgtcctctaatggaactcgaagaaactcagttggatgcatatcagcatgtgatgctctttcccatgaagcaaatggagaatgtaatggtgaaggctgctgccagaaccccgtccctgcagggaacaattggttaatagtcagatcatatcgctttgacaacgacacgtcagtgcaacctatctctgagggtcaatgcatctacgcctttctcgttgaaaatggcaagtttaagtacaatgcttcggacaaatattcttatctgcagaataggaatgtggggtttcctgtggtcttggattggtctattaggggagagacatgtgggcaagttggagaaaagaaatgcggtgtgaatggcatatgttccaattctgctagtgggatcgggtatacatgcaaatgcaaaggaggtttccaggggaatccatatcttcaaaacggttgccaagacatcaatgagtgtactactgctaatcctatccataaacataactgctcgggtgacagcacctgtgaaaacaagttgggacacttccgttgtaattgtcgatctcgttacgaattaaataccaccactaatacctgcaaacctaaaggcaatcctgaatacgttgaatggactacaattgttcttggaaccactatcggcttcttggtcattctgcttgccattagctgtatagaacataaaatgaagaacaccaaggacaccgagctccgacaacaattcttcgagcaaaatggtggcggcatgttgatgcagcgactctcaggagcagggccatcaaatgttgatgtcaaaatcttcactgaggaaggaatgaaggaagcaactgatggttatgatgagaacagaatcttgggccagggaggccaaggaacagtctacaaaggtatattaccggacaactccatagttgctataaagaaagctcggcttggagacaatagccaagtagagcagttcatcaatgaagtgcttgtgctttcacaaatcaaccataggaacgtggtcaagctcttgggctgctgtctagagactgaagttcccttgttggtctatgagttcatttccagtgggacccttttcgatcacttacacggttctatgtttgattcttctctaacatgggaacatcgtttgagaatggctgtagaaatagctggaactcttgcttatcttcactcctctgcttctataccaatcatccatcgcgatatcaaaactgcaaatattcttctggatgaaaacttaactgcaaaagtagctgactttggtgcttcaaggctgataccaatggataaagaagacctcgcaactatggtgcaaggaactctaggttacctagacccagaatattacaacacagggttgctaaacgaaaagagcgatgtttatagctttggggtagtcctaatggaactgttatcaggtcaaaaggcattgtgctttgaaaggccacagacttcaaaacatatagtgagttactttgcctcagccacgaaagagaataggttgcacgagattattgatggccaagtgatgaacgagaataatcagagggagatccagaaagctgcaagaattgctgttgagtgtacaagattgacgggagaagaaaggccagggatgaaggaagtagctgcagagcttgaggccttgagagtcacaaaaaccaaacataagtggtcagatgagtatcctgaacaggaggatactgagcacttggttggtgttcaaaaattatcagcacaaggcgaaaccagcagcagcattggctatgatagtatcaggaatgtagcaatactggacattgaagcaggccgctga

SEQ ID NO: 1679 - DNA, 843 bp, Arabidopsis thaliana
atggagaaacaaatctctctattgctctgtctactcctcttcatcttctcaatatcatcctctctccatgaaaccgaagctcgaaaacacaataaatataaacccgcaccgatcatgagcctagtcccaagaactctctacgaccaaatcttcatccacaaggacaacaacgcatgccctgcaaaaggtttctacccctatgaagctttcgtggaggctacaagatccttcccgaagttcgggagcgtaggaaacttttggacaaggcgacgcgaagtggctgcgtttttggcgcagatatctcacgagacaacaggtggttgggccacggcaccagacggaccatatgcgtggggattgtgttttaaagaggaagtgagtccacagagtaattattgtgatgcttctaataaggattggccttgtgtttctggcaagtcttacaaaggaagaggtcccattcaactatcttggaattacaattacggacaggcgggtcgagcattgggtttcgacggtttacagaacccagaacttgtagccaacaactccgttttagctttcaagacagctctttggttttggatgaccgaacagactcctaaaccgtcctgccataacgttatggtcaaccgatacagaccgacgaaagcagatagagcagcaaaccggactgtcggttatggtttagtcaccaacatcataaacggcggtttagaatgtgggattccaggagatggacgggtcactgaccgggtcgggtatttccaaagatacgctcagttgtttaaagtcaccacaggacctaatttagactgcgagaaccaaagacccttctcctaa

SEQ ID NO: 1680 - DNA, 1752 bp, Arabidopsis thaliana
atggcggatcaagttaaagaaaagacattggaggaaacttctacatgggccgtcgcggtggtttgcttcgtcttgcttctgatttcgatcgttattgaaaaacttattcataaaattggatcctggtttaaaaagaagaacaaaaaagctctatatgaagcacttgaaaaagtgaaagcagagcttatgctgatgggattcatatcactacttctaacaattggacaaggatatatctcaaatatttgcatccctaagaacatcgcagcatcgatgcacccttgtagtgcatccgaagaagcaagaaagtatggtaagaaagatgtcccaaaggaagatgaagaagaaaacttgcgtcgaaagcttctacagttagttgattctcttattcctcgaaggagtttggctactaaaggttatgataagtgtgcagagaagggaaaagtcgcttttgtatcggcttatggcatgcatcagctgcatatattcatctttgttcttgcggtttgtcatgtgatctactgcattgttacttatgctttgggaaagaccaaaatgagaaggtggaagaagtgggaagaggagactaagactatcgaatatcagtattcacacgatcccgagaggtttaggtttgcgcgggatacatctttcgggcgtagacatctgagtttctggagcaaatcaactattacgctgtggattgtatgtttcttcaggcagttctttagatctgtaaccaaagttgattacttaacactgagacatggtttcatcatggcccatttggctcctgggagcgacgcaaggttcgatttccgaaagtatattcagagatcactagaggaagacttcaaaaccattgtcgagatcaaccctgtgatctggttcatagctgtgctattcctcctgacaaacacaaacggattgaattcttacctctggctaccgttcattcccttcatcgtgattcttattgttggaacaaaacttcaagtgataataacaaaactaggacttagaatccaagagaaaggcgacgtagtgaaaggcacaccgctagttcaacccggtgatcatttcttctggttcggtcgtccacgtttcattctcttcctcattcacttagtcctcttcacgaacgcgtttcaactagctttctttgtctggagtacgtatgaattcggtctaaagaactgtttccatgaaagcagagttgacgtgatcatcagaatctcaatcggacttttagttcagattctttgcagctacgttactcttcctctatatgctcttgttactcaaatgggttcaaagatgaaaccaacagtgttcaacgagagagtagcaacagcgttaaagagttggcatcacacagctaagaaaaatatcaaacatggaagaacttcagaatcaacaacacctttctctagtagaccaacaacaccaactcatggttcttctccgattcatctccttcgtaatgctcctcacaaacgaagcagaagcgttgacgaaagctttgcgaattcgttttctccgagaaactctgatttcgattcgtgggatcctgagtctcaacatgaaactgctgagacttcgaattcgaatcatcgttctaggtttggagaagaagaatcggagaaaaagtttgtttcttcatcagtggaacttcctcctggacctggacaaatacgaacacagcatgagattagtactataagcttaagggatttttcgtttaagcgatga

SEQ ID NO: 1681 - DNA, 1182 bp, Arabidopsis thaliana
atgtcttccacttctttcaccgaccttcttggttcttccggcgttgactgttacgaagatgatgaagacttgagagtttctgggtcgagttttggtgggtactatccagagagaaccgggtctggtttacctaagttcaagacggctcaaccaccacctcttccgatttcacaatcttctcataacttcactttctccgattaccttgattctcctctgcttctcagctcctcacacagtttgatatctccaacaacaggaacgtttccattgcaaggctttaatggaacaacaaacaatcactcagattttccctggcagctacaatctcaaccatcaaacgcttcttctgctttgcaagaaacatatggtgttcaagatcacgagaagaagcaggagatgattcctaatgagattgcaacacaaaacaacaatcaaagttttggaacagaacgtcagataaagataccagcatacatggtgagtaggaactctaatgatggttatggttggagaaaatacggtcagaaacaagtgaagaagagcgaaaaccctaggagttacttcaagtgtacgtatcctgattgtgtttccaagaagattgttgagacggcttctgatggacagatcactgagatcatttataaaggtggtcataatcatcctaagcctgagttcaccaagagaccatctcaatcttcattaccatcatcggttaatgggaggcgcttgtttaatcctgcttctgttgttagtgaacctcatgatcaatcagagaactcttcgatttcgtttgactatagtgatcttgagcagaaaagttttaaatcagagtatggtgagatagatgaagaggaggaacaacctgagatgaagaggatgaaaagagaaggtgaagatgaagggatgtctatagaagtaagcaaaggagttaaagagccaagagttgtggttcagacaataagtgatattgatgttcttatagatggctttagatggaggaaatatggtcaaaaagttgtcaaaggaaatactaatccaaggagctactacaagtgcacattccaaggttgtggagtgaagaagcaagtggaaagatccgcagcagacgagagagcagttctcactacctatgaaggaagacacaatcacgatatcccaaccgcgctacgtcgctcgtga

SEQ ID NO: 1682 - DNA, 2163 bp, Arabidopsis thaliana
atggaagattctggagtgaatccaatggattcaccatctaaaggcagtgactttggagtctatggaatcataggaggtggaatcgtggctttacttgtgcctgtgttactctctgtggtgttgaatggaaccaaaaaggggaaaaagagaggtgttcccatcaaagtaggtggcgaggaaggttacacaatgcgtcatgctcgagctcctgaattggttgatgtaccttgggaaggagctgctactatgcctgctttgtttgagcagtcttgtaagaagtattcgaaagatcggttactaggaactagagagtttatagataaggaatttattactgctagtgatgggaggaagtttgagaagcttcatttaggagagtataaatggcaaagttatggagaggtttttgaacgtgtttgtaactttgcgtcggggttagttaatgtaggacataatgttgatgatcgtgttgctatcttttcggatactcgtgctgagtggtttatcgcgtttcagggatgtttcaggcagagcataaccgttgttactatttatgcttctttaggagaagaggctttgatttactcactcaatgagactcgagtgtcaaccttaatatgtgactcaaaacaacttaagaagttgtctgcgatacaatcaagcttgaaaactgtgaagaacattatttacattgaagaagatggagtagatgttgcttctagtgatgtcaatagtatgggtgatataactgtttcgtcgatctctgaagttgagaaacttgggcagaagaacgctgttcaaccgatcttaccttcgaagaatggagttgctgttataatgtttaccagtggtagtactggtctaccaaagggagttatgattacccacggaaatcttgtcgcaactgctgcaggagttatgaaggtggttccaaagttggataaaaatgatacatatattgcgtacttacctttggctcatgtgtttgagctggaagctgagattgtggtctttacctcaggtagtgccatcggttacggctcagcaatgactttaactgacacttcaaataaagttaagaaaggaaccaaaggagatgtttcagctctgaagccaactataatgactgcagttccagctattctggatcgtgtccgagaaggagttcttaaaaaggttgaggaaaagggagggatggcgaagaccctttttgactttgcatacaagcgccggttagcagctgtggatggaagttggtttggtgcctggggtttggagaaaatgttatgggatgctcttgtcttcaagaaaatacgcgctgtgcttggaggacacatccgttttatgctcgttggaggagctcctctgtctcctgattcgcaacgcttcatcaatatctgcatggggtctcccatcggccaaggatatggattgactgaaacgtgtgctggagctacgttttctgagtgggacgatcctgctgttggtcgtgttggacctccacttccatgcggctacgttaagctcgtttcttgggaagaaggtggctacagaatttcagataaaccaatgcctagaggggagattgtggtaggtggtaacagtgtaacagcaggttacttcaacaatcaagaaaaaaccgatgaggtttacaaggtcgatgagaagggcacaaggtggttttacaccggagatattgggagattccaccctgatggatgtctcgaagtcatcgatagaaagaaagatattgttaaacttcaacatggggaatacgtatcccttggaaaggtggaggcagctttgggttcgagcaattacgttgataacatcatggtccacgcagacccaattaacagctactgtgtagctcttgttgttccatcacgaggagcattagagaaatgggcagaggaagctggagttaaacacagcgaattcgctgagctatgcgagaaaggtgaagcagtcaaggaggttcaacaatctcttaccaaggccgggaaggcggcaaagctcgaaaagtttgagcttccagcaaagatcaagttgctgtcagagccgtggacaccggagtcgggattggtcactgctgctcttaagataaagagagaacaaataaagtccaagttcaaagatgaactcagcaagttatatgcctaa

SEQ ID NO: 1683 - DNA, 483 bp, Arabidopsis thaliana
atgtttaactcctatcctaaccttttagtcttggctattgctcttgcactatctttttctgttcctctgaaagcccaagaccagccgcaagactacttcaatgcccacaaccgtgctcgagtttctgtaggcgtgagtcccttgatgtggagccagacactgactgcctatgctcaagcctacgccgagaagagacgcgactgcggtttatttctctcaggtgggccctacggggagaccataaaagcggatattattgacttctcagctgaggagtttgtgagcacctttcttaaccagaagtctgattacgattatactacaaacacatgtcgtgctgggaaatcatgtgacggttataagcaggttttgtttcgaaagtcggtgtttcttgggtgtgccaaagtcaaatgcaataatggtggattccttgccatttgtagctatgatccgtctgtcattcttagtgaacgacctttttga

SEQ ID NO: 1684 - DNA, 1140 bp, Arabidopsis thaliana
atgtcttcaacaaaactcatatcgctcattgtctccataacattcttcctcactctccaatgctcaatggcacaaactgtcgtaaaagcttcgtactggttcccggcgagtgaatttccggttaccgacattgactcatctctcttcactcaccttttttgtgctttcgctgatctcaactctcaaaccaatcaagtcactgtctcctccgcaaaccaacctaaattctcaacctttacacaaactgtccaacgcagaaacccttctgttaaaaccctcttgtccatcggcggtggaatagcagataaaaccgcgtatgcttctatggcaagtaaccccacttctcgaaaatcattcattgattcttcgataagagtggctagatcctatggattccacggtcttgatctagactgggagtatccgagcagtgcgacggagatgaccaacttcggaacgctacttcgagaatggcgatcagcggttgtagcagaagctagtagcagcggtaaaccgcgtttgcttttggcggctgcggttttctactccaacaattactattcggtactgtacccggtttcagccgttgctagcagcttggattgggttaatcttatggcctatgatttttacggaccgggttggtccagagtgaccggtccaccagccgctctgtttgatccttcaaacgcaggtccaagcggagacgctggaacaaggtcatggattcaagctggactcccagcgaagaaagctgtcttgggatttccatactacgggtacgcgtggcgtctcacaaacgccaacagtcatagctactacgcgcctaccactggagcggcgatatcaccagatggttcgataggttacggtcagataaggaagtttatagtagataacggagcaacaacggtttataactccacagtggtcggagattattgttatgccggcacgaattggattggttacgatgataatcagagtattgtgacgaaagttagatatgccaagcagagaggtttgcttggttacttctcgtggcatgtcggtgctgacgataattctggtctatctcgtgcagcttcacaggcatgggatgctacgacggcaaccaccagaactatacagaaggtttaa

SEQ ID NO: 1685 - DNA, 669 bp, Arabidopsis thaliana
atgacgataaaaagtctctcttttcttgcggctctatctctctttgctttgacacttccattagtaattgcttccgatccaagcccccttcaagacttttgtgttggtgtcaacacaccagcagatggcgtgtttgtgaatggaaagttttgcaaggatccaaggatagttttcgcggatgatttctttttctcgagcctcaacagacctggaaatacaaataacgcggttgggtccaacgtgacaaccgtcaatgttaacaaccttggaggactaaacactcttggtatctcacttgttcgtatagactatgcacccaacggtcagaacccacctcacacccacccacgtgccaccgagatcttggttgttcaacaaggaactctacttgtagggtttatctcatcaaaccaagacggaaaccgtcttttcgccaaaacactcaacgtgggtgacgtatttgtgtttccagaaggactcatccatttccagttcaacctaggaggaactccagcagttgcaatcgctgctttgagcagccaaaacgcaggtgttatcacaattgctaacacaatatttgggtctaaaccagatgtagacccgaatgttcttgcaagagcattccaaatggatgttaatgcggtcaggaatttacaagccaggttctaa

SEQ ID NO: 1686 - DNA, 1032 bp, Arabidopsis thaliana
atgtctaaatcatcgtataatcacatcttcatcttgatcttgtgtttatgtttgagatcatcatcagccttcacgaatctcaacaccttaagctttgaagaatcactttctcctctctttggagatgccaatctcgtccgttcacctgatgatctctccgttcgtcttctcctcgatcgctataccggttctggtttcatatcatcgaatatgtatcaacatggattttacagctccatgattaagcttcccgctgattatactgccggcgtcgtcgtcgccttttatacatcaaacggagacgtgttcgagaaaacacacgacgagttagacatagagtttctagggaacataaaaggaaagccgtggaggtttcagacaaatctatacggaaatggaagtacacatagaggtcgtgaagagagatatcgtctctggtttgatccttctaaggagtttcatcgttatagcattctctggactcctcacaagatcatattttgggtagatgatgtgccaataagagaagtgatcagaaacgatgcaatgggagcagattatccggcaaagccaatggctctttacgccaccatttgggacgcttctgattgggctacttccggcggcaaatacaaagctaattacaaatttgcccctttcgtagctgaattcaaatctttctctctagacggttgctccgttgatcctattcaagaagtccccatggattgttccgactcagtcgatttccttgagtctcaagattactcttccattaattcccatcaacgcgccgccatgcgaagatttcgacaacgtttcatgtactattcttactgttacgatacacttaggtatcctgagcctctaccggaatgtgtgattgttccggctgagaaagataggtttaaggaaacgggaaggttgaagtttggtggtacggaggcgcgtgaacggcggagaaatcgccggcagcaacgtcggcctgagattgagattgagagtgatcctgacgacagaaaacttttataa

SEQ ID NO: 1687 - DNA, 573 bp, Arabidopsis thaliana
atgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaa

SEQ ID NO: 1688 - DNA, 1614 bp, Arabidopsis thaliana
atgagctttaccacatcattaccatacccttttcacatcctactagtctttatcctctccatggcatcaatcactctactgggtcgaatactctcaaggcccaccaaaaccaaagaccgatcttgccagcttcctcctggcccaccaggatggcccatcctcggcaatctacccgaactattcatgactcgtcctaggtccaaatatttccgccttgccatgaaagagctaaaaacagatatagcatgtttcaactttgccggcatccgtgccatcaccataaactccgacgagatcgctagagaagcgtttagagagcgagacgcagatttggcagaccggcctcaacttttcatcatggagacaatcggagacaattacaaatcaatgggaatttcaccgtacggtgaacaattcatgaagatgaaaagagtgatcacaacggaaattatgtccgttaagacgttgaaaatgttggaggctgcaagaaccatcgaagcggataatctcatagcttacgttcactccatgtatcaacggtccgagacggtcgatgttagagagctctcgagggtttatggttacgcagtgaccatgcgaatgttgtttggaaggagacatgttacgaaagaaaacgtgttttctgatgatggaagactaggaaacgccgaaaaacatcatcttgaggtgattttcaacactcttaactgtttaccgagttttagtccagcggattacgtggaacgatggttgagaggttggaatgttgatggtcaagagaagagggtgacagagaactgtaacattgttcgtagttacaacaatcccataatcgacgagagggtccagttgtggagggaagaaggtggtaaggctgctgttgaagattggcttgatacgttcattaccctaaaagatcaaaacggaaagtacttggtcacaccagacgaaatcaaagctcaatgcgtagaattttgtatagcagcgattgataatccggcaaataacatggagtggacacttggggaaatgttaaagaacccggagattcttagaaaagctctgaaggagttggatgaagtagttggaagagacaggcttgtgcaagaatcagacataccaaatctaaactacttaaaagcttgttgtagagaaacattcagaattcacccaagtgctcattatgtcccttcccatcttgcgcgtcaagataccacccttgggggttatttcattcccaaaggtagccacattcatgtatgccgccctggactaggtcgtaaccctaaaatatggaaagatccattggtatacaaaccggagcgtcacctccaaggagacggaatcacaaaagaggttactctggtggaaacagagatgcgttttgtctcgtttagcaccggtcgacgtggctgcatcggtgttaaagtcgggacgatcatgatggttatgttgttggctaggtttcttcaagggtttaactggaaactccatcaagattttggaccgttaagcctcgaggaagatgatgcatcattgcttatggctaaacctcttcacttgtccgttgagccacgcttggcaccaaacctttatccaaagttccgtccttaa

SEQ ID NO: 1689 - DNA, 1725 bp, Arabidopsis thaliana
atgggaatcatcgacggttctttgcttcggcggttgatttgtctctgtctctggtgtcttctcggtggaggagtgacggtggttacggcggaggatgagaagaaagtggtacataaacagcttaatcaaactccgacttgggctgttgctgctgtttgtactttcttcatcgttgtttctgttcttcttgaaaaacttcttcacaaagttggaaaggttctatgggatcggcacaagacagctcttcttgacgctttggagaagatcaaagcagagctgatggttcttggattcatctctttgcttctgacatttggacaaacctacattttggatatttgtatcccttcacatgttgctcgtacgatgctcccgtgtcctgctcctaacttgaaaaaggaggatgatgacaatggtgaaagtcacaggagactcttgtcgtttgagcacagatttttatctggaggtgaagcatctcccactaaatgcacgaaggagggttatgtagagcttatctctgccgaggcactccatcagttgcacatccttatattcttcttagccattttccacgttctttacagcttcttaactatgatgcttggaaggttgaagattcgcggatggaagcattgggagaatgagacatcatcccataattacgagttttcaacagacacttccagattcaggctaactcatgaaacatcttttgtgagagcgcacaccagtttctggacccggattccattctttttctatgttggatgctttttcagacagtttttcagatccgttgggagaactgactatttgacattgagaaatggtttcatcgctgttcatttagctccaggaagtcaatttaacttccaaaaatacattaaaagatcgttggaggatgatttcaaggtagtcgttggagtcagccctgtcttgtggggatcttttgtgctattcctcctcctaaatattgacgggacaaagcttcaagcgattatgacaaggatggctcttggtatcacagatagacatgcggtagttcaaggaatgccgcttgtacaaggcaacgatgagtatttctggttcggtcgtccccatttgattctccatctcatgcatttcgccttgtttcagaacgcatttcagatcacttatttcttctggatatggtattcctttggatcagattcttgctaccatcctaatttcaagattgcacttgtaaaagtagcgattgctttaggagtattgtgtctttgcagctacatcacacttcctctttacgcactcgtaactcagatgggttctcggatgaaaaaatcggtattcgatgaacaaacgtcaaaagcactcaagaaatggagaatggcagtgaagaagaagaaaggtgtgaaagccactactaagagactaggtggagatggaagtgcgagccctacggcatcgacagttaggtctacttcgtctgtacgttcattgcagcgttacaaaaccacaccacattcgatgagatacgaaggacttgaccctgaaacatcggatctcgacacagataatgaagctttgactcctcccaaatctcctccaagcttcgagcttgttgtgaaagttgaaccaaataagaccaataccggtgagactagccgtgacactgaaactgattctaaagagttctctttcgtcaagcctgctccgagtaatgaatcatctcaagaccggtga

SEQ ID NO: 1690 - DNA, 810 bp, Arabidopsis thaliana
atggcaaaggaagggggcttgggagagaactcaagatggagtcttggaggcatgaccgctcttgtcactggtggctctaaaggcatcggggaagctgtggtggaggaactagccatgttgggagcaaaagtccacacgtgtgccagagacgaaactcagcttcaagaacgcttacgtgaatggcaagcaaaagggtttcaggtcaccacttctgtctgcgacgtctcttctcgtgaccaacgagtgaaactcatggaaactgtttcctctctctaccaaggaaaactcaacatcctcgtcaacaatgtgggaacgtcaatattcaagccgaccacagagtatacagcagaagatttctcttttgtaatggctacaaatctcgagtcagctttccatctctcacagcttgcccacccattgttaaaagcctctggctcagggagcatcgtgctcatatcctctgctgctggagtcgtgcatgtcaatgttggatccatctatggagcaaccaaaggagccatgaatcagctggctagaaacttagcttgcgaatgggcgagcgacaacataaggacgaactctgtttgtccttggtatatcacaactcctttaagtaacgattttttcgatgaagagtttaagaaagaagcggtgcgtacgacaccaatggggcgtgttggagaagcaaatgaagtctcaccgcttgtggcatttctttgtcttccttcagcttcttatattactggtcagaccatttgcgttgacggcggtgccactgttaacggtttttccttcaagactatgccataa

SEQ ID NO: 1691 - DNA, 2283 bp, Arabidopsis thaliana
atgaagaagacgattcaaatcctcctcttcttcttcttcctcatcaatctcaccaacgctctctcaatctcctctgacggcggcgttctctccgataacgaagtccgtcacattcaacgccgtcaattactcgaattcgccgaacgaagcgtcaaaatcaccgttgatccttctctaaacttcgagaatccgagattgcgaaatgcttatatagctctacaagcttggaaacaagcgattctctctgatccaaacaatttcacttcgaattggatcggatccaatgtctgtaactacaccggagttttctgttctccggcgcttgataatcggaagattcgtaccgtcgccggaatcgatctcaatcacgcagatatcgctggttatttacctgaagagcttggtttgttatcagatcttgctttgtttcatgttaattcaaaccggttttgtggtactgtaccacaccggtttaaccggcttaagcttttattcgagcttgatcttagtaacaaccggttcgctgggaagtttccgacggttgtcttgcaattaccgtcgttgaagtttttagatctccggtttaatgaatttgaaggaactgtaccgaaagagctttttagtaaagatcttgacgcgattttcataaaccataaccggttccggtttgaattaccggagaattttggtgattcgccggtttcggttattgttttggcgaataaccggttccatggttgtgtaccatcgagcttggtggagatgaagaatcttaacgagatcatcttcatgaacaatggtcttaattcttgtttaccgtctgatatcggacggttaaagaacgtgacggtgtttgacgtcagttttaatgaacttgttgggccgttaccggagagtgttggtgagatggtttcggtggagcagcttaatgtggcgcataatatgttgtcggggaagattccggcgagtatttgtcagttaccgaagcttgagaatttcacttatagttacaatttctttaccggagaagcgcctgtgtgtttgaggttgccggagtttgatgatcggagaaattgtttgccgggaagacctgctcagaggtctccagggcaatgtaaagcgtttttgtctcgtccgccggtaaattgtggatcgtttagttgtggccgttctgtgtcgcctcgtcctccggttgtaacgccgttaccaccgccttctttgccatctccgcctccacctgcgccaattttctcaacacctcctacgcttacttccccaccacctccgtcaccgcctccgcctgtttattctccccctcctccaccgccaccacctcctccggtatattctcctccaccaccaccgcccccaccgcctcctccgccagtatattctcctccaccaccaccaccgcccccaccgcctcctccgccagtatattctccgccaccaccatcgccgcctccaccgcctccgccagtctactctcccccaccaccaccaccgcctccacctcctccgccggtatactctcctccgcctccgccagtatactcttctccacctcctccgccttctccagcaccaactccagtttattgcacccgtccaccacccccaccacctcactcgccgccaccaccacaattttctcctccaccacctgaaccttactactacagctcaccaccaccaccgcattcttcaccgccgccgcattcacctccaccaccacattcacctcccccaccgatttatccatatctgtctccaccgcccccaccaacaccagtttcttctccaccacccactccggtctattcccctcctcccccacctccttgtatagaaccaccaccacctccaccgtgtatagagtattcacctcctcctcctccaccagtcgttcattatagctctccgcctccaccgccagtctactacagctctccgccacctccaccagtctattacagctctccacctccgccaccgccggttcattacagctctccgccaccaccagaagtccattaccattctccgcctccatctccagtacactacagctctccaccaccgccaccatcagctccatgtgaagaatctcctccaccagcaccggtagttcaccacagtccaccaccgcccatggttcaccacagcccaccacctccagtgatccaccaaagcccaccaccgccatctcctgaatatgaaggaccactaccaccggtcatcggcgtatcatacgcatctcctccaccaccgccgttctattga

SEQ ID NO: 1692 - DNA, 1251 bp, Arabidopsis thaliana
atggaatattccgacgacggcagattcgacgtgattgtcgttggagcaggagttatgggaagctccgccgcgtatcagctggcaaaaagaggccagaagactcttttgttagagcaattcgatttcctccatcaccgtggctcttctcacggcgagtcacgcaccatacgtgccacttacccggaggattactactactccatggtttccgagtcgactcggttatgggctgcggctcagtccgagattggatacaaagttcattttccaactcaacaattcgacatgggtccggcagatcagcagagtctcctctccgttgtggccacgtgtcaaaaacacgggctagctcatcgggttatggattctcatgcagtttccgagcatttctccgggaggattagtatcccggagaattggatcggagtttcgacggaacttggtgggattatcaaacccaccaaggccgtctccatgtttcagacgcttgcgattggacatggtgccatcttaagagacaacaccaaagttgcaaacataaagagagatggtgaaagtggggaaggggtaatagtctgcacggtgaaaggagataagttctacggtaaaaaatgcattgtaaccgcgggtgcatggataagtaagctggtgaaaacggtggccgggatagattttccggtggagccccttgagactacggtgtgttattggagaatcaaagaaggccacgaggagaaattcacgatagacggagagtttccgactttcgcgtcatacggagctccgtatgtgtacggaactccgtctttggagtatccgggactgatcaaagtggcggttcacggtggttattggtgcgatccggataagaggccatgggggccaggagtgaagttagaggagcttaaagagtggataaaggagagatttggagggatggttgattccgaaggacccgtggcgactcagctttgtatgtattcgatgacaccggacgaggatttcgtgattgattttcttggaggggagtttgggagagatgtggtggtaggcggcgggttttccggtcatggttttaagatggcgccggcggtggggaggatactggcggatatggcgatggaggtggaggccggaggtggaggagttgagatgaaacagtttagtctccgacggtttgaagataatcctaaaggaaatgcaaaggagtatcctgaccaagtgatacttgatgtcccattgaaacattaa

SEQ ID NO: 1693 - DNA, 576 bp, Arabidopsis thaliana
atgccttcggagttaacaccagaagaacgatcggaactaaaaaactcaatcgccgagttccacacataccaactcgatccaggaagctgttcatcactccacgcgcaacgaatccacgcgcctccggaactcgtctggtcaatcgtacgacgattcgacaaaccacaaacatacaaacacttcatcaaatcctgctccgtcgaacaaaacttcgagatgcgcgtcggatgcacgcgcgacgtgatcgtcatcagtggattaccggcgaacacatcaacggaaagactcgatatactcgacgacgaacggagagttaccggattcagtatcatcggaggcgaacataggctgacgaattacaaatccgttacgacggtgcatcggttcgagaaagagaatcggatctggacggtggttttggaatcttacgtcgttgatatgccggaaggtaactcggaggatgatactcgtatgtttgctgatacggttgtgaagcttaatttgcagaaactcgcgacggttgctgaagctatggctcgtaactccggtgacggaagtggttctcaggtgacgtga

SEQ ID NO: 1694 - DNA, 2544 bp, Arabidopsis thaliana
atggcggagaagtcgagcttcttcgttcatttcagctgtcttctgcttcttctaactatcataataacatgtggagagggagtgaggaatccggtgaggccaagatcatcggagagaagagcattgatggacggccaagatctctcgaggccattgaagctgacatttggtgggccttctcgtaattggactgacgctattcccatcggtaatggccgtctcggagccacgatctggggcggcgtctcctctgagattctcaacatcaatgaggacacaatttggactggagtaccagcagactacacgaaccagaaggcccctgaagcattagcagaagtgaggaggcttgttgatgaaagaaactatgctgaagctacttcagaagctgtcaaattatcaggccagccttctgatgtttaccagattgtgggagatttgaatttagagtttgacagttcgcatcggaagtacactcaagcctcttatcgccgtgaactcgacttggaaactgctgtagctaaagtaagttactcggttggggctgtggacttctcaagggagtttttcgcttctaatccggatcaagtaataatagccaagatctatgcaagcaaaccgggatcattgtcttttaaggtgtcttttgacagcgagttgcaccatcattcagagacaaatcccaaggctaatcagattttgatgcggggaagttgtcgccccaagcgacttcctgtgaacttgaagaaaagtatcaacgcgacaaatataccgtatgatgatcacaaaggattgcagtttgcttcgattcttgaagtgagagtcagcaacggtggctctgtgtcttccttaggtggcaagaaactaagtgttgaaaaggcagactgggcggttctgcttctggcggcttcatctaactttgatgggccatttactatgcctgttgattctaagatagaccctgcaaaggaatgcgttaacagaatcagctcagtccagaaatactcgtactctgatctttatgctcgtcatttgggtgactatcagaaacttttcaaccgggtctctttacacctttctggaagctcaacaaatgaaactgtgcaacaggcaacttcaactgctgaaagggtgcgatcatttaaaaccgatcaagacccttcattggtggaacttctattccaatatggtcgatacctgcttatatcttcttcaagacccgggactcaggtggctaacttgcaggcttttgttgtatcactaactccacttcttcttctgcggtattgcagtggtgctcctcacctgaacattaatctgcagatgaactattggcattctcttcctggtaatatccgggaatgtcaggaaccattgtttgattatatgtctgctttagcaattaatggccgcaagacagcacaagtgaactacggagcaagtggttgggtggcacatcaagtatcagacatatgggcaaaaacttcaccagatagaggtgaggcagtgtgggcactctggcccatgggtggagcttggctctgcactcatgcatgggagcattatacatacacaatggacaaggaatttcttaaaaagaaaggatatccattgttggaaggatgtacgtcgtttcttttggactggctgatcaaaggtaaagatggatttctccagaccaatccatcgacttcccctgagcatatgtttactgctcccattggcaaacctgctagtgttagctactcatcaaccatggacattgccattataaaggaagtcttcgctgatatcgtttcagcttcagagattttgggaaaaacaaatgatactcttattggaaaagtcattgctgctcaagcaaaacttccacccactagaatatcaaaggacggttccattagggaatgggcagaagactttgaggacccagaggtacatcatagacatgtttcacatctctttggcctcttcccgggtcacacaatcactgttgagaagtctccagaacttgctaaagctgtggaagcaactcttaaaaaaagaggagaggaaggaccaggatggtcaaccacctggaaagccgccttgtgggcaaggcttcacaatagcgagcacgcatatcggatggttacacatatttttgatcttgtggatccgttgaacgaacgtaactatgaaggaggactgtatagtaacatgttcactgcacacccgccattccagatcgatgctaattttggattcgcagcagcggtagcagaaatgttagtgcagagcactacgaaggatctatatttgctcccggcacttccagcagataaatggcctaacggcattgtgaatgggctaagggcaaggggcggtgtgacggttagtataaagtggatggaagggaaccttgtggagtttggtctttggtcggaacagattgtttccaccagaatagtgtacagaggaatctctgcggctgccgaattgttgccagggaaagtctttacttttgacaaggatttgagatgcattcggaccgacaagttatag

SEQ ID NO: 1695 - DNA, 510 bp, Arabidopsis thaliana
atggcgtctcatcaagaacagagttacaaagctggtgaaaccagaggcaaggctcaggagaaaactggggaagctatgggaacgatgggggacaaaacacaagcagctaaggacaaaactcaagagacagcccagtcagcccaacaaaaggctcatgaaacagctcagtcagctaaagacaagacgtctcaagctgcacaaacgactcaagagagagctcaagagtccaaagacaagacaggaagctacatgtcggaaactggagaagcaatcaagaacaaggcacacgatgcagctgaatataccaaagagactgcagaagcaggtaaggagaagaccagtgggatcttgggccagaccggtgagcaggtgaaacagatggctatgggagctactgatgcggtgaagcacactttagggcttcgcactgatgaaggaaacaaagaacatgtttcttcagctccaagtactactactacgaccactactcgtgagacacagaggaagtga

SEQ ID NO: 1696 - DNA, 933 bp, Arabidopsis thaliana
atggcggcaggactctcaaccgccgttacattcaaaccactccaccgctctttctcctcctcctctaccgatttccgactccgcctcccgaaatccttatccggattctctccgtctcttcgatttaaacgcttttctgtctgttacgtcgtcgaagaacggagacagaattctccgattgagaacgatgagagaccggagagcacgagctccacaaacgctatagacgctgagtatctggcgttgcgtttggcggagaaattggagaggaagaaatcggagaggtccacttatctaatcgctgctatgttgtcgagctttggtatcacttctatggctgttatggctgtttactacagattctcttggcaaatggagggaggtgagatctcaatgttggaaatgtttggtacatttgctctctctgttggtgctgctgttggtatggaattctgggcaagatgggctcatagagctctgtggcacgcttctctatggaatatgcatgagtcacatcacaaaccaagagaaggaccgtttgagctaaacgatgtttttgctatagtgaacgctggtccagcgattggtctcctctcttatggattcttcaataaaggactcgttcctggtctctgctttggcgccgggttaggcataacggtgtttggaatcgcctacatgtttgtccacgatggtctcgtgcacaagcgtttccctgtaggtcccatcgccgacgtcccttacctccgaaaggtcgccgccgctcaccagctacatcacacagacaagttcaatggtgtaccatatggactgtttcttggacccaaggaattggaagaagttggaggaaatgaagagttagataaggagattagtcggagaatcaaatcatacaaaaaggcctcgggctccgggtcgagttcgagttcttga

SEQ ID NO: 1697 - DNA, 510 bp, Arabidopsis thaliana
atgttaccttctccatcatcttcttcagcgccgacgaaaagaatagatccgtccgagctcaaacgcgttttccagatgttcgacaagaacggtgacggtcgaatcacaaaggaagagctcaacgactcgcttgagaatcttggaatctacataccagacaaagatctgactcaaatgatccacaagatcgatgctaacggtgatggatgcgtcgacatagacgagtttgagtcgctgtacagctcgattgtggatgagcatcacaacgatggcgaaacagaggaagaggatatgaaagatgcgtttaacgtgtttgaccaagacggagatgggtttatcactgtggaggagttgaaatctgtgatggcttccttgggactcaagcaagggaagaccctagatggttgtaagaagatgattatgcaagttgatgcagatggtgatggtagagtcaattacaaagagtttcttcagatgatgaaaggtggtggctttagcagcagtaattga

SEQ ID NO: 1698 - DNA, 528 bp, Arabidopsis thaliana
atggctgatgtgccggagcacgtggagctttcccacacgcacgtggttggtccttctcagtgcttctccgtcgtggtacaagacgtggaggctccggtttccacagtctggtcgatcctaagccgcttcgaacaccctcaagcgtacaaacacttcgtgaaaagctgccacgtggttatcggagacggtcgagaggttgggtcggtgagagaggtcagagtcgtctctggtctccccgcggcgtttagcttagagcggcttgagatcatggacgatgatcgccacgtcatcagtttcagcgtcgttggtggggaccacagactcatgaactacaagtcggtgacgacggtgcatgagtcggaggaggactccgacggcaagaagaggacacgtgtcgttgagtcatacgtcgttgacgtaccggcgggtaacgataaggaagagacttgtagctttgctgatactatagtacggtgcaacttgcaatcgctggctaaactcgccgagaacacttctaaattctcgtaa

SEQ ID NO: 1699 - DNA, 1227 bp, Arabidopsis thaliana
atggcgttactctctcgaatccgttcatcaacatctctcttccgtcacctcaacgcatcaccacaaatccgatcactctcctcggcttcaacaatcctctcaccagattcaaaaactcctctcacaagcaaagaaaaaagcaaagcagctctctctcttctcaaatccgagaaagatccagatcgtatcctcgaaatctgccgtgcagcttctcttactccagattgccgcatagatcgaatcgctttctccgccgccgtcgagaatctcgccgagaagaaacatttctccgctgtatcgaatctcctcgacggattcatcgaaaacagaccagatctcaaatcggaacgttttgctgctcacgccattgttttgtatgctcaagctaatatgcttgatcactctttaagagtttttcgtgatctcgagaaattcgaaatctctcgtacggtgaagtctttaaacgcgcttctctttgcttgtttagtagctaaggattacaaagaagctaaaagagtttacattgagatgcctaagatgtatggaattgaacctgatctcgagacttataatcgtatgatcaaagtgttttgtgaatccggttcagcgagttcgtcgtactccattgttgcggagatggagaggaaagggataaagccgaatagttcaagctttggtttgatgatttctgggttttatgcagaggataagagtgatgaagtagggaaagtgttggcgatgatgaaagatcgtggtgttaatatcggtgtttcgacttataacattaggattcagagtttgtgtaagaggaagaaatctaaggaagcgaaggctttgcttgatgggatgttatctgcagggatgaaaccgaatacggtaacgtatagccatttgattcacgggttttgtaatgaagatgatttcgaggaagcgaagaagttgtttaagattatggtgaacagaggatgtaagcctgatagtgagtgttacttcactcttatatattacttatgcaaaggaggagactttgagacggctttgagtctttgtaaagagagtatggagaagaattgggttccgagttttagtatcatgaagtcgcttgttaacggactagctaaggattcgaaagtcgaagaagcaaaggagcttattgggcaagtgaaagagaagttcactagaaacgttgagttgtggaacgaagtcgaagccgcattaccgcaatga

SEQ ID NO: 1700 - DNA, 1041 bp, Arabidopsis thaliana
atgctttggataacgagatttgctggattattctccgccgcgatggcagtgatcgtgttatctccgtcgcttcagtcatttcctccggcggcggcaatccgttcttctccatcaccgatcttcagaaaagctccagcggtgttcaacaacggcgacgaatgtctctcctccggcggcgtctgcaatccgtcgttggtccacgtggcgatcacgttagacgtagagtacctgcgtggctcaatcgcagccgttaactcgatccttcagcactcggtgtgtccagagagcgtcttcttccacttcatcgccgtctccgaggaaacaaacctgttggagtcgctggtgagatcggttttcccgagactgaaattcaatatttacgattttgcccctgagacagttcgtggtttgatttcttcttccgtgagacaagctctcgagcagcctctgaactacgctagaagctacttagcggatctgctggagccttgtgttaaccgtgtcatatacttggattcggatcttgtcgtcgtcgatgacatcgctaagctttggaaaactagcctaggctcgaggataatcggagctccggagtattgtcacgcgaatttcacgaaatacttcaccggaggattctggtcggaggagagattctccggtacctttagagggaggaagccatgttacttcaacacaggtgtgatggtgatagatcttaagaaatggagaagaggtggttacacgaaacgtatcgagaaatggatggagattcagagaagagagaggatttacgaactaggctcgcttccaccgtttcttctagttttctccggtcacgtggctcccatctctcaccggtggaaccagcatggacttggtggtgacaatgttagaggtagctgtcgtgatttgcatcctggtcctgtgagtttgctgcattggtctggtagtggcaagccctggataagactcgattccaaacggccttgtcccttagacgcattatggacgccttacgacttgtatcgacattcgcattga

SEQ ID NO: 1701 - DNA, 810 bp, Arabidopsis thaliana
atggcgacgaaaccgacgtttcagctgttttcttcttctcaaggttctggtctaggtttagggttccttgattcatcagagccagctcttcctccacctcctcctcctgttgaagtattatccttcgaggtgtcttcctccactgatttcgaagtggataaattgactatcggcgagatcactcttttgaagggtcgtgtgagcactaaagaggtttttggattgcctaattcagatttggttcctggagtctatgaaggcgggcttaagctttgggaaggatcgattgatcttgttaaagctcttgagaaagaatcacaaaccggaaacttatcattttccggaaagcgggttctcgagcttggatgtggtcatgcacttccaggaatctatgcgtgtctcaagggttcagatgctgttcatttccaggacttcaatgctgagtcttcctctgtctcagtaagtgaaacagaagtacgcttctttgctggtgagtggagtgaagttcatcaggttcttccactagttaatagtgatggtgagactaataagaagggtggttatgacatcattctaatggctgagacgatatattccatctccgctcagaaaagtcaatatgaattgattaaaaggtgtctggcgtatcctgatggagcagtgtatatggctgcaaagaagtactatttcggggtcggtggagggacaaggcaattcttgtctatgatagagaaagacggtaagatggtctattcgatgatgtatataaagcaacagttgcattgttcattctctacaatgataatataa

SEQ ID NO: 1702 - DNA, 1398 bp, Arabidopsis thaliana
atgagttacggatgggcgatatacgaaggcacggtggtgatagcttcactaagtctcttaggatgggcaggtttatggtttcttaatcggagattatacaaagagtatgaagagaaacgagctttggttcaaatcattttcagtgtcgtcttcgctttctcttgtaatctattgcagctcgttttgttcgagatcatacctgttctctctagagaggcaaggatgataaactggaaggtggatcttttttgtttgatacttcttctggttttcatgttgccgtattaccattgctatttgatgcttcgtaatagtggtgtaagaagggagcgtgcctctgttggggctttcttattcttgtcagcattcctttacgcattctggcgtatgggagttcatttccctatgccttcagcagataaagggttttttaccatgcctcagctggtcagtagaattggggtcattggtgtgaccttaatggctgtcttatcaggatttggagctgtaaatttaccctacagctatatatccctcttcattagggagattgaagaagcagatataatatctttggaaaggcaactgattcagtcaactgagacgtgcatagcaaagaagaagaaaattattttgtctaataatctgatgctttttttctcccagaatcagaaacgtagctctttcttcagaagaattgttgggactgttgtgcggtcggttcaagatgaccaaaaggaacaagacataaaaatattggaagcggaggtggaagccttagaggagctgtcaaaacagttatttttggaagtatatgagctgcgtcaagcaaaggatgctgctgcttattctagaacttggaagggtcatgtgcagaacttacttggttatgcatgttccatttattgtgtgtataaaatgttgaagtctcttcaaagtgttgtcttcaaagaggccggtacaaaagatcctgtcacgacgatgatcagcatattcttgcggttgtttgatataggagtagatgctgcactcctctcacagtatatatccctgctgttcattgggatgttgattgtgatttctgtgaggggattcctgacgaacctgatgaagtttttctttgctgtctcaagagtgggaagtgggtcttcaagcaatgttgtacttttcctatctgaaatcatgggaatgtactttttgtcttcaattcttcttatcagaaaaagcttgagaaatgagtacaggggaatcataacagatgtgttgggtggagatattcagtttgatttctatcatcgatggtttgatgcaatttttgtggcgagtgcttttctttctctcgttttgctttctgcacattacacgtctcgtcaatctgataagcacgccatcgagtaa

SEQ ID NO: 1703 - DNA, 378 bp, Arabidopsis thaliana
atggaagagaagaagacagaatccgcgactaagaacgttaaaaaggttaacttgttagaccacatcgcaatcaaacacctccttgatgaatccgtctccgatatcgttacgagcagagggtacaaggaggatggatcattcaccagcactggtttggtggtatcttccaagttacctagattctctgatcagtacactctaaccatcgacagtgctgatccgcaatcaatctcagctgggaagtcggttcagttcaccaaaagtgtcactcaatggctcacaaaagatggagttcttgtcgagggtttattctggaaagatgttgaagccctagtcaaagagtacacagaagcaggagaaccaaagaagaagagatga

SEQ ID NO: 1704 - DNA, 837 bp, Arabidopsis thaliana
atggaagacggtgagcttgatttctccaatcaggaagtgttttcgagttcggagatgggtgaattaccacctagcaattgttcgatggatagtttctttgatgggcttttaatggatactaatgctgcttgtacccacactcacacctgtaaccccactggaccagagaacactcatactcacacgtgcttccatgtccacaccaagattctcccggatgagagcgatgaaaaagtttctactgatgatacagctgagtcttgtgggaagaagggtgaaaagagacctttgggaaaccgggaagcggttagaaagtatagagagaagaagaaggctaaagctgcttctttggaggatgaggttgcaaggcttagggcggtgaatcagcagctggtgaagaggttgcaaaatcaggctaccttggaagctgaggtttcgaggcttaagtgtttgcttgtggatttgagaggaagaatagatggagagattggatcttttccttatcagaaacctatggctgcaaatattccttctttctcgcacatgatgaatccttgtaatgtacaatgtgatgatgaagtttattgccctcagaatgtgtttggagtgaatagccaagaaggtgcctcgatcaatgaccaagggttaagtggttgtgattttgatcagctacaatgcatggctaatcagaacttaaatggaaatggaaacggatcattcagcaacgtcaatacatctgtctcgaataagagaaaaggtgacacttttattctgtaccttagagttttctctgtaaatcgttctggtttagaaccggaggttgtttactcactctga

SEQ ID NO: 1705 - DNA, 843 bp, Arabidopsis thaliana
atggatccaatatcagcggttagcgaagagctggctgagatcgaaggacaaatcaatgacatcttccgtgctttatcaaatggattccagaagctggagaagatcaaagatgctaataggcagagtaggcagctggaagaactcactgacaaaatgcgtgactgtaagagccttattaaagatttcgatagggaaatcaaaagcttggaaagcggtaatgatgccagcactaaccggatgttgaacgatagacgacaatctatggttaaggaactcaactcatatgttgctcttaagaagaaatactcatcaaacctagcaagcaataacaagcgagtagatcttttcgatggacctggagaagaacacatggaagaaaatgtcttattagcttcaaacatgtccaatcaagagttaatggataaaggaaactcaatgatggatgacacagatcaagctattgagagagggaaaaagattgtacaagaaactataaatgtgggaacagatacttcagcagctctcaaggctcagaccgagcaaatgagtagagttgtcaatgagctcgattctattcatttctcactcaagaaagcctccaagctggtcaaggaaattggtaggcagctccttcttgtccctttcacttactctctgtccttcttttatcaggttgccactgacaaatgtattatggcatttcttttccttatcgtcattggtgtcatagcaatcatcatcgtcaagattgtgaacccaaacaacaaagacattcgcgacataccgggtgtgggcctagctccaccagccatgaacagacgtctgctctggaaccattactga

SEQ ID NO: 1706 - DNA, 1410 bp, Arabidopsis thaliana
atggcttcttctatcttcttcttcttccttatcttcctctccgtcgtctccgccgtcaaactacctctctctcccttctcccactccgaccaatcaccaaaagacccttacctctctctccgtcgtctcgctgaatcctcaatcgctagagctcataaactcaaacacggcacctcaataaaacccgacgaagatgctctctcctccaccaccaccgcatccgccaccgtcgtgaaatctcctctctctgctaaaagctacggcggatactcagtctctctcagcttcggcacaccgtcgcaaacaatcccattcgttttcgataccggaagcagtctcgtttggctaccttgtacctcaagatatctctgctccggttgcgatttctccggtttggatccgactctaatccctagatttatccccaagaactcttcctcttcgaagattatcgggtgtcagagtccaaaatgtcagtttctatacggacccaatgttcaatgcagaggatgtgacccgaatacccgaaactgcaccgtcggttgtccaccgtacattcttcaatacggattaggatcaacggctggggttttaataaccgaaaagcttgatttcccggatctaaccgtacccgatttcgtagtcggatgttcaattatctccacccgacaacccgctggtatcgctgggtttgggcgaggacccgtatcgcttccttcacaaatgaatctcaagagattctctcactgtttggtttctcgtcggtttgacgataccaacgtaaccaccgatcttgatttagataccggatcgggtcataattccgggtctaaaactccgggtctcacatacacgccgtttcggaaaaatcccaatgtctccaacaaagcttttctcgagtattattacctcaatctccggcgaatctacgtcggaagaaagcacgtgaagattccgtataagtatctcgcgccgggaactaacggagacggaggatccattgttgattccggatctacattcactttcatggagcgacccgttttcgagctcgttgctgaagaattcgcttcacagatgtcgaactacactcgtgagaaagacttggagaaggaaacaggacttggaccgtgttttaatatctccgggaagggagatgtgacggtgccggagctgatttttgagtttaaaggtggagcgaagttggaattgccgttatccaattacttcacgttcgttgggaatactgataccgtttgtcttacggtggtttcggataaaaccgttaatccctccggcgggactggaccggcgataattctggggagtttccagcaacagaactatttagttgaatacgatttggagaatgacaggtttgggttcgcgaagaagaagtgtagcccgtga

SEQ ID NO: 1707 - DNA, 345 bp, Arabidopsis thaliana
atggcggctctctccaccaccttctactaccacccactctgcactaaccaccgtacaaagagacaagcctcaagcagacacggagttagatctatgagagtgatgtcttgtcggaagcagaaattaccagaagagaatgaaggagtgatccagagaacattgagaaggatgatttcagaggctgggaagattgggaagaatctgaagccagagaagaagaaaggagacgtcaaggacctgatgcttatgagtctctcttttgctgtttatgtttatatctctcaactattggtttgtgcttacttctcctggcaacatctcagcttccccaaatcttcatggtag

SEQ ID NO: 1708 - DNA, 1713 bp, Arabidopsis thaliana
atgaagcagaggatttcagcacaaacatgcacgacggacaaggggactttcagacccaacggtacttacgacgtaaatcgccgtctcatcctctcttctcttccttcaaatgtcacggaccaagacggcttatactacaacggttccataggacaacaaccgaaccgtgtctacgcaatagggatgtgcatcccaggatcaacttcagaagactgttctgattgtatcaagaaagagtctgaattttttttaaagaattgtcctaaccaaacagaggcgtattcatggccaggatctgctgatctgaacccgcgaaattggctcaccaacactggagacctagactcaaatctaacagagtttacgaaaatatgggaaggattaatgggtcgtatgatttctgcagcttccacagcaaaaagcacaccttcttcaagtgataaccattactcagctgattcagcagtcttgacacctctcctgaatatatatgcattgatgcaatgcacgccggatctttcctccggtgattgtgaaaactgtctgcgacaaagcgcaattgactatcagtcgtgctgtagccagaagcgaggaggtgttgttatgcggccaagctgctttttgcggtgggatttgtatacatattctaacgcttttgataatcttacggtggcttctcctcctccagaacctcctgtgactgtgccacaacctgcaggtgatcaggacaacccgaccaacaatgatagcaaaggaatctcagctggagttgttgtggcgatcaccgttcccactgttattgccatcttgatactgctggttttaggatttgttcttttccggagaagaaaatcctaccaaagaactaagactgaatgttacatgtatactcccgtagccaagacgggaaacacgaaactaatacacccattctttgcagctgaaagtgatatttcaactacagattcattggtatacgattttaagacaattgaagccgcaactaacaagttttcaacaagtaataagcttggtgaaggtggattcggtgcggtttacaagggtaagctttctaacggaactgatgtagctgtgaagcgactgtcgaaaaagtcaggacaaggcacaagggagttcaggaacgaggctgttcttgtgacaaaacttcaacataggaatctggttagacttcttggattctgtttggaaagagaggaacagattctgatctatgaatttgtccacaacaaaagccttgactactttcttttcgacccggaaaagcaaagtcagctagactggacccggcgatacaagatcattggaggaattgctcgagggattctatatcttcatcaagattcacggctcaaaatcatacatcgtgacctcaaagccagcaacattctcttagatgcagacatgaacccaaaaattgcagattttggattggcaactatttttggagtggagcaaactcaaggaaacacgaacagaattgctggaacctacgcttacatgtctcccgagtatgcgatgcatggtcaatactccatgaaatctgacatttatagctttggagtcttagttcttgagattataagcggcaagaaaaacagcggcgtctaccagatggatgaaactagtactgcaggaaacttggtcacttatgtgagcataaagtcctcaactttcaacaatttaacattttaa

SEQ ID NO: 1709 - DNA, 1785 bp, Arabidopsis thaliana
atgagtgactcggtgtcgatctcggttccgtataggaatttgaggaaggaaattgaacttgagacggtcaccaagcatcgtcaaaacgaatctggttcttcgtcgttctctgaatctgcttctccttcgaatcattctgattcggctgatggtgaatctgtgtcgaagaattgtagtttagtgacgttggttcttagttgtacagttgccgctggagttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcgggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagcgggtccatgggatcaattgtttggaggaggaaacttaccggcgtttgttttggcgtctgttgctgctttcgctgctggagttattgcattgcaaaggcttcccacgctatcgagttctttcaagtccaccggtttccacatcggctaa

SEQ ID NO: 1710 - DNA, 1647 bp, Arabidopsis thaliana
atgtgctggtggctaaatggggccgtttggacgatgatgatgatgacgatatccatcatttcttttgttcaagctgatgatccctaccgttttttcgactggagagtcacttacggcaacatttctccacttggcattcctcaaaggggaatcctgataaacggacaatatccaggacccgatatttactcagtcaccaatgacaatttgatcatcaatgttcacaacgatctcgacgagccctttctcttatcttggaacggagtgcaactgaggaagaattcttaccaagatggagtgtatgggacgacttgtccaatcccaccgggtaaaaactacacttatgccatccaagtcaaagaccagatcggtagtttcttctatttcccttccctcgccgttcacaaagctgccggtggttttggcggtttccgtatcctcagccgccctcgcatccccgtccctttccctgaacccgctggagatttcaccttcctcattggtgattggtttaagcatgaccacaaggttttgaaggcaattttggatagaggacacaagctacctttgcctcaagggaaaagcattatattatctcatcatttattttttgttgtggaacaattatcaggtaaaacatacagatttaggatatcgaatgtagggcttcaacacactctgaatttcagaatccaaggtcatcagatgaagctcgttgaggtagagggaacacacacagtccagtccatgtatacctctctcgacattcacgttggacagtcttactcggtcttggtcaccatggaccagcctgaccaagactatgacattgtcgtctccacaaaatttgtcgccaaaaaactcttggtctcatctactatccactactccaactcaagacatagccactcatcttctgctaattcagtccatgttcaacaacctgccgatgaactagattggtctatcaaacaagcccggtccattaggaccaatctaaccgcgtctgggccaaggcctaaccctcagggttcgtaccactatggtcgaatcaagatttctaggactttgatattggaaagctcagcggcactagtgaagaggaagcaacgctacgccataaacggagtgtcgtttgtacctggagatactccgctaaagcttgcggattacttcaagatcaaaggcgttttcaaaatgggaagcatacctgacaagccgagaagaggaagagggatgagaatggagacgtcagtgatgggagcacaccatagagacttccttgaaatcatatttcaaaaccgcgagaagatcgtccaaagctaccacctcgatggatatagtttttgggttgttgggacggatagaggaacatggtcaaaagcaagcagacgagagtataatcttagggatgctatttctcgctccaccactcaggtatatccagaatcttggacagccgtatatgtggcactggacaatgtggggatgtggaatctaaggagtgaatattgggcgaggcaatacttgggtcaacaattctaccttcgagtttattctccaacacactctcttagagatgaatatcttttgcctaagaatgctttgttgtgtggccgagcctccaataaacacaccactccttaa

SEQ ID NO: 1711 - DNA, 996 bp, Arabidopsis thaliana
atggcaagactcacgagctttctccttcttctttctctcatctgctttgtccctctctgtctctgcgacaagagctatggaggcaaacttttcccgggttattacgcccattcatgcccacaagtcaatgagatcgtgagatcagttgtagctaaagctgttgctagagagacacgtatggctgcttccttgttgagacttcatttccacgactgtttcgttcagggttgtgatggctctttgcttctagacagcagtggaagggtagcgactgagaaaaactcaaaccctaacagcaaatcagctcgtgggtttgacgtagttgaccaaatcaaagctgaactggagaaacaatgccctggaactgtttcttgcgctgatgttcttaccctagccgctagagactcctctgttcttaccggtggaccaagttgggttgttccattgggaagaagagattcaagaagtgcaagcttgagtcaatcgaacaacaacatccctgcaccaaacaacactttccagaccattctatctaagtttaaccgtcaaggacttgatatcactgaccttgtcgctctctccggtagtcacacaatcggattctcgagatgcacgagtttcagacagaggttgtacaaccagtccggaaacggcagtccagacatgacattggaacaatccttcgctgctaacttgcgccaacggtgtccaaaatccggtggggaccagattctctcggtgctagacatcatcagcgccgcgagcttcgacaacagctacttcaagaacttgatagagaacaaggggttgttgaactcggaccaagttctgttcagcagtaacgagaaatcgagagagcttgtgaagaagtatgcagaagatcaaggagagttttttgagcaatttgcggaatcgatgatcaagatgggaaatatctctcccttgacaggttctagtggcgaaatcaggaagaattgcaggaagattaactcttga

SEQ ID NO: 1712 - DNA, 976 bp, Arabidopsis thaliana
tttcgaggaatgggctaaacccggtcatttctcaagaacaatagctaagggacctgatactaccacttggatctggaacctacatgctgatgctcacgattttgatagtcataccagtgatttggaggaaatctctcgaaaagtatttagtggccatttcggccaactctctatcatctttctttggctgagtggcatgtatttccatggtgctcgtttttccaattatgaagcatggctgagtgatcctactcacattggacctagtgctcaggtggtttggccaatagtgggccaagaaatcctgaatggagtagtgggcggaggcttccgaggaatacaaataacctcaggcttttttcagatttggcgagcatccggaataactagtgaattacaactttattgtaccgcaattggcgcattggtcttcgcagccttaatgctttttgctggttggttccattatcacaaagcagctccaaaattggcttggttccaagatgtagaatctatgttgaatcaccatttagcagggctactaggacttgggtccctttcttgggcaggacatcaagtacatgtatcttatccgattaaccaatttctaaacgctggagtagatcctaaagaaataccgcttcctcatgaatttatcttgaatcgggatcttttggctcaactttatccaagttttgctgaaggagcaactcccttttttaccttaaattggtcaaaatactcggaatttcttacttttcgtggcggattagatccagtgactgggggtctatggttaaccgatatagcacatcatcatttacgtatcgcaattctttttctaatcgcgggtcatatgtataggaccaactggggtattggtcatggtataaaagatattttagaggctcataaaggtccatttacaggccaaggccataaaggcctatatgaaattctaacaacatcattgccc

SEQ ID NO: 1713 - DNA, 2178 bp, Arabidopsis thaliana
atggagattaacggggcacacaagagcaacggaggaggagtggacgctatgttatgcggcggagacatcaagacaaagaacatggtgatcaacgcggaggatcctctcaactggggagctgcagcggagcaaatgaaaggtagccatttggatgaagtgaagagaatggttgctgagtttaggaagccagttgtgaatcttggtggtgagactctgaccattggacaagtggctgcgatctcaactattggtaacagtgtgaaggtggagctatcggagacagctagagccggtgtgaatgctagtagtgattgggttatggagagtatgaacaaaggcactgatagttatggtgttactactggttttggtgctacttctcatcggagaaccaaaaacggtgtcgcacttcagaaggaacttattagattccttaacgccggaatattcggaagcacgaaagaaacaagccacacattgccacactccgccacaagagccgccatgcttgtacgaatcaacactctcctccaaggattttccggtatccgatttgagattctcgaagcaattaccagtttcctcaacaacaacatcactccatctctccccctccgtggtacaatcaccgcctccggagatctcgttcctctctcctacatcgccggacttctcaccggtcgtcccaattccaaagctactggtcccaacggtgaagctttaacagcagaggaagctttcaaattagcaggaatcagctccggattctttgatctccagcctaaggaaggtctcgcgctagtcaatggcacggcggttggatctggaatggcgtcaatggtgttattcgaaacgaatgttctctctgttttggctgagattttgtcggcggttttcgcagaggtgatgagtggtaagcctgagttcaccgatcatctcactcacagacttaaacatcatcccggtcaaatcgaagcggcggcgataatggagcatatcctcgacggaagctcgtacatgaaattagctcagaagcttcacgagatggatccgttacagaaacctaaacaagatcgttacgctcttcgtacttctcctcaatggttaggtcctcaaatcgaagtgatccgttacgcaacgaaatcgatcgagcgtgagattaactccgtcaacgataatccgttgatcgatgtttcgaggaacaaggcgattcacggtggtaacttccaaggaacaccaatcggagtttcaatggataacacgagattggcgatagcagcgattggtaaactcatgtttgctcaattctcagagcttgtgaatgatttctacaacaatggtttaccctcgaatctaaccgcttcgaggaatccaagtttggattatggattcaagggagctgagattgcaatggcttcttattgttcagagcttcaatacttagctaatcctgtgactagccatgttcaatcagcagagcaacataaccaagatgtcaactctttgggactaatctcgtctcgcaaaacttctgaagctgttgatattctcaagcttatgtcaacaacgttcctcgttgcgatttgtcaagctgtggatttgagacatttggaggagaatttgagacagactgtgaagaacactgtctctcaagtggcgaagaaagttcttactactggagtcaatggtgagcttcatccttctcgcttctgcgaaaaggatttactcaaagttgtagaccgtgaacaagtctacacatacgcggatgatccttgtagcgcaacgtacccgttgattcagaagctgagacaagttattgttgaccatgctttgatcaatggtgagagtgagaagaatgcagtgacttcaatcttccataagattggagctttcgaggaggagcttaaggcagtgctaccgaaagaagtggaagcagcaagagcagcctacgataacggaacatcggctatcccgaacaggatcaaggaatgtaggtcgtatccattgtatagattcgtgagggaagagcttggaacagagcttttgaccggagagaaagtgacgtcgcctggagaagagttcgacaaggttttcacggcgatttgtgaaggtaaaatcattgatccgatgatggaatgtctcaacgagtggaacggagctcccattccaatatgttaa

SEQ ID NO: 1714 - DNA, 1008 bp, Arabidopsis thaliana
atggctgtaacaaatcttcctacttgtgatggtttgttcattatcagtcttattgtcatcgtttcttcaatatttgggacatcatctgcgcaactaaacgcaacattttactctgggacttgtcccaacgcctctgccatcgtacgcagcactattcagcaagctcttcaatccgatacaagaatcggagccagcctcatccgccttcattttcatgactgttttgttaatggatgtgatgcatcgatcttgcttgacgacactggaagcatccagagcgagaagaacgctggtccgaatgtaaactcagctagaggattcaacgttgttgataatatcaagactgccctcgaaaacgcttgccctggtgttgtctcttgctctgacgttttagcccttgcctctgaggcttctgtgtctttggcaggagggccatcatggactgtattattaggaagaagagatagtctcacggccaacctcgccggtgcaaattcgtccattccttctcccatcgaaagcctaagcaacatcacatttaaattttcggctgtcgggcttaatacaaacgatctggtagccttatctggtgcgcatacgttcgggcgtgctcgatgtggagtattcaacaacagactatttaacttcagcgggacaggaaatcccgatccaactctaaactcaacgcttctgagcactcttcaacagctatgtcctcaaaacggtagcgcatcaacgatcaccaatcttgatttgagcacaccagatgcgttcgataacaattacttcgccaaccttcagagcaacgatggacttcttcagtcagaccaagagctgttctctaccaccggttcatccaccatcgcgattgttacttcgttcgcaagtaaccagactctgttttttcaggcctttgcacagtccatgatcaatatggggaatattagtcccttgactgggagtaatggagagattaggttagactgtaagaaggttaatggaagttga

SEQ ID NO: 1715 - DNA, 1803 bp, Arabidopsis thaliana
atgatctgtttagaggtgccaacgtccgatgaagttgaagcctataaatgtctgcaagaatgtcttgaactgcggaagaggtatgtcttccaagaaacagttgcaccatgggaaaaagaagtcatatctgatcctagtactccaaagcctaatacagagccatttgcacactatcctcagggaaaatctgatcattgttttgagatgcaagatggggttgtccacgtgtttgcaaataaagatgcaaaagaagatctcttcccggtagctgatgccacagcgtttttcactgacttgcatcacgtactcaaagtcatagctgcaggaaacatccggactttgtgccaccgtcgactagtgctcctagaacagaaatttaatctccatttgatgcttaatgcggataaagaatttcttgctcaaaaaagtgcaccacatcgtgatttttataacgttaggaaagtcgacactcatgtgcatcattcagcttgcatgaaccagaaacaccttttaaggtttattaagtcaaagctccggaaagaacccgatgaggttgtaatattccgagatggaacatatttgaccttgagagaagtttttgagagcctggatctgactggatatgacctgaacgtcgaccttttggatgttcatgcagacaaaagtacctttcatcgttttgataagttcaacctaaagtataacccttgtggtcaaagtaggcttagggagattttccttaaacaggataatctcatccaaggtcgatttcttggtgagataacaaagcaagtcttctctgaccttgaagctagtaaatatcagatggctgaatacagaatatctatatatggcagaaaaatgagcgagtgggaccaactcgctagttggattgtgaacaatgatctatacagtgagaatgttgtctggttaattcagctcccacgcttgtacaacatttacaaggacatgggtattgtgacatcgttccagaatatcctggacaatatattcattcctctgtttgaagccacggtagatcctgattcccatcctcagctccatgtttttttgaagcaggttgttggatttgatttggttgatgatgaaagcaaacctgaaagacgtcccacaaaacacatgcccactccagctcaatggactaacgcattcaatcctgcattttcgtattatgtctactattgttatgctaacctctatgtgttaaataagcttcgagagtcaaagggcatgactactatcacgctacgaccacattctggagaggctggtgacattgaccacttggctgctacgtttctaacatgccatagcatcgcacatggaatcaatctgcgaaagtctcctgtgcttcagtatctgtactacctcgcccagattggtctggccatgtcaccactgagcaacaactctttgtttctagattaccaccggaacccgtttcctgtgtttttcttaagaggtctcaatgtttctctgtctactgatgacccccttcagattcacttaactaaagaacctctcgtggaagagtatagcatagctgcatcagtttggaagctgagtgcgtgtgacctgtgcgagatagctcgtaactcagtgtaccagtcaggtttctcacacgccctgaagtcgcactggattggaaaagattactacaaaagaggacctgatggaaacgacattcacaaaacaaacgtgccacacataagggtggagttccgtgacacggtatggaatgaaatatatttattcttcacacaagttaatttctctttgtag

SEQ ID NO: 1716 - DNA, 930 bp, Arabidopsis thaliana
atgtctggttcgacccggaaagaaatggatcggatcaaaggaccatggagtcctgaagaagacgatctgttacaatcgttggttcagaagcacggaccaaggaactggtctctgataagcaaatcaatccctggacgttccggtaaatcttgccgtctccgttggtgtaatcagctttctccggaggtagagcaccgtggattcacggcggaggaagatgatacgattatactagcgcacgctcggtttggtaacaagtgggcgacgattgcacggcttctcaatggtcgcactgataacgcgattaagaatcactggaactcaacgctgaagcggaaatgtagcggcggaggcggcggaggagaggaagggcagagttgtgatttcggtggtaatggagggtatgatggtaatttaactgatgaaaaaccgttaaaacggagggcgagtggtggaggaggagttgttgtggtgacggcgttaagtccaacgggatctgacgtcagcgagcaatcgcaatctagtggatctgttttaccggtttcttcttcttgtcatgtttttaaaccgacggcgagagctggtggagtggtgattgagtcatcatcgccggaggaggaggagaaagatccgatgacttgtttgaggttgtctttgccttgggtcaatgagtcaacaactccaccggagttgtttccggtgaagagagaagaagaagaagagaaggaaagagagatttctggacttggtggagattttatgacggtggtgcaggagatgattaagacggaggttaggagttacatggcggatttacagctaggaaacggcggaggagctggaggaggagcaagttcgtgtatggtgcaaggaactaatggtcgtaatgtagggtttagagagtttattggattaggtaggatcgagtag

SEQ ID NO: 1717 - DNA, 960 bp, Arabidopsis thaliana
atggacggtgtcacctaccaaagattcccaacggtgaagatccgtgagcttaaagatgactacgccaagttcgagcttcgtgaaaccgacgtttcaatggccaacgctctccgtcgcgtaatgatctccgaagtccccaccatggcaatccatctcgtcaaaatcgaggttaattcctctgttctcaacgacgagttcattgctcaacgacttagtctcatccctctcactagcgagcgtgctatgagcatgcggttctgtcaagattgtgaagattgtaatggagatgaacattgcgagttctgctctgttgagtttccccttagtgctaagtgtgttactgaccaaaccctagatgttactagtagggatctctacagtgctgatcctactgttactcctgttgatttcactagtaactcatctacttctgattcaagcgagcacaagggaattatcattgcgaaactacgcaggggacaagagttgaagcttaaagcattagctaggaaaggaattgggaaagatcatgcgaaatggtctcctgcagctactgttacgtatatgtatgagcctgacattattatcaatgaagagatgatgaacactttgacagatgaggaaaaaattgacttgattgagagcagtcctaccaaagtgtttggcattgacccagtcaccggacaggttgtggtggttgatcctgaagcatacacttacgatgaagaagtgatcaagaaagctgaagcaatggggaaaccgggactcattgagatccatccgaaacatgatagttttgtattcactgttgagtccacaggtgcattgaaggcttctcagctggtactaaatgccattgatatcctgaagcagaagcttgatgcaatccgtctctcagataacactgtagaagccgatgatcagtttggtgaactcggtgcccatatgcgtgaaggatga

SEQ ID NO: 1718 - DNA, 1386 bp, Arabidopsis thaliana
atggctaaaaccaaaaatgttatttctttcaaactttctctcatcttccttcttaatattttcatcgtagccaccatcgcagccgcagcggccgttaacgccggtaccaaaggtttggattctcggccgtccaaaaccaggcgtccctggcctttcaagaagctcaacaaaccggtggttttaatgatctcttgcgacggtttccggtttggttaccaatttaaaacggacacaccaaacatcgaccttctcatatccggaggaactgaggccaaacacggtttaatcccggttttccccaccatgacattcccaaaccactactctatcgcaaccggactctacccggcttaccacggtataatcatgaacaagtttaccgatccggttacgggagaggtgttcaacaaaggcttacaaccaaaatggtggttaggtgagccgctgtgggtaaccgcagtaaaccaaggtctcaaggctgtgacctacttttggccaggctctgaagttctaaaaagttcttggacttgccctgaaggatattgtccacatttcaatctttcagttcctttagaagaaagggttgattcggtcttgagccattttgatcaccttgaggacgaagttcctgatttactgatgttgtatttcgatgagccagaccaatcgggtcataactatggtcctgatgatcctcgggttacgactgctgtttctagggttgataaaatgattggtagggtgataaaggggctgaagcagagggagatctttgatgaggttcatgtgatattgcttggtgatcacggaatggtgaccaactgtgagtgtaacgagaaagcgatttacattgatgacttagcggattggatcaagatacccgcggcttggatccaggcttacagcccagtgctagcaatcaatcctcagtgggggaaagatgtcgagaatcaaagcgaaaagaacgcggaagtcgtggcgaagatgaacgaagctttgagctcagggaaagtaaaaaacggagagtttttgaaagtttacttgaaggagaagctaccagagagactgcatttttcagagagttatcggattccaccgatcataggaattgtcggagaaggtctaatggtcagacagaacagaacaaatgctcaagtttgctatggagaccatggttatgacaacgagctcttctcgatgaggactatttttgtcggacatggttctaggtttagtagaggaaaaaaagtgccatcattcgagaatgtgcagatctataacgtcgttgcagagcttcttggactccgaccagctccgaacaatggttcttctttgttccctcggagcattctcttgccttctggagcaacaagggaagtaaaatga

SEQ ID NO: 1719 - DNA, 1011 bp, Arabidopsis thaliana
atggagatcaagcagaagaaagtatggctttctttaattgtgctttatgcaattacgacatcagttttgggggactttggagaaccattactgaagggtttctacaaagagagttgcccattggcagaggaaatcgtgaagcataacatcgaagttgctgttctcaaagatcctcgtatggcggcttctcttcttcgtcttcagttccacgattgcttcgtcttgggttgtgatgcgtctgtgctcttggacacacatggagatatgttgagtgagaaacaagcaactccaaatctgaactctttacgtggatttgaagtaatcgattacattaagtacctcctcgaagaagcttgtcctctaactgtctcatgttccgatatccttgccttggccgctcgtgactcagtcttcctgagaggtggcccatggtgggaagttttgctagggagaagagactcattaaaggcaagtttcgccggagcaaaccaattcattccagcaccaaactcctctctcgacagcctcatcatcaatttcaagcaacaagggctcaacattcaagatctcatcgctctttcgggtgctcatacaataggtaaagcgagatgcgtgagcttcaagcaacgcattgttcaaccaaacatggaacaaacgttctacgtcgatgagttcagaagacacagcacgttccgtcgagtcctagggtcacaatgcaaagattcaagccgagacaacgaactgtctccactggatattaagacaccagcttacttcgataaccattatttcatcaatctgttagaagggagagggttgttgatttcggataacgttctggtctcagaagatcatgaaggagagatctttcagaaagtttgggaatatgcagttaatcaagatcttttcttcatagattttgtggaatctatgttaaaaatgggtaatattaatgttcttacaggtattgaaggtgaaattagggagaattgtagatttgtcaatatctga

SEQ ID NO: 1720 - DNA, 669 bp, Arabidopsis thaliana
atgggctgctctgtatcgaagaagaagaagaagaatgcaatgcgaccaccgggatatgaggatcccgagcttcttgcatccgtcacgccattcacggtagaagaagtggaggctttgtatgaactgttcaagaagctaagcagctcaattatcgatgatggtcttattcataaggaagaatttcagctggctttattcagaaataggaaccggaggaatctcttcgctgatcggatatttgatgtatttgatgtgaagcgaaatggagtgatcgagtttggtgaatttgtccggtccttaggtgtcttccatccaagcgcgccggtccatgaaaaagtcaaatttgctttcaagttgtacgatttacgacaaactggattcatcgagcgagaagaattgaaagagatggtagtagcgcttcttcacgaatccgaactagttctttccgaagatatgattgaagtaatggtggataaggctttcgtgcaagcagaccgcaaaaacgacggaaaaatcgatatagatgaatggaaagactttgtatccttgaatccatcgctcatcaagaacatgactttgccatatctaaaggacataaataggacgtttccaagtttcgtttcatcttgtgaagaggaagaaatggaattgcaaaacgtatcttcctaa

SEQ ID NO: 1721 - DNA, 1050 bp, Arabidopsis thaliana
atggccgataaaatgttcaaagcattgttgtgggcttttgccacggcggttgtgatggccgaggctgttcgtggacaactagtcccttgctatttcgttttcggagactctgtcttcgacaatggtaacaacaatgagttggataccctggccaaagtcaactattcaccttacggtattgattttgctagaggtcctaccgggaggttcagcaatggtcgtaatattcccgactttatcgctgaagaattgagaattagttatgacattccaccattcaccagagcatcgacggaacaagctcacaccggaataaattacgcttctggtggtgccggacttctcgaagaaactagccaacatttaggtgaaagaatcagttttgaaaagcaaataactaatcaccggaagatgattatgacggcgggagttccaccggagaagcttaagaagtgtctatatacaattaatattggaagcaatgattatctcaacaactatttcatgccggctccctacactaccaatgaaaatttcagtttcgatgaatatgctgattttctcattcaaagttatcgctcttatttgaagtcattgtacgtcttaggagcaaggaaggtagcggtctttggggtgagtaagcttgggtgcacgccgcggatgatcgcctcccatggtggaggtaaaggctgcgctactgaagtgaacaaagctgtcgaacctttcaacaagaaacttaaagatctcatctctgaattcaacagaatcagtgttgttgatcatgctaagttcacctttgttgatcttttcagcagccaaaatcctattgagtatttcattttaggatttacggtaacagacaaaagttgttgtacggtagaatcagggcaagaactttgtgccgcaaataaaccggtttgtccgaatcgagaacggtacgtctactgggacaatgtccatagcacagaagcagctaataaggtcgttgtaaaggctgcgtttgccggactcattacgtctcctataagcattttactgcttgtactataa

SEQ ID NO: 1722 - DNA, 357 bp, Arabidopsis thaliana
atggctggagtgatgaagttggcatgcttgctcttggcctgcatgattgtggccggtccaatcacatcgaacgctgcgctaagctgtggctcagttaacagcaacttggcagcgtgcattggctacgtgctccaaggtggtgtcattcccccagcgtgttgctccggcgttaaaaacctcaacagcatagccaagacgaccccagaccgtcagcaagcttgcaattgcattcaaggtgccgctagagccttaggctctggtctcaacgctggccgtgcagctggaattcctaaggcatgtggagtcaatattccttacaaaatcagcaccagcaccaactgcaaaaccgtgaggtga

SEQ ID NO: 1723 - DNA, 411 bp, Arabidopsis thaliana
atggcttccattgctgcttctgcttctatttcccttcaagctcgtcctcgccaactggcgatcgcggctagtcaagttaaaagctttagcaatggaagaagaagcagtctttcttttaatctccgccagcttcctacccgcttgactgtttcctgcgctgcaaaacctgagacagtggacaaggtgtgtgcagttgtcagaaagcaactctcacttaaagaggctgacgaaattactgctgccaccaaatttgctgcacttggtgctgattcccttgatacggtggagattgtgatgggactagaggaagagttcgggattgaaatggcggaggagaaagcacagtcaatcgccacagttgagcaagcagctgcgctcattgaggagctcttgtttgaaaaggccaagtag

SEQ ID NO: 1724 - DNA, 3135 bp, Arabidopsis thaliana
atggagcgtgcaaggagacttgcttacagagggatcgtgaaacgtctcgtcaacgagacaaaacgccaccgtaacggcgaatcctctcttcttccgacgacgactgttactccctcaaggtatgtctcctccgtctcctcctttctccatcgccgtcgtgatgtctctggatcggcttttaccacctccggtagaaatcaacaccagacacgatcgatctccgtcgatgcgttgaagccaagcgacactttcccgcgccggcacaactcagcaacaccggatgaacaagctcagatggcgaattactgcggattcgataatctcaacacgttgattgattcgactgttccgaaatcgattcggttagattcgatgaagttttccgggatatttgatgaaggattaacggagagtcaaatgattgagcatatgagtgatttagcttcgaagaacaaagttttcaaatcgttcattggtatgggatactataacactcatgttcctcctgtgattttgcgtaatataatggagaatcctgcttggtatactcaatatactccttatcaagctgagatttctcaaggaagactcgaatctctgctcaattaccagacggttattactgatctcaccggtctaccgatgtcgaacgcttcgttgctcgatgaaggtacggcggcggcggaagcaatggcgatgtgtaataatattctaaaggggaagaagaagacgtttgttattgctagtaattgtcatcctcagactattgatgtttgcaagacgagagcggatggtttcgatttgaaagttgtgacggttgatattaaggatgtggattatagctctggtgatgtgtgtggagtgttggttcagtatccggggactgaaggggaggtgttggattatggtgagtttgttaagaatgctcatgctaatggtgttaaggttgttatggctacggatttgttggctttgacgatgttgaaaccgccgggtgagtttggggcggatattgttgttgggtcgggtcagaggtttggtgttccgatgggttatggtggtcctcatgctgctttcttggctacttcacaagagtataagagaatgatgcctgggaggattattggtgttagtgttgattcttccgggaagcaagctttgcgtatggctatgcagactagggaacagcatatccgcagggataaagctaccagcaacatctgtaccgctcaggccttgcttgcaaatatgactgctatgtatgctgtttaccatggaccagaaggcttaaaatctattgcacaacgggttcatggtctcgctggtgtatttgccttaggattgaagaaactgggaactgcacaagtccaagatcttcccttctttgacactgtcaaagttacatgttcagatgcaactgcaatttttgatgtggcagccaagaaggagatcaatttgcgtcttgtggactccaacactattactgttgctttcgatgaaacaaccaccttggatgatgtcgataaactttttgaagtttttgcttcgggcaagcccgttcaattcacggctgagtctcttgcaccggagtttaacaatgctattccctctagcctaacaagagagagcccttatctgacccatccaatcttcaacatgtaccacacggagcatgagttgcttaggtacatccacaagttacaaaataaagatctatcattgtgccacagcatgattccacttggatcttgtacgatgaaattgaatgccaccactgaaatgatgccagtcacatggccaagtttcaccaacatgcacccttttgctcctgttgaacaagcccaaggttatcaggaaatgtttacgaatttgggtgagctcttatgtacgatcactggattcgactctttctcattgcaacctaatgccggtgctgctggcgagtacgccgggctcatggttatccgtgcatatcatatgtcaagaggcgatcatcacagaaatgtgtgcatcatacctgtttctgcacacgggacaaaccctgctagtgctgccatgtgcggaatgaaaattgttgccgttggaactgatgccaaaggaaacattaacatcgaagagttgaggaacgccgccgaagccaacaaggacaacttggctgctcttatggttacatacccttccacccatggagtctacgaagagggtatcgacgagatctgcaacataattcatgaaaatggaggccaagtttatatggatggtgctaatatgaatgcacaggtgggtttgacaagccctggttttattggagcggatgtttgccatctcaatctccacaagaccttctgtatccctcacggaggtggaggtcccggaatgggccctatcggtgtgaagcaacatttggctccattcctaccttctcacccagtgatacctaccggtggtatccctgaacccgagcagacatcaccgctgggaaccatttctgcagcaccatgggggtctgcgcttatcttgccaatctcgtatacttacattgccatgatgggatctggaggactcaccgatgcctcaaagattgcaattttgaacgctaactacatggcaaagcgtctggagagccactacccagttcttttccgtggtgtcaatggaacagtcgctcacgaattcatcattgacttgagaggattcaagaacactgctggaattgaaccagaggatgtggccaaacgattgatggattatggtttccatggaccgacaatgtcttggcctgtccctggaacgcttatgatcgagccaaccgaaagcgaaagcaaggctgagttagataggttctgtgatgctctcatctcgatcagggaagagatttcacagattgagaaaggaaacgcagatccaaacaacaacgttctgaagggtgctccacatcctccgtcattgctaatggcagatacatggaaaaagccgtattcacgggaatacgcagccttccccgctccatggctccgctcctccaagttctggcccactacagggcgagtggacaacgtgtatggagaccgtaatctggtgtgcactctccaaccggcgaacgaagaacaggctgcagctgcagtgtctgcttaa

SEQ ID NO: 1725 - DNA, 1062 bp, Arabidopsis thaliana
aatggccaacgatcagaagaatagtgagtcttttccagcgaaggaagatcataagaaggatgatgcggcagctccagcagaagtagaccataaggatgaattctcggcatcacagccacatccggtcgaaaacatagttttagttgggcgtacagggaacggcaaaagcgccacggggaacagcatcgtcagatcaaaggtgtttaagtcgaaaacaaaatcatcaggtgttacgatggaatgccatgcagttaaagcagtgacaccagaaggccctatactcaatgtgattgacactcctggtctatttgatttgtcggtatctgctgaatttatcggtaaagaaatagttaaatgcctaactctagcggatggagggctacacgctgtgctcttagttttatctgtaaggactcgaattagtcaagaggaagagatggtacttagtaccttgcaggttcttttcggtagtaagattgttgattaccttatcgttgttttcacggggggagatgtattggaagatgacggtatgacattggaggattacttgggtgataacatgccggacttcctaaagagagttctcatattgtgtggccaacgaatgattctgtttgataacaaaaccaaggatgatgagaaaaagacaaagcaagtccatgaacttctcaaacttatcgacttggtcagaaagcagaacaacaatattccgtataccgatgagatgtaccatatgataaaggaagaaaatgaaaggcacaagaaagaacaagaggagctagaatcaaaagggcattcagaagagcagctcgcagcattgatgaaggagttacagataatgaatgaacgaaacctcaaggcaatggcagagatgatggagaaaaatatgaaaatagctatggaggcgcaggagaagctctttgagcaaagagaaaaagctcaggagatgagctaccagcaaaaaatggaaatgcaggagaagttaaagcagatggaaggacgtatgcgtgctgaaatggaagcgcaaatgctcagccgtcagcagtgcagcattctctg

SEQ ID NO: 1726 - DNA, 1488 bp, Arabidopsis thaliana
atggtggcttttgcaacagagaagaagcaagatctgaatctattgtctaaaatcgcctccggtgacggtcacggcgagaattcctcttatttcgatggttggaaagcttatgaagaaaacccatttcacccaattgatagacctgacggagttattcaaatgggtctcgctgaaaatcagctttgtggagatttgatgcgtaaatgggttttaaaacatccagaagcttcgatttgtacatcagaaggtgtgaatcaattcagtgacattgccatttttcaagattatcatggcttgcctgaattcagacaagctgtagcgaaatttatggagaagactagaaataacaaagttaagtttgatcctgaccggattgttatgagcggcggcgcaaccggagcacacgagacggttgctttctgtttagctaatcccggcgatggtttcttagttccaaccccttattatccagggtttgatagagatttgagatggagaaccggagtgaatcttgtaccggttacttgtcatagctctaatgggttcaagattacggtggaagccttggaagctgcttacgaaaacgcgagaaaatcgaatattccggttaagggtttacttgtaaccaatccttcaaacccgcttggtacgacgttagaccgggaatgtttgaagtctcttgttaacttcactaatgacaaagggattcatcttattgctgatgagatttatgctgctactacttttggtcaatccgagttcataagtgttgcggaagtaatcgaggagatcgaagattgtaaccgcgatttgatacatattgtgtatagtctatctaaagatatgggtctgcctggtttaagagttggtatagtatactcttacaatgacagggtggttcagatcgcaaggaaaatgtcgagtttcggtcttgtttcgtcacaaacgcagcatttgatcgctaaaatgttatccgatgaagagtttgtagacgagtttatccgcgagagcaaattgcggttagctgcaaggcacgctgagataaccaccggtttagatggtttagggattggttggttaaaggccaaagccggtttgttcttgtggatggatttaagaaatcttttgaagacagcaacgtttgattcggaaaccgaactatggcgtgtgattgttcaccaagtgaagctcaacgtgtctccaggcggttcgttccattgccatgaaccgggatggtttagagtatgttttgcgaatatggaccataagacgatggagacagctctagagaggattagagtgttcactagccaacttgaggaggagactaaaccgatggctgcaacaactatgatggctaaaaagaagaagaagtgttggcagagtaacctcaggttaagctttagtgacacgaggcggttcgatgatggcttcttctcgcctcattcgcctgtgccgccttctccgctagtccgtgcacagacttaa

SEQ ID NO: 1727 - DNA, 1131 bp, Arabidopsis thaliana
atggcgattcggaaggaggaagaaagtagagaagaacagagcaattcgtttcttcttgatgctctctactgcgaagaagagaaatgggacgatgaaggagaagaagttgaagaaaactcttccttgtcttcttcttcttctccattcgttgttttgcaacaagatttgttctgggaagatgaagatctggttacactcttctccaaagaagaagaacaaggactcagctgtctcgatgatgtttatctttccacggatcgaaaagaagctgttggttggattctgagagtcaacgctcattatggcttctctactttagcagctgttttagccataacttatctcgataagttcatctgtagctacagcttacagagagacaaaccatggatgcttcagctcgtttctgtcgcgtgtctctcattagctgctaaagtcgaagaaacccaagtccctcttcttctagactttcaagtggaggagacaaagtatgtgtttgaagcaaaaaccatacagagaatggagctactgattctgtctactctcgagtggaagatgcatctcattactccaatttcgttcgtagaccacattatcaggagattgggacttaagaacaatgctcactgggatttcctcaacaaatgccaccgtctcctcctctctgtaatctccgattcaagatttgtcgggtacctcccatcagtagttgccgcagctaccatgatgcgaattatagagcaagttgatccctttgaccctctttcataccaaactaatctcctcggtgtccttaacttaaccaaggaaaaggtgaaaacttgctacgatctaatcctccaactaccagtggaccgcatcggtttacagatccaaatccaatcttccaagaaacgcaagagtcacgattcatcatcatcgttgaacagtccaagctgcgtgattgatgcaaaccctttcaatagcgacgaaagctcaaacgattcgtggtcagcgagttcgtgcaacccaccaacgtcgtcgtcgtccccgcagcaacaacctccattgaagaagatgagaggagctgaagagaatgagaagaagaagccgattttgcatctgccatgggcaatcgtagccactccataa

SEQ ID NO: 1728 - DNA, 654 bp, Arabidopsis thaliana
atgagctctaacaacaaaactgatgattccgacgaccgttctttctggcaaaactcgacttcttacgatgccagcagcaagattttcctcgtcaccaccgtttccttctctattattatcatcatcgtgttcgtttattatctctacgcaaaattcgttctccaccgtagatcagccttccaagacctctccttctctgtcgtttctcagccgccaaaacgtggcctcgattctctagtcatcgcttctctcccaacgttcgtggttggaatcaagaatgacgtggcgggtacggaatgtgcggtttgtctaagcttattggaggagaaagataatgcaaggatgttaccgaactgcaaacacgtgttccacgtgtcttgcgttgacacgtggctcaccacgcagtccacttgtcccgtttgtcgaactgaagccgagccaagtcatccaaggcttgagcctgagcctagggaagggccagttggcgactttgcaccgccgttagatttcgcgggggttgataacaaaaccggcggatcatcggtttcgaggttagactcgttccggaggattttgacaagggaaagatcttcgaacaggcgggatcattctcgcgttgaccaagatcgtgaattggatattgaaagacagtga

SEQ ID NO: 1729 - DNA, 1077 bp, Arabidopsis thaliana
atggtgaagaagcaatcgccattacacgttgtcggtgtgtctgttttgatggtgttgttatgcagtgttaattacagtctctgtgaaaagatcaaaacgtataagctcacaagaggaagcttaagtgttactttcactaactatggtgctgtcatgacctctcttctcctccctgacagacatggaaaacaagacgatgttgttcttggatttgatactgttgatggttacaagaatgatacaacatattttggagcaattgtgggaagagtggctaatagaataggaggtgctaaattcaagttaaatggtcatctctacaaaaccgatcccaacgaaggccgtaacactctccatggtggttcaaagggatttagtgatgtgatttggtcagtccaaaagtatgttcccactagtcacattactttcacatacgatagcttcgacggtgaagaaggttttccgggcaatgtgacggtgaaagtgacgtacatgttgatcggagaaaacaaactcggtgtaaaaatggaagcaaagccactcaacaaacctacaccaatcaacttagctctccacacttactggaacctccacagccacaactccgggaacatcctctcccacaaaattcaactcctcgccggaaaaatcactcccgtcgacgacaaactcattcccaccggagaaatcacctccattaccggaactccttacgatttcctcgagccacgtgagatcggtagccggatccacgaattacccggcggttacgacatcaattacgtgatcgacggaccgatcgggaaacatctgaggaaaactgcggttgtgacggagcaagtcaccgggaggaagatggagctgtggacgaatcagcctggtgttcagttttacacgagtaatatgatgaaacgtgtcgtcggtaaaggtaaagccgtttatgagaaatacggtggcttgtgtttggagactcaaggcttcccagattccgtcaatcacaagaactttccgtcgcagattgttaatcccggcgagagttatttgcatgttatgctcttcagattcactgctcactaa

SEQ ID NO: 1730 - DNA, 981 bp, Arabidopsis thaliana
atggctagcttggtggttgagaaaatttattcggaagttgatacatgtttgaaactaaacaaactgatacatgttttgattttagaatgcggaatcaggctggcttcagctggatacgcggtttttggtatggactatgaaggtcatggaaggtccatgggatctcgttgctacatcaagaagtttgcgaatgttgtgaatgattgctatgactactacacatctatttgtgcgcaagaggagtacatggacaaaggcagattcttgtatggagaatccatgggaggcgcagtcactttattgcttcacaaaaaagatcctttgttttggaacggcgccattctagttgctccaatgtgtaagatatctgagaaggtgaagccacaccctatagtgattaatctgttaactagagtcgaagaaatcatacctaaatggaaaatagttccaacaaaagacgtgattgacgctgctttcaaggacctcgtcaagcgagaagaggtaaggaacaacaagctgatatatcaagacaagcctaggctcaaaaccgcacttgagatgcttaggacaagcatgaacctagaagacactctccacgagataacaatgccattctttgtattacacggagaagcagatacagtgacggatccagaggtaagcaaagctctgtacgagaaagctagcacaagggacaagacgctcaagttgtatccagggatgtggcacgctctgacgtcaggtgagcctgactgtaacgtggaccttgtttttgctgacatcatcaattggcttgaccttcgaaccgctgaccctgcctctctcactgtcactcctatacgagttggtaacactacgagcgtccagagggtaactactgttaacggcgttagtaacggtcataggaggcctaaacgtcccttcttcaatctcctttgtggtttgaaccgtggccgtttggttccacgatccactgtgtaa

SEQ ID NO: 1731 - DNA, 2826 bp, Arabidopsis thaliana
atggctgcgagaaatttggagaagatggcttctattgatgctcagctcaggcttcttgctcctggcaaggtttctgaagacgacaagcttatcgagtacgatgctctgttactggatcgatttctcgatattcttcaggatttgcatggcgaggatgtcagagaattcgttcaagaatgctacgaagttgcagctgattacgatggaaaccgcaacactgagaagcttgaggagcttggaaatatgctgacgagtttggatccaggggattcaattgttgtcactaaatcattctccaacatgcttagcttggctaatctggctgaggaagtccagattgcttaccggcgtaggattaagaaactcaagaaaggtgatttcgctgatgaggcctctgcaacaacggaatctgacattgaagagactctcaagaggcttttgcagcttaacaagactcctgaagaggtctttgatgctcttaagaatcagactgttgacttggttttaactgctcatcccactcaatctgttcgtcggtctttgctccaaaagtttggaaggattcgtgattgtttgacgcagttatatgcaaaggacattactcctgatgacaaacaagaactcgatgaagctctgcaacgagagattcaagctgcttttcgcacagatgaaatccgaagaactcctcctacaccgcaagatgaaatgagagcagggatgagctacttccatgagacaatctggaaaggagttccaaagttcttaagacgtgttgacacagctttaaagaacattggaatcaacgagcgtgttccttacaatgcgcctctcattcagttctcttcttggatgggcggagaccgtgatggaaacccgcgagtaactcctgaagttacaagagatgtatgcttattagctagaatgatggctgctaatctctacttctcccagatagaagatcttatgtttgagatgtctatgtggcgttgcaatgaggaacttcgggttcgtgcagaacgtcaaagatgtgcgaagagggatgcaaaacactatatagaattctggaaacaaatccctgcgaatgagccataccgagctattcttggagatgtgagggacaagctgtacaacacacgtgagcgtgcacgtcagttattgtcaagcggagtttcggacgttcccgaagacgcggttttcacaagtgtggatcagtttttggagccacttgagctttgttacaggtcgctctgtgattgcggtgacagacctattgctgatggaagcctgcttgatttcttacgccaagtgtcaacatttggccttgctcttgtgaaacttgatatccgtcaagaatctgaaagacactctgatgtcttggatgccatcacgacgcacttaggtattggttcttacaaagaatggtcggaggataaaagacaggaatggctgttatctgagctaagcgggaaacgccctctctttggaccggatcttcccaaaaccgaagaggttgcagatgtgttggacactttcaaagtcatttctgagcttccttcggatagttttggtgcttatattatctcaatggccactgctccatcagacgtgctcgctgttgagcttttgcaacgcgaatgcgggatcactgatcctctgagagttgtcccgttgttcgagaagctagcggatttagaatccgcacctgctgcagttgcccgtctcttctccatagaatggtacagaaacaggatcaatggaaagcaagaagtcatgatcgggtactctgactcgggcaaagatgctggtcgtttatcagcggcttggcagttatacaagactcaagaagagctcgtgaaggtggcaaaagaatacggagtcaagctgacaatgttccacggaagaggtgggaccgttggacgaggaggtggacctacccatcttgctattttgtctcagcctccggataccattcatgggcaattgagggtaacggttcaaggtgaagttattgaacagtctttcggagaagagcacttatgctttaggactcttcagcgtttcacagctgcaacacttgagcatggaatgcatccaccggtttcccctaagcctgagtggcgtgtcctcatggatgaaatggctataattgccactgaagaataccgttctgttgtcttcaaggagccccgttttgttgagtacttccgtctgcggaggaatcgagtcgctgcgtgcaatcccgtggatctttgcgtggactcagacgaggttcacttacccgtgtggcttggctttggaggagcattcaaacgcgtgatacagaaggacagtaagaatctcaacatgctcaaagagatgtacaaccaatggccattcttccgtgtcacaattgatctagtcgaaatggttttcgccaaaggagatcccggaattgcggctctgtatgaccgcctcctcgtctctgaagaacttcaaccattcggtgaacaacttcgagttaactaccaagagaccagacgcctcctcctccaggttgcaggtcacaaagacattttagaaggtgacccttacttgaggcaaaggctgcagcttcgtgacccatacatcacgacattgaacgtgtgtcaagcctatacactcaagcagatccgtgacccaagcttccacgtcaaagtccggccacatctctctaaggactacatggagtctagtccagcggctgagctcgtgaaactgaatccaaagagtgaatacgcaccgggacttgaagatacggttatcctcaccatgaagggtatcgctgctggtatgcaaaacaccggttaa

SEQ ID NO: 1732 - DNA, 1035 bp, Arabidopsis thaliana
atggctccggggcttactcaaaccgctgatgctatgtccaccgtgacgataacaaaaccgtcactgccatcagtccaagacagcgatcgagcttacgtgacgtttcttgctggaaacggtgattacgtgaaaggagtcgttggtttagccaaagggttaaggaaagtcaaatcggcttatccactcgtagtagcgatgttacccgacgtcccggaggaacaccgtcgtatacttgtggatcaaggatgcatcgtccgtgaaatcgaacccgtttacccacccgagaaccaaactcagttcgccatggcttattacgtcatcaactactctaaactccgtatctggaagtttgtggagtatagtaaaatgatatatttagatggagacattcaagtttacgaaaacatcgatcacttgtttgacctaccagatggctatttgtacgcggtgatggattgtttctgtgagaaaacatggagtcacacgccgcaatacaagatcagatattgccaacaatgccccgacaaagtccagtggccaaaagcggagcttggagagccaccggctctttacttcaacgccggaatgttcttgtacgagcctaacctcgagacttacgaggatctactacgaacacttaaaatcactcctccgactcctttcgctgaacaggattttttgaacatgtactttaagaaaatctacaagccgattcctttagtgtacaatctcgtccttgcgatgttatggcgtcacccagaaaatgtagagcttggaaaagtcaaggtggttcactactgtgcagcgggttcgaagccgtggagatacacagggaaagaagcgaacatggagagggaagatataaaaatgttagtgaaaaaatggtgggacatttacgacgacgaatccttggattacaagaaacctgttaccgttgtggacacagaggtcgatctcgtgaatctgaagccgttcatcaccgctcttactgaagctggccggctcaactacgtgaccgcaccgtccgctgcttga

SEQ ID NO: 1733 - DNA, 1428 bp, Arabidopsis thaliana
atggattcctcctatggcgccacaaagttccttctcctcctcttcctcaccacctccattgcgaccgcattacccgataacaaaccagtaccgggtcaaataaactcaaactcagtcctcgtagctctcctggactctcactacacagagctagcagaactagtcgaaaaagctctccttctccagaccctcgaagaagcagttggtaaacacaacatcacaatcttcgcaccacgcaacgatgccttggaacgaaacttagacccactcttcaaatctttcttgctcgaaccaagaaacctcaaatctttacaatctttattaatgttccacattcttcctaaacgaatcacttctcctcaatggccttctctttctcatcaccaccgtactctctccaacgaccatctccacctcaccgtcgacgtcaacactcttaaagtagattccgctgagattatccgacccgatgacgtcattagacccgatggtatcattcacggcatcgaacgtcttctcatccctcgctctgttcaagaagattttaaccgccgtcgtagtctccgttcaatctccgccgttataccagaaggagctcctgaggttgaccctagaactcaccgtctcaagaaaccatctcccgccgttcccgccggagctcctccggttcttccaatctacgacgctatgtcaccaggtccttccctagctcctgctccagctcccggacccggtggtccacgtggccatttcaacggcgatgctcaagttaaagatttcatccacactctcttgcattacggtggctacaacgagatggctgatatactcgtcaacttaacctctttagccactgagatgggtcgactcgtgtcagaaggctacgttttaaccgttcttgctcctaacgacgaagccatggctaagctcacaacggaccagcttagcgagccaggtgctcctgaacaaattatgtattaccacatcataccggagtatcaaacagaggagagtatgtacaacgctgttcggagattcggaaaagtgaagtatgattcattgagattcccacataaagtgttggctcaagaagctgatggatctgtcaaattcggacacggtgatggttcagcttacttgtttgatcctgatatctacacggacggtcggatttcagttcagggtattgatggagtcttgttcccgaaggaggaaacgccggcgacggagattaaaccagctgctccggtcgttaagaaagtttctaaatcaagaagaggtaaagataaattttccatttctttactctttttgttacgattatttttagacgctaattattcggtcaataaatatttgacattgacatctaaacacaaaaattcatcattgttttgtgtcattgagtgtcaaaaattcttattctaa

SEQ ID NO: 1734 - DNA, 1035 bp, Arabidopsis thaliana
atgggcccaaagatgcccaacacagaaacagaaaatatgaaaatattagtcaccggctctactggttacttaggcgcacgactctgccacgttctcctccgtcgtggccactccgtacgtgcattggtccgccgcaccagcgatctctctgacttacctccagaagttgagctcgcctatggagacgtaacggattaccgttctctaacggatgcttgctccggttgcgatatcgttttccacgccgcagctttagttgagccttggcttcctgacccatctcgattcatctcagtcaacgttggtggactgaagaatgtcttggaagctgtaaaggagacgaagaccgtgcagaagattatctacacttcttccttcttcgctcttggatctaccgatggatctgttgctaatgagaatcaagttcataatgagaggttcttctgcactgagtatgagagatccaaggctgttgctgataagatggctttgaatgctgcttctgaaggtgtgccgataattttgctgtatcctggtgttatttttggtccaggcaagctcacttcagccaatatggttgctagaatgttgatcgagcgctttaacgggaggttgcctggatatattggctctgggacggatagatactccttcagccatgttgatgatgttgtggagggtcatgttgctgcaatggaaaaaggtaggcttggtgaaagatacttactcactggggaaaatgcttctttcaagcttgtctttgacatggctgcactgattactggaaccaaaaagccaaactttagcattccattatgggccatcaacgcatacggatggttatctgttttaatctctcgggttacaggaaagcttccacttatcagtcctccgacagtgacagtgctgagacatcagtggtcatactcttgtgataaggctaagctggaacttggttataaccctcgaagcctaaaggaaggattggaggagatgctcccttggttgaagagtctgggcgtcattcactactga

SEQ ID NO: 1735 - DNA, 972 bp, Arabidopsis thaliana
atggagagtttcccgatcatcaatctcgagaagcttaatggagaagagagagcaatcactatggagaagatcaaagacgcttgtgaaaactggggcttctttgagtgtgtgaaccatgggatttcactcgagcttttggacaaagtggagaagatgaccaaggaacattacaagaagtgcatggaagagagattcaaggaatcgattaagaacagaggtcttgactctcttcgctctgaagtcaacgacgttgactgggaatccactttctacctcaagcaccttcccgtctctaatatctccgatgtccctgatctcgacgacgattacagaacgttaatgaaagacttcgccggaaagatagagaagttgtcggaggagctactggatctgctgtgcgagaatctcggtttagagaagggttatttaaaaaaggtgttttacgggtcgaaaagaccgacttttggaaccaaagtcagcaattatccaccttgtcctaatccggacctagtcaagggtctccgagcccacaccgacgccggcggcatcatcctcctcttccaagacgacaaagtcagtggacttcagcttcttaaagacggcgagtgggtcgatgttcctccggttaagcattcaatcgtcgttaatctcggcgatcaacttgaggtgataaccaatgggaagtacaagagtgtggaacatagagtgctatctcagacagacggagaaggaagaatgtcgatcgcatcattctataatccgggaagcgactctgttatttttccggcgccggagctgatcggaaaagaagcagagaaggagaagaaagagaactatccgagatttgtgtttgaagattacatgaaactctactctgctgtcaagtttcaggccaaggaaccaaggtttgaagccatgaaagctatggagacaactgtggccaacaatgttggaccattggccactgcgtga

SEQ ID NO: 1736 - DNA, 357 bp, Arabidopsis thaliana
atggccgcagaaggagaagttatcgcttgccacaccgttgaagattggaccgagaagctcaaagccgccaacgaatccaagaaactgattgtgatagacttcactgcaacatggtgcccaccttgccgtttcattgcacccgtctttgctgacttagccaagaagcacctcgacgtagtcttcttcaaggtcgatgttgacgaattgaacactgttgctgaggagtttaaagttcaggcaatgccaacgtttatcttcatgaaagaaggagagatcaaggagactgtggttggtgctgctaaagaagaaatcattgccaatctcgagaagcacaagacagttgttgctgctgcttga

SEQ ID NO: 1737 - DNA, 1158 bp, Arabidopsis thaliana
atggacatgaaatctggtcactcgtctcctgtaatgactgattctccaccaataagcaactcaagattaaccattcgtcagaatagacttccttactcatcagcagcagccacggctatctcacagaacaacaatctcttactaaccgttccaagaaagaaaactgggatccttgatgatgttaagtctaatggttggcttgatgcgatgaaatcttcttctcctcctcctacaatacttaacaaagataacttaagcaatgatgctacggatatgacttatcgcgaatggatgcagctcaagtatccatcagctcttacctcttttgagaaaatcatgagttttgcaaaaggcaaaagaatagcattgtttcttgattatgacgggacactttcgcctattgttgaggaacctgattgtgcatacatgtcaagtgctatgcgtagtgcagtgcaaaatgttgccaagtatttccctaccgcgatcattagtggaagaagccgggataaggtgtatgagtttgttaatttgagtgaactttattacgccggaagccatggaatggacatcatgagtcccgcaggagaatctttaaaccatgaacatagccgtactgtatcagtttacgaacaggggaaagatgtaaatctattccagcctgctagcgagtttctcccgatgatcgataaggtgctttgttctcttatagagagtacaaaagatatcaaaggggtaaaagtagaagacaacaagttctgcatctctgtgcattaccgcaatgtagaagaaaagaactggacattggttgcacagtgtgtagatgatgtcatcagaacatatccaaaactacggctaacacatggccggaaggttttagagatccgtcctgtgattgactgggacaaagggaaagctgtgacatttctacttgaatcactcggcctaaacaactgtgaggatgttcttccaatctatgttggggatgatcgaacagacgaagatgcatttaaggtactacgagatggaccaaaccacggttatggtatattagtctctgctgtgcctaaagacagcaatgccttttactcgcttcgtgacccgtctgaggtgatggagtttctgaagtcattggtgacatggaagagatcaatgggttaa

SEQ ID NO: 1738 - DNA, 1020 bp, Arabidopsis thaliana
atgtctgaatcaaggagcttagcctcaccaccaatgttgatgattcttctcagccttgtaatagcttccttcttcaaccacacagctggacaaatcggagtatgctacgggatgctaggcgataccttgccaagtccatcggacgttgtggctctttacaaacaacaaaacatccagcgaatgcggctctacggccctgacccaggcgctcttgccgctctccgtggctctgacatcgagctcatcctcgacgttcccagttcagatcttgaacgtctcgcctccagtcaaacggaggccgacaagtgggttcaagaaaacgttcagagctacagagatggtgtcagattccggtacatcaacgttggaaatgaggtgaaaccctcagttggggggtttctcttacaagcaatgcagaacatcgagaacgcggtttctggagcagggcttgaagtcaaggtctcaacagctatagccactgacaccaccactgatacgtctcctccgtctcaaggaaggttcagggatgagtataagagctttctcgaaccagtgataggtttcttggcaagcaagcaatctcccttgctcgtgaatctctacccttacttcagctacatgggagacacggccaacatccatctagactacgctctgttcaccgcccagtccactgttgataacgatccagggtactcataccaaaacctattcgacgcaaatctcgactcggtttatgcagcattggagaaatcagggggcggatcgttggaaatcgtggtgtcggagaccggttggcccacagagggagcagtcgggacgagtgtggaaaacgcaaagacttatgttaacaatttgatacaacatgtgaagaatggatcaccgagaaggccagggaaagctatagagacttatatattcgctatgttcgatgagaataagaaggaaccaacgtatgagaagttttggggactgtttcatccagatcgacagtctaagtatgaagttaatttcaactaa

SEQ ID NO: 1739 - DNA, 699 bp, Arabidopsis thaliana
atggccaatgaaattcctaccaaagggattctcaagagcgaagctctaaaacagtacatcatggaaacgtcagcgtatccaagagagcatgaattgctcaaggaacttcgaaaagctactgtccaaaaatacggaaatttaagcgagatggaggttccggttgatgagggtcatttcctatcgatgcttgtaaagatcatgaatgcgaaaaacactatcgagatcggtgttttcaccggttactcgcttctcactacagctcttgctttacctgaagatggccgtattaccgcgatagacattgataaagaagcttacgaagttggactagagtttattaagaaggctggtgttgatcacaagattaattttatccattccgatggtcttaaggccttagaccaattggtgaacgacaaatgtgagtttgattttgcatttgcggatgctgacaaatcaagctacgtcaacttccatgagaggcttctaaaattggtgaaggttgggggaatcattgcgttcgacaacaccttgtggtttggttttgtggcggaggatgaagatggagttccggagcatatgagagaatatagagcagctcttatagaattcaataagaaattggctttggatccccgagtcgaggtctctcagatttccattggagatggtatcacgctctgtagacgtcttgtttga

SEQ ID NO: 1740 - DNA, 1872 bp, Arabidopsis thaliana
atggcgtttgaagctcttaccggaatcaatggtgatctaatcaccagatcatggtcagcctcgaagcaagcttacctaaccgagcgctatcacaaggaagaagcaggagcagtcgtaatcttcgctttccaaccatctttctcagagaaagatttcttcgatccggacaataaatcttcctttggagaaatcaagttgaaccgtgttcagtttccttgtatgaggaaaatcggtaaaggtgatgtagctactgttaacgaagctttcctcaagaatcttgaagctatcattgatccaagaacctcatttcaagcttctgtggaaatggctgtgaggagtagaaaacagatagtgttcacaggacattcctcaggaggtgcaactgcaatcttagcaacagtttggtatttggagaaatacttcatacgcaatccaaatgtttaccttgagcctcgttgtgtgacatttggagctcctttggttggtgactctatcttcagtcacgcacttgggagagaaaaatggagccggttctttgtgaactttgtctcaagattcgatattgtccctcggattatgcttgctcgaaaggcgtctgtagaggaaactttgcctcatgttcttgcccaattggatcccagaaagtcttccgtccaagagagtgaacagagaataacagagttttacacaagggtgatgcgagacacatcaactgttgcaaaccaagctgtttgtgaattgactggaagcgcagaggcgtttttagagaccctttctagtttccttgagctaagtccttatagacccgccggtacttttgttttctctacagagaagagattggttgcagtgaacaactcggacgccattcttcaaatgctgttttacacttctcaagccagcgatgaacaagaatggtctctaattccatttcgaagtatcagagatcatcatagctatgaggaactggtacagtcgatgggaaagaagttgtttaatcatttggatggagaaaactcaatagagtctacgctcaatgaccttggagtgagcacaagaggcagacagtacgttcaagctgcattagaggaagagaagaaacgagtagagaatcagaagaagattattcaggtgatcgagcaagagaggtttttaaagaaactagcatggatagaagatgaatacaagccaaagtgtcaagcccataaaaatgggtattatgattccttcaaagtttcaaatgaagagaatgacttcaaagcaaacgtcaagagagctgagttagccggtgtttttgacgaggtgcttggtttaatgaagaaatgtcaacttccagatgagttcgaaggggacatagattggatcaagttagcaactcgataccgcagattagttgagcctcttgatattgcaaactaccatcgacatttaaagaacgaagacacagggccgtacatgaaaagaggaagaccaacccgctacatatatgctcagagaggctacgaacattatatactgaagccaaacggaatgattgcagaagatgtattttggaacaaggtaaatggtcttaacttagggttacagctagaagaaattcaagagactctaaagaattcgggatccgagtgcggatcatgcttttgggctgaggttgaagaactcaaaggaaagccatacgaggaagttgaggtaagagttaagacattagaagggatgcttggagaatggatcacagacggggaggtagatgataaggaaatatttctggagggttcaacgtttagaaagtggtggattacgcttcccaaaaatcacaaatcgcattctcctctgcgagactatatgatggatgaaataacagatacctga

SEQ ID NO: 1741 - DNA, 1674 bp, Arabidopsis thaliana
atggttttggggtgtttccctttgaaaagcaagaagaaacgtggctctgtttctatgaagcggttggatcttgaagaaagcaagccaactgctttacctgagccaccaaagattccaagtcgtaatttacaatcagctcctccgagtttcagaactcgtgtgaagccaattcaatctaacaacggtggaaccggagagatgagtagccgagcaagagtcatgtctgctccgtcaagcatccacggtgcagcggaacgggatttgcttgctggtgtttaccacgacgagcaagatgaacaaccaagagatccacgtacttctactaaagaatctagccctcaaccacttccgttaccgtcaccaagaactggttcttcattgaagaattggggaagctttaagtcgtttaacggaagcagcggtcggttatcatcatccgcagctgtatctggacctttacctttgccacctagcgggtcagttaggagcttttcatatgatgaagtaatggctgcgtgtaacgctttttcttcagaccgatgtgtcatggaaggtctttcatctgttatgtacatggcttcctttggtgatgaggcttcgacctcaggtttaaagaaggttgacgcaactgttgtacgacttcacgtaattactcagagtattagggagttcattaatgaagtcaacacattggcgtcgctgcaacaccagaacctttgtaagctggtaggctatcatgctcgtgacggttctgacacaagaatgttggtgtacgagaggcttgctctgggcagcttggaccgtttactgcatgggagatcagatgggcctcctcttgattggaacactagaatgaagattgcactatgcgcagctcagggtctaaccttcttgcacgaagaaggcccttttcaggcaatgtacaatgaattttcgacggcaaatatccaagtcgataaagatttcagcgccaagctatcaggatacggttgtgcaggccatgcgcctgagacagagacatctaatagttcggcacttgctaatctctctgtcgagactctagagagagggcttttgaccccgaagagcaatgtgtggagctatggaatagttcttcttgagatgttaacgggtcggaaaaatatggacgggtcttacccgaaagaagagaggaacttagtgaaatggagcagagcttttctagcagatgattgcaggctctcgcttataatggatcctcagcttaaaggtcggtttccggcaaaagcggctaggagcatagcagatatagcacagaaatgtctgcaggtggagccttcagagcgtccaaccatgagaaacatcgtggatcaactcaagatcatacaggacatgaagtactcgtgtaggttcccattgagagaacccgcaccggtcgtggcaaggaaacatatgggaagatcaagcagtctcaacacgattatttggaccccggcatcagtgccaccaaggtcgagtttttcaccgtcacctccaccacgacgaccgtctgtctcacccacaaggggacggacgctcgtgtttcccccagtgtttccgccgcgagcgtgttcatctttggaggaaatggctcgggaagaggttcgaagatcgtcttcagccagtggtaggagaactagcctcgaagggttttga

SEQ ID NO: 1742 - DNA, 1698 bp, Arabidopsis thaliana
atggcttcgaccccgaagcttaccagtacaatttcatcatcttctccatctcttcaattcctctgcaaaaaactcccaatcgcaattcatctaccatcatcttcttcctctagctttctctcgcttcctaaaaccctaacctctctctattctctccgtccccgtatcgccctactctcaaaccaccgctattaccactctcgccggttttctgtttgtgccagtaccgataatggagctgaatcagaccgccactacgattttgatctcttcactatcggtgccggaagcggcggcgtccgcgcctctcgcttcgccactagcttcggtgcatccgccgccgtttgcgagcttcctttttccactatctcttccgatactgctggaggcgttggaggaacgtgtgtattgagaggatgtgtaccaaagaagttacttgtgtatgcatccaaatacagtcatgagtttgaagacagtcatggatttggttggaagtatgagactgagccttctcatgattggactactttgattgctaacaagaatgctgagttacagcggttgactggtatttataagaatatactgagcaaagctaatgtcaagttgattgaaggtcgtggaaaggttatagacccacacactgttgatgtagatgggaaaatctatactacgaggaatattctgattgcagttggtggacgtcctttcattcctgacattccaggaaaagagtttgctattgattctgatgccgcgcttgatttgccttccaagcctaagaaaattgcaatagttggtggtggctacatagccctggagtttgcggggatcttcaatggtcttaactgtgaagttcatgtatttataaggcaaaagaaggtgctgaggggatttgatgaagatgtcagggatttcgttggagagcagatgtctttaagaggtattgagtttcacactgaagaatcccctgaagccatcatcaaagctggagatggctcgttctctctgaagaccagcaagggaactgttgagggattttcgcatgttatgtttgcaactggtcgcaagcccaacacaaagaacttagggttggagaatgttggcgttaaaatggcgaaaaatggagcaatagaggttgacgaatattcacagacatctgttccatccatctgggctgttggggatgttactgaccgaatcaatttgactccagttgctttgatggagggaggtgcattggctaaaactttgtttcaaaatgagccaacaaagcctgattatagagctgttccctgcgccgttttctcccagccacctattggaacagttggtctaactgaagagcaggccatagaacaatatggtgatgtggatgtttacacatcgaactttaggccattaaaggctaccctttcaggacttccagaccgagtatttatgaaactcattgtctgtgcaaacaccaataaagttctcggtgttcacatgtgtggagaagattcaccagaaatcatccagggatttggggttgcagttaaagctggtttaactaaggccgactttgatgctacagtgggtgttcaccccacagcagctgaggagtttgtcactatgagggctccaaccaggaaattccgcaaagactcctctgagggaaaggcaagtcctgaagctaaaacagctgctggggtgtag

SEQ ID NO: 1743 - DNA, 2343 bp, Arabidopsis thaliana
atggctcctgctttgagtagaagtctctacacatctcctttgacttcagttccaatcactcctgtctcttctcgtctctctcatctgagaagctcgtttctcccacacggcggcgctttaagaaccggcgtttcgtgtagctggaatctcgaaaagagatgtaaccgattcgccgtgaagtgtgacgccgccgtggcggagaaagagaccactgaagaagggtcaggtgagaagtttgagtaccaagctgaggttagtagattgttggatttgattgttcatagcttatacagtcacaaggaggtgtttctcagggagcttgtaagtaatgcaagtgatgctttggataagctgaggttcttgagtgtaacagagccttctttgcttggagatggtggagatcttgagattaggattaagcctgatcctgataacggcaccatcaccataactgatactggtattggaatgacaaaggaagaacttattgattgccttggaactattgctcaaagtggtacttcgaaattcttgaaggctctaaaggaaaacaaggaccttggtgctgacaacggtttgatcggacagtttggtgttgggttttactctgctttcttagttgctgagaaggttgttgtgtccaccaaaagccccaaatctgacaagcaatatgtttgggaatcggttgccgatagtagctcgtatctgatcagagaagaaacagaccctgataacattctacgtcgtggaacacaaatcaccttgtatctgagggaggatgataaatacgaatttgcggagtctacaaggatcaagaacctcgtgaagaattactctcagttcgttgggtttcctatctatacatggcaggagaaatcaaggactatagaggtcgaagaggacgaaccagttaaggaaggagaagagggtgagccaaagaaaaagaagaccactaaaactgagaagtattgggattgggaactagccaacgagaccaaaccgctatggatgcgcaattcgaaggaagtggaaaaaggagagtacaatgagttctacaaaaaggctttcaatgagttcttggatccacttgctcacacacacttcacaactgagggtgaggttgagttcaggagcattttgtacatccctgggatgggtcctcttaacaatgaagatgttacaaacccgaaaacaaagaacattcgtctctacgtgaagcgtgtgtttatctctgacgattttgatggagagcttttcccgagatatctgagctttgtgaagggagttgtggactctgatgatcttcctcttaatgtttctcgtgaaattctccaagaaagcagaattgtaagaatcatgagaaagaggctcattagaaaaacctttgacatgatacaagaaatctctgagagtgaaaacaaagaggattacaagaaattctgggagaactttggtagattccttaaattgggttgtattgaagacaccggtaaccacaagcgtatcacaccgctacttagattcttcagttccaagaatgaagaggaattgacaagcttggatgattatatcgagaacatgggagagaaccaaaaggcgatctactacctcgcaactgatagtcttaaaagtgccaagtctgcccctttcttggagaaactaatccaaaaagatatcgaggttctatatttggttgaaccaatcgatgaagttgctattcagaatttgcaaacctacaaagaaaagaaattcgttgatatcagtaaagaagatttggaactcggagatgaagatgaagtaaaggacagggaagcgaaacaagagtttaaccttctctgtgactggataaaacagcagctcggtgacaaagttgcaaaagtccaagtctcaaaccgtttgagctcttctccttgtgtgcttgtctctggcaaattcgggtggtcagctaatatggaaaggctaatgaaggcacaggctcttggagacacttcaagcctggagttcatgagaggtaggagaatactagagatcaatccagatcatcccatcatcaaagacttgaacgctgcttgtaagaatgcaccagagagcactgaagcaacaagagtggtcgatctcttgtatgacactgctataatatcaagtggattcactcctgatagcccggccgagctcgggaacaagatatatgagatgatggcaatggcggttggaggaagatggggcagagttgaagaagaagaagaaagctcgactgtgaatgaaggagatgacaaaagcggagaaacagaggtagttgaaccatctgaagtgagggcagagagtgatccttggcaagattga

SEQ ID NO: 1744 - DNA, 1710 bp, Arabidopsis thaliana
atggcggctactagggttcgttgttgtcatagcaatgcagctttcaccagattgccacttacccgccaccgaaactcgccgacgctaccgatttctctaaatcgtgtcgatttccctacgctgaagaaattatcattacccattggagatggctcctccattagaaaggtttcaggttcaggcagcagaaacattgtgcgagctgtgttggaagagaagaagacagaggcgataacggaggtagatgagaagggtatcacgtgcgtgatgaagtttggtggatcttcggtggcgtcagctgagagaatgaaggaagttgctgatttgattttgacttttccggaagaaagtcccgtcattgttctctctgctatggggaaaactaccaacaatctcttgcttgcgggagagaaggcggttagttgtggtgtttctaatgcatctgagattgaggagttgagcattataaaggaattgcatatcaggacggtgaaagagctcaacattgatccctctgttattttgacctatttggaggaactggagcaactcctgaaaggcattgccatgatgaaggaattgacacttcgaaccagagattacttagtctcttttggagagtgtttgtctacaaggatttttgctgcttatcttaatacaatcggtgtcaaggcacgccaatatgatgcatttgaaattggtttcattacaacggatgatttcacaaatggggatatcctggaggcaacttatccagctgttgccaagagattatatgatgattggatgcatgatcctgctgttcctattgtaacaggtttccttgggaagggttggaaaactggtgcggttactaccttgggtaggggtggcagtgatttgacggcaaccacaattggtaaagcgttgggtttgaaagagattcaggtgtggaaagatgtcgatggtgttctaacatgtgaccctactatatataagcgagctacaccagtaccatatctgacatttgacgaagcagccgagctagcttattttggtgcacaggtcttgcacccacagtcaatgagaccagcaagagagggtgagattcctgttagggttaaaaattcttataaccctaaggctcctggaactatcatcactaaaacaagagacatgaccaagagtattctaacgagcattgttctgaaacgtaatgtgaccatgctggatatagcaagcacccgaatgcttggtcaagttggctttcttgcaaaggtattctcgatatttgaggagcttggcatttccgtagatgttgttgccactagtgaagtcagtatatctctgacactggatccttcaaaactttggagcagagaactgattcaacaggagcttgatcatgtagttgaagaactggagaaaattgcagttgtgaatcttctaaaaggaagagcaatcatctctctaattgggaatgttcaacattcctccctgattttagagagggcgtttcatgttctttataccaaaggtgtcaatgtccagatgatatcacaaggagcatccaaggtaaacatttcctttatagtaaacgaagctgaagctgaaggttgtgttcaggctcttcacaaatccttcttcgagagcggtgacctctcagagttattgatacaacccagacttggcaacgggtcacctgtcaggacactgcaagtagaaaattga

SEQ ID NO: 1745 - DNA, 789 bp, Arabidopsis thaliana
atgtttggagaaagagtcatcatagttccatcaatggctgagatctctgatattactactcagactcaaaccgttgtctcggacatcgaaaacgatcgatcaattgatgattcccagtcgtcggttttatctggtcctcttgtgtccgtatcattcgttcaaaagttgattggcgagttcgtggggacattctctatgatatttgccggctgctcagccatcgtggtaaatgagacgtacggtaaaccggtgacacttcccggtatagctttggtatggggactagtcgtaacggttatgatctactcaattggtcatgtctccggtgcacatttcaaccctgctgtttctattgcctttgcctcttctaagaagttcccttttaatcagtttcacccggagcattatcaggtgcatggacttatggtttgttacgatcgacaacgaaatcatatagtgagattatacgtccaatttgcaataaagtatcttcgagagatcgccaagaagcttcccaagatgagatttgtgttttacgagtggttgatccggctaatcaaaactattttatatgttcatcacctaccgatatcaatggcaaatgtaatgttacatgtaagttggcgtgaattatatcgatgtactactcaccacactagttcaatatccatgtattttgttttctcgtttcatattactgtgtatatttttattttatatgcgataagtgataaaaagcttatatacagtattaacacgaaatgttttctcatgctcaactttatatag

SEQ ID NO: 1746 - DNA, 1137 bp, Arabidopsis thaliana
atgaggttttgtgttttcgggtttttatcgcttttcttgattgtttctcctgcctccgcctggttcttccctaactccaccgcggtaccaccgtctctacgtaacactacacgtgttttctgggacgctttctccaatttcaccggttgtcaccacggccaaaacgttgatggtctctaccgtatcaaaaaatacttccaacgttttggttacatccctgaaacgttttcgggaaatttcaccgatgattttgatgatatcctcaaagccgctgtcgaattgtatcagacgaatttcaatcttaacgttaccggtgagcttgatgcgcttaccattcaacacatcgtgatcccgcgttgcggtaatcctgacgtggtcaacggtacttcgttgatgcatggcgggagaagaaagaccttcgaggtcaacttctcccgcacgcatttgcacgcggttaaacgctacacgttattcccaggcgagccacggtggccgagaaaccgccgtgacttgacctacgcgttcgacccgaaaaacccgttgacggaagaggtcaagagcgtgttctcacgcgcttttggtcgttggtctgacgtcaccgcgttaaacttcactctttccgagtctttctcgacgtctgacatcacaatcggattctacaccggcgaccatggtgacggagagcctttcgacggcgttttgggaacattagctcacgctttctctcctcccagcgggaaattccacctagacgcagatgagaactgggtggtctccggagacctagacagtttcctctccgtaactgctgcggttgatcttgaatcagtggcggttcacgagatcggtcatcttctaggtttaggacattcttcagttgaggaatccatcatgtatccaacgatcacgacagggaaacgtaaggttgacttaaccaatgatgacgtggaaggaatccaatacttgtacggtgcaaaccctaacttcaacggcacaacatctccaccgtcgaccactaaacaccagcgagacactggtggcttcagtgccgcctggagaatcgacggttcatcgagatcaacaattgttagtctcttgttgtcaaccgtcggattggtcttgtggttcttaccgtag

SEQ ID NO: 1747 - DNA, 1164 bp, Arabidopsis thaliana
atggccacaagagcttctacatctagcagagtctctccagctttcactttcctcgtcatcttcttcctcttatctctcactgcttcagtagaagctgctggtcgtggagttaacaatgacaagaaaggcggcggattaggagcttctttcatattcggagattctctagtcgatgccggaaataataattatctatcgacgttgtctagggctaatatgaagcctaatggtattgatttcaaagcctccggaggaactcctaccggccggttcaccaatggacggaccatcggtgatatcgttggggaagaactcggatcagcgaactacgcgatcccgttcttggcaccagacgcgaagggaaaagctttattagccggagtgaactatgcatctggaggaggaggaatcatgaatgccaccgggagaatctttgtgaatagattaggtatggatgtacaagttgatttcttcaacactacacggaaacagtttgatgatctacttggaaaagagaaagcaaaagattacatagccaagaaatcgatattctcaatcactataggagcaaatgatttcctcaacaattatctattcccactactctcggtaggaacacggttcactcaaactcccgatgattttattggcgacatgcttgaacatctacgcgaccaactaaccaggctgtatcaattggatgcgaggaagtttgtgatcgggaacgttggaccgattggatgcataccgtaccagaaaacaatcaatcaattagacgaaaacgagtgtgtggatttggctaataaactagcaaatcaatacaatgttcggttaaagagtttattagaggaactaaacaagaaacttcccggagcaatgtttgtccatgcaaacgtctacgatctcgtcatggagctcattactaactacgataaatacgggttcaaaagtgcgacaaaggcttgttgcggtaatggaggacaatacgcgggtataattccgtgcggaccgacttcgagtttgtgtgaagagagggataaatatgtgttttgggatccttatcatccgagtgaagcagcaaatgtcatcatcgcgaagcaattgttatatggtgatgttaaagttatatctccagttaatctcagcaaacttagagatatgtga

SEQ ID NO: 1748 - DNA, 8688 bp, Arabidopsis thaliana
atgcagttcaagtctgcttctcaacgaacaaatgacattgacaacatcagcaactataggaacttggataaggtgaaggctgagccttcagaaggatccacatttttcagggattgcctcatagaatggagggaactgaataccgcagaagatttcattttgttttatgaagagatgttgccatctgtccagagtttgagtttgattattatgcaaaaagaaagaatcttctcaaatcttgtctctcgattacaaatgaaagcaagattgtctctggaacccattctcaggttgattgctgctctatcaagagatctcttgaatgactttattcccttcttgccacaaattgtgaactccttcgtgactctcctaaataatggtgcgcataacgatccggagattattcagcaggttgttggtattcacatcatgggcttccataatagtgtccctgcagaagtatcttgtgtgcgacatcgaaggcattctcaggatgagcaacttgaaaaagtccccttgatacacagtctagttgattcttctaacctaaaaattacaggtatgaagatgatcctttctgaagttgcacatccatccaaaaaagctggaggagttggagtactatataatgttatgaggggcccttgtacagtcgtggaagttgtgagtttggttttgcagagaatatgcgaggatttggaagcagaaaaattaagtgctatgtgggaatacttgtataagaaaataaacaaatcaatctcaaacaagaaatcagttcatctaagccggctgttgagtgtgcttatggcggttgttaagattaaggaaggtcgcaaggttcacgatatcccatcactgattggaatcgtgagccgcattgtgtcaacttttttcacttcctctgagaccgctgtagaaggggataacttatctgctgtccttgatgaagttttggaattgatattatgcacaatcaacacggtcaatgaaatggaaactgttgcttcgctttgggctcccatttttgccttgaagagttcaagtttgctgacttttttgcgggagttcctaaagaaagatcaatcagtagtgaaagcctttacaaagaatatattatgtgcaattaacaacatgatttgggagtcttctgaggaagttattcctctgttactaacattgtgtgaagagcataagacacaacaaacaagtcacgacgtcgtgaacagcataagtcaaacatttgagagtagatacgagagaattcatgagttcttggaagcaaagattaaaaaggttcaacagaatattgagaatgctggattagctcaaattaatgaggccgagttggctgcaatttggggagttgtcaagtgttatccttattttaaagtggattcatcattattgatttgctttaagaaaactctcagacagcatttggcagtgtcagatggtaagtatcaactcatgattcactcttttttgcatagcttacttggtactactttgaggtcatgttacaaaatgacgggaatcaaccacagtgatctagaggaagctttgtcttttgctaaagattacaagtcatgtgagcaagtgttgtccccggtggccgatgttttggaatttatgcacaggctgattcatttccctattttgaatcgtaggcctgcattagctcatggtaggtctaagccttatccagaacttcaagcaaataaggctggagatgcttttgaaatattttctgaaaatttgcgtcatccgaacaaaaatatccgtcttatgactctgaggattttgtgccattttgaaactttgtcgtctgacccttcttttgaagagcatcctcctaagaagaaaatgaaaactgagaagaatgttcttcagttattactcttattcgaagagactgctcccacagtggatactagtcggatgttggcaggatacatttctacaatacaagataacctctccgctggcaggatacattcggcatatgtgaagcttgtattgaatgggatgttggggatattacatattagttatcgtcctttgtgtgttcaagcatctgagtgtcttgcggttcttgtgaggaaatatactggtgcagtgtggagtgattttgtttgttatttggggcagtgccaactaaaatttgaaaccctccatgatcatagtgagaatgcgaaccaaagtatgtcagagaggcatgcatgtaatttaaatctgaatggccgttttaatttgtttctctttccaccatctgctatcacgcctactgcaacggtatctgatgtggtatctcagttgctacagaccttacaaaaagcttcaagtgttgctcagtctcgggcttctgaaattctccctttgttgttaaaatttctgggatacaacagcgaaaatcctgggagtgtcggatcatataatggccgagtttgtaaaggagaggactggaagacggttcttgtacaatggttgacgttgctaaaattaatgaagaatcctaggttcctggatgataatgatgctgaaatccaaacgaatgttctagagtgccttctgttggcgaatgacttcttactcccacaccgccagcatttgttgaatttgatcaaaccaaaagaattgagagaagaactcacaacctggaacttgtccgaaaacatcggagaacctcacagatcttatattttttctcttgtaattcgcatccttatgccaaaagttaggacattaaaaaattcggcttcaaggaagcatacaagtatccgtcaccggaaggcagttctttgctttatatctcagctggatgttaatgaacttgcgttgttctttgcattgttgataaaacctttgaacatcatatcagaggaaacaatggactcattttggagttcaggcaaaagttctctcgactatttccaaaactccaattttctgaaatatttcactgttgatactatttcaacgttatccagaaatcagaaatttgggtttcttcatgtcatccaacatatccttgaagtctttgatgaacttcgtgtccgaccttttctagactttatgatgggatgtgttgtccggctattggtaaattatgctccaaatgttgatgaagaaatgaacattgattctttggcactaagaaatgtcactgctgccccatcaacttcggatgataaagaaaatgcttcaataaatcacgaccaggctggcactgcttttaagcagtttaaagagttgagatccttatgtctgaaaatcattgctcatgttcttgataaatacgaggattgtgatcttggctccgagttctgggacctcttcttttcagctgtgagtccgttaattaagagtttcaagcaggagggttctagtagtgagaaaccaagttccttgttctcatgcttcttgtcaatgagtaaaagccgtaatctcgtgaatctcttatgtcgggaagagtcccttgttccagacattttttcaattctaactgtcaccacggcttcagaagctataaagtcttctgccttgaagttcattgagaatctgctttgtcttgacaatgtgttgggtgaggatgaaaatatgatccgtggattcgtagatccgtatatagaagcactgattaacagcttgcattctcttttcattggggatattttgaaaaggaaatcagtcaagtatcatggggaaagagagattaaaattcttaaattattgtcaaagcgtatgcaagatcgctcccatgttatgaagtatttggatgtcttgctgtctttcttgaataaaagtgttaaagatcctggtatggtgtcattgcttttattgctaaatgatatccgtcgtgaagctttgctagccattcaggacatcatagcgtatcttgggatggagagtaccagcaagattataaatacagtctctcctctacttgttgatgctgaacttgatgttagattatgcatttgtgatcttcttgagtctcttgcaaaaatcgacttttcactggatgatgtgcgcacagaagctcttgtcttctttattgatttttcagcctcaatactttgccgagaagctccagctcactctgaatttggaaaagaggtcaaaaacgctgatgtaagctggacaggagatcgtgtactgtgcattttgagaaattttattttgaaacacattggagatgcaataaacagagggggcattataataaaggaatggattcttttgatacgcgagatggtgaccaaacttccagatgccgcaaatctttctgcattcagacctctatgctctgaagacgagaatgtagatttttttaaagctattgttcacattcaggcacaccgtagagctagggcaatttcacgtttcagtagtgtggttaaagatagcagtctgcctgagggagtagtgagaaaacttttggtctcggtctttttcaatatgttactcgaaggacaagatggaaaagataataatgtcagaaatgcatgcacagaagcccttgcatctatatctgctcatatgagttggacatcgtactatgctttactgaatcggtgtttccgagagatgaacaagcacaccaaaaaaggaaaaattctgctgcgacttatctgcttgattttggataaatttcattttgcaaaagatggctacccacatgaggctgaggaaattaggacttgccttcagaaaattgtgttcccgaggatgcagaagctgatgaattctgattctgataatgttaatgttaacagtagtgtggctgcgcttaaggttctaaagctactccctgaagatgtattggactcaaacctatcatctatagttcacaaaattgccagttttttaaagaaccggttggagagcacacgtgatgaagccagattggctctggttgcttgtttgaaagaacttgggctggagtacttgcaagttgtagtcaacattttacgtgctatcttaaaacgaggatctgaggtgcatgtgctggggtacactctcaattctatcttatcaaagtgcttgtccaatcctacatgtgggaagttagatcattgtttggttgatctccttgctgtggtggaaaccgatatccttggagaggttgctgaacagaaagaggtggaaaaatttgcatccaaaatgaaagaaacaagaaaacggaagtcatttgagactctgaaattgattgctgaaaatgtaacgttcagaagccatggattaaagttactttctccggtcactgctcagctgcagcggcatctaactccaaagatcaaaacaaatctggagaagatgttaaaacaaattgcagctggtattgaaggcaatacatctgttgaccaaggagatctttttctttttatatatggcctagttgatgatggtattaataacaggagtggtcttggagatcaagtgtctttaccaccctccaaaaagaagaagaaatcaagagatctgaaagagacttctgggttgtgttttggtccgaagtcatgtccacatcttataaccgtgtttgctctggacttattttataaccgaatgaaaaaattgagactcgacaacactgatgaagagctactgtcgaaatgttttacttcattagtaaagtttccactgccttccctcacgtctgaagcagatgaactgaaaacagcattgttaaccattgctcagtctgcagttagttccagcagtcctcttgtgcagtcatgccttaagctgcttacaacgcttctcaaaaatataaatataactttatcatctgagcagttgaaaatgttgattcagttccccatatttattgatctggagtctgattcatcctttgttactctttcacttctcaaggccatcatgaaccggaagcttgtagttccagagatatatgacattgcaattcaggtttcaaagctgatggtaaatagtcagttggaatcaatccgcaagaaatgtaaacatatactgttgcaatttatggtccactatacactttctgaaaaacgtttagagcaacatgtgaactttctgctggaaaatctgaggtatgagtttccaactggaagagaagcagttcttgacatgcttcatgccctaatcttaaaattctcagaacctaatcttggcaagcagtctgttcttgaccagcagtcgcaaaaattgtttattcaacttactgtctgtttgtccaatgaaactgatagaaaagtgctgcccttggttggtgctgtgatagaagttctgataggccgcatgagtaaagatcaacagaacttaagtgctgcggcggcacaggtattgggattttttatcagcgccatgaagaaaacatttcggaagcatatctacaatacagtggaggatgctagaactattttggagtctgcaattagtgcttccagcttacagttgcaagatactgttgaggaagccagtcttccgttctggaaggaagcatactactcactggttatgatagaaaagatgctagagcaatttcctgatttaagattcggaaaagatttagagacttctgagaagtacttgccttctgggagaaaaagaccagaatgtcgtacattagtagcggattctctcctagagaagccaagtagtctgttcatggtggctgtttctctttgcttccagttaaaggagcaacccaccacgggcaacattgatgttgatctcctcacagcaaatattgtttttgcggtctctagtcttcattctctgattggacaatttgatcaggcaacccacaatcggttctggtccagtcttggtgaggatgagcaagtggtattcctcaaagcctttgaagtgcttgatgcagggaaagggaggtctacttttttggctcttacctcaggcaaacgtactgagaatggtgatgatgatgtaagaaatgtaatgatcggaagtttgctcaaaagaatggggaagattgctcttgatatggagtctgttcagatgagagttatgttcaacgtctataaatcttttgcctcacaattgaatcaagaagaatgtcgcttatatgcctacaaaattctgcttccgttgtacaaagtctgcgaaggatatacgggaaaaatcgtcacaggtattataagttttttttctatgaaacaatcgtcatggggttgcacaatcttcatccaattatctctatgtctcatcatctatgtgtctctgcattcgggtcacccattcttcttctctagtgacgacggtgacaatgccacacctctagatcttcatttcatctccgttgccggcggtttcaggcctcttaaccaccaaactcgccttctccgattgatggagaaagttgcagaaacttacaaggccaaatttgttgtgagctcaagtgaacaaggagaagaagatccattcctgcaaaatgcgactcgactgtcttcttcactgaaacttccatggtatcttgatcctgtggaatggatccttttagttaacttaagttccgttgatgtaacaaggagactaatcactttgttgtgtattaggtacactagaatgaaaggatctggatatttcagagagcacatcaaaatgccttttggtggatccttggatgttgttttcgtagacactggctcactcaagcaggtaggatcagtttgtatctgtgagtttgatagaaatgtatttgaatgcctatatgatcagtcaattgaaagggttgacaaggattctaaaagcagtagacggagactggtaagttggcttttttcagcgatagattgtcttgatctctcatcaacttgtataaaataccgtctctgtcgttatttggtgaccaagcgtattgtggttggatcagacccgttactcgcctatactctaactaaggaaccagaggaacctaagagagtggcaaggacatttcatcaaatcatgaccaaatatggagtgaaagggaagatgggtttcttcttcacagagttagcttctcagagttttttctccgcgtttggtacatcaacacttgtagctgtgtatctttctaattcttcctttctttcgctgacagtgcttgctcacacactaatcgcaattgttgctgcattgccgactctgattcgttcgatttcagcattttgttcttccgaagcgatgcctcgtcgatccggagattgcatgagatgtctggtgattttcgcggttgtatcagctttagttgtgtgtggacctgctctttattggaaattcaacaagggtttcgttggatccacacgtgccaactctctttgtcctccttgcgtttgtgattgtcctcctcctttgtctcttctccagattgctcctgggctcgcaaatctctctattacagattgtggaagcgacgatccagagcttaaacaagagatggagaagcaatttgtggaccttctgactgaggagctgaagctgcaagaagcagttgcagatgagcatagccgtcatatgaatgttacccttgcagaagctaaaagggttgcatctcagtatcaaaaggaggctgagaagtgcaatgccgccactgagatttgtgaatcagctagagagagagctgaagctttgttgatcaaggagaggaagattacttctttgtgggagaagagagctcggcaatcaggttgggaaggtgagtaa

SEQ ID NO: 1749 - DNA, 1260 bp, Arabidopsis thaliana
atggctatgatatctcaccgtctccgacgagctttactcactgcgacttcctatgttaaccgatcaattagctcttcgatcacaccagcgtctgatttcccttctgtgtcggcggcggtgttaaagagatccgttatagggcgttcgacggaagtagctactcgagcaccggcgagactgttttcaacgaggcagtacaagctttacaaagaaggtgatgagatcacggaagacactgtgttgttcgaaggatgtgattataatcactggcttatcactatggatttctccaaagaggaaactcctaagtctccagaagaaatggtcgctgcttatgaagaaacttgcgcccaaggacttggcatcagcgtggaagaggctaagcaaaggatgtatgcttgtagcacaactacttaccaaggatttcaagcaatcatgactgaacaagaatcagaaaagttcaaggatctacccggagtggttttcatcttgccagattcctacattgatccccagaacaaagagtatggaggagataaatacgagaatggagtgataacacacaggccaccaccgattcagagtggcagagcaagacctcgtcctagatttgaccgttcaggaggaggaagtggtggtccccaaaacttccaaagaaacacacagtatggtcagcaaccaccaatgcaaggtggtggagggagctatggtcctcaacagggctatgccactccaggacaaggtcagggaactcaagcgcctccaccatttcaaggaggttataaccaaggcccgagatctccaccacctccatatcaggcaggttacaatcaaggccagggatctccagtgcctccatatcaggcaggttacaatcaagtccagggatctccagtgcctccataccaaggaacacaaagcagttacggtcaaggtggatctgggaactatagtcaagggccacaaggtggttacaaccaaggaggacctaggaattacaatccacagggagctggaaactttggtcctgcatctggagctggaaacttaggtcctgcacctggagctggaaatcctggctatggtcaggggtattctggaccaggacaagagcagaatcagacattcccacaggcagatcagaggaatcgagactggaacaacaataatccagcaggccagcccgggtctgaccaagtaagatctcgatcaataatgaatcttgcatctttcttttttgatatcctcatcaggcattaa

SEQ ID NO: 1750 - DNA, 1902 bp, Arabidopsis thaliana
atgtcttattactcctctttcttcttccttttcctcttctcctttctcacgagtttcagagtttctgctcaagatcccacttacgtataccacacctgtcaaaatacggcaaattacacaagtaacagcacttacaacaacaatctcaagacccttttggcttctctttcttcccgcaacgcttcctactccaccggattccaaaacgccaccgtcggccaagctccagacagagtcaccggacttttcaactgccgtggagatgtctcaacggaagtttgccgtagatgcgtctcctttgccgtcaacgacaccttaactcggtgtcctaaccagaaagaagccacactttattacgatgagtgtgtacttagatactctaaccagaatattctctcgacactaataaccaccggtggagttatcttggttaacacccggaatgtgacatctaaccaactagacctgttaagtgatttggttttgcctactctgaaccaagccgccaccgtagccttgaacagttccaaaaaattcggtacgagaaaaaacaattttactgcgttgcagagtttctatggactggttcagtgcacacctgatctcacgagacaagactgttcgcgttgtctccaactggtcatcaatcaaatacctactgacagaattggtgcaagaattattaatccgagctgtacttcaagatacgagatctacgcgttttacaccgaatccgccgttccaccaccaccaccaccaccgtcaatttctactcctccagtttcagctcctccgcgatctggtcagagctctgtttttttcctctcttgtttttcctgcttcaaagactttcattgtgtaacaggagatgatatcacaacagcagactcactacagcttgattatagaacaattcaaactgcaacagatgattttgtagagagtaataagattggtcaaggtggatttggtgaggtttacaagggtactttatcggatgggactgaagttgcggtgaagcgactatcaaagtcatcaggacaaggtgaagtagagttcaagaacgaggttgttcttgttgcaaagctacaacatagaaatctggttagacttcttgggttttgtctagacggagaagaaagagtactggtctacgagtatgtgcccaacaaaagtcttgattacttcctctttgaccctgcaaagaaaggccagctggattggactcgacgatacaagattatcggtggagttgctcgagggattctgtatcttcatcaagactcacgactcacaatcatacaccgtgacctcaaagccagtaacattctcttggacgcggatatgaatcctaaaattgcagattttggaatggctaggatctttggattggaccaaaccgaagagaacacaagcagaatagttggtacctatggttacatgtctcccgagtatgcaatgcatggtcagtactcaatgaaatctgatgtctatagcttcggagtgttagttcttgagattataagtggcaagaagaatagcagcttctaccaaacagatggtgcacatgacttggtctcatatgcttgggggctttggagtaacgggcgaccattagaactcgtggatccagctattgtagaaaattgccaaaggaatgaagttgttcgatgtgtccatatcggtcttttatgtgttcaagaagatcctgctgagcgtccgacgttgtcaaccattgttctgatgctcactagtaacactgtgactttacccgtgccacggcaacccggtcttttctttcagagtagaattggaaaagacccgcttgatacagatacaacgagcaaatctcttctagggtctgttgacgatgcatccatcacagatatacatcctcgatga

SEQ ID NO: 1751 - DNA, 1299 bp, Arabidopsis thaliana
atggctccactgagtccaagagtagtggtgaaggtggatttgaagaagaagccatggcagcaggaccagccattgcacaatagatggcatccggagataccaccagtagcagaggtcaaggctggtgagtttttccgggtagaaatgattgatgcaatgggaggtgttatcaaagacaatgactctgcaagcgatatcaagaacctagtcctaactactactcatcacctaagtgggccgattagggttgtagatgaggaaggtgttgcagctaaagcaggtgatcttcttgctgttgagatatgcaacttgggtcctcttccaggagatgaatggggattcactggttcgtttgatagagagaatggtggcggtttcttgactgaccatttcccttgtgcgaccaaagctatttggtactttgaagggatctatgcctactctcctcagattcctggagtacgatttccgggtttgacacacccaggagtcattggcactgcaccatcgaatgaactcttgagaatatggaatgatagggaaagacaattagaagaaagtggtgttgagtccctaacactatgtgagattgaagaaggaacaccagaatgggaaaggattgcaaacgaggctgcgaggacaataccaggaagagaaaacggaggaaactgtgacattaaaaacctaagcagaggctctaaaatatatcttccagtatttgttgaaggggctaatctaagcacaggagacatgcatttctcacaaggtgatggtgagatctcgttctgcggagccatcgagatgagtggatttctagaactcaagtgtgaaatcataagaaatgggatgcaagagtaccttacgccaatgggacctacccctctccatgtaaacccaatctttgagataggaccagtggaaccgaggttctcagagtggcttgtcttcgaaggtatcagtgtcgatgagagcggaaaacagcattacctagatgcaacagttgcttacaaacgggcagttctcaacgccatagactatcttttcaaatttggttactcaaaagaacaggtgtacctcttactctcatgttgtccatgtgaaggaagactatctgggatagttgattctccgaatgccgttgctacactagcaatacctacagccatctttgatcaggatattaggccaaagaatcggaaggttccagtaggacctcgggttgtgaggaaaccagatgtactgaagagcacatatgatggaaagcttccaattacaaagaatccaagttcttcctcttag

SEQ ID NO: 1752 - DNA, 1266 bp, Arabidopsis thaliana
atggagggaagcccagtgaccagtgtcaggctctcttcggtggtgcctgcttctgtggtaggtgagaacaagccacgacagctcacacccatggacttagccatgaagctccactacgtccgagccgtctacttcttcaagggtgcacgtgacttcactgtcgccgacgtgaagaacaccatgtttactctacagtctctactccaatcttatcaccacgtctcaggtcggatccggatgtccgacaacgacaacgacacttcagctgcagccataccttacattcgctgcaacgacagtggcatacgcgtggtcgaggccaacgtcgaagagttcacagtggagaagtggctcgagttggacgaccgttccattgaccaccgattccttgtctacgatcacgttcttggtcctgatcttaccttctcgccactcgttttcctccagataactcagtttaaatgtggtgggctctgtattgggttgagttgggcccatattcttggagacgtgttttcagcatcaacgttcatgaaaacacttggacagctggtatcgggtcatgccccaacaaaaccggtttacccgaaaacccccgaactaacctctcatgctcgtaatgatggtgaagctatttccattgaaaagatagattcggttggcgagtattggttacttaccaataaatgcaagatggggagacacatttttaattttagcctcaaccacattgatagcttgatggccaagtacaccacgcgagaccaacctttctcggaggttgatattttgtatgcattgatatggaagtcgctactgaatatccgcggcgaaacaaacacgaatgttataacaatttgtgaccgtaaaaagtcttcaacctgttggaacgaggacttggtaataagcgtagtggaaaagaatgacgaaatggttgggatatccgaactagctgcactgattgctggtgaaaaaagagaagaaaacggtgcgatcaagaggatgatagaacaagataaaggctcttcggattttttcacgtacggtgcaaatttaacgtttgtgaatcttgatgaaatagatatgtatgaacttgagatcaacggagggaagccggatttcgtaaactacacgattcatggggtcggagacaaaggtgttgttttggtttttcccaagcaaaactttgcaaggattgtaagtgtagtgatgcctgaagaagaccttgcaaaactcaaggaggaggtgactaatatgattatataa

SEQ ID NO: 1753 - DNA, 1332 bp, Arabidopsis thaliana
atgggtcaaggaccttccggcggattgaatcggcaaggagatcggaaaccagatggtggagagaagaaggagaagaagttcgaaccagccgcaccacctgctcgtgtagggaggaagcaacggaagcagaaaggacctgaagcggcggcgagattgccgacggtgactccttctactaaatgtaagcttcgattgctgaaattggagcgaatcaaggactatttgcttatggaggaagagttcgtagcgaatcaggagagattgaaacctcaggaagagaaagctgaggaagatagatctaaagttgatgatcttcgtggtacacctatgagtgttggcaatcttgaagagcttattgatgagaatcacgccattgtttcttcttcggttggtcctgagtactacgttggcattttgtctttcgttgataaggatcagcttgaacctggctgctctattttgatgcataacaaggtactctctgttgttgggattcttcaagatgaagtggatccaatggtgtctgtgatgaaagtggagaaggctcctttggagtcatatgctgacattggaggtttagaagctcagattcaggagattaaggaagctgttgagttacctttaacacatcccgagctgtatgaagatattggaattaagccaccaaaaggtgtgatcttgtatggtgagccaggcactgggaagacattgcttgctaaggcagtggcaaattctacttcagctactttcttgcgtgttgtcggtagtgaactgattcagaagtatttaggagatggtcccaagcttgtgagggaacttttcagggttgctgatgacctttctccttctattgttttcatagacgagattgatgctgttggcaccaagcggtatgacgcaaactcaggtggggaacgtgaaatccaaagaaccatgttggaactactgaaccagcttgatgggtttgattcaagaggagatgttaaggttattctcgcgacaaacaggatcgagagtcttgacccggcacttcttagaccaggccggatcgacaggaaaatcgaattccctcttccagatatcaaaacaagaagacgtatcttccagatacacacatcaaagatgactttggctgaagatgtgaacttagaagagtttgtaatgacaaaagacgagttctcaggagctgatataaaggcaatatgcacagaagctggtctgcttgctcttagagagcgtcggatgaaagtgacgcatgtggacttcaagaaggcgaaggagaaggttatgttcaagaagaaagaaggagttcctgaaggtctttacatgtga

SEQ ID NO: 1754 - DNA, 1626 bp, Arabidopsis thaliana
atgagaggttcttgcaaagtctctatagttcttcttctggttttaatcaatggtgtgcttggagataacccttatagattcttcacctggaaaattacttatggcgacatttatccccttggtgttaaacaacagggaatattgataaatgggcagtttcctggacctcacattgacgcaatcacaaatgataatatcattatcagtgttttcaattacttgaaagagccttttctcatttcttggaacggagtgcaacagaggaagaactcatggcaagatggagtcgtagggacaacatgtccgattccaccaggcaaaaacttcacttatgtaattcaagtcaaagatcaaattggtagcttctactatttcccttctcttgccttccacaaagccgctggtgcatttggagccatccgtgtctggagtcgtcctcgcatccctgtcccgttctctccccctgacggtgatttctggcttctcgccggagattggtacaaaaccaatcactatgttttgagacgtctactagaagccggaaggaatctaccgaatcctgatggagttctcatcaatggtcgcggctggggaggcaataccttcaccgttcaacccggtaagacctatagattcagaatatcaaacgttggggtcgcgacttcattaaacttcagaatccaaggacacacgatgaagctcgttgaagtagaaggctctcacactgttcaaaacatctacacttcacttgacattcatttaggacagtcttactctgttcttgtgacggctaaccaagctcctcaagactattacatcgtcatctcctcgaggttcacgcggaaagtccttacaacgacttcgattctccattacagtaactcgagaaaaggcgtatctggccctgttccaaatggtcctactttggacatcgcatcttcactctaccaagctcgaactatccggagaaatcttacagcgagtggtccgagaccgaatccgcaaggctcgtatcattacggtttgatcaaaccaggccgtacgatcatactcgccaactcagctccttggatcaacggcaagcaaaggtacgccgtgaacggtgcctcgtttgttgcgcctgacacaccattgaagctcgccgattacttcaagattcccggagtttttaacctcggaagcatcccaacgagtccctctggtggaaacggagggtatcttcaaagctctgttatggccgctaactttagagaattcatcgaggttgttttccaaaactgggaaaattcagtccagtcttggcacgtctccggttactctttcttcgtcgtcggtatggatggaggacaatggactcccggaagccgagcaaagtacaacctgcgggacgcggtttcacggtccaccgttcaagtatatccgagggcatggacagcgatctacatagcgttggataatgttgggatgtggaacataaggtcggagaattgggcaagacagtatttggggcaacaattctatcttcgagtttacacttcctctacttcgtaccgagatgaatatccaccaccaaagaacgctcttatgtgcggacgagctaaaggccgccacactaggccattctaa

SEQ ID NO: 1755 - DNA, 2559 bp, Arabidopsis thaliana
atggtggacgctgttgtaacagtgtttttagagaaaaccttgaacatcctcgaagaaaaaggccgaaccgtatcggactaccgaaaacagttggaagatttgcaaagcgaattgaaatatatgcagtcttttctcaaggatgcagagaggcagaagagaactaatgaaacgttgcgtactcttgttgcggatttacgagaactggtttacgaagctgaggatatacttgtggattgtcagctcgcggatggtgatgatgggaacgagcaaaggtcatcaaatgcgtggctttcgcggcttcatcctgcccgggttccgttgcagtacaagaaaagcaaacgtttgcaagagatcaatgagaggataacgaaaataaagagtcaagtagagccttatttcgaattcataacgccgagtaatgttggaagagataatggaactgatcggtggagctctccggtgtatgatcatactcaggtggttggtttggaaggagataaaagaaaaatcaaggagtggctctttcgatcaaacgacagccagcttttgataatggcctttgttgggatgggagggctaggtaaaactacaatcgctcaagaagtgttcaatgacaaagagatcgaacatcgtttcgaaagaaggatatgggtgtctgtgtcccagacttttactgaagaacagatcatgagaagcatattgaggaacttgggggacgcgagtgttggagatgatattggaacattgctgagaaaaatccagcagtatcttttggggaaaaggtacttgatagttatggacgatgtatgggacaagaatttgagctggtgggacaagatctaccaaggactgcctagaggacaaggaggtagcgttatcgtgaccacaaggtcggaatctgtagcgaaaagggtgcaagcgagagacgacaagactcaccgtccagagctccttagtcctgataacagttggctgctgttttgtaatgtggcatttgcagcaaatgacggtacttgtgagcgtcccgagctagaggatgttggcaaggagattgtaacgaaatgcaaaggtttgcctttgacaatcaaagcggttggtgggttacttctgtgcaaagaccatgtctatcatgaatggagacgaattgcagagcattttcaggatgagctaagaggaaacacttctgaaactgacaatgttatgtcttctctgcagttgagctacgatgaactcccttcccaccttaagtcgtgcattctcacgctttcgctctatccagaagactgtgttataccaaaacaacaactagtacatggatggatcggagaaggttttgtcatgtggagaaacggaagatctgcaactgaatctggagaagactgcttttccgggctcacaaacaggtgtctaatagaagttgtagacaaaacctatagcggaaccatcatcacttgcaagattcatgacatggttcgtgatttggtgatcgatatagccaagaaggattcgttctctaacccggaaggcctcaactgtcgtcaccttgggattagtggaaactttgatgagaagcagatcaaagttaaccataagctgagaggcgtagtgtcaacaactaagacaggtgaagtgaacaagctcaactcagacttagctaagaaattcacagactgcaaatatcttcgggttctcgatatctcgaaatccatatttgatgctcctctgtctgagattttggatgagattgcaagccttcaacacttagcatgtcttagtttgagcaacacacatccgttgatccagtttcctcgttccatggaagatctccacaaccttcagattctagacgcaagctactgtcagaatctgaaacaacttcaaccttgcatcgtcttgttcaagaaactccttgtacttgacatgacgaactgtggatcccttgaatgcttccccaagggtatcggaagtctcgtgaagctcgaagttctgttgggatttaagccagccaggtccaacaatgggtgcaagctcagtgaagtgaaaaatctcacaaaccttcggaaacttggtctttctctgactcgtggcgatcagatagaagaggaggagcttgattctttgataaacctaagcaagctgatgtccatttcgatcaactgctatgatagctacggcgatgatctcataaccaaaatagacgcccttactcctccacaccagctccatgagctttctctacaattctatcctggaaagtcgagtccatcgtggttgagtcctcacaagcttccgatgttgaggtacatgtcaatatgttcaggtaatttggtgaaaatgcaggaaccattctggggaaacgagaatactcactggagaattgaaggtttaatgttaagttcattgtcggacctagacatggactgggaagtgctgcaacagtcaatgccgtacctgaggaccgtgaccgcaaactggtgtccagagctagagtctttcgcgattgaagatgttggctttagaggcggagtgtggatgaaaacaccattgcacagaacctga

SEQ ID NO: 1756 - DNA, 2553 bp, Arabidopsis thaliana
atggaaacatcatcaatcgaaatcaacgagcttccattagccaccaaaacccaaacacctcctgcttccgtcgagccaattccaatggagacatcatcaatcgacgagcttccatcgtccgattcgaatgcaacggataacattgaagctgttggtgagaaacggaaacgcgccgatgaagacgagaaaaccaatctcgaatcgtcagacacgaagattactactccttcaccgtggtggaagacgagtctctgttcttactttaggcgtgaggcttcgtgtagtcatggaaacgaatgtaaatacgctcacggtgaagcggagctccggatgaaaccggataatacttgggatccgacttctgagcgtggaaagaaagccaaggctatgaagatgtctgagcatgaagagaaagaagaagacgaggttttgtttactgagcagatgatggaatcaattgatggtgatgaaggaggtggtggtagtgttagtgttgttgatttgtcactaagtaaatgtttggtgcatttacctaataaatggcaatctgatgaattgaagaaatttttaggagaacagggagttctatataagtctgcaaagaaaagaagaggaatgattgttggttttgttacatttgagaatgcagaacaattgcagagtggcgtggagagaatgttgtatcgtaatgtgtttaatgtattgcagattttggatggaaaaactgttaatagcagtaatttgaagattgctgatgttcttccgcgtacatttgacaagaatgatgcaagaaaatcggttaaaagtgctcgtgacgctgtgactcccttggcttacttgtcttatgctgaccagcttgaacaaaaaaagacttctataggccaaatgctgaaaaaacttgtgaggagctttgtattcttgtttgaattggtgcgaggaatgcgcgtaaagcttgtccaaatgggaattcacttccacaatgggtccttacatcgagagacagagggcattatagaatcaccgattacaaatggctacaggaacaagtgtgagttctcggttggattatctcttcaggggaagccaactgttggattcagtctaggaagtttttgtgcgggtgtgacagcagtcgaggagcctgtggattgccccaacgtctccaaaattgcttctcaatatgcttcaatatttcagaagtttatagaaaattcaaaattccaagtttggaataggtttcaacatagtgggttctggcggcaattgacggttcgagaggggagaaaacccggcgtgttttcaaatgatgaagatgctattacaagaatcgcggaggttatgcttatggttcaggtttgtgtcttgaatggtaaagtggccactgagtttgaagaattggcgaaagcgtttgctgaaggagctagagcaagctctcctactcttcctctgactgtattagttgttcagaatcactcaggaatatcaaatgttgcaccacctgatgctccactgcaagtgctggctattccaatttcagataatgggacagatcaggagcaaaccaccaatgtcttgactgaagctcggattcatgatcacattaacaaccttcggttcagcatatccccaacagcattttttcaggttaataccgtcaccgcagagaagttatactcaattgctggagactgggctgaccttggtcccgacactttgctcttcgatgtatgctgtggaactggaacaattgggcttacactggcacatcgtgttggcatggtaattggcatagaaatgaatgcttcggctgtagcagatgccgaacggaatgcaacgatcaatggcataagcaactgcaagttcatctgctcaaaggcatgcattttgacagtaacatatttcgtagttggttccattgtcttaatctgtcttcatggtagttctgttggctttgttgtacaggcagaggatgttatgagctctctacttaaacagtacctagatgtgactcaaatggaagaagctaagcctctaagtaatgctaacgatgatctcaacaaacaaattccctcaacagaagaaatgacaaactcagagcatgtagctgatcaaaacctacctccttcaaacactcaagtggaagaacttcaagacaatgagcagaaggattcctcgtccttagaaccggaaaaaactacaaaaccacagttcaaaaatgtggttgctatagtcgatccacctcgctctggacttcatccagctgtaatcaaagctctaagaacccatccccggttaaagagacttgtgtacatttcgtgcaaccctgaaacgctagtggcaaacgcgatagagctttgcacgccatcttttgatgaaccggatagaggaaacaaaaattacagagggcgcaagaaaataggcattgccgctttggctcgacatagagccaagtcaatgccaacttctgaggcttttagacctgtcaaagcaatggccgttgaccttttcccccacactgaccactgcgaaatggtaatgctccttgagaggtaa

SEQ ID NO: 1757 - DNA, 1341 bp, Arabidopsis thaliana
atggaactcaataaggatcagacagtcatgtcggaggataaaaagcctcaagatccaaatcccagatttgcttgcgaaggttgcagcgttctgctcgacatcaacgatggtgaccgtctcgtcttcgctcgtttatctagtggcgctatattaaaaattgggaataagaattattctttaaagccattgatcggagctccgtttggatctctgttccaagtcgaaaccggagaagatggttctttcctctctcgcattcttcccattaaacaagaaagtaacagtaataatgttatggacgattcgagagataatcgagaaatcgtcgacaataatgaagctcagaatcttactggtgaagaaattgaagctatgcggagagagggtgcaaaaggggatgaaattattgaagctctaattgcaaacagcaaaacttttgataagaagtttcagttgtctcaggaaaaatataagcttaaaaagcagaagaaatatgcaccaaagctgcttcttcgacggccttttgctcgaagtatatgtgaagcttatttcaagaaatacccagccagaattggattcttacgagtagatgcgttatctcttctgttaacgatggctaatgtcactgcatactcggatgtgcttgtggtggatatggttggtggccttgtcactggtgcagtggctgaaagattaggaggcactggttatgtttgcaatacatataagggaagttctccttatcctgtggagatggtaaggatgttcaactttagtgacaaggttttaaagaggatcgtgcagtcatcgataaacgagctctcgtcagccaaaactgcgtctactgaaggaaacaatcaacaagaaggagtttgcaaagctgagaacaatattaatgaaacagctacatctgatgttatggttgaagaaatatctgtgacaactgaggctggagtagtagatattgttgtaccagagagcaaaattatcaaagccgcaaaagctggagccaaagcttcaaaagaaacaatagagatgtggcaagaaaacggtttttcgagtctaatcatggctgcgcaagaccaagacccatggatcgtagctaaggatgtattgccactactgtcctactctgctccttttgcaatatatcatcagtatttacagccgctggcgacatgtatgcacaagcttcaacagggtaaaatggcgatcaatctgcaaataacagaaccatggctacgcgaatatcaggtgcttccttcaagatctcaccctcacatgcagatgagttcttttggaggctatgttctgagtggcatcagaatctctaccacttga

SEQ ID NO: 1758 - DNA, 1260 bp, Arabidopsis thaliana
atggcgtttcataacaatcactttaatcatttcaccgaccaacaacaacatcagcctcctcctccgccgcaacagcagcagcaacaacattttcaagaatcagcaccccctaattggctcctccgctccgacaacaacttcctcaatctccacacagctgcctctgccgccgctacaagctccgattctccttcttccgccgccgctaaccagtggctctcacgatcctcatccttcctccaacgaggcaacaccgcaaacaacaacaacaacgaaacatccggtgacgtcatcgaagacgttcccggcggagaggagtcaatgatcggagagaagaaggaggcggagaggtggcagaatgcgagacacaaggcggagatactgtctcatccactatacgagcaacttttgtcggcacacgtggcgtgcctgaggatcgcaacgccggtggatcagcttccgaggatagacgcacagcttgctcagtctcaaaacgtcgtggctaagtactcaactttagaagccgctcaaggactcctcgccggcgatgacaaggagcttgaccacttcatgacgcattatgtactattgctttgctctttcaaagaacaactgcaacagcatgttcgtgttcatgcaatggaagctgttatggcctgttgggagattgaacagtcgcttcaaagttttacaggggtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagatatatggagtcattaaatttggagggttttctttatgaagcaatgcaggtgaaaacagcggaagagaccgttgagatcaagcttgcatgtagagatccaaaagctttatag

SEQ ID NO: 1759 - DNA, 477 bp, Arabidopsis thaliana
atggctttctgtaacaaactcggtggtctattgagacagaacatttcttctaacggaaatgttccggttacgtctatgctcggatctctccggttgatgtctaccaagcttttcatcggaggtctctcatggggaaccgatgacgcatccttaagggatgcttttgctcacttcggtgacgttgttgatgctaaagttatcgttgatagagagacaggaagatcaagggggtttggatttgtcaacttcaatgatgagggtgctgcaactgctgccatatcagagatggacggaaaggaactgaatggtcgtcacatccgagtgaatcctgctaatgatagaccaagtgctccacgggcttatggaggtggtggtggatacagtggtggaggtggaggctacggaggaggtggtggtgggtacggaggaggaggtggtggctatggaggaggtggtgatggtggtggtggtttctaa

SEQ ID NO: 1760 - DNA, 1374 bp, Arabidopsis thaliana
atggcgtctcttagccaaatcaccctgccacgcgcgccgtcgtcggagattggcctcttacgccgtcgattggagcggccgatcatcagaacccggatcggattcaacggccggattgcgagcgtattgactaacgcaggggaccaagcggtgtcggtaaaagcgagtgtgagccagaaggtgattgaagaggaagccaaagttattgtgggtacctacgcgcgagctccagtggttctctcgagtgggaaaggttgtaaattgttcgaccctgaaggaaaagagtatctggattgtgcatctggaatcgctgtgaatgctcttggtcatggagatcctgattggcttcgagctgtcactgagcaagctggtgttcttgcccatgtcagcaatgtttattacacgatccctcagatagagctcgcaaaacgcttggtggcgagttcttttgcagaccgtgtattcttttgtaactcgggaacggaagccaatgaagcagccattaagttttcaagaaaattccagagattcacccatccagaagacaaagaagtcgcgacaggtttcatcgcctttacaaacagcttccatggaagaaccttaggagctcttgccttgacaagcaaagaacaatacagaactcctttcgaacccatcatgcctggtgtaaccttcttagaatatggtaacattcaagcagccacagaccttatccgctcaggtaaaatagctgcagtttttgtggaaccaattcaaggagaaggcgggatttactctgctacaaaagagtttctgcaatctctgcgctctgcttgtgatgccgctggatctcttctcgtcttcgatgaggttcaatgtggtttgggtcgaacgggtctcatgtgggcttatgaagccttcggtgtgactcctgacataatgacggttgcaaagcctttagctggtggtttacctattggagcggtgctggtgactgaaaaggttgcagagaccataaactacggagatcatggaagtacatttgcaggcagccctcttgtgtgcagtgcagccattgcagttatggataaagtatcgaaaccctctttcttgtccagtgtctcaaataaaggtcgatactttagagacctgttggtgaaaaaacttggaggaaactcgcacgtgaaggaagtgagaggcgaagggcttatcataggagtggagctcgatgtgccggcaagctcactggttgatgcttgccgagattcgggtcttctgatcttgacagcggggaaaggaaatgtcgtcaggattgttcctccgttggttatatcagaggaggaaatcgaacgtgcggttgagatcatgtctcaaaatttgactgcgcttgattga

SEQ ID NO: 1761 - DNA, 3165 bp, Arabidopsis thaliana
atgggtacggagaatcagggctatccaaattttccagctaggcctgcttcctctccatttgcatctgctccgccaccagggattcctcctcaatcaggtggaccacccactggatcagaggcggttggctttagaccttttacaccatctgcatcccaacctacaagacctttcactgcctctggtcctcctccggctccaccagtgggtacgatgaggcctggccagccgtctccttttgtttctcagattcctgggagtagacctccaccgccatcatcaaattcgtttccttcaccagcatatggtcctcctggtggtgccccttttcagcgttttccatccccgccattcccgactacacaaaaccctcctcagggcccaccaccacctcaaactcttgcaggtcacttatctcctcctatgtctcttcgcccacagcaaccgatggcacctgtagcaatggggcctccgccacaaagtacgacttctgggctacctggagcaaatgcttatccccctgctacagattatcatatgcctgccaggcctggttttcaacagtcaatgcctccagttactccgtcttatcctggcgtgggcggttcgcagccatcttttcctggttatcctagcaagcaggtcttacaggctccgacgccattccagacatctcaaggtcccccaggaccccctccagtctcatcatatcctcctcacacaggaggttttgctcagcgaccaaatatggcagcacagcagaatctgcatccaaactatgcacctcctcccagtaacgttcaaggcttgactgaagattttaactcgctatctctttcatctattcctggatcgctggaaccaggacttgatcataaatcattcccaaggccattggatggtgacgtggagccaaattcatttgctgaaatgtacccaatgaattgccattctagatatctacgactgacgactagtgctataccaaattcccagtctctggcttcaaggtggcatttacctctaggagctgtggtttgtccacttgctgagactcctgaaggggtaccacttattgattttggctcaactggcatcatccgctgcagaagatgccgtacctatgtgaatccttttgtgacttttacagattctggaagaaagtggcggtgtaatatatgttcgatgcttaatgatgtgcctggtgaatacttctcacatttggatgctactggccgaagaatggatatggatcaacgacctgagctgactaaaggcagtgttgaaatcatagctccaactgaatacatggttcggcctccgatgccacctatctacttcttcctcattgatgtttcgatttcggctactaaaagtggaatgcttgaggttgttgctcaaacgattaagtcttgtttggataacctgcctggttatccaagaactcaaattggatttattacttatgacagcacgttacatttttacaacatgaagtcatctttgagccagccgcagatgatggttgtatcagatctagatgatatctttgtcccattgccagacgatctgcttgtaaatctatctgaatctagaactgtggtggacgcctttttggacagtctacctttgatgtttcaagataatttcaatgtggaatcagcttttggcccagccctcagagcggcgtttatggttatgaaccaacttgggggcaagttactaattttccagaactcattaccttctcttggtgctgggaggttaaagttgcggggagatgatcctcgtgtctatggaactgacaaagaatatgcattaagggtagctgaagatcccttctataaacaaatggctgctgattgtaccaagttccagataggaattaatgtttatgcattcagtgataagtacactgatattgcctcattagggactctggcaaaatacactggaggacaggtgtactattatccaggtttccaatcatctgttcatggagataagttaagacacgagcttgctagagaccttacaagggaaactgcgtgggaggcggttatgcgaataagatgtggaaaaggaattcgtttctcgtcctaccatgggaacttcatgctaaggtctactgacctgcttgctcttcctgctgttgactgtgacaaagcgtatgcaatgcagctatctcttgaggagactttgctaacatcccagactgtgtatttccaagtggctttgctatataccgcctcttgtggagagagacgtataagggtacacacatctgttgcaccagtggttacagatcttggggagatgtatagacaagcagacactggttccattgtgtctttatatgctagattagcaattgagaaatctttgtccgcaaaattggatgatgcacggaatgcaatacagcaaaagattgttaaagccctcaaagaatatcgtaatcttcacgcggtgcagcatcgcttggggtccagattagtatacccagagtctctgaagttcttgccattgtacggattggcaattactaagtccactcctcttctaggtggacctgctgatacttctcttgatgagcgctgtgctgcaggcttcaccatgatggctctgcctgtcaaaaagctattgaagcttttgtatcccaatttattccgtgttgacgaatggctcttaaaggtttgtgtatttttatctcaatgtccattatcaaacatcagtgttcaagaaataccatcagcagcccacgatgactttaaagacgtattaaggagattgccgctggctgcagagagtttggattctagaggcctttacatatatgatgatggttttcgattagttttgtggtttggccggatgctttcacctgacattgctaaaaatcttcttggggttgactttgcagcagacctctcaagggttacctttcaagagcaagagaatgggatgtcaaagaagctaatgaggttggtaaagaaactgagggagagtgatccttcatatcaccccatgtgttttctagtgagacaaggagaacaaccccgagaaggcttccttctcctcagaaatctcattgaggaccagatgggcggttcgagtggttatgtcgattggattctacaacttcaccgccaagttcaacaaaactaa

SEQ ID NO: 1762 - DNA, 1599 bp, Arabidopsis thaliana
atggcgtttgcgatatcaaagcgaaacgcaaccttgtttcttgtaacgctactactaatctccgttccattgtcttcctccacgctacaacaagatttcgtgaagtgccttgtcgacaactccgacgtctccttccccataacggcgtcgtttttctcaccggaccaaaacgctactttgtttaaagaggagcttgaatcaacggcacagaatctccgttacttgacgccgtcaaacccgaagcccgtgttcatattcgagcctttgtacgagacgcatgtccaagcagcggtcgtgtgtgccaagaagcttcagcttcacctccggctacgtagcggtggtcacgactacgaagggctctcgtttgttgccgaggacgaaacgccgtttgtgatcgttgatttgtcgaagcttagacaggttgacgttgatttggacagtaacagtgcgtgggctcatgctggtgctaccatcggagaggtttattacaggatccaagagaaaagccaaacccatggttttccggccggtttatgctcaagccttggcatcggtggccacttagtcggtggagcgtacggttccatgatgaggaagttcggtctcggcgctgacaatgtcctcgacgccagaatcgtcgacgccaacggccaaatcctcgatcgcgcggcaatgggagaagacgtcttctgggcgattcgcggcggcggcggtggtagcttcggcgtgatattggcctggaagattaagctcgtccccgttccggcgaccgttacggtattcacagtcacgaagacgcttgagcaagacggaactaaagttttatacaaatgggaacaaatcgctgataagcttgacgatgatctcttcattcgcgtcattatttcaccggccagtaaaaccaccaaaccgggaaatcgaaccatctcgatgtcgtaccaagctcagtttctcggagactccaatcggctcttgcaggtgatgcagaagagtttccctgagttaggactgacgaagaaggactgcacagaaatgagctggatcaaatcagtgatgtacattgcaggttttccaaacagtgcagcaccggaagctttactagccggaaaatcattgttcaagaatcacttcaaagccaagtcagactttgtgaaagagccaattccagtagaaggtttagaaggattatgggaaaggtttctagaagaagattcaccgttaacgatatggaacccttacggaggaatgatgtcgaggatctccgagtcagagatacctttccctcataggaacgggacattgttcaagattcagtggctaagcacgtggcaagatgggaaagtgagcgaggaaaggcatatgaagtggattagggagatgtatagttacatggagcagtatgtgtcgaagaacccgagacaggcgtatgtgaattacagggatcttgatttggggactaatgaaggagagactgatgctagagagtggggtgctaagtattacaaagggaatttcgagaggttggtgaagattaagggtgagtttgatcctgataatttcttcaggcatgaacagagtgttccgacaaagattggttga

SEQ ID NO: 1763 - DNA, 1776 bp, Arabidopsis thaliana
atggaaactgtagaagcggggcatgatgatgttattggttggttcgagcatgtgtcggaaaatgcctgcaaggtccaaagcgagacgctacgaaggattcttgagctcaactccggagtggagtatctgaggaaatggcttgggactgttgatgtagaaaagatggacgattatactttggaaactctctttacttccttggtgcctattgtttcacatgctgatttagatccttatattcaaagaattgcagatggagagacttctccattacttacacaagaacccatcactgttctgtccctcagctctggaacaacagaagggagacaaaagtatgttccgtttactcgccatagcgcgcaaactactcttcagattttccgattatcagcggcttacagatcaaggttttatccaataagggaaggagggaggattcttgagtttatatacgccgggaaggaatttaagacgctaggaggattgacagtaggaacggccacaacacattactatgcgagcgaagagtttaaaactaagcaagagacaacaaaatccttcacttgtagcccacaagaggtcatctcaggaggtgatttcggtcagtgcacgtattgtcatctcctacttggtctccattactccagccaagtagagtttgtcgcctctgctttttcttacaccattgtccaagctttctcctttttcgaagaaatctggagagagatatgtgctgacatcaaggaaggtaatcttagctcaagaatcactctgcccaagatgagaaaagctgtattggctctgatcagaccaaacccgtctcttgcttctcatatcgaggagatctgcttagagctggaaacaaatctcggatggttcggtttgatttcaaagctttggccaaatgcaaaatttatctcctcaatcatgacgggttctatgctgccgtacctgaataagctgaggcattacgctggcggtttgcccctggtgagcgcagattacgggtcaaccgagagctggattggtgtgaacgttgatcctcatcttcccccagaagacgtgagctttgctgtgattcccacttttagttacttcgagtttataccactttacaggcggcagaatcaatcagacatatgcattgacggtgactttgtcgaagataaacctgtgccgctctctcaagtcaaactcgggcaggagtatgaacttgttctaaccactttcacaggtctttataggtacagattaggagacgtagttgaagtgaccagttttcacaaaggcacaccgaagctaagtttcatatacagaagaaaactcatcttaaccatcaacattgacaaaaacacagagaaggatcttcagagagttgttgacaaggcgtctcagcttctgagccgatccacacgagctgaagtcgttgactttacaagccacgcagacgttatagctcgtcctggtcactatgtaatctactgggaaatcagaggagaagcagatgataaggctcttgaagaatgttgcagagagatggatactgcttttgtggactatggttatgtagtgtcgaggcgcatgaactcgatcggaccgcttgagctacgagttgtggaacgaggaacgtttgggaaagtggcggaaaggtgcgttgggaaatgcggtggcttgaaccagtttaagactcctaggtgtacgaccaattctgttatgcttgacatacttaatgattctactatcaagagatttcgcagttcagcttatgactag

SEQ ID NO: 1764 - DNA, 1872 bp, Arabidopsis thaliana
atgagttcgtggagcaagagctttaccaggctcgtcaatggtgtttcgcttgtagcgaaagagatctataatcagtcaccggagttacaaagagcgagaaatggagatctcgaaggtttaataacgtcttcagggaaaaaagctttggttgccgccaccgacttagtcggacttacctccgggaagcttcgcgaactctcgattcgtcgatctaaggaaccttccgttgtttatttcgacgaaggagataataaggataacgtcgtcgcaacgcctgaggttagatctgttaacaccaaacctagcgagaaaatcgttgattcgaaagtcctgagaaatgaatttagcgatgaagttaagaattcaaatagagaaggtgagattaaggtttcaggcgttgaagcgggagagattattggagttagagctgttgaatcaggtacggtaacggaagcatcatctccgtcggaggtagtacctccggtgaagagacggagacctagagagaggaaggttccttcaactcctatggcaagagcttatgggttttttaatttaggagctgctcttgcttggggagctgttaaagaatctacgtataggatggtaaatgggacaccaatgacaccagacaatcagcctgcgttatcgtctttgatgtctaaggaaaatgctgaaagattggctcttggattgtgtgaaatgcgtggagctgctcttaaagttggccaaatgttgagtatacaggacgagagtctcgttcctgctccgatcttgaatgctctggaatatgtgcgtcaaggtgctgatgtgatgccaaggagtcaacttaatccagttttggatgctgagttaggttccaattggcaatccaagttgactagttttgattatgaaccgctagcggcagcgagtattggtcaggtgcacagagctgttactaaagatggattagaagttgcaatgaagattcagtaccctggcgttgccaacagcattgaaagtgatattgaaaatgtcagacgcttgttaaattatacaaatctaattccaaagggactgtttctagacagagctataaaggttgccaaagaagagttggcgcaggagtgtgactatgaaatcgaagcagtcagtcaaaagcgctttcgtgatttgctttcagacactccagggttttatgtgccgcttgtggtagatgagacttcaagcaaaaagattctaaccactgaacttatatctgggatccccattgataaagtagcgttgttagatcagaaaacacgagattatgttgggaggaagatgctagaactcactttgaaggagctctttgtcttccgctttatgcagacggatccaaactggggtaacttcttatacaatgaagccacaaagacaataaatcttatcgatttcggagcagctcgtgattaccccaagaaattcgtcgatgactatctacgaatggtgatggcatgtgcagaaaaagacagtgaaggagtgattgaaatgtctaggagactcgggttcttaaccggagatgaatcagatgtaatgctagacgctcatgtccaagccggtttcatagtgggtctaccttttgcagaacccggtggctatgctttccgaaccaacaacattgcttctagtatctccaatttaggagcaaccatgttgaaacatagactcagtccaccacccgatgaagcctatagccttcaccgtaaattatccggcgctttcttggcttgtatcaagcttggagccaccgtcccttgccgtgatctattgctccaagtttacaacaagtatcagttcgatgatgagccacaagatcccgtagtagctacaagctctgtttcttcatag

SEQ ID NO: 1765 - DNA, 1584 bp, Arabidopsis thaliana
atgaaatatgcattgattcttgttctcttttttgttgtcttcatatggcaatcaagctcatcatcagcaaactcggagactttcacacaatgcctaacctcaaactccgaccccaaacatcccatctcccccgctatcttcttctccggaaatggctcctactcctccgtattacaagccaacatccgtaacctccgcttcaacaccacctcaactccgaaacccttcctcataatcgccgcaacacatgaatcccatgtgcaagccgcgattacttgcgggaaacgccacaaccttcagatgaaaatcagaagtggaggccacgactacgatggcttgtcatacgttacatactctggcaaaccgttcttcgtcctcgacatgtttaacctccgttcggtggatgtcgacgtggcaagtaagaccgcgtgggtccaaaccggtgccatactcggagaagtttattactatatatgggagaagagcaaaaccctagcttatcccgccggaatttgtcccacggttggtgtcggtggccatatcagtggtggaggttacggtaacatgatgagaaaatacggtctcaccgtagataataccatcgatgcaagaatggtcgacgtaaatggaaaaattttggatagaaaattgatgggagaagatctctactgggcaataaacggaggaggaggagggagctacggcgtcgtattggcctacaaaataaaccttgttgaagtcccagaaaacgtcaccgttttcagaatctcccggacgttagaacaaaatgcgacggatatcattcaccggtggcaacaagttgcaccgaagcttcccgacgagcttttcataagaacagtcattgacgtagtaaacggcactgtttcatctcaaaagaccgtcaggacaacattcatagcaatgtttctaggagacacgacaactctactgtcgatattaaaccggagattcccagaattgggtttggtccggtctgactgtaccgaaacaagctggatccaatctgtgctattctggacaaatatccaagttggttcgtcggagacacttctactccaaaggaatcaacccgtgaactacctcaagaggaaatcagattacgtacgtgaaccgatttcaagaaccggtttagagtcaatttggaagaaaatgatcgagcttgaaattccgacaatggctttcaatccatacggtggtgagatggggaggatatcatctacggtgactccgttcccatacagagccggtaatctctggaagattcagtacggtgcgaattggagagatgagactttaaccgaccggtacatggaattgacgaggaagttgtaccaattcatgacaccatttgtttccaagaatccgagacaatcgtttttcaattaccgtgatgttgatttgggtattaattctcataatggtaaaatcagtagttatgtggaaggtaaacgttacgggaagaagtatttcgcaggtaatttcgagagattggtgaagattaagacgagagttgatagtggtaatttctttaggaacgaacagagtattcctgtgttaccataa

SEQ ID NO: 1766 - DNA, 1629 bp, Arabidopsis thaliana
atgcttcttcaaaacttctccaacaccattttccttctctgcctcttcttcacactcctctccgccactaaacccctaaatctcactctccctcaccaacacccttcccctgattccgtcgctctccatgtcatcaggagtgtaaatgaatctcttgcaagaagacaactaagctcaccatcatcatcctcatcatcatcatcctcctcatcatcatcctcttgccgtaccggaaacccaatcgacgattgctggagatgcagcgacgcagactggtcaacaaaccgacaaagactagcagactgttcaatcggcttcggacacggcacactcggaggcaaaaacggcaagatctacgtcgtaactgactcatccgacaacaacccaacaaacccaacaccaggaacactccgttacggcgtaatccaagaagagccactctggatcgtcttctcttcaaacatgctcatcagactaaaacaagaactcatcatcaacagctacaaaaccttagatggtcgtggctcagccgttcacattaccggaaacggttgcttaactctccaatacgttcaacacatcatcatccacaacctccatatctatgactgtaaaccttcagctggattcgagaaacgtggtagatccgatggagatgggatctcgatcttcggatctcagaagatctgggttgatcattgttcaatgagtcattgcaccgacgggctaattgatgctgtgatgggttctacagctataactatatctaacaattacttcacccaccacgacgaggttatgttgttgggtcatgatgataactatgctcctgatacggggatgcaagtgacgatagcgtttaatcatttcggacaagggcttgttcagaggatgcctaggtgtcggagaggttacattcatgtagtgaataatgatttcactgagtggaaaatgtatgctattggtggtagtggtaatcccaccattaacagtcaaggaaatcgttactctgctccttctgatcctagcgccaaagagcgagtggactcgaaggacgatggtgaatggtcgaattggaattggagaacagaaggggatttgatggagaatggagctttctttgtggcctctggtgaaggaatgagctcaatgtactctaaagcttctagtgttgaccctaaagctgcttctctcgtagaccagctcactcgaaacgctggcgtttttggcggtcccagggatgatcaaggtcagagtggcaattcttactctccttatggaggcgacggcggtggcggtgggagcagcggtgggagcagcggtggagggatggacgttatgggaggtacgacgagaggaagcagcagcagcagcggcgatgacagcaatgtcttccagatgatatttggaagcgatgcaccgtctcggccgcgtttaaccaaaatttgccgcatgaaaaagcttcttcaagtgatgctaatagcgagttttccatcggttgagaagtctgagatagagagaatcatcagagagaaggcgacaagggttgcggaaggaggagaggaagagaatgttatggcaaaacgattgtctaaagaagctatttcaaatgcagatgaaggatcttga

SEQ ID NO: 1767 - DNA, 1701 bp, Arabidopsis thaliana
atggcttcgtcatctacaagtatctctctccttctcttcgtctctttcattcttcttctcgttaactcgcgtgcagagaatgcgtccagtggatcggatctcgacgaagaattggctttcctcgccgcggaggaatccaaggaacaaagccacggcggcggttcgtaccacgaggaggagcacgatcatcagcaccgagacttcgagaattacgatgatctcgagcaaggaggcggcgagtttcatcacggcgatcacggttacgaggaggagccgttaccaccagtcgacgagaaagacgtggcggttctgaccaaggacaatttcaccgagttcgtcggcaacaatagcttcgcgatggtggagttttacgctccgtggtgcggcgcttgtcaggctttgactccggagtacgccgcggctgcgacggagttgaaaggccttgcggcgctcgcgaagatcgacgcgacggaggaaggggatttggctcagaagtacgagattcagggcttccccaccgttttcttgtttgtcgacggagaaatgcgcaagacctacgaaggtgaaagaacaaaggatggtattgtgacttggctgaagaagaaggccagtcctagcatccacaacatcactactaaagaggaggctgaacgtgttttgtccgctgaacctaaacttgtctttggttttctcaactcattagtggggtcagagagtgaggagctcgcggctgcgtccagactggaagacgatctcagtttttaccaaactgcaagccctgatattgcaaagctatttgaaattgaaacccaagtcaagcgtcctgccttagttttactgaaaaaggaggaagagaaacttgcccgttttgatggaaacttcactaaaacggctatagcagagtttgtgtcagccaacaaagtcccattggtgatcaacttcacaagggaaggtgcatcactgattttcgagagctcagtgaaaaaccaagcaaatgaatcagagaagcaccttcccactctgagggaggtggcaaagtccttcaagggaaagtttgttttcgtttatgtgcaaatggacaatgaagattatggagaagcagtttctggattctttggtgttaccggcgctgcccccaaggttcttgtatacactggtaatgaagatatgaggaagtttattctggacggtgaattgaccgtaaataacattaagacacttgcggaagatttcctagcagacaaactgaagcctttctacaagtcagatccactaccggaaaataacgatggtgatgttaaggtcattgtgggaaacaattttgatgagattgttcttgacgagtcaaaggatgttcttctcgagcactgccaatcatttgagccgatttacaacaagcttggaaagtatttaaaaggcattgactcgttagttgtagcaaagatggatggtaccagcaatgagcatcctagagcaaaggctgatgggttcccaacaatcctgttcttccctggtggaaacaaaagcttcgatccgatcgctgtggatgttgaccgtacagtagtggaactgtacaaattcctgaagaagcacgcatcaatcccatttaaacttgagaaaccggcgacacctgaaccggtgatctcgaccatgaaatctgatgagaagatcgagggtgatagttccaaggatgagttgtga

SEQ ID NO: 1768 - DNA, 1890 bp, Arabidopsis thaliana
atgggttctaagcataacccaccagggaataacagatcgagaagtacactatctctactcgttgtggttggtttatgttgtttcttctatcttcttggagcatggcaaaagagtgggtttggtaaaggagatagcatagctatggagattacaaagcaagcgcagtgtactgacattgtcactgatcttgattttgaacctcatcacaacacagtgaagatcccacataaagctgatcccaaacctgtttctttcaaaccgtgtgatgtgaagctcaaggattacacgccttgtcaagagcaagaccgagctatgaagttcccgagagagaacatgatttacagagagagacattgtcctcctgataatgagaagctgcgttgtcttgttccagctcctaaagggtatatgactcctttcccttggcctaaaagcagagattatgttcactatgctaatgctcctttcaagagcttgactgtcgaaaaagctggacagaattgggttcagtttcaagggaatgtgtttaaattccctggtggaggaactatgtttcctcaaggtgctgatgcgtatattgaagagctagcttctgttatccctatcaaagatggctctgttagaaccgcattggacactggatgtggggtaagtcgatttctgtttgatctagttgctagttggggtgcttatatgcttaagaggaatgttttgactatgtcgtttgcgccaagggataaccacgaagcacaagtccagtttgcgcttgagagaggtgttccagcgattatcgctgttcttggatcaatccttcttccttaccctgcaagagcctttgacatggctcaatgctctcgatgcttgataccatggaccgcaaacgagggaacatacttaatggaagtagatagagtcttgagacctggaggttactgggtcttatcgggtcctccaatcaactggaagacatggcacaagacgtggaaccgaactaaagcagagctaaatgccgagcaaaagagaatagagggaatcgcagagtccttatgctgggagaagaagtatgagaagggagacattgcaattttcagaaagaaaataaacgatagatcatgcgatagatcaacaccggttgacacctgcaaaagaaaggacactgacgatgtctggtacaaggagatagaaacgtgtgtaacaccattccctaaagtatcaaacgaagaagaagttgctggaggaaagctaaagaagttccccgagaggctattcgcagtgcctccaagtatctctaaaggtttgattaatggcgtcgacgaggaatcataccaagaagacatcaatctatggaagaagcgagtgaccggatacaagagaattaacagactgataggttccaccagataccgtaatgtgatggatatgaacgccggtcttggtggattcgctgctgcgcttgaatcgcctaaatcgtgggttatgaatgtgattccaaccattaacaagaacacattgagtgttgtttatgagagaggtctcattggtatctatcatgactggtgtgaaggcttttcaacttatccaagaacatacgatttcattcacgctagtggtgtcttcagcttgtatcagcacagctgcaaacttgaggatattcttcttgaaactgatcggattttacgaccggaagggattgtgattttccgggatgaggttgatgttttgaatgatgtgaggaagatcgttgatggaatgagatgggatactaagttaatggatcatgaagacggtcctctcgtgccggagaagattcttgtcgccacgaagcagtattgggtagccggcgacgatggaaacaattctccgtcgtcttctaatagtgaagaagaataa

SEQ ID NO: 1769 - DNA, 1566 bp, Arabidopsis thaliana
atgacattgacgatcccaaacgcacctgggagctccgggtacttggatatgttcccagagagaaggatgtcgtattttgggaattcttacattctgggtttgactgtcactgccggaatcggtggccttctgttcggttatgatacaggtgtaatttccggtgcccttttgtacattaaggatgatttcgaagttgttaagcagagcagtttcttacaggtatataatgtttctagctttacctcttccaagctggaaactattgtaagtatggctttagttggtgccatgattggtgctgcagctggaggttggatcaatgactactacggtcgtaaaaaggcgactctttttgcagatgttgtctttgcagctggagctatcgttatggctgctgctcctgatccgtatgttttgatatcgggtcgtctcttggtcggtttaggagttggtgttgcttctgtgactgctccggtttatatagcggaagcatctccatcggaagttagaggtggacttgtgagcaccaacgtattgatgatcactggtggacagtttctttcatatctcgttaattctgctttcacacaggttccaggaacatggagatggatgcttggtgtttcaggcgttcccgctgtgattcagttcatcctcatgcttttcatgccagaatcccctcgatggcttttcatgaaaaatcgtaaagcggaagccatccaagtgctcgccagaacctatgacatctcgcggttagaagacgagattgatcatctttcagcggctgaagaggaagaaaaacaaaggaagcgcactgttggctacttggatgttttcagatccaaagaattgagacttgcatttcttgccggagcaggacttcaggcgtttcagcagttcactggtatcaatacagttatgtactacagccctacgatagtccaaatggctggatttcactcaaaccagctcgctttgttcctgtctctcattgttgctgccatgaatgctgctggaacagtcgtggggatttacttcatcgatcattgtggaaggaaaaagctagctctctcaagtttatttggcgtcattatatcactcttaatcctctcagtctcgtttttcaaacaatctgagacatcatctgatggagggctctatggttggctcgctgtgcttggcttagctctatacattgttttctttgcaccgggaatgggaccagtcccatggacggtgaactcagagatataccctcaacaataccgaggcatatgcggaggcatgtcagctacagttaactggatcagcaatttgattgtggcacaaacattcttgacaatcgcggaagctgctggaacaggaatgactttcttgattttggcgggaattgcggttcttgctgtaatctttgtgattgtgtttgtccctgagactcaagggctaacgttttcggaagttgaacagatttggaaagaaagagcttatggaaatatcagtggctggggcagtagcagtgatagcaacaacatggaagggttactcgagcagggatctcaatcttaa

SEQ ID NO: 1770 - DNA, 1173 bp, Arabidopsis thaliana
atgcggttgcgttttccgatgaaatctgccgttttagcgtttgctatctttctggtgtttattccactgttttccgtcggtatacggatgattccgggaagactcaccgccgtatccgccaccgtcggaaatggctttgatctggggtcgttcgtggaagctccggagtacagaaacggcaaggagtgcgtgtctcaatcgttgaacagagaaaacttcgtgtcgtcttgcgacgcttcgttagttcatgtagctatgacgcttgactcggagtacttacgtggctcaatcgcagccgtacattcaatgctccgccacgcgtcgtgtccagaaaacgtcttcttccatctcatcgctgcagagtttgacccggcgagtccacgcgttctgagtcaactcgtccgatctactttcccgtcgctaaacttcaaagtctacattttccgggaagatacggtgatcaaccttatctcttcttcaatcagacaagctttagagaatccattgaactatgctcggaactacctcggagatattcttgatccatgcgtagacagagtcatttacctagactcggacatcatcgtcgtcgatgacataacaaagctttggaacacgagtttgacagggtcaagaatcatcggagctccggagtattgtcacgctaacttcacaaagtacttcacttcaggtttctggtccgacccggctttacccggtttcttctcgggtcgaaagccttgttatttcaacacgggtgtgatggtgatggatctagttagatggagagaaggaaactacagagaaaagcttgaaacttggatgcagatacagaagaagaagagaatctacgatttgggttctttgcctccgtttcttcttgtcttcgcagggaacgttgaagcaattgatcataggtggaaccaacatggtttaggaggagacaatgtacgaggaagttgtaggtctttgcataaaggaccagtgagtttgttgcattggagtggtaaaggtaagccatgggtgagacttgatgagaagagaccgtgtccgttggatcatttatgggaaccgtatgatttatatgagcataagattgaaagagctaaagatcagtctttgttcgggttctcttctttgtctgagttaacagaagattcaagctttttctga

SEQ ID NO: 1771 - DNA, 1320 bp, Arabidopsis thaliana
atggcgtccgaggatttgaatattgttgcggaatcaaagaaaggggaagagaatgttattgttgataattccaaggacatgaatagacctgagaatcttgacttatctactgagaaaactgatactgccaatgagaatggtccaaaagatgaagcttctaagctggaagcagacctccctgagtctggtacttcagtgaagagtaaaacagctaaggataataaacctgttaagagaaagtcagggacgttttctcggagcccgagattcatgtctcagagctcttcatttccaactaaaggagcttatactgatattactagaaagagcattgatgccacaacatcaaagactagtcttaaacccgtcgttgctggtggatccaaaccaaaagccactccatcttcaagcagcggtgtttccgcaaagcgcaccagtttagtatctgcgcctctcaaaaagcaaactatggtaactactgaatctgttttgttagttcctgtgaaaaccatttctaaggatgcagcttcaggccctacttccaaattaggagatgaaggttctaaatccatcaaagaagaaactgcggggaaggatgtcgaggaggctggatcaaccaccgctgtggtggcagataaagtatctaacccgttgaaagctgaaatggcaagcaaggacgacgaagacactcgttcaactaccacttcaacttctacacctcgtgggcggagaagcagtgttggatcggcatctggattttcgttcaggttggaggaacgggctgaaaaacggaaggagttttatatgaaactagaagagaagatccatgcaaaggaagtagagaagaccaatttgcaggcgaaatcaaaggagagccaggaagaagagatcaaaaggttgaggaagagcttgacgttcaaggctggtcccatgcccagtttctacaaagaacccccacctaaggttgaattgaagaagataccaactactcgtcctaagtctccaaagctaggacgcagaaagagtagcagtgatgcaacaggaggtgaagccgctcctcgcgtgacaaaaccaaaagactcatcatcatctacagtgaagaaaccaataacaaagtctcagccaaagcttgaaactcaagagaaatcagtgaaggccaaagaaaagaaaaagaaagtgaagaaagaagaagcagagaagagaggagaagaagagaaggctactgccgtggctgcgaaacctgaagagcagaaaccaaactccaataacatccaagtgaaggctgagataatggcgagtgaggttgtagtgggaggctga

SEQ ID NO: 1772 - DNA, 615 bp, Arabidopsis thaliana
atggctggtatgcttcccggagttgagtgtgcaaggaggcggcgcttccacggtggtgctcctccgattgaatcctcgaacacagcttctgtggcggctgcggcgggacacgtctggacacggcgaccatcgttctctctttacactaccaatcatgagagccaccaggcccatgtctccttctcggagagaagtgttaggaataaatcttatggagaagacaacgatgagaaacttgacggagcagccaaagaggcaaagcagaggcttaacaagcggctgagaatcccaccacgtacaaggttcgatttagtaaaaaacggcgtgcaaaatggtaaagacaaagggaataaattggagcaaggaaagggtaaacctctcggggacttaccgaccgaggtggtcgggttaaagaagagccgaggaaggttgatggaatggttcaagcggcgagttagggaacaacaagattgtgctatatgtctagaccggttcaagaagggtgagaccttggtacacctaccatgtgcccataagtttcactccatatgcttattgccttggctagacaccaatgtttattgcccatattgtagaactgatatttggaattaa

SEQ ID NO: 1773 - DNA, 405 bp, Arabidopsis thaliana
atggccgccgacggaatattccgcagcatcttcgagggttgtatctccggccttgattccgccatcgaacggcgtccttaccacaaaaactgcggatgtgctcttcacgataaatcaagtggcgctgggaaaaatcaaaatcagcgacggccgccgtcttgtcgccgccacggaagctcagagagcatctcgttcccgatccgaaggtcttggagcgaaggcaacatcatggctatgaatctcttctcctcatcgtcgtcttcttctaatctccaatcgctttcttcgtcttcttcgctctcaaatctggcatcagatttaccggtggataatgctgcgacggaggaaccgagcagatctaataaacagctacgatggacgattgatgaaggtgaagatgattga

SEQ ID NO: 1774 - DNA, 159 bp, Arabidopsis thaliana
atgaaaagttcatcggagctccttgtaataatgattttcttattcttggcgcttctcataatctcccacgctcaatcacttccaggtacgccgtatggcggccctggtccgtatccgcgtagttaccctgtgtgttacccaccgtattgccgtccatga

SEQ ID NO: 1775 - DNA, 714 bp, Arabidopsis thaliana
atgagatttagtgatattttctgctcttctccggcatcaaccgccgtacgacatagtacacttcaccacgacggaaatgttaccggaggtcgcagatctttccaaagccacctccggagccaaaaccctagtaagaagaaggataaaactgtcccttgcttctcttccgagatgcctttaatccctattcctcgtcacttgagctgtagaaactcctttgaatctccaagcgggtttcgtccgaaaatcgcttcggctcgcggtagcgatgttcaaatccgccggaaaagctctgctgacgtaagtgacttgaggagatcaaggagttctctgctaagctcatcgtccaggtatcttttaaaagatcataagtctttgaaaggtgatgataaggacctctggttatcatcggatcgttctaaagatttgattctttaccgtgaccgcaacgtaacttcttcagcctcatcatcttcttcggtatcaatccattgcaagggatgtgaaggaaaggttagaaagcatatctccaaaatggaaggggtgacgtcatacactattgatttagcgacaaagaaggtgacggtggtcggaaagataacacccgtcggactagtagaaagcatctcaaaggtcaaattcgctcagctttggccttcctcttcttctcctccatttcctcacattcctaattattcactcctcaaatcttaa

SEQ ID NO: 1776 - DNA, 645 bp, Arabidopsis thaliana
atggtgaggggcaaaactcagatgaagagaatagagaatgcaacaagcagacaagtgactttctccaaaagaaggaatggtttgttgaagaaagcctttgagctctcagtgctttgtgatgctgaagtttctcttatcatcttctctcctaaaggcaaactttatgaattcgccagctccaatatgcaagataccatagatcgttatctgaggcatactaaggatcgagtcagcaccaaaccggtttctgaagaaaatatgcagcatttgaaatatgaagcagcaaacatgatgaagaaaattgaacaactcgaagcttctaaacgtaaactcttgggagaaggcataggaacatgctcaatcgaggagctgcaacagattgagcaacagcttgagaaaagtgtcaaatgtattcgagcaagaaagactcaagtgtttaaggaacaaattgagcagctcaagcaaaaggagaaagctctagctgcagaaaacgagaagctctctgaaaagtggggatctcatgaaagcgaagtttggtcaaataagaatcaagaaagtactggaagaggtgatgaagagagtagcccaagttctgaagtagagacgcaattgttcattgggttaccttgttcttcaagaaagtga

SEQ ID NO: 1777 - DNA, 1686 bp, Arabidopsis thaliana
atggcggccacctctagcatctcttcttctctatctctcaatgctaaacccaacaagctctctaacaacaacaacaacaataagcctcaccgtttcctccgtaatcccttccttaacccctcctcctcctctttctctcctcttccggcttctatctcctcttcttcttcttctccttcgtttccgctcagagtttcaaaccctcttaccctgttggcggcagacaacgatgattatgacgagaagcctcgggaagagtgtggagttgtcggaatctacggtgactcagaagcttcacgactctgttacttagctctccatgcgcttcagcatcgaggtcaagaaggtgcaggtattgttaccgttagtaaagataaggttcttcagaccattacaggtgttggtttggtctctgaggttttcagtgaatccaaactcgatcaattaccaggagacatagccattggtcatgtcaggtactcgactgctggttcttctatgctcaagaacgttcagccgtttgttgctggttatcgatttggctctgttggtgttgctcacaatggcaatttagtgaattacacgaaattgagagctgatttagaggaaaatggttcgattttcaatactagctctgatactgaggttgtgcttcatttgattgccatttctaaagctagaccctttttcatgagaattgttgatgcttgtgagaagcttcaaggtgcttattcgatggtgtttgtgactgaggataagcttgttgctgttcgtgacccacatgggtttaggcctttagttatgggtaggagaagtaatggagctgttgtgtttgcttctgagacttgtgctcttgatttgattgaagctacttatgagagagaggtttatcctggtgaggttttagttgtggataaagatggtgtcaaatgtcagtgtttgatgcctcatcctgagccaaagcaatgcattttcgaacatatttacttctcgttgcctaattcgattgtctttggtcggtctgtgtatgagtctaggcatgtctttggtgagattttagctactgagtcacctgttgattgtgatgtggtgatcgctgtgcctgactcgggtgttgtggctgctcttggttacgcggctaaagctggtgtagcgtttcagcaaggtttgattaggtctcattatgttggaaggactttcattgagccgtctcagaaaatcagagattttggagtgaagctgaagctatcgccagtccgaggagttttagaagggaaaagagttgttgttgttgatgattcgattgttagaggaacaacttcgtccaagattgtgcgtttattgagagaagcgggtgcgaaagaggttcacatgaggatcgcgagtcctcctattattgcatcttgttactacggagtggacacgcctagctcaaatgagttgatatcgaataggatgagtgttgatgaaatcagggattacatcggatgtgattcccttgcgtttttgtcgtttgagacgttaaagaaacatttgggggaagattctagaagcttctgctatgcatgcttcacgggggactatccggtgaagcctacagaggataaggtgaagcgaggaggagattttatcgatgatggtctcgttggaggaatccacaacattgaaggaggttgggtacggtag

SEQ ID NO: 1778 - DNA, 1098 bp, Arabidopsis thaliana
atggctgctttgaaaggttatggcttgtgttctatggactctgctcttcaattcccctgtcctaagctattcaatagctacaagagaaggagctcgaaatgggtctctcccaaagcagctgttgtacccaatttccatctcccaatgcgcagcttggaggttaaaaacaggacaaacacagacgacattaaagctctacgtgtgatcacagctatcaaaacaccgtatctacctgatggaagattcgaccttgaagcctacgatgacttggtcaacattcagatacaaaacggtgctgaaggtgtcattgttggtggtacaactggtgaaggacaactgatgagctgggacgaacacattatgcttataggccataccgttaactgttttggcggaagcatcaaagtcattggaaacactggaagcaattcgactagagaagcaatccacgcgactgaacaaggattcgcggttggaatgcatgctgctcttcatataaacccttactatggcaagacttctattgagggactgattgcacatttccagtctgttcttcatatgggaccgacgattatatacaatgtgcctggtcgaacagggcaagatataccgcctcgtgccatcttcaaactttctcagaatccgaatttagctggtgtgaaggaatgtgttgggaacaagcgagtcgaagagtacactgagaatggggttgttgtgtggagtgggaatgatgatgagtgtcatgattccagatgggattatggagcaacaggagttatatcagttactagtaatttagttccgggtttgatgaggaagttgatgtttgaaggtaggaattcatctttgaactcaaagcttctacctttgatggcttggctgttccacgagccaaacccgattggaatcaacactgctttggctcagcttggagtttcgaggccggtttttaggttaccatatgtaccattgccactgtctaagaggcttgagtttgtgaaactggtgaaggagattggacgagagcattttgtgggtgagaaagatgttcaggctcttgatgatgatgattttatccttatcggtcgatattag

SEQ ID NO: 1779 - DNA, 843 bp, Arabidopsis thaliana
atggcgccgccggtgacggagcggtggtgcttagctttgattcttctctttctctccttgttcgtccaatcttcaacggcaatttactgcggtgctgaagattgttatgctcttctcggagtcgctcaagatgcgaacgcatcggatatcaagagatcttattataagctctctcttcaacatcatccagataagaatccggatcctgaatcgaggaaactgtttgttaaaatcgccactgcttatgagattttgaaagataatactactcgggcacaatatgattatgcaattgaacatccagaagaggtattttacaacaccgctcaatattaccgcgcgaaatatggacataaatcggatccccgtgctgttcttgttggtctattggtggttttatctgcatttcaatatctgaacaacgtggcaaggtataatgaggctatagcgacggttaagcgaacacctgcttacaaaaataagctcaaggcattagaactcgaacgcacaggtggagtaagtaacaagaagaagggttcaaagcagattgaccagaaactacaggaagagctaagcaacgaacttgacttacaaatcaaaggagctgaaaaaccatcggtctgggaacttctcggtgttcgattcattctcctaccatacactatcattaagcttctagtatggtacagcagttgggtgtggagatataaggtcaagaaagctccttattcatgggaagacgcatcatacctaacccgaagatcacttagtgtgcctgccgacgcatgggctaatctaggtatccttctattctctaatttccaacctgaaccgacatattga

SEQ ID NO: 1780 - DNA, 819 bp, Arabidopsis thaliana
atgacaggatcacaagaagaccaacctaagatcatcattgatcaagagcaacccaaaactctagaaacagagcaccaaccagaaccttcttcatcgtctccggatcagaagaaatggggtactcacgtgatgggagctccggcagctccagttgctcatcccgataaccaacaggcggcggcgtgggtcgctggagataaccagcagacgcagtaccaaccgtacgtcatctactctcctgtcgaacatccaacaactaacaaccctctcgagccagtcatcggaatgttccatacctggagtcgcaaggcagaaaccgtcgcacgtaacctctggcacaatctgaagacaggaccgtctatgtcggaaacggcgtgggggaaggttaatttgacggccaaagcgataacaaaaggaggattcgagtcgcttttcagacagattttcggaacagagccaaacgagacgctgaagaaaactttcgcttgttatctctcgacgacgacaggtcctgttgctggaactgtctatctttcgaatgctcgtgtcgctttttgtagcgatcgtcctctgtacttcacagcaccttctggtcaagaatcttggagctactacagggtggttgtacctttggcgaatgtagcgacggtgaatccggtggtggtgaaagagactccacctgagaagtatattcagttgacgacggtggatggtcatgacttctggttcatgggttttgtgaattatgagaaggctacgcatcatctgctgaccagtgtctccgattttcaaaccgcacacggctctgtgtctggttaa

SEQ ID NO: 1781 - DNA, 1242 bp, Arabidopsis thaliana
atggctctttcaatcgttcttcttcccttcattctcattctcataccgacttttctcagttcggttttcgccgtttcaccactcaaaactgatacgttaaaaccggggcagcagctcagagactgggagcagttgatctctgcggatggtatcttcactctcggattctttacacctaaagactcatctacttccgaactcgggtcagctggtcttagatatcttggtatttggcctcaaagtattccaataaatctagtttgggtgggtaacccaaccgaatcagtttctgattcatctggttctctatccattgacaccaatggggttctaaagataacacaggcaaacgctattccaatcttggtgaaccaaagaccagccgcgcagctttcattggtcgggaatgtgtctgccattttactcgataccgggaactttgtggtccgagagatcaggccaggaggagttccgggtcgtgttctatggcaaagctttgaccatcccacaaacacattacttcccgggatgaagattgggtttaacctaagaaccaagaaagaagtatcagttacgtcttggataactgaccaagtcccagtcccaggagcattcagactaggactagacccatcaggagctaaccagttactcgtctggcgccgcggggaaatctactggtccagtggaatcttgacgaacaatggaagctctcatttgaacttagaagtatccagacactacattgattatgaattcaagttcgattcaaataagtacatgaagtacttcagctactcaatcaagaaagctaatagttcggtcttttccagctggttcttggatactctaggccaaatcactgtaaccttttctctcagcagtaacaatagcagcacctggatttccgaaagcagtgaaccctgcaagacggatttaaagaacagttcagcaatctgcatcacggagaagccaacggcttgtaggaaagggtcagagtatttcgaacccagaagaggatacatgatggaaaataataccggttattatccattttactatgacgatagtttgagcgctggtcttagcgactgtcatggaacctgctggagaaactgttcttgcatagctttccaagcctttcctgatggatgccaatattgggaaaaaggatcaaagtttgttccttatgatagcttcaactccaatttagtaacttatgttcttgattctgtaaagtga

SEQ ID NO: 1782 - DNA, 495 bp, Arabidopsis thaliana
atgactggaatttccttcagggatcagctctggatcaattcataccctcttgatcgtaactacatcttcgattacttcgctttgtctcctttctacgatacaacttgcaacaatgagattcttcggagaagatccattcaccctctcgatctctctcacctctcgaagatgacaggtctagaatatatgttaactgatgctactgaaccaaacctgttcgtctttcgtaagcaaaagagagatggtcctgagaaagtcacaccgatgctaacatattatatcttggatggttctatttaccaagctcctcagctttgtagtgtcttcgcagctcgagttagtcggactatttataatatatccaaggctttcactgatgctgcatcgaaattggagaccattagacaaggtaaggtttcgttctcttccaaaagatcgatggctttgtatgaaactggacgaaatatatatgttgtttgtatgaactatttgtag

SEQ ID NO: 1783 - DNA, 885 bp, Arabidopsis thaliana
atggatactaataaagcaaaaaagcttaaagttatgaaccaactcgttgaaggccatgacttaacaactcagcttcagcaactcctctctcaacccgggtccggtctagaggatctagtggctaaaatcttagtgtgtttcaataacaccatctccgttcttgataccttcgaacccatctcctcctcctcatccctcgccgccgttgagggatctcaaaatgcttcatgtgataacgacggcaagtttgaagattccggcgatagtcggaaaagattgggacccgttaagggtaaaagaggatgctacaaaagaaaaaagagatcggagacgtgtactatagagtcgactatacttgaggacgcattttcttggaggaaatatggacaaaaggagattcttaatgccaaattcccaagaagttactttagatgcacacacaagtatacccaagggtgcaaggcaacaaagcaagtccagaaggttgagctcgaacccaagatgttcagtatcacatacataggaaaccacacgtgtaacaccaacgcagaaactcccaagagcaagacttgtgaccatcatgatgagatcttcatggattccgaagatcacaagagtcctagtttatctacctcaatgaaggaagaagacaatcctcatcgtcatcatggttcgtccacggagaatgacttgtcattggtgtggccagaaatggttttcgaagaagattatcatcatcaggccagttacgtcaatgggaaaacgagtacatctatcgatgttttgggttctcaggatctcatggtgtttggaggtggcggcgatttcgagtttagcgaaaatgagcacttctctatcttcagttcatgttcgaatctatcttga

SEQ ID NO: 1784 - DNA, 460 bp, Arabidopsis thaliana
attgggtttacagtttactagaccagatgtggtggggtttgggtacaaaagggccagactggttttcgaagttgcaaaatggaaaaactgatcagcaggcgggataggacggggctggtccacaggctacagcctacaggttgatcatacatacctaaaacctataatcagtttaggcagatatagtagccttacaagttagaactatctcaattcataagtcccaagtccctaagccctcctttgccatggctctttgtgaaactagcactttaagataatcgcattttctctcatctccttgggcctctcacaaactaaattttgtgggcaacttcaatcttggtttctagtatatgtgcaaagatattaaaatcagtataaaattagttagtgttagtatttggagtttataaatttaaaaatatctactacttcaatcaaaagtcgacgcggccgc

SEQ ID NO: 1785 - DNA, 909 bp, Arabidopsis thaliana
atggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatag

SEQ ID NO: 1786 - DNA, 2754 bp, Arabidopsis thaliana
atggcggcctctgtagataatcgccaatacgctcgtctcgagccaggtttgaacggcgtggttcgttcttacaaacctcccgttccaggccggtccgattcccctaaggcgcaccagaaccaaaccaccaaccaaaccgtgttcttgaaaccagccaaggttcatgacgatgacgaagacgtgtcgagcgaagacgagaacgagacacacaacagcaacgccgtgtactacaaggagatgataagaaaatccaacgccgagcttgaaccgtccgttttggacccgagggacgaatacacggctgatagctggatcgagcgtaacccttccatggtacgtctcacagggaaacatcccttcaactccgaggcgcctcttaaccgtttaatgcaccacgggtttatcacccctgtcccgttgcactacgttcgtaaccacggccacgtccctaaagcccaatgggccgaatggacggtcgaggtgaccggattcgtcaaacggcccatgaaattcaccatggaccagctcgtctccgagtttgcttaccgcgagttcgccgcgacgctagtctgcgcggggaaccgccgtaaggaacagaacatggtgaagaagtcaaagggattcaactggggatccgccggagtttccacctccgtgtggcgtggtgtccctctctgcgacgtactgcgtcgctgcgggatctttagccgaaaaggcggcgctctcaacgtctgcttcgaagggtcggaggatcttccgggcggtgccggaactgctggttccaaatacggaacgagcatcaagaaggaatatgccatggatccatcaagagacatcattttggcttatatgcaaaacggagagtatctaacaccagaccacggttttccggttcggatcatcatccccggtttcattggtggccggatggttaaatggttgaaacgaatcattgtcacaactaaagaatccgacaatttctaccatttcaaggacaacagagttttaccttctttggtagacgccgaactcgccgacgaagaaggttggtggtataagccagagtacataatcaacgagctaaacataaactccgtgattacgacgccatgtcacgaggagattcttcccatcaacgctttcacaacccaaagaccttatactttaaagggttacgcatattccggaggtggaaaaaaagtgacccgtgtggaggtcacggtagatggtggagagacatggaacgtatgtgcacttgaccatcaagagaagccaaacaagtatgggaagttctggtgttggtgtttttggtcacttgaggttgaggttttggacttgcttagtgccaaagagattgctgttcgtgcatgggacgagactctcaacacgcagcccgagaaaatgatatggaatctcatggggatgatgaataactgctggtttagagtgaagactaacgtgtgcaagccacacaagggagagattgggattgtgttcgagcatccaacgcttcctggtaatgaatctggtggatggatggcgaaggaacgtcacctcgaaaaatcggctgacgcgcctcctagtctaaagaagtctgtctcgacgccgtttatgaacacaactgcgaagatgtactcgatgtccgaggtcaagaagcataattcggctgactcttgctggatcattgtccatggacatatctatgattgtacacgattccttatggatcacccgggtggttcggattcaatcttgatcaatgctggtacggattgtacggaggagtttgaagccattcactcggataaagccaagaagatgcttgaggattaccgtatcggtgagctcatcaccactggttattcctctgactcttcctcgcctaacaactcggttcacggttcatccgccgtgttctcgctgttggctcccattggagaggcgactccggttaggaacctcgctttggttaatccccgggctaaagtcccggttcaactcgtcgaaaagacttccatttctcatgatgttcgtaaattccggtttgctttaccggttgaggatatggttctaggcttaccggttggtaagcacattttcctttgcgccaccatcaatgacaagctctgcctcagagcttacacaccaagcagcaccgttgatgtggttggctacttcgagctcgtggtcaagatttactttggcggtgtccacccaagattccctaacggcgggctcatgtctcagtacctagactctttgcctatagggtcaactttggagattaaaggaccattgggtcacgttgagtatctcggcaagggtagtttcacggttcacggtaaaccaaagtttgctgataaattggcaatgttggcaggtggaaccggaataactccggtttaccaaattatccaagccattctcaaggatccagaggatgagactgaaatgtacgtcatttatgctaaccggaccgaggaagatattctcctaagggaggaactggatggttgggcagagcaatacccggaccggttaaaggtttggtacgtagtggaatcagctaaggaaggttgggcatacagtaccgggtttatttccgaggcgattatgcgagaacatatccctgatggattagatggctcagcccttgccatggcttgcggaccaccaccgatgattcagtttgcggttcagccgaatttggagaagatgcaatataacatcaaggaggatttcttgatattctag

SEQ ID NO: 1787 - DNA, 975 bp, Arabidopsis thaliana
atggaaggaagagatatgttaagttgggagcaaaagacattgctaagcgagcttatcaatggatttgatgcggccaaaaagcttcaggcacgacttagagaagctccgtcgccgtcgtcatcattttcatcaccggcgacggctgttgctgagactaacgagattctggtgaagcagatagtttcttcctacgagagatctcttcttctgctaaactggtcatcctcaccgagcgtacaacttattccgacgccggttactgtagtcccggtggcaaatcccggcagtgttccagaatctccggcatcgataaacggaagtccgagaagtgaagagtttgccgatggaggaggttctagcgagagtcatcatcgccaagattacattttcaattcaaagaaaagaaagatgttaccaaagtggtcagaaaaagtgagaataagcccagagagaggcttagaaggacctcaagatgatgtctttagctggagaaaatatggtcaaaaagacattttaggcgccaaattcccaaggagttattacagatgcacacatcgtagcacacaaaactgttgggcaacgaaacaagtccagagatcagacggggatgctacggttttcgaagtgacgtacagaggaacacacacttgttcgcaggcgatcacaagaacaccaccattagcctcgccggagaagcgacaagacaccagagtcaaaccagccattacccaaaagccaaaggatattctcgagagtcttaaatccaacttaaccgttcgaaccgatgggcttgatgatggtaaagacgttttctcgttccctgatacgccgccgttttacaattacggaactatcaacggcgagttcggccacgtggagagttctccgatcttcgacgttgttgactggttcaatccaacggtcgagattgacacaactttccccgcgtttttacacgagtcgatttattattaa

SEQ ID NO: 1788 - DNA, 1491 bp, Arabidopsis thaliana
atggtaggagcttcaagaacaatcctatccctatctctatcatcttccctcttcaccttctccaaaatccctcacgtttttccatttctccgcctccacaaacccagattccaccacgcgtttcgtcctctttactccgccgccgcaacaacttcttctccgacgacggagactaatgttacagatccggatcaattgaaacatacgatcttactagagaggcttaggcttcgacatttgaaagaatcagcgaaaccaccacaacagagaccaagtagtgttgttggtgtagaggaagagagtagtattaggaagaagagtaagaagttagttgagaattttcaggaattgggtttaagtgaagaagttatgggagctttacaagagttgaatattgaggttcctactgagattcagtgtatcggaatacctgcggttatggaacgtaagagcgttgtattgggttcgcataccggttctggcaagactcttgcttacttgttgcctattgttcaggtgcttagtgagctgatgagagaagatgaagcaaaccttggtaaaaaaacaaagcctagacgtcccaggactgttgttctttgtcctacaagagaactatctgagcaggtttgtcttcaccaagattatcatcacgcgaggtttagatctatattggttagtggtggttctcggataagaccccaggaggattctttgaacaatgcaatagatatggttgttggaacccctggtaggattcttcagcatatcgaagaaggaaacatggtgtatggagatatcgcatatttggtattggatgaggcagatactatgtttgatcgtggctttggtcccgaaattcgtaaattccttgccccactgaatcaacatattaaggtagtgaatgaaattgtgagttttcaggctgttcagaagttagtcgatgaggagtttcaagggatagagcatttgcgtacatcaacactgcataaaaagatagcaaacgctcgccatgacttcatcaagctttcaggtggtgaagataagctagaagcacttctacaggttcttgaacctagcctagccaaagggagcaaggtgatggtcttctgtaacactttgaactccagtcgcgctgttgatcactatctttctgaaaaccagatctccactgtaaattatcacggtgaagttccagcagaacaaagggttgagaatttgaaaaagttcaaggacgaagaaggagactgtcccacgctagtgtgcacggatttggctgcaaggggtctggacctcgacgttgatcatgtagtcatgtttgatttcccaaagaactcgattgactaccttcatcgcactggaagaacagctcggatgggtgctaaaggtttgtttcatacctctagattatcacttgttaagttctcgtatttcagatggtttcggctagggtggcgtaccaagttttcagatttttttgtttatggactatag

SEQ ID NO: 1789 - DNA, 942 bp, Arabidopsis thaliana
atggcaaaaatagaaccaaaaacgtcaatggatatgaattttcctgtcaagtacttcgtggttgatgcattcactgagtcagccttcaaggggaaccaagctgcagtgtgttttcttgaagaggatcatgagagagacgacgtgtggcttcagtctatggcctctgagtttgaccttccattgacgtgttttcttattcccatccccggctccgaaccaccacgtttccttctgaggtggttcacggctgtagccgagatggatatatgtggtcatgcaacactagcatcagctcatagtatcttctcaaacagtttggttggttcatctgacactgtcgaattttccaccaactcggggattctaaccgctaaaaggctgtctgattgtgactctaaaagatctttcttgatcgaaatgaatttccctgtgattacaacttgtgagtacagctccaaggatgtctccatcttctctaaagccttgaatggagctaccattgtcgatgttcgagaaactaaaactgatagactcatctttaaacccttgataggagctttcaaaacaacttcaacagaccaaatcatcgttgtgctttcatcttgggaatctgtcattgaatttcagccaagagtggatgatatcgtgaaatgccctggcaaagtgatgattgttaccgctgctgctcctcaaggatctccttttgacttctgcagtcgactctttgctcctaaactagggctcaatgaggactctgtatgtggaagtgcacattgttcattagcacattactggagcctcaagatgaacaagtgtgatttcgtcgcttttgcggcttcgcaaagaagtggaacactcaaggttcattatgataaggagaagcagagagtcttgcttaccgggaaagctgtgactgtcatgaaaggctctatcttagtttaa

SEQ ID NO: 1790 - DNA, 969 bp, Arabidopsis thaliana
atgattggaacaagcttccccgaggatcttgattgtggcaacttctttgacaacatggatgatctcatggactttcccggtggagatatcgatgtcggtttcggcataggtgactccgactctttccctaccatctggaccactcatcacgacacgtggcctgccgcttctgatcctctcttctcttccaacaccaactctgattcatcacctgagctctatgttccgtttgaggacattgttaaggtggaaagacctccaagctttgtagaggaaacattggttgagaagaaggaagattcgttttcgacaaacactgattcatcatcttctcatagccaattcaggagctcaagtccagtgtcggttctcgagagcagctcctcctcgtctcaaaccaccaacacaacctcccttgttctccctggaaagcacggtcgtccacgcacaaaacgccctcgtccacctgtccaggataaagatagagtcaaagacaatgtgtgcggtggtgactcgcgcctcatcattagaataccgaaacagtttctctctgatcacaacaagatgatcaacaagaagaagaagaagaaggccaagattacttcttcctcttcttcgtccgggattgatcttgaagtcaatggaaacaacgtcgattcgtattcttcagagcaatatccgcttaggaaatgtatgcactgtgaggtcaccaagactccacagtggaggcttggtccaatgggtccaaagacactttgcaatgcgtgcggtgtacgttacaaatcagggaggcttttcccggagtaccgtccagctgctagtccaacatttactccagctcttcactcaaactcacacaagaaagtggctgaaatgagaaacaagagatgcagtgatggtagctacataaccgaagagaatgatctgcaagggctgattccgaacaatgcctacattggcgtagactaa

SEQ ID NO: 1791 - DNA, 393 bp, Arabidopsis thaliana
atggggaggctgtttgtggtgaatcttgaagggaagatctatagctgcaaacactgtaagactcatcttgctacttatgaagacatcatctccaagtcttttcactgcaagcatgggaaagcttatctcttcaataaggttgccaatgtttccattggagagactgaagaaagactgatgatgactggtaaacatactgtggctgatattttctgtgtctcgtgtggatcaatcgttggctggaaatacgagactgctcatgagaagaaccagaagtacaaagaaggaaaatcagtgcttgaaagatttaagatatcgggtcctgatgggagcaactattgggtgagtagccatggaaggcatataggtggaagtgatgcagatgatgcttga

SEQ ID NO: 1792 - DNA, 573 bp, Arabidopsis thaliana
atgagctccttcaccaccaccaacactccgccaccgtatctcctccggaaaatttatcatcgccgtgtaaaccaaccgttctccgtcgtatgttgcaccggagaaccccaacaagacatcttcacccgccggagaaccttgacttcactaataacattcacggtcatcggcggtgctacgtcatcagcattagcacaggagaaatgggggacaaggtcattcataaaggagaaatattttatgccgggactatcacctgaggatgcggcggcgcgtataaaacagacggctgaaggattaagagacatgagggagatgttggaccacatgtcgtggaggtacgttatattctacataagattgaaacaggcttatctgtctcaggatctcaccaacgccatgaacatcttgccggagagtcgccggaatgattacgttcaggcggcaaacgagcttgtcgaaaacatgagtgagttggatttctatgtacggacgccaaaggtgtacgagtcctatctttactacgagaagacattgaaatcgatagacaatgttgtggagtttcttgcttaa

SEQ ID NO: 1793 - DNA, 1428 bp, Arabidopsis thaliana
atggccaccgcaagcaccgctgctactttcagaccctcctccgtttcagcttcttccgaattaacccatctgagatcaccctccaaactccccaaatttacgcctctgccatcggctcgctcacggtcctcttcttcgttctccgtctcctgcaccatcgctaaggacccagctgttgtcatggcggactcggagaagattaaggccgctggatctgatccgactatgtggcaacgacctgattcattcggtcgtttcgggaagtttggcggcaagtacgtccccgaaactctaatgcacgccctctctgaactcgaaacggctttctattcgctcgccaccgacgaagatttccagagagaattagcagagatcttgaaagactacgttggtcgggaaagtcctctttactttgcagagaggctcacggagcattaccgccgtgaaaacggtgaagggccgctcatatacctcaaaagggaagacttgaaccacaccggtgctcacaagatcaacaacgctgtggctcaggctcttctcgccaagcgtctaggaaagaaacgaattattgctgagacaggggctggtcaacatggtgtagccacagctactgtgtgtgcacgtttcggtttgcagtgcattatctacatgggtgctcaagacatggagagacaagctcttaatgtgttcagaatgcgtcttctcggtgctgaggtaaggggagtccactctggaacagccactttaaaggacgcaacttctgaagctataagggattgggtgaccaatgtggagactacacattacatattgggatccgttgcgggtcctcatccttatcctatgatggtcagagactttcacgcggtgattggtaaagaaacaaggaaacaagcgatggagaaatggggcgggaagcctgatgttctggttgcttgtgtcggtggtggttcaaatgctatgggactcttccatgaatttgtcgatgacacagaggttcgaatgattggtgtggaagccgctggatttggattggacagcggcaaacatgctgccacattgacaaaaggagatgtcggtgtactccacggagctatgagttacttgctgcaagatgatgatggccaaatcattgaaccacactccatcagtgccggattggactaccctggagtcggacctgagcatagtttccttaaagacgtgggaagggctgaatactttagcgttactgatgaagaagcattagaagctttcaagagagtgtctcggttggagggaataatcccggcattggagacatcgcacgcattggcccatctggagaagctttgtccgacgttacctgatggagccagagtggtattaaacttcagtgggagaggcgacaaggatgttcagactgcaatcaagtatctcgaagtttaa

SEQ ID NO: 1794 - DNA, 1968 bp, Arabidopsis thaliana
atgaaactctccgacgttggattagacgttgtcaaaactccgagattggttaaattgattgcgtttgcgtttctctcaatctcaacaatttttctcttcaatcacttctcagattccttctcttatccatctcttccttttcccatctcctcttcttcaaacgtcaccgaagctattcaaaccaacataacatccgtcgcggcggtggcaccatctcctccaccgcgtcctcgtctcaaaatatcacctcctccgcttccaccgacagtggtgagaacaggtatcatcaacgagaatggtgccatgtctgattccttcgaaatcggcggattcgatccagattccatcgacgagcttaaatcagccaccggaaattcgtcggttgaggaaaaagaatcgccggaagtcggttttcagattgagaaactcaaattgtgtgacaagacgaagatagattacattccttgcttagacaacgaagaagagataaagagattgaacaatacagatcgaggagaaaattacgagagacattgtcctaaacagagcttagattgcttgattccacctccagatggttataagaaaccaatccaatggccacagagcagagacaagatatggttcaataatgtgcctcatacacgtttagtggaagataaaggaggtcaaaattggattagaagagagaaagataagtttgttttccctggaggtggaactcaattcatccatggagctgatcagtacttagaccagatctcccagatgattcctgatattacatttggatcacgcacccgtgttgctttggacattggctgtggtgtggcgagctttggtgcgtttttgatgcagcgtaacacgacaaccttgtctgtagcaccaaaagatgttcatgagaatcagatacagtttgcattggagcgtggtgttcctgcgatggtggctgtctttgccacacggaggttgttgtatccaagccagtcttttgagatgattcattgttccagatgcagaattaattggacacgcgatgatgggatacttcttcttgaagttaatagaatgcttagagcaggaggctactttgtttgggctgcacaacccgtttacaaacatgaggataacttgcaagagcagtggaaagaaatgttagaccttacgaatcgaatctgttgggagcttatcaagaaagagggatatattgctgtgtggaggaagcctctaaacaacagctgctatgtcagtcgcgaagctggaacaaaacctcctttgtgcagacctgatgatgatcctgatgatgtttggtatgtagatatgaaaccgtgcatcacccgattacctgataatggctatggggctaatgtctccacatggcctgcacgtcttcatgatccgccagagaggctacaaagcattcaaatggatgcgtacatatcccgaaaggaaattatgaaggcagagtctagattttggttagaagtagtagagagttatgtgcgggttttccgctggaaggagttcaaactgaggaatgttctggacatgagagctggttttggagggtttgcagcagcattaaacgatctggggcttgactgttgggttatgaacattgttcccgttagcggattcaacaccttgccagttatttatgaccgtggactacaaggggctatgcacgactggtgtgagccatttgacacctacccaagaacctatgatctgatacatgctgcatttctcttctctgttgagaaaaagaggtgcaacataacaaacattatgctggagatggaccggatgttgagaccaggaggacatgtttacataagggattcactgtctttgatggaccaacttcagcaagtggctaaagccatcggttggactgctggtgttcatgataccggggaaggaccccacgcaagcgttaggattctcatctgcgataaacggatatga

SEQ ID NO: 1795 - DNA, 654 bp, Arabidopsis thaliana
atggagcagccgtacgtgtacgcatacccgcaaggtagtggcccctcgggagctccgactccacaagccggaggagtggtagtggatccaaagtactgcgctccttaccctatagatatggcgatcgtacggaagatgatgtcgttaacggacggcaatttcgtgataacggacgtcaacggaaacctgctgttcaaggtgaaggaaccggtgtttggtctccacgacaagagggtcttgctggatggttctggtactccggtcgtcactttgagagaaaagatggtgagcatgcatgacaggtggcaagtgtttagaggagggagtacggatcagcgtgatctgctgtacacggtgaaaagatcgtcgatgcttcagctaaagaccaaactcgatgtgtttttgggacacaacaaagatgagaagagatgtgatttcagagtcaaagggagttggctcgagcgttcttgtgttgtttacgccggcgaatctgacgccattgttgcccaaatgcacaggaagcacacggtgcagagcgtattcttgggaaaagacaacttctcggtgactgtttatccaaacgtcgattatgccttcatcgcctctctcgtcgtcattctcgatgacgtcaaccgcgaagaccgcgccgcctga

SEQ ID NO: 1796 - DNA, 1470 bp, Arabidopsis thaliana
atggaagaacatattcaagatcgccgtgaaattgcgttcttacactcaggagaatttctccacggagattctgactcaaaggatcatcaaccgaacgagtctccggtggaacgtcatcacgagtcgtctatcaaagaagttgatttcttcgctgctaaaagtcagccgtttgatcttggtcatgtgagaacaacgacgatcgttggatcatctggttttaatgatggattaggtttggtaaattcatgtcatggaacatcaagcaatgatggcgatgacaaaaccaaaactcaaattagtagactgaagttggagctagagaggcttcacgaggagaatcacaaactgaagcatttattagatgaggtcagtgagagttacaacgacctccaaagaagagttttgttagcaagacaaacacaagtggaaggtcttcatcataaacaacatgaggatgtacctcaagctggttcctcacaagctctagagaacagaagaccaaaggatatgaaccatgaaactccggccaccaccttgaaacgacggtctccagacgacgtggatggtcgtgatatgcaccgaggatcaccaaaaactcctcgaatagaccaaaacaagagtactaatcatgaagaacaacaaaaccctcatgatcaattaccctatagaaaagctagggtttccgttagagctagatctgatgccactacggtaaatgacggatgtcaatggagaaaatacggtcagaaaatggcgaaagggaatccatgtcctcgcgcttattatcgttgcaccatggccgttggatgtcctgtccgtaaacaggtccaacgatgcgcggaggatacaactatcttgacaacaacgtacgaaggaaaccataaccatcctcttcccccgtcagccacagccatggctgcaaccacctccgccgcagcagccatgctcttatcaggctcctcctccagcaacctccaccaaacactctctagcccctccgccacgtcatcatcatccttctaccataacttcccatacacctccacaatcgcaacactctctgcctcagctcctttccccaccataaccttagacctcaccaacccacctcgaccgctacaaccgccaccgcagtttctaagccagtatggtcccgccgcgtttttaccaaacgctaatcaaattaggtctatgaataataataaccagcagttattaatacctaatttgtttggcccacaagccccaccacgtgaaatggtcgattcagttagggctgcgattgcgatggatccgaacttcacggcggcacttgcggccgcgatctcaaacattatcggaggaggtaataacgacaacaataataatactgatattaatgataacaaggttgatgcaaaaagtggagggagtagtaacggagattcgccacagcttcctcagtcttgcaccactttctctacaaactaa

SEQ ID NO: 1797 - DNA, 726 bp, Arabidopsis thaliana
atgatcgccggagtattgcgccgatcttcactcccgtcgaggcagactctctccgccgcgttagcctccttcaattcgtgtatttcgcacaatctcactccagccaccaccggagcttccgtcagctctcgattcactctcgcgtcgtctcctaactcgtttggcatcagagcgaggaacatccacattagatctgagccgtcgatgattgttcccgcaggaatcgcgtcacaaggttacgccactgtcacaaaggatcgcaaaaacgagattaagaaagctaagattaaaatttctccagacaatgtcagaccattgagtaggaaggagatcgctctccagaaagaggcagcagaagaaagcacatcaaagataaaaggaacaaagatttgtatagcgattcggtcttttgttaacccggaaaagcaagcttggtgtcttcctcctcacactcgtaaagtcgcaatgcccgatacacgaactctgtacacggtgctaagatcgcctcacgtcgataagaagtctagagaacagtttgagatgaggttcaagaaacggtttcttgtcatcaaagctcagagtcatgagttgagcaagaagctgttttggttaaaacgttatcgtattcttggagctcaatatgaactccagttccattgcaagacccgtttggatatgactcaagtgttaggcaacatcaatggctccaccaccaatgcttactga

SEQ ID NO: 1798 - DNA, 1218 bp, Arabidopsis thaliana
atgcagaaacggagaacggtgaaggaatctacgaagataagaaatggtaaaggtatggattccggcgaaaagaagagatctgagaagagattgatgaagttcgaggagttacctaggtatttgaaagataacgagttcatacacaatcattatcgatgtgagtggtcaatcaaagaaactttcctcagcgctttctcatggcacaatgagactctcaacatctggacgcatttgtgtggatttgcgatatttacttggatgatggttgtgagttcaatggagacgacggagcttggcctcgccggctttgttagccttctctccgggaaaattaaacaaatttcaatctttttgggggatttgtgggtcctaatgacagagcaacaattcgctggccatggccgtcaatggcaatgtcaaaagatgtttacttctccagcgatcaaactctgcatcacttccatgtcacacctcttcgcctgtcactccagacggttcaacctcttcttctggcgtctagactacgctggaatctccctcatgatcgtctgttcattcttcgcacctatctactatgcattctcatgccacacttactggcgactcttctacctctcatcgatctcaatcctcggtctcctcgccatcttcactctcctctctccatcactctcagctccacgtttcagatctttcagagcagctctgttcctaacaatgggattttctggcgtaataccagccacacatgtgctttaccttcataaggatcacccaaacgtgcttatagctctcgtatatgaacttgcgatggctgtgttgtatgcaacaggagcagcgttttatgttacccgcatacctgaaagatggaagcctggggcttttgatattgcaggacatagccatcagatattccatgtgtttgtagtcttaggagctcttgctcatagtgttgccagtcttcttatcatggattttcgacgggcttctccttcttcatcgatgaatcccaaactcagaacagcgatcgcagatcgagcgacgattgtgttggggactttgattcgcaagatgggtcgttcttcgtttgatttctctgaaaagtctctccttttcgacattatcgtgacgccattagcaaagcttcggagtttgttgtcgttaggacagaatgagacgaagctactgtgttgtaagctaaagactgagggtgcttag

SEQ ID NO: 1799 - DNA, 1500 bp, Arabidopsis thaliana
atggttttctcagtttccatttttgcctctctcgctccgtacttagtctctgcgttactactcttctttctcatcgagcagctctcttacctcgtcaagaaacgtaacctccctggtcctctctttgtccctccgatcatcggaaacgccatttcactcgtccgtgatcctacttccttctggttcaagcaatccgacacggcaggcacttcccctggcctcgctgctaactacctcatcggcaaattcatcatctacatcagagacacagagctttctcatcaaatattctccaacgttcgtcttgaagcttttcaccctctaggacatccttttggcaaacaactattcggtgatcatagcctaatctacttgtttggtgaggatcacaaaactgttcgccgtcaccttgctcctaacttcacccccaaggcactctccacttactctgatctccaacaaatagttatgctccgtcatctacgacagtgggaggaaagtttctccggcggaactaagccggtttctatgcgagaccttgtccgtgaactcaatcttgagacttctcaaacggttttcgttggaccctaccttgacaaggaagctaggaacacgttctgtactgattacaatctgttcaatctcggatctatggcgctcccgatcaacctgcccggctttgcgttcaacaaggctcgccgggcggtaatgaacctggagaagacgctctccgtctgtgcgggaaaatccaaaaagaggatggctacaggagaggagccaacatgcttaatcgatttttggatgcatgcattcgtcacggagatagaatccggtaatccaccgccgcttcactccgaagacgaagccatcggcggtttgctcttcgattttctctttgccgcacaagacgcgtcgacgtcatcactcctttgggcggtgacgtttctagaatctcatccgaaagtgctgagcaaagtgagggaggaagtggccaagatttggtcacctcagtctggccatctgatcacggccgatcagctcgcggagatgaagtatactcgcgctgtggcacgtgaggtggtgagatatcgaccaccggcaactatggtcccacacattgctactaatgatttccctcttacagaatcgtacactatcccaaaaggtacaatagtgtttccctcggttttcgacgcctcgtttcaagggtttactgaaccgaaccggttcgatccggaccggtttagtgagacaaggcaagaggatcaagtgttcaaacgaaactacctagcttttggatggggtgcacaccaatgcgtaggccagcgttacgcattgaaccacctcgtgctcttcatcgctatgttctcatcgttgtttgatttcaagagacttcaatcggacggttgcgatgacatcatatactgtcccacgatatcgccaaaggacgggtgcacggtgttcttgtctaagcgcatcgtaacgtatccgaacctctga

SEQ ID NO: 1800 - DNA, 645 bp, Arabidopsis thaliana
atggaagcagaagtagaagaggaagaagaagacatgttcgaagacgccgtgtgtaccacgcaagcaagagtcaacacgccattgtccgtaatcacagaggccttcgaagatctcgcggatctggtgaaaccgcaacgatctgatgagatcgatgaagacgaattaaggcttgatgatttctgcagtgcgtgtactcacgtctctgttctcttcaattgtcttggattcgctttcaaatttgcggaaatggagtacatcgccaaggttaaggatttggtggaagcgtcgaaaacgttcgaaacgttacacaacattcttgacctagacgtggagaaagaaacggttaaaacaccggggagccattcgcgtaacctaagacgtgtgagacaagatgactattcgttgaaagacgctgcgacaacggcttacacggaagtgtgtgcaccgttccatacgtgggccgttagaaccgcggtttacgccggaatgtatacacttccgacgagggatcaacttctcttacggctcaatgaaactgatcaatcggttgagaagaacatgaggaggtacatggaagcatcgcgacctatcatagaatatattgacaagctttacattgaaaggaatattaaactcgattggtaa

SEQ ID NO: 1801 - DNA, 1803 bp, Arabidopsis thaliana
atggcgggtcgagttaaagaagacgagaagaacgagaagattattaggagtcttcttaaacttcctgagaataagaggtgtataaactgtaacagccttgtaaatggtgttcattggaaatgttgtttgagatatgcatatgtatttttgaacagtcgtgagtttacacatcgtgttaaatcgatatcaatggcgaaatttacctcacaagaagttactgctttgaaagaaggtggaaatcagcatgctaaggatatttattttaaaggattggatcaacagcggcaatcagtgcctgacggaagtaatgttgagcggttaagggacttcatcagacatgtgtatgtaaataaaaggtatacgaatgagaagaatgatgataagtctccaagtgagacacgtagttctagtggttctcggagtccaccttatgaagatggatatgaccgtcgttacggcgacagatcaagtcctggtgggagaagtccagggttcgagacgggtagtaggaatgctgttaataacagaaaaagccctgctcgtcctgagatcctgaatgattggcgcagagaggataggtttgggggtagaaaaacatcagaagagggctcccagtcacctgagcaagtaaaagacttgggttcagctagccctcctgtagctcgacctgttagggaaattttgggtgacagtgttattcctcttcgtgtgggagagcctccaaaaccccctgtcagtagaaataccgatgcttcagcacatgcaaagtcaggtacatcattgagtagtttaatgtccacaaatgagaagccaccagaagtgaagctggagactgctttaagcctgattgattttgatactgattttgaaactcctgctccatctgttgcaattcaagcaccactatcgaccacatctcagcctgctccacagccaacaacttcatctaatgataactgggcatctttcgatgctgcacccagtgcccctagtttaaatgtatcgcaaccaccacccagtggaaacacactggattcacttctctcccagttggcagtgacttcttctgtgccaggtcaggcgtctacaccatctaacggacctgtgaatcttggtcattccacgtcacaaatctttgcaccctttcagaatgagcattcgagtgaacagccatggaacacagcacttgcatctaatgtacagaggtcaatgagtgcaccgtcattgcaacctcttcaaggagtcccttctggtggcctgcagtcttctgaagttaaaccttcgggaagatcagaattacctgcggatttattcgctgtaaactacccatcataccatgcaccagtgcctggatggcaagctggtccacctcatgctatgcactatggcatgcagcagtataataaccccgtgccgtatcagaatgttccgcagccaggcaagtcaatgaacccttttgacttcagccctgggccgccatcacaaacacaaacggaaaatatgttcccttccatggctcctctgcaaggtgcattacctccttcaggcatgatgccttctcaaggagtacacaatcaattcaatataccttctcaaggctcagcccatccatctgcaatgccaccaaggtacatgccttctcaaataccaggaagcatgccacctagcaatgtaaacccaattggcgacataaacacgtcatatgacactcaacaaacatatcaaaattttggaagctcgtttgctgctgcagttcctttgaacccaccttctttccaatcaggaggaaacccatttgggtaa

SEQ ID NO: 1802 - DNA, 1350 bp, Arabidopsis thaliana
atggagcataagagaggacatgtattagcagtgccgtacccaacgcaaggacacatcacaccattccgccaattctgcaaacgacttcacttcaaaggtctcaaaaccactctcgctctcaccactttcgtcttcaactccatcaatcctgacctatccggtccaatctccatagccaccatctccgatggctatgaccatgggggtttcgagacagctgactccatcgacgactacctcaaagactttaaaacttccggctcgaaaaccattgcagacatcatccaaaaacaccagactagtgataaccccatcacttgtatcgtctatgatgctttcctgccttgggcacttgacgttgctagagagtttggtttagttgcgactcctttctttacgcagccttgtgctgttaactatgtttattatctttcttacataaacaatggaagcttgcaacttcccattgaggaattgccttttcttgagctccaagatttgccttctttcttctctgtttctggctcttatcctgcttactttgagatggtgcttcaacagttcataaatttcgaaaaagctgatttcgttctcgttaatagcttccaagagttggaactgcatgagaatgaattgtggtcgaaagcttgtcctgtgttgacaattggtccaactattccatcaatttacttagaccaacgtatcaaatcagacaccggctatgatcttaatctctttgaatcgaaagatgattccttctgcattaactggctcgacacaaggccacaagggtcggtggtgtacgtagcattcggaagcatggctcagctgactaatgtgcagatggaggagcttgcttcagcagtaagcaacttcagcttcctgtgggtggtcagatcttcagaggaggaaaaactcccatcagggtttcttgagacagtgaataaagaaaagagcttggtcttgaaatggagtcctcagcttcaagttctgtcaaacaaagccatcggttgtttcttgactcactgtggctggaactcaaccatggaggctttgaccttcggggttcccatggtggcaatgccccaatggactgatcaaccgatgaacgcaaagtacatacaagatgtgtggaaggctggagttcgtgtgaagacagagaaggagagtgggattgccaagagagaggagattgagtttagcattaaggaagtgatggaaggagagaggagcaaagagatgaagaagaacgtgaagaaatggagagacttggctgtcaagtcactcaatgaaggaggttctacggatactaacattgatacatttgtatcaagggttcagagcaaatag

SEQ ID NO: 1803 - DNA, 5129 bp, Arabidopsis thaliana
ggatgctgacgagactcgctctttgcgacgactccaagctcgaatccctagtctctaacctccttcctcttaccatatcttctctttcttctcaatctcccgttgttcgcaacaaggcaatgtgtgttgatttcatttttcaggttcttgagatattgagtcatgttaacaagagagtgaagcatcagcatgaaattggtttgcctttattggctttatggaaattgtacacagatcctgctgctgctcctatggttaggaactttgctattgtctatgttgagatggcttttgaacgagctcctgcaaaggtcattggagaatgtcatgcaagcaagatcagtgatgatgtgtctgcgaagtatagatctttgattacttctcaggataaagacttgtttctggatttttgccttcatatgcttttgtatcaaccatcttctcaaggaggtggatcttctcctgggctttcagtttttcaagttaatcgtataatcggaaagcaagcattaaaaggggacacgcttacaagacgaaagctgccaagcaatacattcctcactaagaactaccattttctaaaaattaatcaatttcttaagcagttggggatcttgaatgtcattggaaacatggacctacctggtgaatctgtatatccattgtacattgctgcatcagtggatagagttggtatggatttgttggtgaaaattcattcaagtcaagaacctgtagctaagagaggggaagagcttctaaaaaagatagcttctggaacaaatttggatgatcccaagttgataaacagactgttcttactattcaatggcactacaggcactgaaaatgttgctccggaacataatgtagctccaggaaatatatccttgaaaatgaagctcatgtctggtttctgtcgttctatcgcagctgcaaatagttttcctgcaacattgcagtgcatatttggctgcatgtatgatattttgtttcttttaaacttaactttcagagaaaagactgaaatggctgttcgtctttttgatgcgctgaaattagaaacccaatctcttcgttcaaccatccaggaggcaatagtttctcttgctgctgcatacaaggactccccagagaatattctcagagacttggaggtgcttctgctagcaaattctctggcggaacaaaatgaagctcgcttttgtgctttacgatgggcaacttctttgtataattcacaccattgtccaagtctctatatttgcatgctgagtgcagcagatccgaagctagatataagggaaatagcactcgaaggactctttctgaaagaagaaggtcgcagtatagtctctaatcatgaccataagtacccaaaatttattgagatgctggagtacattctcaagcaacagccaaaactgttagattcttcagaaatgagaagccagaagcttctctttccctcgcaagtctatctggtcatgataaagtttttagtgaagtgttttgagttagagatggaggagagcaatacccaggctgtagggactgaatttttggattcggcacaaaaaatgtgttcgttgttggaacattccttggcattcgaaggctcggctgaactacatgcttgtgcttctaaagcattggtttcagttggctcttaccttccggagatggttgaactttacttctcccgaaaaattgtgtggctaagaagtctgcttagtcatacagacttgagtactcgtgaatctgtatcacgattactcggaatggcatcctgtgctctgtctgatgctgaatcatgttccttgctctctgaattgatatcttcaatttcccaaccgcagaagttaaggtttgaggcacagcatgggggattatgcgctgtaggatttgtatcagcacactgtttacataggatccccactgtttctaaagcagttactcaaaatgcggtaaagtatttggtggaagttgttaatttagagactgcaccactggcttctgttgctatggaagctctgggtcatattgggatttgtggcgcattaccctttcttgttaatgattctagtccagggactcaagtgctggaaattcttcaagaaagattgagcaagctactctctggtgatgatataaaatcagttcagaaaattgctctttctcttggacatatctgttcaaatgaaacgtcatcttcgcacttgaaaatagcgcttgatcttttatttagcctttcacggtcaaaggctgaagaaattttgtttgctgctggtgaggcgctatctttcctctggggtggtgtaccagttactgctgatatgattctgaaaactaattatacttctctttcgacggactcaaattttctgatgaaagaagttaaatctttgtctgatgtcaaaactgatactgaggaagatagccgtaccacaaccagagaaacaattactggaaaactctttgacactcttctgtatagtagcaggaaggaggaacgatgtgctggaactgtgtggatgctgtctttgaccatgtactgtggccagcagccatcaatccaactaatgcttccaaaaatccaggaggctttctcacatttgttaggtgaccagaatgaacttacacaggagctggcatcccagggcatgagcatcatctatgaacttggtgatgcatcaatgaagaaaagcctggtagatgctctggtaaatactctaacaggcacaagcaaaagaaaacgagctattaagcttgttgaggagtctgaagtgtttcaagagggaactatcggtgagagtcctagtggagggaagattagcacttacaaggagctttgtaatcttgcaaatgaaatggggcaacctgatttaatttacaaatttatggacttagccaatcaccaagcttctcttaactcaaagagaggagctgcttttgggttctccaagatagccaagcaagctggagatgctcttcgaccacatttgcgactgttgattccgaggttgattcgttaccaatatgatcctgacaaaaatgtccaggatgcgatggcacacatttggaaagcactgatacaagaccctaagaaagctgttgatgaacatttgaatcacatcttcgatgatctgctagtacaatgtggttcacggctttggcgctcccgtgaggcatcctgtttggctcttgctgatattattcaaggtcggaaatttgaccaggtcaaggagcatttgaaaaaactatggatagctgccttccgtgcaatggatgacattaaagaaactgtgagaaatgctggtgataagttatgtcgtgccgtgacatccttaacaataaggatctgtgatgtcacgcttaccgaactagcagatgcaaaacaagcgatggatattgttcttccttttttgctttcagaaggaataatgagtaaagtcaacagtgtacgtaaggcttcaattggagttgttatgaagcttgcaaagttttactccaaacatgaaataattaatcagtttgaattacttgctagttttggtgaactgaatgtcctcctcggaaatatttatgatcctttaagtgattttgtgctattcgttaccgtttgcaggttgcatgctgccaatattggcatagaaaccgagaaacttgaaaatttacgaatttcaatctcgaaaggctctccaatgtgggaaacacttgatctgtgtattaatatagtggatattgaatcacttgaacaattgatccctcgtctcactcaacttgttcggggtggtgttggcctcaatacgagagttggtgttgccagctttatctcattgctagttcaaaaagttggttccgagataaagccgttcactggaatgctgctgagacttttgtttcctgttgccaaagaggagaaaagttctgctgcaaaacgtgccttttcgagtgcttgcggcattgtattgaagtattctagcccctctcaagctcaaagcttaatcgaagaaactgcagctctgcactctggtgatagaagctcccagatcgcatgtgcgagtctgttcaaaagcttctcatctacagctgctgatattatgagcagtcatcagtcggctattgttccagctatatttatttccagatttgaggatgaaaaacagatttcgagtctctttgaggaggtgtgggaagacatcacaagtggtgaaagggtcacactacagttgtttctgcaagaaattgtgaatcatatctgcgagagcatcacatcatcctcaagatttaaactttctttcagtctgggaaaggatgctcttttggatgccctaggtgctctttcagtcgcttgccacgaggcaataactaaggaggacccaacaactccgactaccatcttgagtcttatctgttctgcatgcaaaaagaaactcaagaaatatcgcgagtcagccttttcttgtctggagaaggtcataatagcttttggcgatccaaagtttttccatgccgttttcccgatgttgtatgagatgtgtaatactgcctccatcaaaacgaacactcaagttcaggcagcaagtgatgctgtcaaaacagaatcagaaaatggagaagatggacatgtccctcttgaaaaaattatggaatgcgtcaagtcttgcatccaagtggcaactatagatgacattcttagcgcaaaagcagatttgattcatgttcttataatttccttatcacctggttttctgtggactgtaaaaatgtctggaatttcatgtgtgggaaagctttgttcaaggtttccgagtctatggactgactccatggatgacctttcacctagtgatgcgacaaaattcgttcatgagttatttcactcactagttcctaaactcctggagtgcatacacactgtgaagatagcacagtttcatgtggctgcttcccaatgcctgcttgagctcatcgaactgtatagcacaatctcgtctttgcatcccgtggaagtagattttaaggctgaggttgtttctttacttgaactcgaaaagagtgaagaagccaagtcgttgttgagaaaatccagggatgctcttgcaaatctcccttcgttaaactaa

SEQ ID NO: 1804 - DNA, 1278 bp, Arabidopsis thaliana
atgacgatcgttaaaccgtcgcagttctcattctccggcggcggatcttcgccgttatgttcactcaaaagctcactcctcaccgtcgctattctcactttcatttccctcttctacctctctctcaattccttacgcacttcgccgccgtctcctgtcatcgtggtaacaccgattcatgttcctcataccttcgtgaatgagtataagactgataacgaaacaccgacgatggaagaagaaacctactccgatgtttatcactcaccggaggctttccgattgaattacgccgagatggagaagagattcaaggtttatatttatcccgacggcgatccaaatacgttttatcaaacgccgaggaaagtcaccggtaaatacgctagtgaggggtacttcttccagaacattagagagagtcgatttcgaaccctagatccagatgaagcagatctcttcttcattccaatctcttgtcacaagatgcgaggcaaaggaacatcatatgaaaatatgactgtgattgttcaaaactatgttgatggattgatagctaagtatccttattggaatagaactttaggagcagatcacttctttgttacatgtcatgatgttggtgttagagcatttgagggatctccgcttctgattaagaatactattagggttgtgtgctcacctagctacaatgttggtttcattcctcacaaagatgttgctttgcctcaagttcttcagccatttgctctccctgctggtggaaatgatgttgagaatcggacgactcttggtttttgggctggtcatcgaaattctaagatacgggttatacttgctcatgtgtgggaaaacgacacagagcttgatatttcaaacaacagaattaacagagctacagggcatttggtgtatcagaagagattctaccggactaaattctgcatatgccctggtggttctcaagtaaacagcgctcgcataacggactcgatccattacggatgtattcctgtcatattatcagactactacgacctccctttcaacgacatcctgaattggcgaaaatttgcggttgtactcagagagcaagatgtctataaccttaagcagatcctcaagaacatacctcactcagagtttgtttcgttgcataacaacttggtcaaggtgcagaagcattttcaatggaactcacctccagtcaaattcgacgcatttcacatgatcatgtatgaactatggttacgccaccatgtcgtcaagtactga

SEQ ID NO: 1805 - DNA, 432 bp, Arabidopsis thaliana
atggagactctccagattcgtaaacccacttccctccccgtttctcaacgccctaatgcagcagccaccgccgacgatgagcctggtctcatccgccgtcgtctctcttctctatcactcaacctctcaaaccaaccagcagcgatcgcagctagattcccgagatccaaatctgtttccgccatgggagaacaagcaggaagctctgtgaaagaatggtgggaatggggttggtcatggatcctttcaagaaaacctatattcatcagagatcttgagcttaacaaagacgaagctaaatcgattggttcacaaaacagaggaagtataatgcacgttttcttcaaactccgatctcagatccgtaatttcatgggaccttcttcagaagattctcttcctctttcttgcaaatacaagcgtcaacgataa

SEQ ID NO: 1806 - DNA, 1317 bp, Arabidopsis thaliana
atgttgaacctcattgctttcctccgccgtcgtctccgccgtccccggaaagccagaatctccgtcaaccaccaccacctctcagttgattcttctcctgagactcatcatcatcaaaatggcttttcatcggcagccgccatccacccaaacccggacaaaaccatcacagtggccacctttaacgctgctatgttctccatggctcccgccgtccctagcaacaagggcttgccattccggtccaagtctacggttgaccgccccaagagcattctcaagcccatgaacgccgccgcatctcctactcacgactctagaaagcaacagaggtttgccaaatccaggcctaggagagtctccatcaatctccccgacaacgagatcagccgccagctcagcttccgggaggatccacagcactctcccctcaggcccggcgagatcggtctccggagcaccagaacggctctggaagtgctgagtgagctagacgcagacgtgctggctcttcaagacgtcaaggcggacgaggctgaccaaatgagaccgctctccgatctcgctgcggcgctggggatgaattacgtcttcgccgagagctgggcgccggagtacggcaacgccattctctctaagtggcccatcaaaagctccaatgttctaagaatcttcgaccacactgatttcaggaacgtgttgaaggcgagcatagaggttcccgggagcggggaagtggagtttcactgcactcatctggatcacttggacgagaagtggagaatgaagcaagtcgatgccattatccaatccaccaacgtaccgcacatactcgctggtgctctcaattctctcgacgaatccgattattctcctgagagatggaccgacatcgtcaagtattacgaagagatgggtaagccaataccaaaagcacaagtgatgagattcttaaagagcaaagaatacactgacgctaaggactttgctggagaatgcgaatctgtggttgttgtcgccaaaggccaaagtgtgcaggggacatgcaagtacgggacacgcgtggactacatacttgcttcctccgattcaccgtaccggttcgtgccagggtcgtattccgtgttgtcttccaaaggaacctcggaccatcacatagtcaaagtcgatgttgtaaaagctacatcgatcaacgtcaacgagcaggagcagcgaccgataagatcacataagctgcagagaattacagcgactacgtataataataactcgtctctcacaaaggcctcgtggaggacacactactataaagcatga

SEQ ID NO: 1807 - DNA, 531 bp, Arabidopsis thaliana
atggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggataccgcagcggcggtggtggaggttactccggtggaggtggtagctacggaggtggcggcggtagacgcgagggtggaggaggatacagcggcggcggcggcggttactcctcaagaggtggtggtggcggaagctacggtggtggaagacgtgagggaggaggaggatacggtggtggtgaaggaggaggttacggaggaagcggtggtggtggaggatggtaa

SEQ ID NO: 1808 - DNA, 558 bp, Arabidopsis thaliana
atggctgaggaaatcaagaatgttcctgaacaggaggtgccaaaggtagcaacagaggaatcatcggcagaggttacagatcgtggattgttcgatttcttgggaaagaagaaagacgaaacaaaaccagaggagactccgatcgcttcagagtttgagcagaaggttcatatttcagagccggagccagaggttaaacacgaaagtcttcttgaaaagcttcaccgaagcgacagttcttctagctcctcaagtgaggaagaaggttcagatggtgagaagaggaagaagaagaaggagaagaagaagccaactactgaagttgaggtaaaggaggaagagaagaaagggtttatggagaagttgaaagagaagcttcctggacacaagaaacctgaagacggttcagccgtcgctgcggcaccggtggttgttcctcctcctgtggaagaagcgcatccagtggagaagaaagggattcttgagaagattaaggagaagcttccaggataccaccctaagaccaccgtagaggaggagaagaaagataaagaataa

SEQ ID NO: 1809 - DNA, 891 bp, Arabidopsis thaliana
atgactgtttcttcatctccatgggctctcatggctctctttctaatggtttcttcaacaatggtaatggctattcctccacgcaaggccattgatgtaccatttggtcgtaactacgtcccaacttgggcttttgaccaccagaaacagttcaatggcggttccgaacttcagcttatcctcgacaaatacactggcacaggatttcaatcaaaggggtcatatttgtttggacattttagtatgcacataaagcttccagctggtgacacagccggagttgtcacagctttctatctatcatctaccaacaatgagcatgacgagatagactttgagttccttggaaacagaacaggacaaccagctatattacagacaaatgtattcacaggaggaaagggaaacagagaacaacgaatctatctctggtttgatccttctaaggcttatcacacttactcaatcctttggaacatgtaccagatcgtattctttgttgacaacataccaatccgaacgttcaagaatgctaaggatctaggagtacgtttcccattcaaccaaccaatgaagctttactcaagcctttggaacgcggatgattgggccacgagaggcggtttagagaagaccaattgggccaatgcacctttcgttgcatcttacaaaggattccacatagatggttgccaagcttctgtggaagccaagtactgtgccacacaaggccgcatgtggtgggatcagaaagagttccgtgaccttgacgctgaacaatggcgtcgtctcaaatgggttcgtatgaagtggaccatctacaactactgtaccgaccggactaggttcccggttatgccagctgaatgtaaaagggacagagacgcataa

SEQ ID NO: 1810 - DNA, 1509 bp, Arabidopsis thaliana
atggtgctctcccacgccgtatcggagtcggacgtctccgtccactccacattcgcatcacgttacgtccgtacttcacttcctaggttcaagatgccggaaaactcgattcctaaggaagcggcgtatcagatcatcaacgacgagctgatgcttgacgggaatccacggttgaacttagcctcctttgtgacgacatggatggagcctgagtgtgataaactcatcatgtcctccatcaacaagaactatgttgacatggacgagtaccccgtcaccaccgaacttcagaaccgatgtgtgaacatgattgcacatctattcaatgcaccgttagaagaggcggagaccgccgtcggagtaggaaccgttggatcatcggaggccataatgttggccggtttggccttcaagcgtaaatggcagaacaagcgcaaagctgaaggcaaacccgtcgataaacccaacattgtcaccggagccaatgttcaagtgtgttgggagaaattcgctaggtactttgaggttgaacttaaggaagtgaaattgagtgaaggatactatgtgatggaccctcaacaagctgttgatatggttgatgagaacaccatttgtgttgcggccattcttggttccactcttaatggagaattcgaagatgttaaactcttgaacgatctcttggtcgaaaagaacaaagaaaccggatgggatacaccaatccacgtggatgcggcaagtggaggattcattgcaccgtttttgtatccggaattggaatgggactttagacttcccttggtgaagagtatcaatgtgagtggtcacaagtatggacttgtgtacgcagggattggttgggtgatctggagaaacaaagaggatttgcctgaggaactcatcttccatatcaattatcttggtgctgaccaacccacctttactctcaatttctccaaaggttcaagtcaagtcattgctcaatactaccaacttatccgattgggccacgagggttacagaaatgtgatggagaattgcagagagaatatgatcgtcctaagggaaggacttgagaagacagaaaggttcaacatcgtctcaaaggacgagggagtgccacttgtcgctttctccttgaaagatagcagctgtcacactgagttcgaaatctccgacatgcttcgcaggtatggatggatagtgccggcctacacaatgcctccaaatgcacaacacatcactgttcttcgtgtggttatcagagaagatttctcgagaacactcgctgagagacttgtgatcgatatagagaaagtgatgcgtgagctcgatgagcttccttcgagagtgattcacaaaatatcacttggacaagagaagagtgaatctaacagcgataacttgatggtcacggtgaagaagagcgatatcgacaagcagagagatatcatcactggctggaagaagtttgtcgccgacaggaagaagacgagtggtatctgctaa

SEQ ID NO: 1811 - DNA, 936 bp, Arabidopsis thaliana
atgtcggtgacatcaacggtggaggagaaccaccagaaaaatccatcaacgccggcggcggtggaggagaagaagaagaggagatgggtgttttgggatagaaggtggaggagattagattatgtgaaattctcagcttctttcactgttcattctcttgctctcttggctccgttttatttcacttggtcggctctttgggttacgtttttgttttacaccatcggtggtcttggtatcaccgtctcttatcatcgcaacttggctcaccggagtttcaaagtccctaaatggcttgagtatctcttagcctattgtgcccttctcgctattcagggagatccgattgattgggtgagtacacatcgttaccatcaccagttcacggattcagaacgtgatccacatagtcctaaggaaggtttttggtttagtcatcttctttggatctatgactctgcctatcttgtttcaaaggtgattttattttgtggaagaagagcaaacgtggaggatttgaagaggcaatggttttataggtttcttcagaaaacagtgctatttcacattttaggattgggtttctttctcttctaccttggtggcatgtccttcgttacttggggaatgggggtaggagcagcattggaagtgcacgtgacttgcctcataaattcactctgccatatttggggcactcgaacttggaagaccaatgacacttctcgtaatgtttggtggttatcggtattttcatttggagagagttggcacaacaatcatcatgcgttcgagtcatcggctagacaaggacttgaatggtggcaaatagacatttcgtggtacattgttcggtttttcgaaattatcggtttagcgaccgatgtgaaagtgccaacggaggctcaacgacgtcgtatggctatagttcgttga

SEQ ID NO: 1812 - DNA, 1446 bp, Arabidopsis thaliana
atgggatctcatgtcgcacaaaaacaacacgtagtttgcgttccttatccggctcaaggccacatcaacccaatgatgaaagtggctaaactcctttacgccaaaggcttccatattaccttcgtcaacaccgtctacaaccacaaccgtctcctccggtcccgtgggcctaacgccgttgacgggcttccttctttccggtttgagtccatccctgacggtctacccgagactgacgtggacgtcactcaggacatccctactctttgcgagtccacaatgaagcactgtctcgctccattcaaggagcttctccggcagatcaacgcaagggatgatgttcctcctgtgagctgtatcgtatccgacggttgtatgagcttcacacttgatgctgcggaggagctcggtgtcccggaggttcttttttggacaactagtgcttgtggcttcttggcttacctttactactatcgcttcatcgagaagggattatcaccaataaaagatgagagttacttaaccaaggaacacttggacacaaaaatagactggataccatcgatgaagaacctaagactaaaagacatccctagcttcatccgaacgactaatcctgacgacatcatgctcaactttatcatccgtgaggctgaccgagccaaacgcgcttcagctatcattctcaacacgtttgatgatctcgaacacgacgttatccaatctatgaaatccattgtacctccggtttattctattggaccgttacatttactagagaaacaagagagcggcgagtatagtgaaatcggacggacaggatcgaatctttggagagaggagactgagtgtctggactggctaaacacgaaagctagaaacagtgttgtgtacgttaacttcgggagtataactgttttgagcgcaaaacagcttgtggagtttgcatggggtttggctgcaacggggaaagagtttttgtgggtgatccggccggatttagtagccggggatgaggcaatggttccaccggagtttttaacggctacggcggaccggaggatgttggcaagttggtgtcctcaagagaaagtcctttctcatccggccattggagggttcttgacgcattgcgggtggaactcgacgttggaaagtctatgcggtggagttccaatggtgtgttggccgttttttgcagagcaacaaactaattgtaagttttctcgtgacgaatgggaggttgggattgagattggtggagatgtgaagagagaagaggttgaggcggtggttagggagttgatggatgaagagaagggaaagaatatgagagagaaggcggaagagtggcggcgcttggcgaatgaagcgacggagcataagcatggttcttctaaattgaactttgagatgctcgttaataaggttcttttaggggagtag

SEQ ID NO: 1813 - DNA, 996 bp, Arabidopsis thaliana
atggtccccttttggactacagtttctcgaaatggctcatcagactcagagacgactctccaatctgcttcaaaagccacaaaacagtataaatatccttctcttcgtccctctcatcgcctgtctctcctcttcctcttcccgttccatttatccgcaaacggagcttgttttcggtgcacctgcttcagccacttcaaacttgaactgagaaggatgggaaacgaatcatatgaagacgccatcgaagctctcaagaagcttctcattgagaaggatgatctgaaggatgtagctgcggccaaggtgaagaagatcacggcggagcttcaggcagcctcgtcatcggacagcaaatcttttgatcccgtcgaacgaattaaggaaggcttcgtcaccttcaagaaggagaaatacgagaccaatcctgctttgtatggtgagctcgccaaaggtcaaagcccaaagtacatggtgtttgcttgttcggactcacgagtgtgcccatcacacgtactagacttccatcctggagatgccttcgtggttcgtaatatcgccaatatggttcctccttttgacaaggtcaaatatgcaggagttggagccgccattgaatacgctgtcttgcaccttaaggtggaaaacattgtggtgatagggcacagtgcatgtggtggcatcaaggggcttatgtcatttcctcttgacggaaacaactctactgacttcatagaggattgggtcaaaatctgtttaccagcaaagtcaaaagttttggcagaaagtgaaagttcagcatttgaagaccaatgtggccgatgcgaaagggaggcagtgaatgtgtcactagcaaacctattgacatatccatttgtgagagaaggagttgtgaaaggaacacttgctttgaagggaggctactatgactttgttaatggctcctttgagctttgggagctccagtttggaatttcccccgttcattctatatga

SEQ ID NO: 1814 - DNA, 555 bp, Arabidopsis thaliana
atggctgaggttttgcgtcccgagatgttagatatctctaacgacacttcttcattagcatcaccgaaacttcttcatgttcttgctgttgatgatagtatggttgatcggaagttcatcgagcggttactcagagtctcatcttgtaaagttactgttgtcgatagtgcgacaagagctttacaatatcttggattagatggagagaataatagttcggttggatttgaggatctgaagattaatttgataatgacggattactctatgcctgggatgactggatatgaactactgaagaagatcaaagaatcatcagctttcagagaaataccagttgtgattatgtcttcagagaacatcttgcctcgtatcgatagatgtcttgaagaaggagctgaagatttcttattgaagcctgtgaaattagctgatgtgaagagattaagagattctttaatgaaagctgaggaaagagcttttaagaatattatgcacaagagagagcttgaagctaatgatatctactcgcagctaaaacgcgcaaagatctga

SEQ ID NO: 1815 - DNA, 1080 bp, Arabidopsis thaliana
atggactcggtggctctctactgcaccgctggtctcattgccggcgccgtctactggttcatatgcgtcctaggtccagcagaacgaaaaggcaaacgagcctctgatctctccggcggctcaatctccgcagaaaaagtcaaagacaactataaccaatactggtctttcttccgcaaaccaaaagagatcgaatcagccgagaaagtacctgacttcgtcgacacgttctacaatcttgtcactgatatctacgagtggggatggggacaatctttccatttctctcctcatgtccctggaaaatccgacaaagacgccacaagaatccacgaagaaatggccgtcgatctcatcaaagtgaaaccgggacaaaagattcttgacgctggttgcggcgtgggtgggccgatgagagccatcgcggcccattccaaggcccaagtcactggaatcactatcaacgagtaccaagtgcaacgagccaagcttcacaacaagaaagctggacttgattctctctgcaacgtcgtttgtggtaactttttaaagatgccgttcgatgaaaacacgtttgacggagcttactcgatcgaagctacgtgtcacgctcctaagctcgaagaagtatactcggagatcttcagagtgatgaaaccaggatctttgttcgtgtcctacgaatgggtcaccactgaaaaatacagagacgatgacgaagaacacaaggacgtgattcaagggatcgagagaggagacgcacttcctggactaagaagctacgctgatatagccgtgacggcgaagaaagttgggtttgaggtagtgaaggagaaagatttggctaaaccaccgtctaaaccgtggtggaaccggttaaagatgggaaggattgcttattggagaaaccatgttgtggttgtgattctttctgctattggggttgctcctaaaggaactgttgatgttcataagatgttgtttaagactgctgattatttgaccagaggtggtgagactggaatcttctctccgatgcatatgattctctgtagaaaaccagagaaagcttctgaatga

SEQ ID NO: 1816 - DNA, 1059 bp, Arabidopsis thaliana
aatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgcgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtg

SEQ ID NO: 1817 - DNA, 1044 bp, Arabidopsis thaliana
atgtggagctacgtttggttaccgttggtagctctatctctctttaaggatagcatcataatggccaaggctgcgacgattctcctccctagtcaaaccggatttgatatttctcggagtccggtatgctctgctccggatccgaacctaaattacagaccggttattggtattctgagccatcctggcgacggtgcgtcaggtcgtttgagcaatgctacagacgcgtcctccattgcggcttcgtatgtgaaattagctgagtctggtggagcacgtgtgatcccactcatctttaacgagcctgaagaaattctctttcagaagctagaattggtcaacggtgtgatactaactggtggttgggctaaagaaggattgtattttgaaatcgtcaagaaaatcttcaataaagttttggaaagaaatgatgctggagagcattttcctatatacgctatttgcctcggatttgagctcttgacaatgatcataagccagaacagagacatttttgaaaaaatggatgcaagaaattctgcatcaagtcttcagttcgttgaaaatgttaatatccaaggaaccatattccaaagatttcctccagagctgttgaaaaaactcggtacagattgtctggttatgcagaatcatcggtttggtatctcaccacaaagctttgaaggaaatattgctctgtctaatttctttaaaattgtcacaacatgcgttgatgacaacggcaaggtttatgtttcaacagttcaatcaacaaaatatccagtgaccggcttccagtggcatcctgagaaaaatgcattcgagtggggatcatctaaaattccacactctgaggacgcgatccaggtgactcagcacgccgcaaatcatctagtcagtgaagctaggaagtcactgaacagaccagagtctaagaaagtgctgagcaatctcatttacaactataagcctacttactgtggatacgcagggattggttacgacgaggtttacatcttcacacaacaacgatcccttctctaa

SEQ ID NO: 1818 - DNA, 1014 bp, Arabidopsis thaliana
atgggtcattgcttttcgttaccgtcttctcaatcggagattcatgaggataatgagcacggtgatggaaatgtggtgtgttatggagaagagttcggtttagatcaagaccttccggttcatcgactcggttcggtctgctccatacaaggaaccaaagtgcttaaccaagatcatgctgttctttaccagggatatggaacaagagatacagagctatgtggagtgtttgatggacacggcaaaaatgggcacatggtgagcaaaatggtgaggaatagattgccatcggttttgttagcactaaaggaagagctaaaccaagaatctaatgtttgtgaagaagaagcttcaaaatgggaaaaggcttgttttactgcctttagactcattgatagagagcttaatcttcaagtctttaattgctctttcagtggctccactggtgtggttgccataactcagggagatgatcttgtgatagcgaaccttggtgattcaagggcagtattggggacaatgactgaagatggtgagatcaaggcagtacagttaacatcagacctaacacctgatgttcctacgagttctagcgtttcaggtgaagcagagaggatcaggatgtgcaaaggtcgtgttttcgcaatgaaaacagaaccaagcagccaaagggtgtggttaccaaaccaaaacataccaggattagccatgtcaagagcttttggagatttcaggctcaaagaccatggtgttattgcggttcctgaaatctctcaacaccgaattacttctaaagaccagttccttgtactcgctactgacggggtttgggatatgcttagcaatgatgaagttgtatcgcttatatggagttccgggaaaaagcaagcttcggccgctaaaatggtggcggaggcggctgaagctgcatggaagaaaaggcttaagtatacgaaggtagatgatattacagtaatatgtcttttcttacagaacaaggaacaaccaagttga

SEQ ID NO: 1819 - DNA, 1761 bp, Arabidopsis thaliana
atggttgcggcgaaagagaacaagtttctgacagtggcaccttttgagtgtgcttggagtgatgatctgaagttccgggaagcgggaagaggttgtgttgcgtttgatgcgtttgctcacaatgatgtcacggtggtgtttagagagaatgtggggactcaacattaccattataagaaagataatagtcctcactacattgttatcattggtagcaataggaatcgtaggttgaagattcaggtagatggaaaatctgtggtcgatgaggaagcttctgatctttgtcgttgttctttggagtttcagagttactggattagtatctatgatgggttgattagcattggtaaaggtcggtatccgtttcagaacctggtatttaagtggcaagaccccaagcccaattgtaatgttcagtatgttggtctgagcagctgggataaacatgttggatatagaaacgtgagtgtgtttcctgtgacacataatcatatcttgctgtggaagcaagtggattgccgtgaagttagaggagatgagtctggtgacgagaaggttgtggaggaagggactggttatgattatgaacaatggggacttgggaatttcttggagagttggcaattatctgacacagtcttccttgttggtgaagaggaaatggatgtccctgctcacaaggttatattacaagcatcaggtaattttcctttgagatcatctgatggggatgtcattcaacttcgtggagtgtcgtacccgattcttcatgctcttcttcaatatatctatactggacgaactcagattttggaatcagaacttgctccattgcgggatttaagttctaagtttgaagtgatgtcattggtgagacagtgtgaagaaagtatagaccattttaaattgagcaaaacagcatttgactcctgcagaaaagtcaaactcttgtgtcctatttctcacccgttatctggctttatgttcccaagtgctttccctgttgatgttgggaagctggtaaagttgtactcaaccggcgaatatagtgacataaaaatctacctcagtgaccatagtctcactttccaatcccacaaagtcattctaagtctttggagtgttgcatttgcaaagatgtttacaaatgggatgagtgaaagccattcatcaacgatttacctaaccgatgtatcaccagaagcattcaaggctatgatgaatttcatgtatagtggagagttgaacatggaagacactgtgaattttggcaccgagttgattcatcttctctttctagctgaccggtttggagttgttccacttcatcaagaatgctgcaaaatgctcttggagtgcctctcagaggattctgtatgctcagttctccaagtggtttcgtctatctcatcatgtaaactcattgaggagatgtgcaagaggaagttctccatgcacttcgactattgtaccactgcaagtttggactttgtcttgttagatcagaccaccttcagtgatattcttgagtctgcagatctgacggtgacatctgaagaaaagattctgaatgctgttctcatgtggtgcatgaaagctgaggagtcgcacagttggggagtaatagatgagatgatgaactatgctgaccccaaaagtttgttcaaagaaaggcttcagtcacttgatgacctgttacctcatgtacgcttctctttgttgccatatgagttacttaaaagggtaagtggatcctga

SEQ ID NO: 1820 - DNA, 126 bp, Arabidopsis thaliana
atgaatagcacggccaatgacgatgaaaggatgaataggatcatcagagatggccgtcgtcgttacgtcacctggagccgcagccgcaacccttcggcagctcatatcttttggtcaaaaccctaa

SEQ ID NO: 1821 - DNA, 804 bp, Arabidopsis thaliana
atggctggagaggagttgttgaaactgttcgagcaaaactggtcagagaggccaatcttcaagaaagacaaagagaatctgaatggaaaaagtagagagaagcgtggagaaaaagagattctagaggaacgacgagaagaagaagcactgaagaattttccggtgagctttcttgtagagagggctatgagtgacgagacgatgatgacgacgagttccaagacaagtttgtttagttcttcatcagatgatttgttcttgtctcctagatcggtcttacccgttaaaccaacgccgatgaagcttcagacgatcctctccggaaaagaagtcaacgcgttcacgattgcggaaagagagagactactttcagagaaggaagagcagaggaagaagaagaagaagaagagtaatgtgagaacaagaaagggaaagagtatgtcggatttggagtacgaggagcttaaagggtttatggatctaggttttgtcttttccgaggatgaccataaagactccgatctagtttcgattcttcctgggttacagagattggtgaagaaagatgatggagtaacaaaagaagaagaagaagaagaagaagaagacaaaatcggtggaaacagagcagcgagaccgtatttgtcggaagcgtgggatcattgtggaggaagaaaaggaaaaaaacaaatcacgccggagattaagtggagagttccggcgccggcggcggctagcgaagttgacttaaaagataatctaaggctttgggctcatgctgtggcctcgactattcgaagttaa

SEQ ID NO: 1822 - DNA, 477 bp, Arabidopsis thaliana
atggatcatgatcacatgcatgacatgccaccaccatcaccatcatcatcatcgatgtcgaatcatacaacaccacacatgatgatgatgcacatgaccttcttttggggtaagaacacggaggttctcttctccggatggcccgggacaagctccggcatgtacgctctctgtctcattgttatattcctcctcgccgtaattgccgagtggctcgctcattcaccgatcctacgtgtcagtggctcaaccaatcgagccgccgggctcgctcaaaccgctgtgtacacactcaagactggcctttcgtatttggtgatgctcgctgttatgtcctttaacgcaggtgttttcatcgtcgctatcgccggctatggcgttggtttctttctctttgggagcactactttcaagaaaccctccgatgaccagaaaaccgccgagcttcttccgccgtcttcaggctgcgtttgttga

SEQ ID NO: 1823 - DNA, 687 bp, Arabidopsis thaliana
atgacgctttttcacttcttcaactgtgcgattctcacattcggtcctcacgcggtctactactccgccactcccttatctgaatatgatacacttggaacctccgtgaaagctgctgttgtttaccttgctactgcattggttaagcttgtttgtttggcgacttttctgcaagtgtctgagactgaagtgtttgacccataccaggaagcattgaaagcgatgattggattcatagatgtcgctggtctgtattatgctctggcccagctgactcacaggaacatctcccaaaaccataagtttcaggctgttggtctcgggtgggcattcgcggattctgttttgcacaggttggcacctctctgggttggtgctcgaggactggagttcacttgggattatgttttgcaagggcttgaagccaatgcaaatctggtgttcacgatatctctagctgcactaggttcattaatgtggctacgcaagaacaagccgaagagtctgatccccatcatatacacatgtgcagtcatcattgcgacaatgccttcgatcacaagctatctaaagagagtcaatggatggcatttcccgaaaattgttgggtttgagctggcgacttctctggtaatggcttttatcagttgtcaactcttcatcctctgtcagagaccgtctttgtga

SEQ ID NO: 1824 - DNA, 345 bp, Arabidopsis thaliana
atggaagacggccatatatcatcctggtgggtggtggacttaggcgaagaacatcagcttatgtgcaactattacaccttcagacaagacggatcaagagcattcacaagattctggaagtttcagggatcgatggatgggaaaacatggacagacttgagagtccatgaggatgaccaaacaatgtgcaaggccggtcagtttgcatcatggccaatcaccgcagcaaatgcattactcccctttaggtttttcaggctggttctgaccggtccaactgcagatacatcaactccgtggaacttttgcatttgctacttggagctctacggttacttccgttga

SEQ ID NO: 1825 - DNA, 765 bp, Arabidopsis thaliana
atggctatatcactgaagaggaaccgtttcttcattccttatacgaatctcgtcttcttcttcttcttgtgtgtctctctgctcgataaaactgtatccatcaggatttcgaatcagatctcggatactgtcgttgattctcccgatcgtcctttgaaatctgcggttttcgctcttggaagcttctggagatcggaggcggcgtttggttgtatcaatggcgtcgtacgaacctccgccggttacgccggtggaacgaagacgaatccggagtataggaacttaggtgatcacgccgagtccgtacaggttgaatatgatccaaggataattggttatcgtcagctcttagatgtattttggtctagtcatgattctagacaagtgtttggacaaggtcctgatgtgggtaatcaatacagatcctgtattttcactaattctacagaagaattgagactggcttctaccagcaaagaaagggagcaacttaatacaagaagcagtatcgtgaccactcaaattcaacagctaggaacgttttatcgcgcagagcctgatcaccagaagttcgagctgaaacaacatccatttcttattcagctaattggaaacatggtagaagaagagcttgagagatcagctctagccacaaaactaaacggttacgcagccgagctctgcccgcctagaatccagaaacatatcgactctagagttaatgagatcattagaaaaggttggcccgtcttgagagacatctaa

SEQ ID NO: 1826 - DNA, 1467 bp, Arabidopsis thaliana
atggaattggattcggagaacaaattgttgaagacgggtttggttatagtggcgacacttgttatagccaaactcatcttctctttcttcacttctgattctaagaagaagcgtcttcctcctactcttaaagcttggcctccattggttggaagtcttatcaaattcttgaaaggacctattattatgcttagagaggaataccctaagcttggaagtgtgtttactgttaatcttgttcacaaaaagattacttttcttattggtcctgaagtctctgctcattttttcaaagcttctgaatctgatcttagtcagcaggaagtgtatcagttcaatgtccctacttttggtcctggagttgttttcgatgttgattattctgttcgtcaggagcagtttcggttcttcactgaggcacttagagttaacaagttgaagggttatgtggatatgatggttactgaagctgaggattacttctctaaatggggagagagtggtgaagttgatattaaggttgagctagagaggctcatcatcttgactgcaagtagatgtttactgggtcgagaagttcgtgatcagctttttgatgatgtctctgctttgttccatgaccttgacaatggaatgcttcccatcagtgttctcttcccatatctcccaattccagctcaccgccgtcgtgaccgtgcccgagaaaagctttcggagattttcgcaaaaatcattgggtcgagaaaacgctctggaaaaacagagaacgacatgctgcagtgtttcatcgaatcaaagtacaaagatggtagacagacaaccgaatctgaagtcactggtttgctcattgctgctctgtttgcaggacaacacacgagctctatcacttccacctggaccggtgcttatctgatgcgatacaaagagtacttctcagctgctcttgatgagcagaagaacctgattgcgaaacatggagacaagatcgatcatgatatcttatccgagatggatgttctctaccgctgcattaaggaagcgttgaggcttcaccctccactcatcatgttaatgagagcctcgcacagtgatttcagcgtgacagctcgggatggaaaaacttacgatatcccaaagggtcacatcgttgcaacctcccctgcatttgccaaccgcttaccgcacatcttcaaagaccccgacacctacgacccagaaagattctcccctggaagagaagaggacaaagccgcaggggcattctcgtacattgcattcggagggggaaggcacgggtgccttggagagccgtttgcttacctgcagatcaaagccatatggagtcatttgttgaggaacttcgagcttgagctagtttcaccgttccctgagattgactggaacgctatggtggttggagttaaaggcaatgtgatggtgcgttacaagaggcgccagctttcttaa

SEQ ID NO: 1827 - DNA, 1236 bp, Arabidopsis thaliana
atgaatgctttagcagcaacaaacagaaacttcaagttagctgctaggcttcttggtctggattctaagctcgagaaaagtcttctcatccccttccgagaaatcaaggtggaatgtaccataccgaaagacgatggtacactagcatcattcgttgggttcagagttcaacacgacaatgcaagaggtcccatgaaaggtggaatcagatatcatcctgaggttgatccggatgaagtgaacgcattggctcagctcatgacatggaaaacagcagtggctaagattccttacggaggagctaaaggagggattggttgtgatcctagcaagctcagtatctccgagctcgagcggttgactcgagttttcactcagaagattcatgatctcattgggattcatactgatgttccagctccagatatgggcactggtcctcagacaatggcttggattcttgatgaatactctaagtttcatggatactcgcctgcagttgtgactggaaaacccattgatcttggtggatcgctagggagagacgcggctactggaagaggagtgatgtttggtaccgaagctttgcttaacgagcacggaaagaccatatcagggcagcgttttgtcatccagggatttggtaatgtgggttcttgggcggcaaagctgataagtgaaaagggtgggaagattgttgccgtgagtgacattaccggagcaatcaagaacaaggatggtatcgatatcccggccttgctcaagcatactaaagaacacagaggtgtcaaagggtttgatggtgcagatccgatcgatccaaactccatactggttgaggattgtgatatcctcgtccctgcagcacttggtggtgtcatcaacagggagaatgcgaatgagattaaagcaaagttcatcatagaagcagctaatcatccaactgatccggacgcggatgagatcctaagtaagaaaggtgtggttattctcccggacatatatgcaaactctggaggagtcactgtaagttacttcgaatgggttcagaacattcaaggctttatgtgggaggaagagaaggtgaacgatgagctaaagacttacatgactcgctctttcaaggacttgaaagagatgtgcaaaactcactcttgcgatctccggatgggagctttcacactcggtgttaatcgtgtggctcaagctaccattctcagaggctggggagcttaa

SEQ ID NO: 1828 - DNA, 963 bp, Arabidopsis thaliana
atggcatcaattctcaggtcagtggcaacgacttcagccgtcgtagccgccgcctctgcgattcccatcgcgatcgccttctcttcttcttcttcttcttcctctaccaaccccaaatctcaatctctcaatttctccttcctctcccgatcgtctccacgtctcttgggactttcacgaagcttcgttagctctccgatggcgactgctctcacttctgatcgtaatctccatcaggaggatcgagccatgcctcagcttcttactgagtttatggtggatatgacatgtgagggttgtgttaatgctgtgaagaacaaattagaaaccattgaaggtattgagaaagtggaggtggatttgtccaatcaagttgtgaggatacttggatcttcccctgttaaggctatgactcaagctttggagcaaactggtcgaaaagctcgcttaattggacaaggtgttcctcaagatttcttagtctcagctgcagtagcagaattcaaaggccctgacattttcggggtagtccgatttgctcaggtcagtatggaacttgcaagaatcgaagccaactttaccggtttgtcacccggaacccacagctggtgtatcaacgagtatggagatctcacaaacggagcagccagcacagggagcttgtacaatccatttcaagatcaaactggcacagagccattgggagacctgggaacactagaggcagacaaaaacggagaggccttttattcgggaaagaaagagaaactcaaggttgcagaccttatcgggagagccgtcgtggtgtacaagaccgatgataataagtcaggccccggattgaccgccgcagtgattgctagaagcgcaggggttggagaaaactacaaaaaactttgttcttgtgatggtactgtcatatgggaagctacaaacagcgatttcgtggccagtaaggtttaa

SEQ ID NO: 1829 - DNA, 810 bp, Arabidopsis thaliana
atgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatag

SEQ ID NO: 1830 - DNA, 1875 bp, Arabidopsis thaliana
atggcattttcatcttcgtgttcgtccgtcaaagccgtcaactcacggtggacgtctccgtctccgtcaccgtcttctagattcgccgtcctccctgctttccttcaccgccgttacgcaacaagcgtcaaactaacggccataagcgccgccttaaaaaccgtcgagcaaacgacgttaacagaggataacagattctcaaccgtcggatctgactctgatgaatacaatccaactcttccaaagccgaggatcctcgtcaccgagaaactgggagaagccggcgtgaatctcctcagggaattcggcgacgttgactgctcttacgatctttcgccggaagatctgaagaagaaagtggcggagagtgacgctctgatcgtgagaagcggaactaaagtgacgagggaagtgtttgaggcggcgaaggggaggttgaaagtggtcggaagagccggagttgggattgacaatgttgatctgcaggcggcgacggagcacgggtgtttggtggttaatgctccaacggctaatacggtggctgctgccgaacatggaattgctttgcttgcttctatggcacgtaacgttgctcaggccgacgcttctattaaagccggaaaatgggagaggagcaagtacgtcggtgtatctctcgtcggaaaaaccttggccgtgatgggtttcgggaaagttgggacggaggtggcgagaagagccaaaggtctaggcatgaccgttatctcccacgacccttacgcgccagctgacagagccagagctctcggtgtcgatcttgtttcattcgatcaagctatctccaccgccgatttcgtctccctgcacatgcctttaactccggccaccaaaaaggtcttcaacgacgaaactttctctaagatgaagaaaggtgtgcgtctcattaatgtcgctagaggtggcgtcatcgacgaggatgcactcgttagagctctcgatgccggaatcgttgctcaggcagcattagatgtgttctgtgaggaaccaccatcgaaagatagcagactaattcagcatgaaaatgttactgtgacacctcatcttggagctagcacaaaagaagctcaggaaggtgtagccattgagatagcagaggctgtagcaggggcattgaaaggagagttatcagctactgccgtcaatgctccaatggtggctcctgaggtcttgtctgagttgactccttatattgtcttagctgagaagcttgggaggttagctgtgcagttagcatctggaggtaaaggagtacagtccattagggtggtctatcggtcagctcgtgaccgagatgatttggatactagactacttcgtgcaatgatcacaaagggaatcattgaaccgatctcagattcatatgtcaacttggtgaatgctgatttcatagctaaacaaaagggtcttcgtattagtgaggaacgaatggttgttgattcatcaccagagtaccctgttgattccatccaagttcagattttgaatgtggagtcaaatttcgctggtgctgtctctgatgctggtgatataagtattgaagggaaggtgaagtacggagttccgcatttaacttgtgtcggatcatttggtgtggatgtgagccttgaagggaatctgatactgtgcaggcaagtggatcaaccagggatgattggacaggttggtaacatacttggagaacaaaacgtgaatgtgaatttcatgagtgttggaagaacagtgttgaggaaacaagcgataatggcgattggagttgatgaagaaccagacaacaaaacacttgagaggattgggggtgtttctgcgattgaagagtttgtgtttcttaaactataa

SEQ ID NO: 1831 - DNA, 1290 bp, Arabidopsis thaliana
atggaatcacttccccagccgcaaaaccaatcatctccggcaacaactccggcgaagatcctccttgggaaatacgaactcggtcgtcgtctcggtagcggaagcttcgcgaaagtccatttagctcgatcaatcgaatccgacgagctcgtcgccgttaaaatcatcgagaagaagaaaacaatcgaatccggtatggaaccaagaataatcagagagatcgatgcgatgcgtcgtcttcgtcatcatccaaacatactcaagatccatgaagttatggcaaccaaatctaagatctatctcgtaatggaactcgcttccggtggtgaacttttctcaaaagtcctccgtcgtggacgtcttcctgaatcaacggcgcgtcgttactttcaacaactcgcctccgctcttcgtttctctcaccaagacggtgtcgctcaccgtgatgtgaaacctcagaatctactcttagatgagcaaggtaacctcaaggtctctgactttggtttatcagctttaccggagcatctacaaaacggattgcttcacacggcgtgtggtactccggcttatacagctccggaggttatttcacggaggggatacgacggagcaaaagctgatgcgtggtcttgtggtgtgattttgtttgttttattggttggcgatgttccatttgatgattcgaatatcgctgcgatgtatcggaagattcatcggagagattatcggtttccgagctggatttcgaaacaagctaaatcgataatctatcagatgttagatccgaatccagtaacgaggatgagtattgaaacagtgatgaaaacgaattggttcaagaagtctctagagacttctgagtttcatcgtaacgtctttgattcggaagtagagatgaaatcgagtgttaattcgattactgcttttgatttgatctcgttatcgtcgggattagatctttctggattgtttgaggctaagaagaagaaggagaggagattcacggcgaaggtttcgggtgttgaagtggaggagaaggcgaagatgattggggagaagttaggttatgtagtgaagaagaagatgatgaagaaggaaggagaagtgaaggttgttggattagggagaggaagaactgtgattgtggtggaagcagtggagttaacggtggatgttgtggtggttgaagtgaaagttgttgaaggtgaagaagatgattcacggtggtctgatttgattactgagcttgaagatatagttctttcatggcacaatgacatcatgtaa

SEQ ID NO: 1832 - DNA, 1788 bp, Arabidopsis thaliana
atgaataaatggttaaacagaaaacctaaagtttacgattttagcgaagacgaaattgatacagaacctgagagcgaagacgatgatggtggtgtgagtgtgaggggtggttaccaaaggaaacaccggcgaggcaaatcggagactttgagagctcaatacattaacacaaaggatatcaaagtgacggtggctacatggaacgtcgccggaaaacgtccctccgatgatctcgagattgaagattggctctctactgataatccttcagatatttacattatcgggtttcaagaagtggttccattaaacgctggaaacgttttcggagcagaagatagaggtccgattccgaaatgggaatcgataattcgtagaacactaaacaaatccaataaagaatcagtttatgatcaatcgccaagctgcaacaacaacgctcttcatagatctcacagcgcgccgtcgtctcctatcttggcacaagaagcaaactccattatctctcatgtcatggtagagaatctagttgcggaccactcgctggatttagctacaaacgagttcatcgatgctgcaaccgctttaccgagccttgaaccacagcggaatccgaacatggactggccggaactagctttagatagcaaccctcagatagttggatcagaggggaagctaaggagggtatttagcagcaacgcgacgctaggatttaagctaccggagaatccatcaggagctagtagatttgcttcggaagcaagacaattgaaacgctcacggagctttgaaactttaaacttgagttggaatgatataaaagaagagattgataataggtcctcctcctcgtccgaagcggaagaagctgcaaaaatcatgcatgatgattcatcagacggagattcgtcttcccaggacgaagaggatggtgacaagatcagaaatagttatggattgccggaagatttggtggaggagtgtcggaaagtgaaagatagtcaaaagtatgtaaggatagtaagtaagcaaatggttgggatctatgtatcggtttggatccgacgacggttaagaagacatgtcaacaacctgaaagtctcaccggtcggagttggcttgatgggctacatgggaaacaagggatcagtgtcgattagcatgacgttgtatcaatcacggatgtgttttgtgtgctcacacttaacttccggccacaaagacggtgctgagcaacgccggaatgctgacgtgtacgaaatcatacgtaggactcgttttgcatcggttcttgacactgatcaaccaaggacgattccatgtcacgatcaagtattttggttcggagatttgaactaccgacttaatatgtcagacggtgaagtaagaaagcttgtctcacaaaaacgatgggatgagctcaagaacagtgatcagttgattagagaattaagaagagggcatgtttttgatggatggagagaaggaccgattaaattccctccaacctataaatacgaattcgattctgatcgttacgccggagaaaacttgagagaaccggagaagaagagagctcctgcttggtgtgataggatattatggttaggaaaaggaataagacaagaatgttataagagatcggagataagaatgtccgatcaccggccggtgacttcgatttttaacgttggagttgaagtgttcgatcaccggaaacttcaaagagctcttcacgttaataacgcagctgcttctgctgttcatcctgaaccttctttttga

SEQ ID NO: 1833 - DNA, 1386 bp, Arabidopsis thaliana
atggcttcttcttcttcttcttctttattatttcctttctttcttattcttttttcatgtttaatctcggtttcatcgtcaagaagatcattaatcgaccgtactcttccgaaaaaccttccgagatccggttttcgattgagtcttcgacatgtggattccggtaaaaacctcaccaagatccaaaagattcagagagggattaaccgtggattccatagattaaacagattaggagctgtagctgttttagctgtagcctctaagcctgatgatactaataacattaaagcacctactcatggaggaagcggtgagtttcttatggagttgtctattggaaacccggcggttaaatactctgctattgttgataccggaagtgaccttatttggactcaatgcaagccttgcactgaatgttttgatcaaccaactccgatttttgacccggagaaatcttcctcttactcgaaagtaggatgctcttctggtctttgtaacgcattgcctcgatcaaactgtaacgaagataaagatgcttgtgagtatttgtatacttatggagattactcatctacaagagggctcttggccacggaaacgttcactttcgaggacgagaactcgatttctggtatcgggtttgggtgtggggttgagaacgaaggcgacgggttctctcaagggtcaggtcttgtaggtcttggtcgcggaccgctctcgcttatttctcagctcaaagagactaagttttcttattgcttgacctcgattgaggatagtgaagcatctagctcgttgtttattggatctttagcctcgggtatcgtcaacaaaacaggtgcaagtttagatggtgaagtcaccaaaacgatgtctttgctacgaaatccagatcagccttcgttctattaccttgagttacaaggcatcaccgttggagcaaaacgcctttctgttgaaaagtctacttttgaactagccgaagatggaaccggaggtatgatcatagactcaggcacgaccatcacgtatctcgaggagaccgcgtttaaagtgttgaaagaggagtttacttctcggatgagtttaccagtagatgactctggatccacgggacttgacttgtgcttcaagttacctgatgctgccaagaatattgctgttcctaagatgatttttcattttaaaggtgctgatttggagcttcccggagagaactacatggtggcggattcaagcaccggcgttttgtgtttggccatgggaagttctaatgggatgtctattttcggaaatgttcaacagcagaattttaatgtacttcatgatcttgagaaagaaacggtgtcgtttgttcccactgaatgtggaaaattgtag

SEQ ID NO: 1834 - DNA, 921 bp, Arabidopsis thaliana
atgacatattacttctctcttccttttgctttcgcatcttcttcttcgtcaacgaatcctcggactctccggcgatgcccgtcgattaaacgacgcgagcctggccgttttaccgccaccgttcttcttttaatcggtttaatctcttgtgttatcgtctacgctgttttctcttctgtcctccgtccatcccaagatcctacactcgttgattccgcggttcgattcaaagaggagccgcgagatcacgatgcaactgaagacggtgaaggtgggtgttgccgtggaattgataatctggagctttggggtccggcggtgaagtggggcacggattttaagtttaattcgtctgatggatgttgtaaagcttgtaaagttatgtgtagtggcaacgatggaccttgcttgtgcgattcatgggtgttttgtgggaacaaagaggattgtggctcgaagtttggagagtgttggttgaagaagcaaaaagatgtcttggtgcctgatcgacaaggaggtggcgagaaagtaatgtggacatctggacttatcttcggacaaggccaggctccctttggtccaccatacgctatgattcaaggaatactccaggccgagggaaacattttcacaccgatcccaaccgagcactgcccaactataagccgtggctcggtggcgtgggtcggctcgggtccagaattcttcatcagtttagcaaaccaccacgaatggaaacaatcttacacggtattcggcttagttctaccagaagacatggatgtcgtggagacaattgccggtttaccaacaagagccgatgtctggaacagcgtcaatgtctctgtgctggagaaaccggtttccttaaccgtacggagaatgaagacgggccaagaacaagaagaaaccggttcatga

SEQ ID NO: 1835 - DNA, 435 bp, Arabidopsis thaliana
atggagtttgcgaatcccgttaaagtcggatacgttttgctcaagtatccgatgtgttttatctgcaactccgacgatatggactttgacgacgccgttgccgctattagcgctgacgaagagcttcagcttggtcagatatactttgctcttcctctttgttggcttcgtcagccacttaaagctgaggagatggctgcattggccgttaaagctagctctgcgctcatgagaggtggtggaggaggttgtcgccggaaatgtgtcgagcctatcgtttctgataagcttcgaatgagagttggctccggtgatgatacggtgggttcaggatccgggaggaggaaagtgaggaacggtgatggtggtggtagtgttagtagtagccggaggaggaaatgttacgcggcggagttgagtacgatagatgagtga

SEQ ID NO: 1836 - DNA, 1935 bp, Arabidopsis thaliana
atggctgcttcagtacactgtaccttgatgtccgtcgtatgcaacaacaagaatcactctgctcggccgaaacttccaaactcgtctttgttacctggattcgatgttgttgttcaagctgctgctactcgattcaagaaggaaacaacaaccacaagagccactttgacgtttgatccaccaaccactaattctgagagagctaagcagagaaaacacaccattgatccttcttctcctgattttcaaccaattccatcttttgaagaatgctttcctaagagcactaaagaacacaaggaagttgtccatgaagaatctggtcatgttcttaaagttccctttcgtcgtgttcatttgtctggtggtgagccagcttttgataattatgacactagtggtcctcaaaatgttaatgcacacattgggcttgctaagctaaggaaggagtggattgatcgtcgggagaagctaggaacaccaagatacactcaaatgtactacgctaagcaagggatcataactgaggaaatgctctactgtgctactagggagaagctagaccctgagtttgtaagatcagaagttgcacgaggacgggcgattatcccttccaacaagaagcatttggagctggaaccgatgattgttggtagaaagttcttggtcaaggtcaatgcgaatatcggaaactctgctgttgccagctctattgaagaggaagtctacaaggttcagtgggcaaccatgtggggagctgatacaatcatggatctctcaactggtcgtcacatccatgagacacgtgagtggatcctaaggaattcagctgtgcctgttggtacggtgcctatttatcaagcacttgagaaagtggatggaattgctgagaatcttaactgggaggttttcagagagactctgattgaacaagctgagcaaggtgtagactatttcacaatccatgctggagttttgctgcgttacattcccttaactgccaagcgtttgaccgggatcgtttcgcgtggaggatccattcatgctaaatggtgcttagcttaccacaaggagaactttgcttacgagcactgggatgacattctagacatctgtaaccagtatgatgtggctctttccattggagatggtctgagacctggctccatttatgatgctaacgacactgctcagtttgcagagctccttactcaaggtgaactaactcgccgagcgtgggaaaaagatgtgcaggtgatgaatgaagggccagggcatgtcccaatgcacaagattccagagaatatgcagaagcagttggagtggtgtaacgaggcaccattctacacccttggtcctttgactactgatattgcccctggatatgatcacattacctctgccattggagctgccaatattggagccttgggtacagctcttctttgctatgtaacaccaaaagaacaccttgggctaccaaacagggacgatgtgaaggccggggttatagcatacaagatcgccgctcatgcagctgatctagccaaacagcatccacatgctcaggcatgggacgatgcgctgagcaaagcgcggtttgagtttagatggatggaccaatttgctctgtcgttggaccccatgactgctatgtctttccatgatgaaactcttccagctgatggagccaaggttgcacacttttgctccatgtgtggaccaaaattctgctctatgaagataacagaagacatccgaaagtatgcagaggagaatggttatggcagtgctgaagaagcaatcagacaaggaatggatgctatgagtgaagaattcaacatcgcaaagaaaaccattagcggagaacagcacggtgaagtaggtggagaaatatatttgccagagagctatgtcaaagctgctcagaaataa

SEQ ID NO: 1837 - DNA, 504 bp, Arabidopsis thaliana
atgggtttcatctcttgcatctcatttccgacgatcaattcaagaattctatcgactcaccacttttccaagcactcgacttcagcgtcttcttcatattcacttaagtttgctttgagacgtcaggaggataaacccaaagtctcgttttttcttccattaacgtcttcgttaatggcgacccctattcaagcctcttcttcctccaccattggtgagaccagtgatggcttgaaggtccagtctcatgtttcaattggagcaaacgatctgctgattgttggaccgggtgttcttggacgcttagttgcagaacagtggagacaggaacatccagagtctcaaatctttgggcagacagtaacaacaaatcatcatggtgagttggagaatttgggtatcaaaccatctcttaaaggaaccgaatatgggggaaagttctcctatgtgatcttttgtgctccaccatcacaaagcgctgattatgctggtgaagtcaggtga

SEQ ID NO: 1838 - DNA, 1197 bp, Arabidopsis thaliana
atggcatcggcggttcagaaatcagcgttgctcttatgtggagactacatggaagcctatgaaacgattgttcctctctatgttctccaatcgtttggggttagcgttcattgcgtttcacccaaccgcaacgccggcgatcgctgcgttatgtctgcccacgatttcttgggcctcgagctatacaccgagcttgtcgttgaccagttgactttaaacgcaaacttcgatgacgtcactccggagaattacgacgtcatcatcatcccaggaggccgattcacggagcttctcagcgccgacgagaaatgcgttgacctcgtggcgcgattcgccgaatccaagaagctgatcttcactagctgtcatagccaggttatgctgatggcggccggaatcctcgccggtggtgtgaaatgcacggcgtttgaaagcataaagcctttgatcgaactctccggcggtgagtggtggcaacagcctgggattcagagcatgttcgagatcaccgattgcgttaaagacgggaatttcatgagtacggttggttggccaacgcttggtcacggcattaagcttttgcttgaatctcttggtggcaaagtctgtagcttggagaagaagcaagcttctgtgcttttcctcattggggactatgtagaagattatgggatcaatgtaccgtttagagcactacaagctttaggttgtaaagtggatgctgtgacaccgaacaagaagaagggagaagtgtgtgcaacggcggtttatgaccttgaggatggacggcagattcctgcagagaagcgtggacataacttctttgtgactgcatcgtgggatgatatatgtgtggatgattatgactgtgtagtggttccaggagggagatcacctgagctattggtgatgaatgaaaaggctgttgctttggttaagagttttgcagagaaagataaggtgtttgcagctattggacaggggaaattgcttcttgcagccactggtgttcttaaggggaagcgatgcgcgagtgggaaagggatgaaggtgatggtgaaggtggctggaggtgaggctgtgatggaaaagggatgtgtaactgatgggaaggttgtgacggcagcatcagccacggatctgcctgcctttttgtttgatttatcaactgctcttggtctaactgtcatgttctaa

SEQ ID NO: 1839 - DNA, 1833 bp, Arabidopsis thaliana
atgattagcacagtacttcgccgatctatccttggtacgtcaaggcgtactctcgccgcttcggtgacctccattaacgcagctctatttcataaccttgctccagccgccgccacagtctccgatctagcaaatggagctactaatgtcaagtctctcccttcgaattcgagcccttttggtgttaaagtgagagactttcatgttaaatctgtaccgtcggagtttagatcgtcgattgtttcttctgcgggattcgcggctcaagagtatgctccttcttatgagaacgatggagggattggagattcggagagtgttggtagcagcggtggtggtgatgggcttgcgatagctgatcttggtatatctccggagattgttaaagctttgaagggtaggggtattgagaaactctttcctattcagaaagctgtgttggagccagcgatggagggtcgtgatatgattggccgtgcaaggactggaacgggaaagacacttgcttttgggattcctattattgacaaaatcatcaaattcaacgctaaacatggtcgtgggaagaatcctcagtgcttggttttggcaccgacgagggagcttgctcgtcaggttgagaaagagttcagggaatctgctccaagtttggatactatttgtctctatggaggtacaccaatcgggcaacaaatgagggagctgaactatggtattgatgtggcggttggaactcctggtcgtatcattgatctgatgaaaaggggagctttgaatctatcagaggttcagtttgtggttcttgatgaagctgatcagatgcttcaagttggatttgcggaagatgttgaaataatattgcagaagttgccagcgaagcgtcagagtatgatgttttctgcaacaatgccaagttggatcagatctctcaccaagaagtacctgaacaatcctttgacaattgatcttgttggagattcagatcagaaacttgcagatgggattactatgtattctatcgctgcagattcttatggaagagcatccatcattggtcctcttgtaaaggaacatggcaaaggaggaaaatgcattgtctttacccaaacaaaacgtgatgcagatcgccttgcatttggattggcaaaaagctataaatgtgaagctttacacggtgacatatctcaagctcagagagaaagaacacttgctggtttcagggatgggaatttcagtattcttgttgcaactgatgttgctgcccgtggacttgatgtacctaatgtcgatttagtaattcattatgagcttcctaataacacggagacgtttgttcaccgaacggggcgaactggtcgtgctggaaagaaaggaagcgcgattctcatccacggtcaagatcaaaccagggctgttaaaatgattgagaaagaagtcggaagcagattcaatgagctgcctagcattgctgtggaaagaggaagcgcaagcatgtttgaaggagtaggtgctagatctggtgggtcgttcggaggaggtcgatcaggcggtggtgggtatggtagttacggtagcagcagtggccgttcaggtggtggtagttatggaggttatggtggcagcagtggccgttcaggtggtggtggtggtagttatggaggttcagggggatcaagcagccgttactctggtggttcagaccgctcatctggtttcggaagctttggttcaggcggttcttcaggaggatttggttcagaccgttcttctcagtcaagtggaaggagcagctttggtgggtttggatcaaacgatggtaaaagatcttactga

SEQ ID NO: 1840 - DNA, 1044 bp, Arabidopsis thaliana
atggtgggtttaaacaacgccgtctcactcgacattgaagagatctgcaatggtggcaaggagcatcatgtcaaaacttgccatggttcagtttcagttgtagtatatggagatcaagagaaaccagcattgatcacttatccagatgtagcactaaactatatgtcttgtttccaaggattgtttctatgccctgaagcagtgtccttactgctccataatttctgcatctaccatattagtcctccaggacatgagtttggagctgctccagtttgttccaatgatccgtcaccttctgttgaagacctcgcggaccagattcttgaagtattgaacttctttagcctcgaggcagtaatgtgcatgggaatcacagctggtgcctacatcctttccttgtttgctattaaacataaagaacgagttttgggtttgattcttatatcgcctctatgcaaagcaccctcatggtctgaatggttttattacaaggttgtgtcaaacttattgtactactatggcatgtctggactgttaaaagatattttccttcagaggtacttcagtaaggaagctcgtggtagctctgaagttccagagcgggatgtggtacatgaatgcagaagactgctaggtgaaagacacggtagtagtcttatgcggtttctagaagcagttaacaggagacatgacttaactgatggattgaagagtttgaaatgccgtacactcatctttgttggcgaccaatctcctttccactctgaaactcttcacatggtgacagcattggacagaaagtacagcgccttggttgaggtgcaagcttgtggatcaatggtgacagaagagcaaccacatgcaatgttgataccaatggagttctttttcatggggtttggattgtatcggcctggtcgggttagcgatagcccccggagtccactaagtccgtcatgtatttcgccagagcttctatcaccagagagtcttggtttgaagttaaagccaataaaaactcgggttcccacgaaatgttaa

SEQ ID NO: 1841 - DNA, 282 bp, Arabidopsis thaliana
atggatatgtacaaagatgatagctcaccatactgttatttccatccaaaagaagagtatgttggagtttgtcctctctgtttgaacgagaggcttcttgttttagcttcaaaacagagatcatcaagaaccaaacactcttcctcttcaccaatcatcagcctccctaagatattcgccttgagctctctcctcagtcgcctcgatctccgtcaccggaaattccatccctcctccgatcttgacgtctccacaagccaagaaggtacagtatttttatga

SEQ ID NO: 1842 - DNA, 2682 bp, Arabidopsis thaliana
atgggtatttctttctcgataccctttgatccgtgtgtaaataaagtctctcaatggctagacatgaaaggaagttatactcacaatctcgagaagaatcttgtggctctcgagacaaccatggaagagctcaaggccaagcgggatgatttattaagaaggctcaaaagagaggaggatagaggtctacaaaggctttccgaattccaggtatggcttaatagagttgcaactgtcgaagacataattattactcttcttagagatagagatgttgaaattcaaaggctgtgtctttgccggttttgctctaagaatttaacgacgagctatcgttatgggaaaagtgttttcttgaggttgagggaggttgagaaactcaaaggtgaagtttttggagtgataaccgagcaagcttcaacatctgcgtttgaggaacgacctcttcagccgacaattgttggtcaaaagaaaatgcttgataaggcatggaaacatctcatggaagatggaactggtattatgggtatgtacggtatgggcggtgtagggaagacaacacttctcactcagctcttcaatatgttcaataaggataagtgtggatttgatattggcatttgggttgtcgtgtctcaagaggttaatgtggagaagattcaagatgaaatcgctcaaaagcttggtcttggtggacatgagtggacacagagagatataagtcaaaagggcgttcatttattcaatttcttgaagaacaagaaatttgtgttgtttttagatgacttatgggataaggtggagttagctaatatcggtgttccggatccaagaacacaaaaaggatgtaaattggcattcaccagtcggtccctaaatgtatgcacaagcatgggggatgaagaaccaatggaagttcaatgcttggaagagaatgtggcatttgatttgttccaaaagaaggttggacaaaaaacacttggaagcgatccggggatcccccaacttgcaagaatagttgcgaaaaaatgttgtggcctaccattggccctcaacgtcataggcgagaccatgtcatgcaaaaggacgatacaagaatggcgtaacgctatacatgttttgaattcatacgctgcagagtttataggcatggaggataagattcttccgcttttgaagtatagctacgataaccttaagggggagcatgtcaaatcgagtttgttgtattgtgctttatatccagaagatgctaaaattcggaaagaagatttgatagagcattggatatgcgaggaaattatagatggaagtgaaggtatagaaaaggctgaggacaagggttatgacatcattggtagtcttgttcgtgcatcactgttgatggagtgtgttgatttgaaaggaaaatctagtgtgattatgcatgatgttgttcgtgaaatggcattatggatcgcttccgaactgggaatacaaaaagaagcctttattgtgtgtgcaggtgttggcgtacgtgaaattccaaaggttaagaattggaatgttgtgagaaggatgtcattgatggggaacaagattcatcatctcgttggtagttatgaatgtatggaactcacaactttgctcctgggagagggagaatatggaagtatttggagatggagtgaaataaaaacgatctcgagtgaattcttcaattgcatgccaaagctagctgttttggatctatcgcataatcaaagtctctttgaattgccggaagaaatatcaaatctagtttctttgaaatatctcaacttgtcacatactgggatacgtcatttgtctaagggtatacaagagttgaagaaaataattcacttgaatttggagcatacaagtaagcttgagagtattgatgggatatcaagtctgcataacttgaaagttctgaaattatatggttctagattaccatgggatctcaacacagtgaaggagctggaaactttggaacatttagaaattttaaccacaactatcgatccaagagcgaagcagtttttgagctcccataggttgatgagtcgttcacgattgctacagatctttggatctaatatattctcaccggatagacaactagaatcactttcagtatctacggacaagcttcgtgaatttgaaattatgtgctgcagtatctctgagataaagatgggagggatatgcaacttcttgagcctcgtagatgtgactatatacaattgtgaaggcttgagggaattgacgtttctgatctttgctccaaagcttagatctctttctgttgtggatgcaaaagacctagaagatataataaacgaagagaaagcttgtgaaggtgaagattcagggattgttccttttccagagctgaagtatcttaatttagatgatctaccgaagctgaagaatatctatcggagacctctaccctttctatgtctagaaaaaatcactataggggaatgtccaaatctgagaaagcttccactcgattccagaagtggcaagcaaggcgaaaatggatgcatcatacattacaaagattcacgttggttgaaaggtgtgaaatgggcagacgaagctacgaaaaaacgcttcttaccttcatgcgaacaccgattagaaaggtgtgaaacaatctttgaagactag

SEQ ID NO: 1843 - DNA, 2823 bp, Arabidopsis thaliana
atgggtgaagcggtcaaggatgggagagaagaagtgattcaagcttggtatatggatgatagtgaagaggatcagagacttcctcaccacaaggatcctaaagagtttgtatcgttggacaaacttgcagagctgggagtacttagctggagacttgatgctgataactatgaaaccgatgaggatttgaaaaagatccgtgaatctcgtggttactcttacatggtttgtggtctttatttatttactatcccactagacttgaatggtagatgtttatttttgtccaagtcttattttaactctctaggggacttttgtgaggtatgcccggaaaagcttccaaactatgaagtgaaagtgaagagctttttcgaagaacatttacacactgatgaggagatccgttactgcgttgcaggaactggttactttgatgtgagagatcgtaatgaagcttggattagggtattggtaaagaagggaggtatgatagtcttacctgctgggatctatcatcgcttcactgtggactctgacaactatatcaaggcaatgcggctattcgtgggtgaaccggtatggacaccatacaatcgcccacacgaccatcttcctgcaaggatggttcgtttggtggttgttgttatcgaacatgttcacggttctaaggaagaaaagtgtggttttgtgtatttgtggttggacataagattttcgttttcgtttacatttgtggctttcttttgtaatttccttttagagtttggaatctccttaaatccgacctacattaactctatagtctatagaattggaggagtttccctgctccgggaacaattcccccaaattgactcccccataggaaaaactattcgacctcactctctctcgccactgttccgctctctctcattcttcctaattttacccccaaaacctccgattattactgaaacgccactgctctctcgccgggattccggtgaagaggaggagatggatgtcggagtttcaccggcgaagtctatacttgcgaaacctctgaagctactcactgaagaggacatttctcagctcactcgcgaagactgccgcaaattcctcaaagacaaagaatggaggctgacacatgtcgaaataggaatgcgaagaccgtcgtggaacaaatctcaggcgatccagcaagttttatctcttaaagctctctatgagcctggagacgattccggcgccggtatcttccgcaagatcctcgtttctcagccagtaaatccgcctcgcgtcacaacaacgttgattgagccaagcaacgagctggaagcttgtggccgggtttcttatccggaagataacggcgcgtgccatagaatggattctccaagatcagctgagttttccggtgggtctggtcactttgtatccgagaaagatggccacaagacgactatttctcccagaagcccagctgaaacaagtgagctcgttgggcaaatgacgatattctatagtggaaaagtgaatgtgtatgatggaataccacctgaaaaggcccggtcaatcatgcactttgcagccaatccaattgatttgcctgaaaacggtatttttgcttccagtagaatgatttcaaagctcataagtaaagagaagatgatggaacttccccaaaaaggccttgagaaggcgaattcttctcgtgattctggtatggagggccaggcgaacagaaaggtatctttgcaaagatatcgtgaaaagcggaaagacagaaaattctcaaaggccaaaaagtgtccaggagttgcgtcctctagcttggagatgtttctgaattgtcagccacggatgaaagctgcatattcgcaaaacctaggctgcaccggatctccactgcatagccagtcacctgaaagccagacaaaaagtcccaatctttcagttgatctaaacagtgaaggtaagaagagaatcatatataaagctttgttaaatcagtggagagaaggcatatatcgcgtggatttgaagacgaagaggaatcataaaaagcctaacgaagaagacgaagaagaagaggaacaaacaaccatgggtgaagtggttaaggatggaagagaagaagtgatccaggcatggtatatggatgatagcgaagaggatcagagacttcctcaccacaaggatcctaaggagtttctatctttggacaaacttgcagagctgggagtacttagctggagacttgatgctgataactatgaaaccgatgaggatttgaaaaagatccgcgaatctcgtggttactcttacatggaaaattcgttgatgatttgcaaattgttttatgtgcttgagtcttggtttgatgatggaaaagtgttcaaaatgcaggacttttgtgaggtatgcccggaaaagcttccaaactatgaagtgaaagtgaagagctttttcgaagaacatttgcacactgatgaagagatccgttactgcgttgcaggaagcgagtggttaattcatcatatatatatttggttgattagaaaattgaaatatcttgttgagcaggcaatgcggcttttcgttggtgaaccggtctggacaccatacaatcgcccacacgaccacctccctgcaagcttctgcaatctgtgcttctctccaggttcacaaagaacgattctgcattcaccaagatcacaaccgattttgagaagaatgtcccaaccgggaaaagcttcaccattggttaagcaaatagacgatactgttgttgctactctgtcaaagcttgtctctgccattcctgttttgtaa

SEQ ID NO: 1844 - DNA, 762 bp, Arabidopsis thaliana
atgttggcaatatttcagaaagcttttgctcacccaccggaagaactcaacagtccggcttctcatttctccggcaaaactcctaaacttcccggcgaaactctctccgacttcctctctcatcaccaaaacaatgctttctctatgaacttcggcgactccgccgtcttagcttacgctcgccaagaaacctctcttcgtcaaaggttgttctgtggactagatgggatctactgtatgtttctagggagattgaataatctctgtacattgaatcgacaatacggtttatctgggaagaactcaaacgaggcaatgtttgtgatcgaagcttatcgaacacttcgtgatcgtggtccttacccagcagatcaagttcttagaggtcttgagggaagcttcgctttcgttgtctacgatactcaaacttcctctgttttctcagctctgagttctgatggaggagagagtctttactggggaatttctggagacggatctgttgtaatgtctgatgatattcagatcataaagcaaggctgtgctaaatcgtttgctcctttccctaatggatgtatgtttcatagtgagacagggcttaagagctttgaccatccgactaatatgatgaaggcaatgccgaggattgatagtgaaggtgttctttgtggagctagtttcaaagttgatgcttgttctaagatcaatagtatccctagaagaggaagtgaagctaactgggcgctggctaattctcgttga

SEQ ID NO: 1845 - DNA, 1350 bp, Arabidopsis thaliana
atgcgagagattcttcacatacaaggtggccaatgcggaaaccagatcggagctaagttctgggaagtagtttgcgccgagcacgggatcgattcgacgggaagataccaaggagagaacgatttgcaactcgaacgagtcaatgtctactacaacgaagcgagttgcggaagattcgtcccacgcgccgtcctcatggatctagagcctggtactatggatagtgtcagatccggtccgtacggtcagatcttccgtcctgataacttcgtatttggtcaatccggtgccggtaacaattgggctaaaggacactacactgaaggtgctgagcttatcgattccgttctcgatgttgttcgtaaggaagctgagaattgtgactgcttgcaaggattccaagtgtgtcactcattaggaggaggaactggatctggaatgggaacgttgttgatttcaaagattagggaagagtatccagataggatgatgctgacgttttctgtattcccatcaccgaaagtgtcagacactgttgttgagccttataatgcaactctctctgttcatcagcttgtggagaatgcagatgagtgtatggttcttgacaatgaagctctctatgacatttgcttcagaactcttaagctcaccactccaagctttggagacttgaatcacctcatctctgcaaccatgagtggtgtcacttgctgccttcgtttcccgggtcagctaaactctgacctgcgcaagcttgcagtgaatttaatcccattccctcgtctccacttcttcatggttgggtttgcaccactcacatctcgtggatcacagcaatacagagccttaaccgtccctgagctcactcaacagatgtgggatgccaagaatatgatgtgtgcagctgatccacgccacggcaggtacttgacagcctcagccatgttcagaggcaaaatgagcacgaaagaagttgacgaacagatgatcaacgttcagaacaagaactcgtcatactttgtggaatggatcccaaacaacgtgaaatcaaccgtgtgtgacattccaccaacaggtctgaaaatggcttcgactttcatcgggaactcgacatcgatccaggagatgtttaggcgtgtgagcgaacagttcacagcgatgttcagaagaaaagctttcttgcattggtacacaggtgaaggaatggacgagatggagttcacagaggcagagagcaacatgaatgatttggtatcagagtatcaacagtaccaagacgcaacggctgatgaggaagaagggtatgagtatgaagaagacgaagtggaagtgcaggaggagcaataa

SEQ ID NO: 1846 - DNA, 606 bp, Arabidopsis thaliana
atgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttga

SEQ ID NO: 1847 - DNA, 2358 bp, Arabidopsis thaliana
atgggagatcaaaaaacactttcttacgacaaatctaataaacccttttattcttcttcttcatctccatgttccttcacagccatcgtcgtcttcttgatcttcgtctcatatctcttatactcattcagtttcatctcttttctaaacccatattcaccttctaaatcccccaattctctcctcgtacccgttatccgtctcgggtcgggtcaaacacctgaggaacaaacggagctcaaacacatagtcttcggaatcgccgcgtcttcagatctatggaagcatcgtagagaatacgtgaaaacatggtggaaacctaacggagtcatgaacggcgccgtttggctcgacaaacccatcaacgacaccgtttcttcttcatcagctttgcctcagatcagaatctcttccgacacgtcgagtttcaagtaccgttaccgtaacggtcacagatcagcgatcaggatcacgagaatcgtgtccgagacggtgaggatgttaaacggaacggaagcggagagaaacgtgaggtgggttgtgatgggtgacgacgataccgtgtttttcacggaaaatcttgttagggttttgagaaagtacgatcataaacagttttattacatcggagctccgtccgagagtcatttgcagaatcttcatcagttttcttatggaatggcgtacggtggaggagggtttgctataagttatccattagccaaggttttggagaagatgcaagatcggtgtatcgagagatactccgatttgtacggatccgatgatcggattcatgcttgtatggctgagcttggtgttcctctcactaaagaagttggattccatcagtttgatgtatacgggaatctcttagggctattatctgtccatccacaagcaccaatagtatcaatccatcacctagacgtagtggatcctatattcccaaaaacaaaccgagtcaacgcattaaagaagctaatgatcccagcgaaactcgattcagcgagtcttgtccaacaatcggtatgctatgataagagtcatcagtggacaatgtcaatctcgtggggatacacagttcaaatcacgcgtacgtatatgccagcaaggatgatggaagtgcctactcgcacttttaatgattggcacttacgtagcgatttcactaatcttgcattcaacacacgtccggtaacatggacggattgtcagcgtcctcgtgtgttttatttctctcatgcgtttagtaactcttcttcttctgatacaacgacgattagccaatacttgaggcacgacgaatggtatcctaaatgtgaatggggaatcgcggatccttccgagatcaatcagatatttgtctacaaaaagcctactccggataggtggagcaaggttgttattaggtttgttcctagtaaagattcgaactttgcattcgttaatgctattgaagttatctctgcgcctaaggatttgattggtgacgttgcaacctctgtatctcatgatgggactgagaaattcaatggtttagctaaacaagcaatggaggttgtgtatagagtcaatgttggtggtagaaaagttactccttttaatgacacattgtggaggacttgggttactgatgaaggattcttgaaaaccggtgatgggtcgtctgagaaaagttacttcaccgggaggattaagtataggcgtggaggggcgagtcgtgaagttggtcctgataatgtttacaacactgctcgtgttggtaaaagaagcaatggattggttgatatgagttggggtttcaaggtgaatgtgggttacaagtatctcatccggatgcatttctgtgacatagctagcaaatctctcggcaggctttatttcaatgtctacattaacgggaacttggcgtatgaagatttcgatatctcatacgctgcggataatgtccttgcttctccgtattacattgatttcgtggtggatgctactgctgatgacaacaacccttcaggatcgtcgataaccgttagtgttggaccatcaaacaagactagtgttgatggaaatggagtggatgcgatattgaacggtgttgagatcatgaagatgaataactcgatgggtagtcttgatgggtatgtttcaacagagatgattctgagtacttgcccaaataggagaaacctgagcatatttatcgcaatgttggcgtttatgtgtatatttatgagcttctacattgtgactcaaagaaagagagttaaggatcagtatggctggacaaagctgtccatggacgtgcttgaagataattccaagtcagggaatcaatttacagcaagaaaggcttga

SEQ ID NO: 1848 - DNA, 639 bp, Arabidopsis thaliana
atggaggatcggttctccgctatcaccaatcttcatggagatcataaacaggcaatatttggagtctatgttggtcatggaggagttaaagcggctgagtttgcagctaagaacttagataagaacattgtagaagaagtagttgacgcaacgtttcttaaggaggaaggttttaagggtggttcatcctgtgtcacggctttggttagcgaagggagccttgttgtgtcaaacgccggtgactgtcgtgctgttatgagtgtaggagagatgatgaacggaaaagaattgaaaccacgggaggatatgttgatacgtttcacgttgtggagaatccagggatccttagttgtgccaagaggaatcggagatgctcaacttaagaaatgggttatagctgaaccagagacaaagatctcgagagttgagcatgaccatgagttcttaatcttggcatcacatggtttatgggataaggtaagtaaccaagaagcagtagacattgctcgtcccttctgcttacgaaccgagaagccattgttgttagcagcttgtaagaagcttgttgatctctcggcttcacgaggctcgtttgatgatatcagtgtgatgttgatcccattgcgccagttcgtatag

SEQ ID NO: 1849 - DNA, 1152 bp, Arabidopsis thaliana
atggatcaccgggaaaagagtgaccggcgactactgctatggttcttcgccgtagccaccgccgtaaaactccttctcattccgtcgtccagaagcaccgatttcgaggtccaccgtaactggctcgctatcacaaactctcttcctcttaccaaatggtacttcgacgagactagccaatggacactcgactatcctcctttcttcgcctacttcgaacgcttcctctcaattttcgcgcgtctcgtcgatcccaggatcgtagatcttcaatcaggactcgattacaatgccgaatctgtaatttacttccaacgaatcagcgtaatcgtctcagatctatgtcttctctacggtgtttatcgattgactcgaaaattagaaccgttgaaacgaaatctgatctgcgcattggtgatttggtctccggggctattgatcgtagatcacattcattttcagtataatggatttctactgggttggttattgctttcgatttcgtttcttcaagaagggagagatcttttggttactggtttccgacggcttgtaactattggtgcggtggttgtggcggtttttgctgctgcctatggaccttttatctatcatggacagatacagcaagtcatcagtagaatgtttcctttcgggagaggattgtgtcatgcatactgggcacctaatttttgggttttctacataatactcgacaaagggcttgcggttttgctgcggaagctaggatatgaaattcaaattccttccgcatctttcactggaggattagttggagattcttcgccttttgcagttcttcctcagatcacgccattgacaacatttgcaatggtattactagctatatctccatgtctcatcaaagcctggaaaaaaccacactcggggctcgttgctagatgggtagcttatgcatatacatgcggttttctgtttggatggcacgtccatgagaaagcatcgcttcactttaccatcccacttgcaatcgttgcagttcagagtctagaagatgctaaacattactttctggtttccatagtctcttgctattcgctctatccactcttatatgaaccgcggagtacccgatcaaggttctgttgctgttattgcattccgtggtaa

SEQ ID NO: 1850 - DNA, 1590 bp, Arabidopsis thaliana
atgaatcacgtaccgtctgatcaaagcttttacattgagagcgaggacgaagacgataggaaagattacgtagaagaagatggtggaagccattctgattcctctgatgatgtttatgatgaaaaccaagctcacattaagcctagctcatacaccactgcttggcctcagagttacaggcagtcgattgatctttatagtagtgtaccgtctcccggtatcggttttcttgggaataattcgatgacgagattcggaagctctttcttgtcttctggtttgataagaagacatactccggaatcattacctactgttacaaaacctttgttagaagaacaagcagatgaacaagcactaccaaaacatagacttagctctcagggcttactctctcctattccttcgaggaggggttcgatgcgaaaggatgagaaatcatccatggtgtctcatgagattccaatgtctcgtaatagctcatacggacaagctgtactaaatggattgaacgttctttgtggggttggaatactttcaacgccttatgctgccaaagaaggaggatggttaggacttatgatactatttgtatatggtcttctttctttctacaccggaatcctccttcgttattgcctcgacagtgagtctgacctcgaaacctatcccgacattggccaagctgcgtttggtactactggacgtatctttgtctcgattgtactctacttggagctatacgcatgctgtgtggaatatataatattggagagtgataatttgtcttcattatatccaaatgctgccttaagtattggaggatttcagttagatgcacgccatctatttgcattgctaaccactctcgccgttctccccaccgtttggctcagagatctcagcgtacttagttatatctctgctggaggggtgattgcatcagtgctagtggttttatgtttgttttggattggtttggtagatgaagttggaattcacagcaaaggaactacactaaacttgtcaacattacctgtggctataggactctatggttactgctactcaggacatgctgttttccccaatatttatacttctatggccaaaccatctcaataccctgctgttctcttgacatgttttggtatttgtactctgatgtatgccggcgtcgctgttatgggttatacgatgtttggagaatcaacacagtcacagtttactctcaacttgcctcaagatttaattgcaactaagattgctgtgtggactacgttgataccatcaaggcatatcaggtcacattggtacgccatcggcattagaaccctattggtcttctctactctgcttgttggtctcgctattcccttctttggtcttgtcatgtcattgattggatcgttgttgactatgctcgtcactctaatacttcctccagcttgtttcttgagcattgtaaggagaaaagttaccccgacccagatgatgttgtgtgtcttaatcatcatagtaggagcaatatcttcagtcattggctcatattcagctctttccaagatcgttgagaaattgaccaactga

SEQ ID NO: 1851 - DNA, 1749 bp, Arabidopsis thaliana
atgaaaggcggaggcggtggtggaggaggtggtggcggaggaaaacgccggtggaaagttctggtgattggagttttggttcttgttattctttctatgcttgttcctcttgctttcttactcggtcttcacaatggctttcactctcctggatttgtcactgttcaaccggcttcttcatttgagagctttaccagaatcaatgctactaagcatacacagagagatgtatccgaacgggtcgatgaggttcttcaaaaaatcaatccagttcttcccaagaaaacaaaatcggaagcctcatatacaggtgttcagaggaaaatagtaagtggtgatgaaacttggagaacttgtgaagtgaaatatgggagctactgcctctggagggaggaaaataaggaaccaatgaaagatgccaaggtgaagcaaatgaaggaccagctgtttgtggctagagcatactatcccagtattgctaaaatgccttctcaaagcaagttgactcgggatatgaaacagaatatccaagagtttgagcgtattcttagtgaaagttctcaagatgctgaccttccaccacaggttgataaaaagttgcagaagatggaagctgtaattgcaaaggcaaagtcttttccagtcgactgtaacaatgttgacaagaaattgagacagatccttgatttgactgaggatgaagctagtttccacatgaaacagagtgtgttcctctaccagcttgcagtacagacaatgcctaagagtcttcattgcttgtcaatgcgactaactgtggaacatttcaagtcagattcacttgaggatcccattagtgagaaattttcagatccctcattacttcactttgttatcatctccgataatatactagcatcgtccgttgtgatcaactcaacggttgtacatgcaagggacagtaaaaactttgttttccatgtactgacagacgagcagaattactttgcaatgaaacaatggtttattaggaatccttgcaaacaatcaactgttcaagtattgaacattgaaaaactcgagctggacgattctgatatgaaactgtctttgtctgcggagttccgtgtttccttccccagtggtgaccttttggcgtctcaacagaatagaacacactacttatcccttttctctcaatctcactatcttcttcccaaattatttgacaaattggagaaggttgtgattctggatgatgacgttgtagtccagcgagacttatctcccctttgggaccttgatatggaagggaaagtgaatggcgctgttaagtcgtgcactgtgagattgggtcagctaaggagtctcaagagaggaaattttgataccaatgcttgtctctggatgtctggtttgaatgtcgttgatcttgctagatggagggcattgggtgtttcagaaacctatcaaaaatattataaagagcagatgagtagtggagatgagtcgagcgaagcaattgcattgcaggcaagcttgctcacatttcaagaccaagtatatgctcttgacgacaaatgggctctatcagggcttggttatgactactacatcaatgcacaagccataaaaaacgcagccatattgcactataacgggaacatgaagccgtggcttgagctgggaatcccaaattacaaaaactattggagaaggcatctgagtcgggaagatcggttcttgagtgactgtaacgtgaatccttga

SEQ ID NO: 1852 - DNA, 843 bp, Arabidopsis thaliana
tctgtaaaacccatttggggaagaaccaaagaaaccgatgaacatatgggatgggtctttccaggttcagataccgaagttccaggagctgatcctgaccatcttaatggtgctaagagtgtaagagaactctatgagattgctagcccaaactacaccgggaagtatactgttcctgttctgtgggataagaagctcaaaactgttgttaacaacgagagtgcagaaataatccggatgttcaacactgagttcaatcatattgcgggaaatcctgatcttgatctttacccttcccatctccaagctaaaatcgatgaaactaatgaatggatttacaatgggataaataatggtgtctatagatgcgggtttgcaaagaaacaaggaccttatgaggaggcagtggagcaagtgtatgaagcattagatagatgtgaggagattcttggaaaacatcggtacatctgtggtaacactttgactgaaacagatatcagattgtttgtcacccttataagatttgacgaggtaagttcatactttcaaagcaagaaaaagaagtacaccatatgtgaacgaatctctaatgttgaaacgttgatccaggtttatgcagtccacttcaaatgcaacaagaaactcataagggagtatccgaatttgttcaactacacgaaagacattttccagatccccggtatgagtagcacggttaacatgaatcacatcaagcagcattactatggaagccacccgtcgatcaacccttttgggatcatccctcatggaccaaacatcgattacacttcgcctcatgatcgacacagattctccaaatga

SEQ ID NO: 1853 - DNA, 2673 bp, Arabidopsis thaliana
atgtcaaaggcgcttttgcatttgcattttctttctctgtttttactctgttgtgtctgccattcaagtatttttactttaaattttcattttactggtattgtggcctgtcgtccccaccagattcaagccttcacgaagttcacgaacgagtttgacacccgcggttgcaacaacagtgacacctttaatggagtctggtgcgataactcgacgggtgcggtcgcagtgctacaactaaggaagtgtctcagtggaactttgaagtccaacagtagcctcttcgggtttcatcaactccgttacgttgatctccaaaacaacaacttaacctcctcttcactcccttccgggtttggaaatctcaaaagattagagggcttgtttctttcctctaatggcttcctcggccaagttccttcctcattcagtaacctaacaatgcttgctcaattagacctttcttataacaagctcactggtagtttcccacttgtccggggtctaagaaagctcattgttttagacctttcatataatcacttctccggaactctgaatccaaacagtagcctctttgagttgcaccagctacgttaccttaatctcgcttttaacaactttagttcctcactcccttccaaatttggcaatctccatagattagagaacttgattctttcctctaatggcttttctggtcaagttccttccacaattagtaacctgacccggttaactaagttgtaccttgaccaaaacaagctcactagtagtttcccacttgtacagaatctaaccaacctctacgaattagacctttcatataataagttctttggagtcatcccttcttctctcctcactctgcctttcttagcacatcttgctctacgtgaaaacaatcttgctggttctgttgaagtttcaaactcctctacctcatctaggctcgaaatcatgtatctcgggtctaaccattttgaaggacaaatcctagagcctatctcaaagctcatcaacctcaagcatcttgacctttctttcctaaacacaagctacccaatagacttaaaactcttctcctccctcaaatctttgcggtctctggatctttctggaaacagtatatcttcggccagtttaagttcagattcatacatcccgttgaccctggaaatgttgaccttgaggcactgtgacatcaacgagttccccaacatcttaaagaccctcaaggagttggtgtatatagacatatccaacaacagaatgaaagggaagatccctgagtggttatggagcctacctcttctacagtcagtaactcttggaaataattatttcacaggtttccaaggttcggcggagattttagtaaattcatcagtgctgctattatatttggattcaaacaattttgaaggagcacttcctgatctaccactctctatcaaaggcttcggtgtggctagtaatagtttcacaagtgagatacctctttcaatctgcaaccgaagctctctcgctgctattgatctatcctacaacaacttcactggtcccattcctccatgtttgcgtaatttggaacttgtgtatctccggaacaacaacctggaaggaagtatccctgacgcgctctgtgatggtgcctctttacggacactcgatgttagccataaccgattaacagggaagcttccaaggtcttttgtaaactgctcatcgctaaagtttctaagcgttataaacaacagaattgaagatacgtttccgttctggctcaaagctttaccgaatttgcaagtccttactcttcgctcaaacagattttatggtcctatatctcctccgcatcaaggtcctctcgggtttccagagctgcggatatttgaaatatctgacaataagtttacaggaagcttgccaccaaactactttgtgaactggaaagcatcatcacgcacgatgaatcaagatgggggtttatatatggtatacgaggagaagctgttcgacgaaggcggctatggttatacagatgctttagatttgcaatacaaaggtctacacatggagcaagctaaggccctcacttcctacgccgccattgatttttctggaaatagactcgaaggacagattcctgaatctattggtctcttgaaggcactgattgcagtcaatatatcaaacaacgccttcacaggccatattcccctgtctatggccaatcttgagaatctcgagtcactagacatgtcaagaaaccaactctcggggactattcctaatggactagggagcatttcgtttttggcgtacatcaacgtgtctcacaaccaactcacgggtgaaataccacaaggaacacagattactgggcaatctaaatcttccttcgaagggaatgcagggctttgtggtcttcctctcaaggaaagttgcttcggcactggtgcacctccgatgtatcaccaaaagcaagaagacaaagaagaagaagaagaagaagaagaagaagaagaagaagtgttgaacgggagagcagtggcaatagggtatggatctggattattgcttggattggcaatagcacaagttattgcttcatacaaaccggagtggcttgtcaagataattggtctgaataaacgcagaaagcgttag

SEQ ID NO: 1854 - DNA, 993 bp, Arabidopsis thaliana
atggctcttccgttgccattgatcttccttatcttctctcatttgttcgtttctggagttagatcaacgagcttcattatggtgaacaaatgcgaatacacagtctggcctggacttttatcaaacgccggagttccaccacttccgacgaccggattcgttctccaaaaaggcgaagaacgaacaatcagcgctccaacttcatggggaggaagattctgggggagaactcaatgttccaccgacaccgacggaaaattcacttgtctcaccggagattgcggatctggtaccctcgaatgctccggatccggagcaacaccaccagcaacactagcggaattcacactagacggatctaacggactcgatttctacgacgttagtctcgtcgacggttacaacgtcccgatgctagtggctccacaaggaggctcgggtttaaactgtagcagcaccggatgcgttgtagatctgaacggttcgtgtccgtcggagcttaaagtgacgagtttagacggcagaggtaaacaatccatgggatgtaaaagcgcgtgtgaagcttttcgtacgccggagtattgttgcagcggcgcccacggtacacctgacacgtgtaaaccgtcgtcgtactcgttgatgtttaaaactgcgtgtccacgtgcttacagctacgcttacgatgatcagagtagtaccttcacatgtgctgaatctcctaattacgttatcacgttttgccctactcctaacaccagtcaaaaatcatctcaagatcagagcccagatcccaaaccgacgacaccaaccgggacgtcgtcgacaactcctgccggagatagtagtacgacgtggtcaccggtagatacatcaatgatatacgaaggagctttggatcaaaacaaaggatcaccgtccacgtgtcatctttcgttatgtggaatcacagtcacacttgcgctggccttttgtcggatgtggcggctcttttga

SEQ ID NO: 1855 - DNA, 576 bp, Arabidopsis thaliana
atggctcgatctttcgctattgctgtgatctgtatcgtcctcatcgccggcgttactggtcaagctccgacttcaccaccaaccgctacaccagctccaccaactccaacaactcctccaccagcagcaactcctcctcctgtctcagcaccaccaccagtcacaacatctcctcctccagtcaccactgctcctcctccagcaaatccaccaccaccagtctcttctcctcctcctgcttctcctccaccagctactcctcctccagtcgcttctcctcctcctcccgttgcttctcctccaccagcaactcctcctcccgtcgctactcctcccccagctcctctagcttcccctcctgctcaagttccagctccagcaccgaccacgaagccagattctccatctccatctccgtcatctagcccacctcttccatcaagcgacgctcctggacctagcaccgattctatctctcctgctcctagccccactgatgtgaacgaccagaatggagctagcaagatggtttcgagcttagtatttggatctgttctcgtctggtttatgatctaa

SEQ ID NO: 1856 - DNA, 1086 bp, Arabidopsis thaliana
atggactctttaacactcttcttcaccggtgcactcgtcgccgtcggtatctactggttcctctgcgttctcggtccagcagagcgtaaaggcaaacgagccgtagatctctctggtggctcaatctccgccgagaaagtccaagacaactacaaacagtactggtctttcttccgccgtccaaaagaaatcgaaaccgccgagaaagttccagacttcgtcgacacattctacaatctcgtcaccgacatatacgagtggggatggggacaatccttccacttctcaccatcaatccccggaaaatctcacaaagacgccacgcgcctccacgaagagatggccgtagatctgatccaagtcaaacctggtcaaaagatcctagacgtcggatgcggtgtcggcggtccgatgcgagcgattgcatctcactcgcgagctaacgtagtcgggattacaataaacgagtatcaggtgaacagagctcgtctccacaataagaaagctggtctcgacgcgctttgcgaggtcgtgtgtggtaacttcctccagatgccgttcgatgacaacagtttcgacggtgcttattccatcgaagccacgtgtcacgcgccgaagctggaagaagtgtacgcagagatctacagggtgttgaaacccggatctatgtatgtgtcgtacgagtgggttacgacggagaaatttaaggcggaggatgacgaacacgtggaggtaatccaagggattgagagaggcgatgcgttaccagggcttagggcttacgtggatatagctgagacggctaaaaaggttgggtttgagatagtgaaggagaaggatctggcgagtccaccggctgagccgtggtggactaggcttaagatgggtaggcttgcttattggaggaatcacattgtggttcagattttgtcagcggttggagttgctcctaaaggaactgttgatgttcatgagatgttgtttaagactgctgattatttgaccagaggaggtgaaaccggaatattctctccgatgcatatgattctctgcagaaaaccggagtcaccggaggagagttcttga

SEQ ID NO: 1857 - DNA, 459 bp, Arabidopsis thaliana
atggcgaaaggagttgcagttttgaacagcagtgagggtgttacggggactatctttttcacccaggaaggcgatggtgtgaccactgtgagtggaacagtttctggccttaagcctggtcttcatggtttccatgtccatgctcttggtgacaccactaacggttgcatgtctactggtccacatttcaaccccgatggtaaaacacacggtgcccctgaggatgctaatcgacatgctggtgatctaggaaacatcactgttggagatgatggaactgccaccttcacaatcactgattgccagattcctcttactggaccaaactctattgttggtagggctgttgttgtccatgcagaccctgatgacctcggaaagggaggccatgaactcagcctggctactggaaacgcaggcggccgtgttgcttgcggcatcattggtctccagggctaa

SEQ ID NO: 1858 - DNA, 591 bp, Arabidopsis thaliana
atggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattag

SEQ ID NO: 1859 - DNA, 1638 bp, Arabidopsis thaliana
atgggtaactgtaacgcctgtgtaaggccagactcaaaagaatcaaaaccatcttcaaagccgaaaaaacccaatcgagatcggaaattaaacccattcgccggagatttcaccagatccccagctccaatacgtgttctcaaagatgtaatccctatgagcaatcaaactcagatcagcgacaaatacatcttaggtcgtgaattaggtcgaggcgaattcggaatcacttacctctgtactgatcgtgaaacccacgaagctttagcttgcaaatcgatttcaaagcgaaagcttcgaacagctgtcgatatcgaagacgttcgtcgtgaggtagcgattatgtctactttacctgagcatccaaacgtagttaagcttaaggctagttatgaggataacgagaacgtgcatctggttatggagctttgtgaaggaggtgagctttttgatcggattgttgctagaggacattacacggagcgtgctgctgcagctgttgcgagaacgattgctgaggttgtgatgatgtgtcactctaatggagttatgcatcgagatttgaaacctgagaatttcttgtttgctaataaaaaggagaattctccactaaaggctattgattttggcttgtctgtgttcttcaaacctggagataagtttacagagattgtaggaagtccgtattatatggctccagaagtgttgaagagagattatggaccaggggttgatgtgtggagtgccggagttattatctatatcttgctctgtggtgttcctccgttttgggctgagactgaacaaggtgttgctcttgcgatcttgcggggagttcttgattttaagagagacccttggcctcagatatcagagagtgccaagagccttgtgaagcagatgttggatcctgatccgactaagcggttaactgctcagcaagtgttagctcacccatggatacagaatgcaaagaaagctcccaatgttcctttaggagatatagtcagatctaggttgaagcagttctctatgatgaacagattcaaaaagaaagttcttcgtgtaattgcggagcacttgtctattcaagaggttgaagtgataaagaacatgttctcactgatggatgatgacaaggatggtaaaataacttacccggaactcaaagctgggcttcagaaggtcggttcacaacttggtgaaccagagatcaaaatgttgatggaagtggcggatgtcgatggaaatgggtttctggattatggagagtttgtagctgtgataattcacttgcagaagatagagaatgatgaacttttcaaactagcttttatgtttttcgacaaagatggaagtacatacattgaacttgatgagctacgggaagctttagcggatgagttaggcgagccagacgccagtgttctaagcgacatcatgcgtgaagttgacactgacaaggacggacgtataaactatgatgagtttgtgacgatgatgaaagctggaactgactggagaaaggcatcgagacaatattcaagagagaggttcaaaagcttaagcattaacttgatgaaagatgggtcattgcatctccatgacgctctcactggacaaactgttcctgtttaa

SEQ ID NO: 1860 - DNA, 1530 bp, Arabidopsis thaliana
atgcaaggcttacacttttctgctcatttgcaggaacgtcccgttgcttttgtgtttttcaagagtcgttatgatgctcttgttgtttcagaagttcttcaaacaccaaatcctatgttatgggtggcagacttggctccagagcctcatgatgttcactggagaaatctcagaataccttatcggcagctttggatgcgaagaatagcaacccttgttggtgcaattgccttcatgtttgtgtttctttttcctgttacctttgttcaagggctgactcaactaccaacgttatccaagaattttccttttctaaaagacctcttgaacaggaggtttatggagcaggtcatcacagggtatttaccaagtgtgattttggttctattcttttataccgttccgccattgatgatgtacttttcaaccttggagggatgtgtttctcggagtcaaagaaaaaaaagtgcatgtctcaaaattttatacttcaccatctggaatgtgttcttcgtcaatattctatcaggctctgttatcaggcagtttaccgtcttgaatagtgtgagggacgtacctgcacaacttgcgaaacttgttccagcacaggtaattttcagtgttcctttcacacgtgtgactatattcaattttgttattttctataaggctaacggtatgaaattattcattgactacatgcaggctggcttcttcatgacctattgtttcacgtctggttgggccggtttggcatgtgaaatcatgcaacctgtaggtcttatttggaatctgattgcaaaagttattgttaagaacaaggaggagtcatatgaaacacttaggtttccctaccatacagaaattccaagactacttttgttcgggctcctgggtttcaccaattcagtcatagcgcctctgatactgccgtttctgctgatctactttttcttcgcatatcttatatacaaaaatcagataatcaacgtctatattacaaagtatgaaagcggtggacaatattggcctgtttttcacaacactacaatcttttcactgatcttgtcgcaagttatagctctaggctttttcgggttaaagctatcaacggttgcttcaggtttcaccatcccgttaatccttctcactcttctatttagtgagtattgccggcaaaggtttgcgcccatattccagaaatatccagccgagattcttatcgctatggacagagcagatgagatgacaggaaagatggaagagatacataacaacttgaaagttgcatactctcagataccaacgtgttctgaagaatccagcaaagctggttgcacttctccttgctcagatcaggagttaccagattctgaagagttgaagcctgagaaagagaatcttaaagctgattacatatgggagttccagagaagtaaatctggtcttgatcttgaggtgaaatcctgtcccagtgcttccccaattcgtaattccccagggtttgccgagatctacaaacgaacatag

SEQ ID NO: 1861 - DNA, 1689 bp, Arabidopsis thaliana
atggctacggagcctacaaggagctggttccagatacggcagcagaaaccggataaatcaagccctactaaaaagggacaagagggaaatgtgaagaatcttgggagacctcctatgaatgatgcaccatctaatgctactaaacagaaagttgctgcagcgaagcaatatatcgagaatcattataaaattcagaagaagagtctccaggaaagaaaagagcgtcggagcatcttggaacaaaacctagctgatgctgatgttactgttgaagacaagatggatatattaaagaactttgagaaaaaggaaatggagtatatgcgtctacaaagacagaaaatgggggttgatgactttgaactgcttagcatcattggccggggtgctttcggtgaggtgagaatttgtaaagaaaaatctactggaagcgtatatgcaatgaaaaagttaaagaaatccgagatgcttcgacgagggcaggtggaacatgttaaagctgaaagaaatgtgcttgcagaagtggatagccctttcattgtcaagctttgttactctttccaagatgatgagcatttgtatcttattatggaatacctccctggaggtgatatgatgacactgctgatgcgaaaggataccttacgggaagatgagactcggttttatgttgcgcagacaattctggctattgagtctatccataagcataattacgtccacagggatataaagcctgataatttattgattactcgaaacggccatatcaagctttcagattttggattgagcaagtctctggaaagcaaaaattttccagattttaaggcggagcttgttgacaggagtacaaagcctgcagcagaacatgatagactctccaagcctccttctgcacctaggagaactcagcaggaacagcttttacattggcaacaaaacagaaggaccctggctttttctacagtaggaactcccgattacattgcccctgaggtgctgctgaagaaagggtatggaatggagtgtgattggtggtctcttggagcaatcatgttcgagatgcttgtagggtttccgccattctattccgaagaacctttggcaacatgtagaaagattgtaaactggaaaacctgcttgaagttccctgatgaagctaagctctccatcgaggtaaaagatcttatccgaagactgctctgcaatgtcgaacagaggcttgggaccaaaggagttcacgaaatcaaagcacacccttggtttaggggagtcgaatgggaacggctatatgagtcaaatgctccatatataccacaagtgaagcatgagcttgatacccaaaactttgaaaagtttgatgaggtaccatctacttgccaaacttcttcaaagtctagcccttggagaaagatgatctcatccaaagatgcaaatttccttggttatacattcaagaatctggagatagttgatgaacaccatatccctggcatggcggaactgaagcggaagagtaagacagcaaataaaccatctctcaaaacactcttcgaaacaccatatcctccttctgagaatcaagccttaaaggatttgcttgattcacctatttactctgaaggctctagagggtcttccggatcaccattttcacgaccgaatcaatcacaggcccggagatga

SEQ ID NO: 1862 - DNA, 3036 bp, Arabidopsis thaliana
atgtccagtgctcaaaccccactgttcttggcaaatcagactaaggtattcgatcacttgattccattgcataaaccctttatttcttctccaaacccagtttcccaatccttccccatgtggagaaacattgctaaacaagcaatttcgaggtcagctgctagattaaacgtcagttcccaaactcgtggccttcttgtgtcttctccggagtctattttctcgaaaaatttgagctttcggtttccggtcttgggatcaccatgtcacggaaagggttttcgttgtttaagtgggatcacgaggcgagaggagttttccaagagcgagaggtgccttagtgggactttggctagagggtacacgagtgtagccgaagaggaggtcttatcaacagatgttgaggaagagcctgaggtagatgaattgttgaaggagatgaagaaagagaagaagagagaaagtcatcgttcgtggcggatgaagaagcaagaccaatttggaatgggtcgtaccaagttccagaatttatggagaagacaagttaagatcgagactgaagaatgggaaagagctgctgcagagtacatggagcttttgacagatatgtgtgagcaaaagcttgcgcctaatctgccttatgtgaagtctttatttctgggttggttcgaaccattaagagatgcaattgctaaagaccaggagttgtatagattagggaagagcaaagcaacttatgcacattaccttgatcagttgcctgccgacaagatatctgttattacaatgcacaagttgatggggcatttgatgactggtggtgataacggttgtgttaaggttgttcatgctgcgtgtacagtaggcgatgccattgaacaagagataagaatatgcacattcttggataagaagaaaaaaggggatgacaatgaggagagtgggggagttgaaaatgaaacttctatgaaggaacaagataagttaagaaaaaaggtcaatgagttgataaagaaacagaagttgtcagcagttagaaagatcttgcagtcacatgactatacgaaaccatggatcgcagatgttagggctaaggttggaagtcgtctaatagagttactcgtaagaacagcttatatacagtctccagctgatcagcaggataatgatctgcctgatgtccgacctgcatttgtgcataccttcaaggtagcgaaaggaagcatgaattctgggagaaaatatggtgtaatcgagtgtgaccctttggtccgcaaaggcttggaaaaaagtgggagatatgcagtgatgccatacatgccaatgctggttcctcctctcaaatggtcgggatatgacaaaggtgcttacttgttcttgacgtcttatataatgaaaactcatggagccaagcaacaaagagaggcacttaagagcgcacctaaaggacaactacaaccagtctttgaggccctggatacgcttggaagtactaaatggagagtaaataagcgagtcttaacggttgtagataggatatggagcagtggcggatgtgttgctgatatggtggatcggagtgatgttcctttaccagaaaagccggatactgaagatgagggcattcttaagaaatggaagtgggaagtcaaatctgctaaaaaggtgaacagcgagagacattctcagcgatgtgacacagaactcaagctttcggtagcacggaaaatgaaagatgaggaagctttttactatccccacaatatggacttccggggtcgtgcatatcccatgcccccacacttaaatcatcttggctctgatttgtgtcggggtgttttggagtttgctgagggaaggcctatgggaatttcaggcttacgctggctgaagatacacttagcaaacttgtatgctggtggtgtagataagttatcacttgatggacggctagctttcactgaaaatcacttggatgacatatttgattcggcagacagaccacttgaaggaagcagatggtggctgcaggctgaagacccatttcagtgcttggctgtctgcataagtctgactgaagctctgagaagcccatccccagagacagttctgtcacatattcctatacatcaggatggttcctgcaatggtttacagcattatgccgctcttgggagagacacattaggagcagaagctgttaatctagttgcaggtgagaagccggcagatgtttattcaggaatagctaccagggttcttgatattatgcgccgagatgcagacagagatcctgaagtttttccagaggcattgcgtgcaagaaaattacttaaccaggtggatcgtaagcttgtaaagcagacggttatgacatcagtctatggtgtcacctacattggcgctcgggatcaaataaagagaaggttgaaggaacgaagtgattttggtgatgaaaaagaagtttttggggctgcttgctatgcagcaaaggtaacattagctgctatagatgagatgtttcaagctgcacgcgccatcatgcgttggtttggtgaatgtgcgaagattattgcttcagaaaatgaaacagttcgatggacaaccccattgggtcttcctgttgtacaaccttaccaccaaatgggaacaaaactcgtaaagacatccctccagaccctatcgcttcagcatgaaactgatcaggtcattgtgaggcgacaaaggacagcttttcctccaaattttattcactccctggatgggtctcatatgatgatgactgcggttgcctgtaaaagagcaggcgtgtgttttgcaggagttcatgactctttttggacgcatgcgtgtgatgtggataaactaaacataatactacgggaaaagtttgttgagctgtattcacaaccgatactagagaatttgctggagagctttgagcaatcgtttcctcatttagactttcctcctctgccagaacgaggagatttggatttaaaagtggtgttagattcaccttatttcttcaactga

SEQ ID NO: 1863 - DNA, 975 bp, Arabidopsis thaliana
atggccgtcgatctaatgcgtttccctaagatagatgatcaaacggctattcaggaagctgcatcgcaaggtttacaaagtatggaacatctgatccgtgtcctctctaaccgtcccgaacaacaacacaacgttgactgctccgagatcactgacttcaccgtttctaaattcaaaaccgtcatttctctccttaaccgtactggtcacgctcggttcagacgcggaccggttcactccacttcctctgccgcatctcagaaactacagagtcagatcgttaaaaatactcaacctgaggctccgatagtgagaacaactacgaatcaccctcaaatcgttcctccaccgtctagtgtaacactcgatttctctaaaccaagcatcttcggcaccaaagctaagagcgccgagctggaattctccaaagaaaacttcagtgtttctttaaactcctcattcatgtcgtcggcgataaccggagacggcagcgtctccaatggaaaaatcttccttgcttctgctccgttgcagcctgttaactcttccggaaaaccaccgttggctggtcatccttacagaaagagatgtctcgagcatgagcactcagagagtttctccggaaaagtctccggctccgcctacggaaagtgccattgcaagaaaaggaaaaatcggatgaagagaaccgtgagagtaccggcgataagtgcaaagatcgccgatattccaccggacgaatattcgtggaggaagtacggacaaaaaccgatcaagggctcaccacacccacgtggttactacaagtgcagtacattcagaggatgtccagcgaggaaacacgtggaacgagcattagatgatccagcgatgcttattgtgacatacgaaggagagcaccgtcataaccaatccgcgatgcaggagaatatttcttcttcaggcattaatgatttagtgtttgcctcggcttga

SEQ ID NO: 1864 - DNA, 843 bp, Arabidopsis thaliana
atgggaaacctcaagtctctcgttctcttggctttgctcttttctttctccgtcgctgttttcgcgaacacatccaacgatgccacacacgatgaagtgaagccaagtactgaagcaacccatgccatagaggcgcaaaaacatgacggtaaaccccagatcgcggaagcccaagttgaggccaatgaccctgttgtagagccccagcaagactggggtggccgtggtggttgtaggtggggatgttgcggtgggtggtggcgtggacggtgcagatactgttgcaggagtcaagccgaggccagcgaggttgtggaaactgttgagcccaacgatgttgagcctcagcagggtggccgtggtggtggcggtggtggtggcggaggccgtggtggttgtaggtggggatgttgcggtgggtggtggcgtggacggtgcagatactgttgcaggagtcaagccgaggccagcgaggttgtggaaactgttgagcccaacgatgttgagcctcagcagggtggccgtggtggtggcggtggtggtggcggaggccgtggtggttgtaggtggggatgttgcggtgggtggtggcgtggacggtgcagatactgttgcaggagtcaagccgaggccagcgaggttgtggaaactgttgagcccaacgatgttgagcctcagcagggtggccgtggtggtggcggtggtggtggcggtggccgtggtggttgtaggtggggatgttgcggtgggtggtggcgtggacggtgcagatactgttgcaggagtcaagccgaggcaaacgaggttgtggaaactgttgaggcccaacaagctaagccatga

SEQ ID NO: 1865 - DNA, 519 bp, Arabidopsis thaliana
atggcgagattcacggtgctgattacggcggttgtgctagcttttctaatggcggcgccgatgccaggagtgacggccaagaagtatacagtcggcgagaacaagttttggaaccccaacattaactacaccatctgggctcagggcaagcatttctacctcggagactggctctatttcgtgttcgacagaaaccagcacaatattcttgaagtgaacaagactgactatgaaggatgtatcgccgaccacccaatacgcaactggacacgtggagctgggagagacattgtcactctcaaccagaccaagcattactaccttctcgacggaaagggtggatgttacggtggcatgaagctatctgttaaagtagagaagcttcctcctccaccaaaatctgcacctgtcaagaacattggatcggtttcaatggtcacaggtctcgctcaattcatgattccggtatctctattcgctttccctgcaatgtgggatgtgatctcaaggatgtggtag

SEQ ID NO: 1866 - DNA, 2181 bp, Arabidopsis thaliana
atgacggagatcgatcgttcacgcgcgttcgccaaagacgttaagcgtatcgtcgtcaaggttgggactgcagttgttactgggaaaggtggaagattggctcttggacgtttaggagctatctgtgaacagcttgcggagttaaactcagatggatttgaggtcattttggtgtcatctggtgccgttggtcttggtcgacaaaggcttcgatacagacaattagtcaacagcagttttgcagatttacagaagccacaaatggaacttgatgggaaggcttgtgctggtgttgggcagagcagtctcatggcttactatgagactatgtttgaccagttggatgtgacggttgctcaaatgcttgtgaccgatagcagttttagagataaggatttcaggaagcaacttagtgaaactgtcaaagcgatgctgaggatgagggttattccagttttcaatgagaatgatgctataagcactcgcagagccccctacaaggattctactggtatattttgggataatgacagcttagccgctcttctgtcgctagagctgaaagctgatcttttgattcttctaagtgatgttgagggcctttacactggccctccaagtgattctacctcaaaattaatacacacattcattaaagaaaaacaccaggacgagattacttttggcgaaaagtccaaattaggacgagggggtatgactgcaaaagttaaagctgctgttaatgcagcttatggtggcgttcctgttatcataaccagtggatatgcagctgagaatataagtaaagtccttagaggactgcgtgttggtaccctgttccatcaagatgctcatttatgggctccggtcgtagatactacttctcgtgacatggcagttgctgcaagggaaagctcaagaaagcttcaggccttatcttcagaagataggaaacaaattctacacgacattgccaatgcccttgaagtaaatgagaaaacaattaaagctgagaatgatttagatgttgctgcagcacaagaagctggatatgaagagtctttggtagctcgcttagttatgaagcctgggaagatctcaagccttgcagcttccgttcgccagctagccgaaatggaagatccaataggccgtgtattaaagaaaactcaggttgcagatgatcttattttagagaagacctcatcaccaataggtgttcttctgattgtttttgaatcccggcctgatgcacttgttcaggtatcttcgcttgcaatccggagtggaaatggtcttctgctgaagggtggaaaggaggctcgtcgatcaaatgctatcttacacaaggtgatcactgatgcaattccggagactgttggaggtaaactcataggacttgtgacctcaagagaggagattcctgatttgctcaagcttgatgacgttattgatcttgtgatcccaagaggcagcaacaagcttgtttctcaaataaaaaactcgacgaaaatcccagtgctaggccatgctgatggaatctgtcatgtatatgttgataagtctggtaaactggacatggcaaagcgcattgtttccgatgcaaagttggactatccagcagcctgtaatgcgatggaaacccttcttgtacataaagatttggagcagaatggttttctcgatgatcttatttatgttctgcaaaccaaaggcgtcactttgtatggtgggccaagagcaagtgcaaaactgaatattccggaaacaaaatcatttcaccacgagtacagttccaaggcctgcaccgttgaaattgtagaagacgtatatggtgctatagatcatattcaccaacatggaagtgcacacactgattgcatagtgacggaagatagtgaagtagcagaaatattcctccgccaagtggacagtgctgctgttttccacaatgcaagcacaagattctctgatggttttaggttcggacttggtgctgaggtgggaataagcacaagcaggattcatgcccgtggtccagttggagttgaaggattattgacaacaagatggataatgagaggaaagggacaagttgtggatggagacaatggaatcgtttacacccataaggatcttcctgtcttacaaaggacagaggctgttgagaatggaatttag

SEQ ID NO: 1867 - DNA, 666 bp, Arabidopsis thaliana
atgggacgaagacctgcgagatgttaccgtcaaattaagggaaagccataccctaaatcaagatactgtcgtggtgttcccgatcctaagatcaggatttacgatgttggtatgaagaggaaaggagttgatgagttcccttactgtgttcatttggtttcatgggagaaagagaatgtttcaagtgaagctcttgaagctgctcgtattgcttgtaacaagtacatggtgaagtctgccgggaaagatgcgtttcatctccgtattagagttcatcctttccatgttcttaggatcaataagatgctttcttgtgctggagctgatagacttcagactggtatgagaggtgcttttggcaaagctcttggtacttgtgctagagttgctattggacaggttcttttgtctgtgaggtgcaaagatgctcatggtcatcatgctcaggaggctcttcgtcgtgctaagtttaagttccctggtcgtcaaaagatcattgttagcaggaaatgggggttcaccaagtttaaccgtgctgattacacaaagctaaggcaagagaagaggattgtccctgatggtgtaaatgccaagttcctatcttgccatggtccgttggctaaccgtcagcccggaagtgcgttcttgtcagctggtgcacagtga

SEQ ID NO: 1868 - DNA, 1542 bp, Arabidopsis thaliana
atggaagctctaaactctatcttaaccggctacgccgtggcagccctatcagtctacgctctttggttctacttcctgtcccgaagactaaccggtcccaaagtcttaccgttcgtaggaagcttaccgtatctaatcgctaaccggagccgaattcacgattggatcgctgataatctccgagcaactggtggtacgtatcaaacatgcaccatggtgatacctttcgtagccaaggcgcaagggttttacactgtgacgtgtcacccaaaaaacgtcgagcatatccttaagacacggttcgacaactatccgaaaggtccgatgtggcgcgctgctttccacgacctgttaggacaaggaatcttcaacagcgacggtgacacgtggctcatgcaacgtaagactgcagcgcttgagttcacaactagaactcttagacaagccatggctcggtgggttaacgggactatcaagaaccggttatggcttatattagaccgtgcggttcaaaacaacaaaccggttgatcttcaagatttgtttttgaggttaacttttgacaacatttgtggtctgacttttggtaaagacccggagacgctctctctggatctaccggataatcccttctctgtcgcttttgacaccgcgacagaggctactctaaagagacttctctacaccggtttcttgtggaggattcagaaagctatggggattggatcagaagataagctcaagaagagtcttgaagtcgttgagacttacatgaacgatgcaatcgacgctcggaaaaactctccctccgatgatcttttgtcacgtttcttgaagaaacgtgacgttaacggtaacgttcttccaacagatgttcttcagcgtatcgcgcttaactttgttctcgcgggccgtgacacttcttcggtggccttgagctggttcttctggctcgtcatgaataaccgggaggtggaaacgaagatcgttaacgagttgtcgatggttctgaaggagacacgtggcaatgatcaggagaaatggacggaggagccgttagagttcgacgaggcagataggctcgtttacctcaaggctgctttggctgaaacgctgcgtttatacccttctgtgcctcaggatttcaaatacgtcgtagacgatgacgttttgccggacgggactttcgtgccaagaggctcgacggtgacctactcgatttactcgatcggacgtatgaaaacaatttggggcgaagattgtctcgagttccgtccggaacggtggctgacagccgacggtgaacggtttgagactcccaaagatggttacaagttcgtagcgttcaacgccggaccaaggacttgcttgggaaaggacttggcttataatcagatgaagtcggtggcttcagccgttctcctccgttaccgggtttttccggttcccggtcaccgcgttgagcaaaagatgtcgctgacgcttttcatgaagaacggtttacgtgtttatttgcaacctcgtggtgaggtgcttgcatga

SEQ ID NO: 1869 - DNA, 1338 bp, Arabidopsis thaliana
atggcgagcaacggagttaccaactgtaacgcaaacgccaatgtttggcggttcaaaggaaacggtgcaacgagtgatgcggcggcggtgacgttgagaaagcttgcttttgggatgtttaaaaactgcaccatgaacagtggaaagaccattttgttcccaactcccggcgagccctccgcccattccaacttcaggacttgcccggaagccgaggaagccgttgccgcagctgcacgctccggcatggctaactcttacgcacccagccctggagttttcaaggctagaagggcggtggctgaatatttaaacggagaacttccgacgaagctgaaggccgaggatgtgtatatcaccggaggatgtaaccaagccatagagatcgtgatagattctcttgccggaaatccatccgccaacattctacttccaaggccgggatatcctcactacgatgctcgtgctgtctatagcggcctcgagattcgcaaatacgatcttctccccgagagtgattgggaaatcaatctcgatggcctcgaggcggctgcggatgagaataccgtcgcaatggtaatcatcaaccccaacaatccatgtggaaacgtctacacctacgaccatctcaacaaggtcgcggagatggctagaaaactcggtataatgataatatccgacgaagtatatgatcatgttgtatatggagacaagccttttattcccatggggaagtttgcatcaatagctccggtgatcacgctcggatccatatccaaaggatgggtcaacccaggctggagagttggctggatcgccatgaacgatcctaatggtatctttgtatctacaggggtagttcaagcaatagaggattttcttgatttaactccacagccttcatttattctccaggaagcacttcctgatatattggagaaaacacctaaagagttcttcgagaagaagatcaaagccatgagacgcaacgtcgagctttcatgtgagaggctcaaggatattccttgtctcttttgtcccaagaaacccgaatcttgttcttatttatggttgaagcttgacacatcaatgttgaataatatcaaaaatgattttgatttctgcacgaagctagttagtgaggagagtcttatccttataccaggagtggctctaggggcagagaattgggtgaggatatcgataggaaccgacgaatcagtggtacaagaaatatttgacagactaaaaggtttctatgatcgtcatgccatctccaaggaagctatcaaactcagtggccatgccattaaccagatcgtcgtctctgtcaactga

SEQ ID NO: 1870 - DNA, 357 bp, Arabidopsis thaliana
atggcacaagttcaagtagaagcaaagatctgctgcccttccaaccaagctagaaatggctatagtgtatgccgtataaggttttccaagggaaggtgtatgcaagtgagtggatgccaaaactctgatacatgccctcgaggttgggtaaacgccattctcgaaaactcagctgatgctaccaatgagcactgcaagttagggtgtgaaacttctgtgtgtggtgccatgaacactctccagaactctgatgcaagtgaaattgtgaatggagcgtcggaacaatgtgccaagggatgttctattttctgtaccaagagctatgtagtcccacctgggccgcctaaactgttgtaa

SEQ ID NO: 1871 - DNA, 693 bp, Arabidopsis thaliana
atgaagattcttctagcatcattgtgtttgatcagtcttctcgtaatcttgccttctgtcttctctgcttcttcttcctctgaagattttgatttcttctacttcgtccaacaatggccaggatcatactgtgacacacagaagaagtgttgttatccaaattcaggcaaaccagctgctgattttggcattcatggtctttggcctaactacaaagatggaacttatccatctaactgtgatgcctctaaaccattcgatagctcaacgatatcagatcttctcacttcaatgaagaagagctggccaacactggcttgcccaagcggttcaggtgaagcgttttgggagcacgaatgggagaagcatggtacttgctctgaatcggttatcgatcaacatgaatatttccaaaccgctcttaaccttaaacagaaaaccaatctccttggagctctaaccaaagccgggattaatccggatggaaaatcttactctttggagagcataagagattcgataaaagagtcaattggtttcactccttgggttgagtgtaacagagatggttctggtaatagccaattgtaccaagtctatctttgtgttgaccggtctggttccggtttaatcgaatgtccggttttcccacatgggaaatgtggagctgagatcgaattcccttctttttag

SEQ ID NO: 1872 - DNA, 1299 bp, Arabidopsis thaliana
atgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgaatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatttgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttga

SEQ ID NO: 1873 - DNA, 777 bp, Arabidopsis thaliana
atgggaagagggaaagttgagctgaagaggatagagaacaagatcaatagacaagttacttttgcaaagagaagaaatggtttgctcaagaaggcttatgagctttctgtcctttgtgatgctgagattgctcttctcattttctctaaccgtggcaagctctacgaattctgcagcagccctagtggtatggcgaggacggttgataagtatagaaaacatagttatgcaacaatggatccaaatcaatcagctaaagacttgcaggataagtatcaagactacttgaagcttaaatcaagagttgagatccttcaacattcacaaaggcatttgctaggtgaagagctatccgagatggatgtgaatgagcttgagcatctcgaacgccaagtagatgcatcactaagacaaataagatctaccaaggctcggtctatgcttgatcaactatctgacctcaaaactaaggaggaaatgttattggaaaccaatagagatcttaggagaaagttggaggacagtgatgcagcacttactcaatcgttttggggaagttctgctgcagaacaacaacaacaacatcaacaacagcaacaaggcatgagctcttatcaatcaaaccctccaattcaggaagcaggtttcttcaagcctctacaaggcaatgtagcattgcaaatgagcagtcattacaatcacaatcctgcaaatgcaaccaactctgcaacaacatcacagaatgttaatggattcttccctggatggatggtctga

SEQ ID NO: 1874 - DNA, 1239 bp, Arabidopsis thaliana
atgtatcctctccaatccttggccagaagcaagagattgtttccgattcgaaccagatcaaaaccggtttgtttagcactgaccaatgctcaaacaaacggtggtgaccaagaggagaaagtagtgattgttggcgccgggattggcggacttgccactgccgtttcacttcacaggcttggaatccggtcggtggtgttggagcaggcagagtcgcttcgtactggtggaacatcactgacgctattcaagaatgggtggcgcgttcttgacgccatttccgtcgggcctcaactccgaacgcagtttcttgaaatcgaaggccaagaagttcgggccgtggagaggcgagtactcttggaaacacttgcaagccagcttcctccacaaaccattcggttttcctcaaaactggaaagtatacaaagcaatgccaatggtgacactctccttcaacttggagatggaacccggttgcttgcacagattgttattggttgtgacggtatccggtctaaggttgcaacttggatggggttcagtgagccgaaatatgttggccattgcgcttaccgtggtcttgggttctatccaaatggacagccatttcagaaaaaggtgaactacatatacggtaaagggattagagctggatatgtacctgtatctacaacaaaagtctactggttcatctgtttcaacagcccatctctaggtaggcccaaaattacggatccagcgatcctaaaaaaacaagccaaagaactggttagtacatggccagaagatctgcaaaacctcatcgatttaacacctgatgaaactatcagcagaactcctctagtagaccggtggctatggcctggcattgctcctccagcatcaaaaggacgagtggttcttgttggagatgcttggcacccaatgactccaaatcttggacaaggtgcttgttgtgccttggaagattcagtagttctggcaaataaacttgccaatgcaataaatggaggaaccgaatcaattgaagtagcaatggaatcatacgggagtgagagatggtctcgagcattcccgttgacagtacgtgcaaacctagttggcgcacttctgcaatgggagaatcctctagtgtgttccattagaaacaatattgtcataccaaagttactgaggcttggaccaatgcttgaacacacaaactttgagtgtgaacctctctttgtttctaaaagctga

SEQ ID NO: 1875 - DNA, 708 bp, Arabidopsis thaliana
atggacgcttcaatagtttcctcatccactgcttttccatatcaagattctctaaaccagagcatcgaagacgaagaaagagacgttcataattctagtcacgaactcaatctcatcgactgcatagacgacacaacgagtatcgttaacgaatctacaacatccacagaacaaaagcttttctcatgcaactattgtcaaagaactttctatagctcacaagcacttggtggtcaccaaaacgcacacaagagagagagaacgttggcgaagagaggacaacgtatggcagcgtcagcctcagcttttggacatccttacggtttctctccacttcctttccacggacagtacaacaaccataggtctttagggatccaagcgcattcgataagccacaagctaagttcttataacgggtttggtggtcactatggtcagatcaactggtcaagacttccatttgatcaacaaccagccataggtaaatttccctcaatggataattttcatcatcatcatcatcagatgatgatgatggctccttcagtaaattcacggtccaataacatcgatagcccaagcaacacaggacgggttctagaagggtcaccgactcttgaacaatggcacggagacaaaggattgttgttaagtacaagtcatcatgaagagcagcagaaacttgacttgtccctcaagctttga

SEQ ID NO: 1876 - DNA, 1302 bp, Arabidopsis thaliana
atggcgataattccgttagcacagcttaatgagctaacgatttcttcatcttcttcttcgtttcttaccaaatcgatatcttctcattcgttgcatagtagctgcatttgcgcaagttctagaatcagtcaattccgtggcggcttctctaaacgaagaagcgattcaacaaggtctaagtcgatgcgattgaggtgttccttctctccgatggaatctgcgagaattaaggtgattggtgtcggtggtggtggtaacaatgccgttaaccggatgatttcaagcggtttacagagtgttgatttctatgcgataaacacggattcgcaagctctgttacagtcttctgctgagaacccacttcaaattggagaacttttaactcgtgggcttggcactggtggaaacccgcttcttggagaacaagctgcagaagaatcaaaagatgcaattgctaatgctcttaaaggatcagaccttgttttcataactgctggtatgggtggtggaacagggtctggtgctgcacctgtggtagctcagatttcgaaggatgctggttatttgactgttggtgttgttacctatccgtttagctttgaaggacgtaaaagatctttgcaggcactggaagctattgaaaagctccaaaagaatgttgatacccttatcgtgattccaaatgatcgtctgctagatattgctgatgaacagacgccacttcaggacgcgtttcttcttgcagatgatgttttacgccaaggagtacaaggaatctcagatattattactatacctggactagtcaatgtagattttgcagatgtgaaggcagtcatgaaagattctggaactgcaatgctcggggtaggtgtttcttccagcaaaaaccgggcagaagaagcagctgaacaagcaactttggctccattgatcggatcatccatacaatcagctactggtgtcgtctacaacatcactggtggaaaagacataactttgcaggaagtgaaccgagtatcacaggtcgtgacaagtttggcagacccatcggccaacatcatatttggagctgttgtggatgatcgctacaccggagagattcatgtaacgataatcgccacaggcttctctcagtcattccagaagacacttctgactgatccaagagcagctaaactccttgacaaaatgggatcatcaggtcaacaagagaacaaaggaatgtctctgcctcaccagaagcagtctccatcaactatctctaccaaatcgtcttctccccgtagacttttcttctag

SEQ ID NO: 1877 - DNA, 1242 bp, Arabidopsis thaliana
atgggattacctcaaaataagctcagttttttctgcttcttcttcctcgtctctgtactaactcttgccccattggctttctccgagatcttcttagaggagcatttcgaaggtggatggaaaagtaggtgggtcttgtctgattggaaaagaaacgaaggcaaagctggaacctttaagcacactgccggtaaatggcccggcgatcctgacaataaaggtattcagacttataatgatgccaagcattatgcgatttctgcaaagattcctgagtttagcaacaaaaaccggactcttgttgtccagtactcagtcaagattgaacaagacattgaatgtggtggtgcttacattaagctcctgtctggctatgttaaccagaagcagtttggtggtgatactccatacagtctaatgtttggaccagatatatgcggaacacagacgaagaagcttcatgttatagtttcatatcagggacagaattatccaatcaaaaaggatttgcaatgtgaaacagacaaattaaatcatttctacacatttattctgcgtcctgacgcttcttacagcgttctggtggataataaagagagagaatttggcagtatgtacacagactgggacatccttcctccaaggaagatcaaggtcaagaatgcaaagaagccagaggactgggatgatagagagtacatcgatgaccccaacgatgtcaaacccgagggttttgattctattccacgtgaaattccagatcgtaaagctaaagagcccgaggactgggacgaggaagaaaatggtctctgggaacctccaaagatcccaaattctgcgtacaaagaatttgaagatgatccagatctttacgttctgaagtctatcaaatatgcaggcattgaagtatggcaggtgaaggctggctcaatctttgacaatatattgatctgcgatgacccggcatatgcaagaagcatcgtggatgactattttgcccaacacagggagtctgagaaggagttatttgcggaagcagagaaagaaagaaaagctagagaagatgaggaagctcggatagcacgggaagaaggtgaacgcaggcggaaagaaagggaccaccggtatggagacaggaggaggcgttacaaacggccgaatccacgtgattatatggatgattaccatgtaagtgttccttctatctcaaccactttaaaaagaatggtttatgcagtttag

SEQ ID NO: 1878 - DNA, 1293 bp, Arabidopsis thaliana
atggcggctacgacgaactctttccttgtcggaagcaacaacactcagattcctgctttgaaacccaaatcatcatctcaatcctttcttcacctcagcaaaccaaacaccgtcaacttcgtcagcaaaaccaagcccgtcgctgttagatgcgtcgcttcaacgactcaagttcaagatggagttagatccggctccgtcggatcccaagaacgtgtcttcaacttcgcggcgggtccagccactttgcctgagaacgttctcctaaaagctcaggcggatctatacaactggcgtggatctggcatgagtgtgatggagatgagtcacagaggcaaagagtttctctcgattatacaaaaagctgaatcggatcttcgtcagcttctcgagattcctcaggaatattccgttttgttcttacaaggtggtgccactactcaattcgctgctttacctctcaatctctgcaaatcggatgatacagtcgatttcgttgttactggttcgtggggtgataaagctgtcaaggaagcgaagaagtattgcaagactaatgtgatttggtctgggaaatctgagaaatacacaaaggttccatcttttgaggagttggagcaaactccggacgctaagtatttgcatatatgcgccaatgagactattcatggagttgagtttaaagattaccctgttcctaaaaatgggttcttggttgctgatatgtcttctaacttctgttcgaaacctgttgatgtatctaagtttggtgtgatttacggtggtgcacagaagaacgttggtccatctggtgtcacaattgtgatcattcgtaaagatttgattgggaatgctcaagatattactcctgtgatgcttgattacaagattcatgatgagaatagttcgttgtacaacacgcctccttgctttgggatttacatgtgtggtcttgtgtttgaagatctgttggagcaaggtggattgaaagaagtggagaagaagaaccagaggaaagctgatttgctttacaatgctattgaagaaagcaatggctttttcagatgtcctgttgagaaatcagtgaggtcgttgatgaatgtgcctttcacattggagaagtctgaattggaagctgagtttatcaaggaagctgctaaagagaagatggtgcagctcaaaggacatagatcagtgggaggtatgagagcttctatttacaatgcaatgcctttggctggtgttgaaaagcttgttgctttcatgaaagatttccaggctaagcatgcttag

SEQ ID NO: 1879 - DNA, 1176 bp, Arabidopsis thaliana
atgacggcggcacaagggaactctaacgagactctgttttcttcttacaagatgggaagattcgatctctctcatcgagtggttctggcgccgatgacgcggtgcagggcgttgaacggagtaccaaacgcggcgttggcagagtattatgctcaacggaccactcccggcggttttctcatctccgaaggcaccatggtctctcccggatccgcagggttcccacatgtgcctggaatctattcagatgaacaagtagaagcatggaagcaagttgtggaagcagttcacgctaagggaggtttcatcttttgtcaattatggcatgttggacgtgcttctcatgcagtgtatcaacctaatggaggatcaccaatatcgtcaacgaacaaaccaatctcggaaaacaggtggcgagttttgttgcccgatggttcccacgtgaagtacccgaaacctcgggctttagaagcttccgagatacctcgggtggtggaggattattgcctttctgctttgaatgcgattcgagctggtttcgatgggattgagatccacggggcgcatggttaccttattgatcagtttttgaaagatgggatcaatgaccgtactgaccaatacggaggatccattgcaaaccgttgtagattcttgaaacaagtagtggaaggtgtagtttcagccataggagctagtaaagttggtgtgagggtatctccggctatagatcacttggacgcaactgattctgacccactatcactcgggctagccgtggttggcatgctcaataagttacaaggtgttaatggctcaaagctcgcttaccttcacgttacacaacctcgctaccacgcctacgggcaaacagagtctggaaggcaagggagtgatgaggaagaagctaagctaatgaagagcttgaggatggcttataatggaacctttatgtctagtggaggattcaataaggaactaggtatgcaagctgttcaacaaggtgatgctgatttggtttcatatggcagactgtttatcgcaaacccggatttggtttcgcggttcaagattgatggagagttgaataaatataatcggaagacgttttacactcaagatccagttgttggctacacggattatcctttcttggctcctttttcccgcctctga

SEQ ID NO: 1880 - DNA, 963 bp, Arabidopsis thaliana
atggaaggaagagtcaacgctctgtcaaacataaacgatctcgaacttcacaatttcttggtcgatccaaacttcgatcagttcataaacctcataagaggagatcatcaaaccattgacgaaaacccagttcttgatttcgatcttggtccattacaaaacagcccctgtttcatagacgagaaccagttcatcccaacacctgtcgatgacctcttcgacgaattgcctgacttagactccaacgttgctgaatcattccgtagcttcgacggtgatagtgttagagccggtggtgaagaagatgaagaagattacaacgacggtgatgattcttcagccactactacgaataatgatgggacccgtaagacgaagactgatcggtctaggactttgatctctgagagaagaaggagagggcgtatgaaggataagctttatgcattgagatctcttgttcccaatattactaagatggataaagcatccattgttggagatgcagtgttgtatgttcaagaacttcagtcacaagcgaagaaactcaaatccgatatcgcgggtcttgaagcttctttaaactctactggagggtaccaagaacatgctcctgatgctcaaaagactcaaccttttcgcggtatcaatcctcctgcttccaaaaaaatcattcagatggatgttatacaagtggaggagaaagggttttatgtgagattggtgtgtaacaaaggagaaggtgttgctccatctctttacaagtctttggagtctcttacaagtttccaagtgcagaactctaacctaagctctccttctccggacacatacctcttaacatataccttagatgtaaatcaacttgtgcccttttactttgttttgtttccgagtataccgtttacttaccgagttttcttgtgtggtggaaacaggggacatgcttcgaacagagcttaa

SEQ ID NO: 1881 - DNA, 1764 bp, Arabidopsis thaliana
atggcaccaatcaaagaattcatatccaaattctcagatttcaaaaacaacaagaaactcattctctcctccgccgcaatagccttgctattattggcctccatagtcggaatcgccgccacaacaacaaaccaaaacaaaaaccaaaaaatcacaactctatcttcgacatcacacgccattctaaaatctgtttgcagctcaacactatacccggagctctgtttttccgccgtggcagccaccggaggaaaagagctgacgtcacagaaagaagtcatcgaagcgtcacttaacctaactaccaaagccgtgaaacacaactacttcgctgtcaagaagctgatcgcgaagagaaaaggtttgacaccgcgtgaggtcacggcgcttcacgactgtttggagacaatcgacgagacgttagatgagctccacgtggcggtggaggatcttcatcagtatcctaagcaaaaatctctgaggaaacatgccgatgatctcaaaacactaatcagctcagccattactaatcaagggacttgccttgacggtttctcttacgacgacgccgataggaaagttcgtaaggcgttattgaagggtcaggtacacgtggagcacatgtgtagcaacgcattagcaatgatcaagaacatgacagaaaccgacatagccaactttgagctaagagataagtcttcaaccttcaccaacaacaacaaccgcaagctcaaggaggttaccggcgacttagacagtgatggatggccaaagtggttatccgttggagacagaaggcttcttcaagggtcaacaattaaagcagacgctacggtggcggatgacggaagcggtgactttacaacggtagccgcggctgtggctgcggcgccagagaagagtaacaagaggtttgtgatacatataaaggcaggagtttatagagagaatgtggaagtgacgaagaagaagacgaatataatgttcttgggagatggccgtggcaaaactattatcactggaagtagaaatgtcgtcgatggaagcaccactttccactccgctactgttgctgccgtcggcgagaggtttctagcgcgtgacatcacattccaaaacaccgccggtccgtcgaagcatcaagcggtggctctccgagtcggatcagatttttccgctttttaccaatgcgacatgtttgcttatcaagacacactttatgtccactcaaatcgtcaattctttgtgaaatgtcacataaccggaaccgtcgatttcatcttcggaaacgcagccgcggttttacaagactgcgatataaatgcacgcagaccaaattccggtcagaaaaacatggttaccgcccaaggacggtctgatccgaatcaaaacacggggattgtgatccagaattgtcgtattggtggcacgtcggatcttttggccgtgaaaggaacgttcccgacgtatcttggtcgtccttggaaggaatattcacggacggtgataatgcaatcggatatatccgacgtgatccgacccgaaggatggcatgagtggagcgggagttttgcgttggacactctaacttatagagagtatttgaatagaggaggaggggcaggaactgcaaatagagtgaagtggaagggctataaggtaattacaagtgatacagaagctcagccatttacggctggtcagtttattggtggtggaggctggttagcgtcgaccggttttcctttctcgttaagtctttga

SEQ ID NO: 1882 - DNA, 1167 bp, Arabidopsis thaliana
atgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactgtaggttcagcatatgccaagaaaactgtagagtccgctgagcaagctgagaaatcttctaagaggaagaggaagaatcaataccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaaccaaactctgatgagtcagacgatctgatggcataccttgacaacgccttgtgggacaccccactagaagtggaagccatgcttggcgcagatgctggtgctgtgactcaggaagaggaaaacccagattttgctgttgggggatggtacaagtcacacctcaagctctatgcattggtatctcatgagcctctcttccatagagagtttctcttttaa

SEQ ID NO: 1883 - DNA, 717 bp, Arabidopsis thaliana
atgtgtacgttagagaagcgcggcgatctctttctcctaaccctaaccggcgaagacgagcacagattccaccccgacacgatcgcctctgttctctcgcttcttgaacaagcaaagtctcaatccacaaaaggatccgtcctcatcactaccggtcacggaaagttcttctccaatggctttgacctcgcgtgggctcaatccgctggacacggtgctataaaacggatgcaccaaatggtcaaatcctttaaaccggtgttagccgccctcctcgatcttccaatgccgacgatcgccgccttgaacggccacgcggcagcctcggggctgatgtttgcgctgagccacgactacgttttcatgaggaaagaccgtggggttctatatatgagcgaggtggacatcgggctaccggtgccggactacttctcggcgttggtcgtggctaaggttgggtcaggtatcgcgagaagggagctgttactgagcgggaagaagctcaaaggagaagaagcggtggctctcgggatcgtggactcagcggcgcatgatagtgcggaaggtgtggtggaggctacagtgagccttggagaaagtttggccgctaagaaatggaatggtgaggtgtatgcaaccattaggaagagtttgtatccggagctttgtcggatggttgatttaacggcaaataacttggccactcacaacctctag

SEQ ID NO: 1884 - DNA, 1863 bp, Arabidopsis thaliana
atgaagagagaaggagaagaagaagaagacaacaatcaactttcactgcaagaagaagaaccagatacagaggaagagatgtctgggaggacaatcgaaccgtggacgaagcagataacggtgagaggagtgttcgtgagcatagtgatcggagttgtgttcagtgtgattgctcagaagctaaatctcacgacaggaattgttccaaatctcaacagctctgcagctttacttgcttttgtctttgtccagacttggactaagattctcaagaaatcaggatttgttgcgaaaccattcacaagacaagagaacacaatgattcagacatctgctgttgcttgttacggcatcgctgtcggaggtgggtttgcttcatatcttctggggttaaaccataagacatatgtgttgtctggtgtgaacttggaaggtaactctccaaagagtgtgaaagaacctggccttggttggatgactgcttatctctttgttgtctgtttcatcggtctttttgtcctaatccctctccgaaaggttatgattgttgaccttaaattaacatatccgagtggtttagctactgcggttctcatcaatggcttccacacacaaggagatgcacaggccaagttcttctttgatttcagcatgacatttgtgggagcaggaatgatttgttcacatttggttaacctttctttgcttttaggagctatcctctcttatggcttaatgtggcctcttcttgataaacttaagggctcttggttccctgataatctcgacgaacacaacatgaagagcatttacggctacaaagtcttcttatccgtagctctaatcctcggcgacggtctttacactttcgttaagatcctctttgtgaccattgccaatgtcaacgcaagattgaagaacaaacctaatgatctagatgacgtaggtcacaagaaacaacggaaagatctcaaggaagatgagaatttcctcagagataaaatcccaatgtggttcgcagtttccggatatcttacattcgctgcggtctcaaccgtcgtggttcctctgatatttcctcagctcaaatggtattacgttattgtagcttacattttcgcgccttctctggccttctgtaacgcttatggagctggacttacagacattaacatggcttataactacggcaaaattggtctttttgtcatcgcggctgtgacgggaagagagaacggagttgtagccggactcgccggttgtggactgatcaaatccgttgtttcggtttcttgtattttgatgcaagatttcaagacggctcattacacgatgacgtcacctaaggctatgtttgctagccaaatgattggaacggtcgttggatgcatcgtgacgccgttaagtttctttttgttctacaaagcgttcgacattggaaaccctaacggagaattcaaggctccttacgctttgatttacagaaatatggcgattcttggggtgcaaggcttctctgctctgcctcttcactgtctccaaatgtgttacgggtttttcgggtttgctgttttggtcaacgtcgtcagagatcttactccggcgaagattggaagattcatgccacttccgacggcgatggctgttccgtttcttgtcggagcttatttcgcaatcgacatgtgtgttgggactttgattgtgtttgtttgggagaagatgaatcggaagaaagcagagtttatggttccggcggtggcttcagggctaatctgtggcgaagggctttggactttacctgcggcggtgcttgccctcgccggagtaaaacctccgatatgtatgaagttcttagcttcatag

SEQ ID NO: 1885 - DNA, 882 bp, Arabidopsis thaliana
atgggtcgtctttcatcaactctctgcctcacgtttctgattttggccacagttgcatttggtgtacctcctaaaaagtccattaatgttccatttgggaggaactacttccccacttgggcttttgatcacattaagtatctcaatggtggttctgaagtgcatcttgtcctcgacaagtacactggcactggctttcagtccaaaggttcctacttgtttggccacttcagtatgcacataaagatggttgctggtgactctgctggaactgtgaccgccttctatttgtcgtcccagaactcagaacatgatgagatagactttgagtttctagggaacagaactggccagccttacattttgcagactaacgtgtttacaggaggcgccggaaaccgtgagcaacgaatcaacctctggtttgatccttccaaggactatcattcctattcagttctctggaacatgtatcagattgtgttctttgtggatgatgtgccgatacgagtgttcaagaatagcaaagacgttggggtgaagtttccattcaaccaaccaatgaagatatattcgagtctgtggaatgcagacgactgggccacaaggggagggttggagaagaccaactgggaaaaagctccttttgtcgcgtcctacagaggcttccacgtcgatggatgtgaagcttcagtaaatgctaagttctgcgagacgcagggaaaacgttggtgggatcagaaagagttccaggacttggacgctaaccagtacaagcgtctcaaatgggttcgtaagagatacaccatctacaactattgcactgaccgcgtccgatttcccgtacctcctccagagtgccgcagagaccgcgacatatag

SEQ ID NO: 1886 - DNA, 750 bp, Arabidopsis thaliana
atggccttagatcaatcttttgaagatgctgctttacttggagaactctatggagaaggtgcattttgtttcaagagcaagaaacctgaacccattacagtctcggttccttctgatgatactgatgattcgaattttgactgcaatatttgcttagactcggtgcaagaacctgttgtgactctctgtggtcacctcttttgctggccttgtattcacaaatggcttgatgtacagagcttctcaacaagtgatgaataccaaagacatagacagtgtcctgtttgtaaatctaaagtttctcattctactttggttcctttgtatggtagaggccgttgtactactcaggaggaaggtaaaaacagtgtgcctaaaagacccgtaggaccggtttatcggcttgaaatgccgaattcaccttatgcaagtactgatctgcggttatcacaacgggttcatttcaatagcccacaggaaggttactaccctgtctcaggggtgatgagctcgaacagtttatcatactctgctgttttggatccggtgatggtgatggttggagaaatggtagctacgaggttgtttggaacacgagtgatggatagatttgcgtatccggacacttacaatctcgcagggactagcgggccgaggatgagaaggcggataatgcaggcagataaatcgctgggaagaatcttcttcttctttatgtgttgtgttgttctgtgtcttctcttgttttag

SEQ ID NO: 1887 - DNA, 1497 bp, Arabidopsis thaliana
atgtcaggagcaataacatgctctgcggccgatctcgccaccctacttggccccaacgccacggcggcggccgactacatttgcggccaattaggcaccgttaacaacaagttcaccgatgcagccttcgccatagacaacacctacctcctcttctctgcctaccttgtcttcgccatgcagctcggcttcgctatgctttgtgctggttctgttagagccaagaatacgatgaacatcatgcttaccaatgtccttgacgctgcagccggaggactcttctactatctctttggttacgcctttgcctttggaggatcctccgaagggttcattggaagacacaactttgctcttagagactttccgactcccacagctgattactctttcttcctctaccaatgggcgttcgcaatcgcggccgctggaatcacaagtggttcgatcgcagagaggactcagttcgtggcttacttgatatactcttctttcttaaccggatttgtttacccggttgtctctcactggttttggtccccggatggatgggccagtccctttcgttcagcggatgatcgtttgtttagcaccggagccattgactttgctggctccggtgttgttcacatggttggtggcatagcaggtttatggggtgctcttattgaaggtcctcgtcgtggtcggttcgagaaaggtggtcgcgctattgctctgcgcggccactctgcctcgctagtagtcttaggaaccttcctcctatggtttggatggtatggtttcaaccccggttccttcactaagatactcgttccgtataattctggttccaactacggccaatggagcggaatcggccgtacagcggttaacaccacactctcaggatgcacagcagctctaaccacactctttggtaaacgtctcctatcaggccactggaacgtaacggacgtttgcaacgggttactcggtgggtttgcggccataaccgcaggttgctccgtcgtagagccatgggcagcgattgtgtgcggcttcatggcttctgtcgtccttatcggatgcaacaagctcgcggagcttgtacaatatgatgatccactcgaggcagcccaactacatggagggtgtggcgcgtgggggttgatattcgtaggattgtttgccaaagagaagtatctaaacgaggtttatggcgccaccccgggaaggccatatggactatttatgggcggaggagggaagctgttgggagcacaattggttcaaatacttgtgattgtaggatgggttagtgccacaatgggaacactcttcttcatcctcaaaaggctcaatctgcttaggatctcggagcagcatgaaatgcaagggatggatatgacacgtcacggtggctttgcttatatctaccatgataatgatgatgagtctcatagagtggatcctggatctcctttccctcgatcagctactcctcctcgcgtttaa

SEQ ID NO: 1888 - DNA, 1419 bp, Arabidopsis thaliana
atgacggcgaagcgtgggattggacggcacgaatctcttgctgacaagatccaacgccatcgtgggattatacttgtgatttcggttcccattgtgttgatcggtctcgttcttctgctaatgcctgggagatcgatttctgattccgtcgttgaagagtattctgtgcataatcgcaaaggaggtcctaattcgagaggtccgaagaattacgctgtgatttttgatgctggaagttctggtagccgtgtacatgtttactgttttgatcagaatttggatcttattcctcttgggaatgaacttgagctcttcttacagctaaaaccagggttgagcgcatatcctactgatccccgacaagcagcaaactctttggtgtctcttcttgacaaagcagaagcttctgttccccgtgagctgcgtccaaagacacatgtcagagttggggctactgcaggtttgaggacgctgggtcatgatgcatctgagaacattttgcaagcggttagggaactcctgagagatagaagcatgctgaaaactgaggcaaatgctgttactgtactggatggtacccaggaaggttcttatcagtgggtaacaattaactacttgctaaggaacttgggaaaaccatactcagatacggtaggagtggttgatcttggaggggggtctgttcaaatggcatatgctatatctgaggaagatgctgcaagtgcaccaaaaccattagaaggagaggattcatatgtcagagagatgtatctgaagggacggaagtatttcctctatgttcacagttacctacattacggattactggccgctcgagcagagattttgaaagtttctgaagattcagagaacccctgcatcgtggcaggctatgatggtatgtacaagtatggaggaaaagaatttaaagcccctgcttcacaatcgggtgcgagtcttgacgagtgccgaaggataaccatcaacgcactaaaagtgaatgatacactgtgtacacacatgaaatgcacattcggaggagtctggaatggtggtcgaggtggtggtcaaaagaatatgtttgttgcttcttttttcttcgatcgtgctgctgaggctggattcgttgacccgaagcaacctgttgctacagttcgtcccatggactttgagaaagcagcaaagaaagcttgtagtatgaagctggaagagggaaaatcaacgttcccacttgtggaggaagagaatttgccttacttgtgcatggatctcgtttaccaatatactctgctcattgatggattcggattggagccatcacagacaataacgttagtgaagaaggtcaaatacggagaccaagccgtggaagctgcgtggccattgggtagcgccatcgaggccgtatcctcaccgtga

SEQ ID NO: 1889 - DNA, 1470 bp, Arabidopsis thaliana
atggacagagtggtggcaaaaatagcaaaaatccgttcgcagcttactaaattacgttcactattcttcctttacttcatctacttcttgttcttctcctttttagggtttttggcactcaagatcacaaagccaagaaccacttcacgtcctcatgactttgaccttttcttcacttctgtctctgccatcaccgtctcttccatgtctaccgtcgacatggaagtcttctccaacacccaacttatcttcctcactatcctcatgttcctcggtggcgaaatcttcacctcctttctcaacctctacgtctcctatttcaccaagttcgtcttccctcataacaagattagacatattttgggatcttataattcggacagttccatcgaggatcgctgtgacgttgagactgttactgattatcgcgagggtcttatcaagatcgatgaaagggcatctaagtgcttgtactcggtggttcttagttaccatcttgttactaacctagttggctctgtgttgcttcttgtgtacgtaaattttgttaaaacggcgagagatgttcttagttccaaagaaatctcacctctcactttctccgtcttcacaactgtttccacgtttgcaaactgcggatttgtccccacgaatgagaacatgatcatctttcgcaagaactctggtctcatctggctcctaatccctcaagtactgatgggaaacactttgttcccttgcttcttggttttgctcatatggggactttataagatcacaaagcgtgacgagtatggttacattctcaagaaccacaataagatgggatactctcatctactctcggttcgtctatgtgttcttcttggagtgacggtgctagggtttctgataatacagcttcttttcttctgcgcctttgaatggacctctgagtctctagaaggaatgagttcgtacgagaagttggttggatcgttgtttcaagtggtgaattcgcgacacaccggagaaactatagtagacctctctacactttccccagctatcttggtactctttattcttatgatgtatcttcctccatacactttatttatgccgttgacggaacaaaagacgatagagaaagaaggaggagatgatgattccgaaaatggaaagaaagttaaaaagagtggactcatcgtgtcacaactttcctttttgacgatatgtatctttctcatttcaatcaccgaaaggcaaaatctacaacgtgatccgataaatttcaacgtccttaacatcactctcgaagttatcagaattatcaacaaaataagttttgtaatggcagtgcatatggaaacgttggtttcactaccgggtacagctgtgaacggcgtgtggacatcagcgatggtggctgcaaagacgcgagttatgggtttgcaggacgatggagtccaatgggaaaattcgtactaa

SEQ ID NO: 1890 - DNA, 5451 bp, Arabidopsis thaliana
atgttgctgttgatagccgtcaggacacgggttgacaccacaattcacccggctcactcgaacatagacaaagatacagtcgtcgaagtgggcaaaggcaactctcctagttttccagaagttttgaagcttttgcttgctgagggggattttttagcttttgcacctgacactgatgaaactaataacatgatcgacattttgtctcttaagtttccggaactgcggctagttactaaaatttttaaagatgacatagagctggaaacttatataacatctgcgcattatggtgtctgtagcgaagtgaggaattgttcgaatccaaaaataaaaggagcagtggtattccatgaacaaggacctcatttgtttgattatagcatccgcttgaaccacacatgggcattcgcaggattcccaaatgtcaagtcgatcatggacacaaatggaccttatatcaatgatctcgaaatggggattaataccataccaacaatgcaatacagctttagcggattcttgactctccagcaggtggtagactctttcattatatttgcttctcagcaaaataacgacttgccattatcacattcaaatcttagttcagctctacgctttgagctgccatggacactgtttagcccctcagtgataagaatggttccatttccaacccgtgaatacactgatgatgagtttcaatctattgtcaaaagcgtaatgggattgtttctctttaagtatagtgataagaccttagtcttcacatacttctttttatttgggctcagcgcaatcatgctctcatttatgatatcaacattttttactcgagcaaagacagctgtggcagttgggacccttacctttctcggagcctttttcccttactacactgtaaacgatgaatctgtctccatggtattgaaggtagtggcttctttgctttcgcctactgcatttgctcttgggtcaatcaactttgctgattatgagcgtgcacatgttggacttcgttggagcaatatatggcgggcatcttctggagtaagcttttttgtctgcctcttaatgatgttgctcgactctattctttactgcgcacttggactttatctggacaaggtcctccccagggaaaatggtgtgcggtacccatggaacttcatcttcagcaagtattttgggaggaagaaaaacaacttacaaaatcgcattccaggttttgaaactgatatgtttccagcggatatagaggttaatcagggagagccttttgatcctgtttttgaatcaataagcctggaaatgaggcaacaagagcttgatggaaggtgcatacaagttagaaatctgcataaggtctatgcctcaagaaggggaaattgttgtgcagttaattcattgcaacttacattatacgagaaccagatactttcacttctgggacataatggagctggtaaaagcacaacaatatcaatgcttgttggccttcttcccccaacgtctggagatgccctgatacttggaaacagtattataacaaacatggatgagatacggaaagaactaggtgtttgccctcagcatgacatcctctttccagaactgacagttagagaacacttggagatgtttgcggttcttaaaggtgttgaagaaggttccttgaagagcacagttgttgatatggcggaggaagtgggattgtctgataaaattaatacacttgtacgggcactttctggagggatgaagaggaaattgtcacttggaatcgcattgataggtaacagtaaggtgatcattctcgatgaaccaaccagtggaatggatccttactcaatgcgtcttacatggcagttaattaagaaaattaaaaagggtagaataatattgttgacaacacattccatggatgaagctgaagaacttggagatcggataggaatcatggctaatgggtctcttaagtgttgtggcagttcgattttcctgaagcatcactatggggttggttacactcttacgctagttaagacttctccaactgtctctgttgccgcacatatagttcatcgtcacattccatcagcaacctgtgtgagtgaggtgggaaacgaaatttctttcaagcttccgttggcttccttgccttgtttcgaaaatatgttcagagaaatcgaaagttgcatgaagaattctgactcagattatcctggtattcagagttatggtatatctgtcacgacacttgaagaggtgtttctgagagttgctggctgtaacttagatatcgaggataagcaggaagatatatttgtttctcctgataccaagtcttctctggtatgcattggatctaatcagaaaagtagtatgcaacccaagttgctagcaagttgtaatgatggcgctggagttataattacctcagttgcaaaagctttcagattaattgttgctgcagtttggactctcattggatttattagcattcaatgttgtggttgttccattatctcaaggtcaatgttttggcggcattgcaaagcattgttcataaaaagagcgagatctgcttgcagagaccgcaaaacagtggcattccaattcatcatcccagcagttttcttgctttttggccttctttttcttcagctcaagccacatcctgatcaaaaatccataactttgacaactgcatattttaatcctctgctgagcggaaagggtggtggtggcccgattccttttgatctgtctgtgccaattgccaaagaggttgcacaatatatcgaaggaggctggattcagcccttgaggaatacttcatataaatttcctaatccaaaagaggcactggctgatgcaattgatgcagcaggtcccacgttggggcctactctactttcaatgagcgaatttctgatgtctagttttgatcagtcctaccagtcaagtcgtgaaggcttaagttctcatgattcatgtaaccatccagatgggagtttaggatacaccgtgttacacaacggtacttgtcagcatgctggtccaatctacatcaatgttatgcatgctgcgattctccgacttgctacgggtaacaagaatatgaccattcaaacccgaaaccatcctttgccccctacaaaaactcagcgcatacagcgtcatgatttggatgctttttccgctgcaattattgttaacattgcgttctcgttcatcccggcctcctttgctgttcccattgttaaggagcgggaggtgaaagcaaagcatcaacagcttattagtggggtttctgttctttcatactggttatcaacgtacgtatgggatttcatcagtttcttatttccgtcaacatttgcaataatccttttctacgcttttggtctggaacaatttatcggaataggtcggtttcttccgactgtccttatgctcctggagtatggcttggcaattgcatcatcaacgtactgtcttacatttttcttcaccgagcatagcatggctcaggcaacttctagctactctgtgcttttacccatatcgttatttgttttttctttttcctcaaatgttattcttatggtccacttcttctctggtcttatccttatggttatctcatttgtcatgggccttattccagcgactgctagtgcaaattcatatctaaaggaactgattctttttcgttatgctttacagaacttcttcagattatcaccaggattttgcttctctgatggattggcttcattagcgcttctaaggcaggggatgaaagacaaatctagtcatggggtgtttgaatggaacgtcactggagcgtccatctgttacctgggtttggaggttagattggaatattgtcgctactctatgctactattgtcattttttcatgggatagacacaaaattatcgttaatatatactataggggcatctcgtctgactgaactcatatatgacagagtatattctacttccttttctacagagccacttctcaaggattcgactggagccatttccactgatatggaagatgacatagacgtgcaagaggaaagagacagggtgatttcggggttgtcagacaacacgatgctctacttacagaacctgaggaaggtctatcctggtgacaaacatcacggcccaaaagtagctgtacagtctttgactttctcagtccaagcaggagaatgttttggctttctagggacgaatggagctgggaagactactaccttgtctatgttatctggagaagaaactccaactagtggaactgccttcatctttggcaaagacatagtagcgagtcccaaagctattcgtcagcatattggctactgcccccagttcgatgctttattcgagtatttgactgtgaaggagcaccttgaactttatgcaaggatcaaaggagtagttgatcatagaattgataatgtggttacggaaaagttagtcgagtttgacttgttgaaacattctcacaagccatcgttcactcttagtggcggaaacaagcgcaaactatccgttgctattgcaatgattggagatcctcctattgtcatcctcgatgaaccatctacaggtatggatcctgttgccaaaagattcatgtgggatgtgatatcccgcttgtcgacaaggagtggaaagacagcggtcattctgactactcatagcatgaatgaagctcaagcactttgcactaggatcgggatcatggtaggaggccgcctaagatgcataggtagtccacaacacttaaagacacgctacggaaaccacctagagttagaggtacctttttacaatggtgtcaaacccaatgaagtcagcaatgtggaattggagaacttttgccaaataattcagcagtggctgtttaacgttcctacgcagcctagaagtttactgggtgatctcgaagtttgtataggtgtctctgactcgattactcctgatacggcttcagcatcagaaatcagtttgtcaccagaaatggtacagaggattgccaagtttcttggtaatgagcagagagtgagtactctggtacctccattgcctgaggaagatgtgcgattcgatgaccagttatcagagcagctgtttcgagatggtggtattccacttccaatatttgccgagtggtggctaaccaaagaaaagttctcagcattggattctttcatacaatcttcgtttcccggtgcaacattcaaaagctgcaatggactgagtatcaagtaccagttgccatttggagaaggaggattgtcacttgcggatgcctttggacatcttgaaagaaaccggaatcggctgggaatagctgaatacagtataagtcaatccacacttgagaccatattcaatcattttgcagctaactcatag

SEQ ID NO: 1891 - DNA, 2529 bp, Arabidopsis thaliana
atggcggaaagagtcgaagcatcatctgtaccagaaggagaaaatacaatagaagaaagagaagtaggagctatgtgggaattagagcagaaacttgatcaacccatggatgaagaagctaataagctcaacaacatgtatagagaaaagggattatcaatgttgatgcttctaaggctctcttttcaaagtctagggatagtttatggagatttagggacgtctccattgtatgtgttttacaatacattccctgacggaattgatgatagtgaagatgtaatcggagctctttctttgatcatttactctcttttgcttattcctctcatcaagtatgtgttcattgtctgcaaagctaatgataatggtcaaggtgggactttagctatatattcgttgctttgtagacatgctaaagtgaaactaatcccgaatcagcaccgtagtgatgaggatctcacgacttatagtcgaactgtatccgctgaagggtcttttgctgctaaaaccaagaaatggttggagggtaaagaatggaggaagagagctcttcttgtcgttgttcttctcggtacttgtatgatgatcggtgatggtatcttaactccagctatctccgcaactggtgggatcaaagtaaacaatccaaaaatgagcggcggtaacattcacttcaccttattttcaacttcagatatcgtcgtgcttgtggcaattgtcattttgataggattgttcagtatgcaacactatggtacagacaaagtcggatggctctttgcacctatcgtgcttatttggttcctcttcattggagccactgggatgtacaacatctgcaagtatgacacaagcgttttaaaagcgttttcgcctacatatatatacttgtacttcaaaagacgaggtcgagatggttggatatcgctcggtggcattcttctcagcataacagccatatctaaatgttacttcttgaatattgcaggcacggaggcactatacgcagacattgcctatttccccttactagcgatacagctcgcctttacgttttttgtgttcccttgtcttcttctagcatactgtggacaagctgcttatcttgtgattcataaggaacattatcaagacgcgttctatgcatctatcccggatagtgtctattggccaatgtttatagtcgcgacaggagctgctattgttgggagccaagctacgatctccgggacttattcgatcgtcaagcaggccgtggctcatggatgttttcctcgagtaaaaattgttcatacttccaagaagttcctcggtcagatctattgtcctgatattaactggatactcatgctcggctgcatcgcggttactgctagtttcaaaaagcagagccaaataggaaatgcatacggtaagatgacaacaacttcaaaatacaagaaaaattattttagtcaatggactgcggttgttctcgtgatgcttgtgaccacattactaatggtgctgataatgctactcgtgtggcattgccactggatccttgtccttatattcacctttctctccttctttgtggagttatcgtacttctcagccgtgatctttaaaatcgatgaaggaggatgggtgccgctcatcatagcagcgatatctcttttagtaatgtcagtctggcattacgcaacagtcaagaaatatgagtttgaaatgcacagtaaagtgtccatgagttggatactcggcctcggtcccagcctcgggcttgtccgtgtcccggggatcgggttagtctacacggaattagcaagtggtgttcctcacattttctctcatttcatcaccaacctccccgcgattcattcggttgtagtctttgtctgcgtcaagtaccttccggtttacaccgtccctgaagaagagaggtttcttgtgaagagaatcggaccaaaaacattccggatgttccgatgtgtagccagatatggttacaaagatctacacaagaaagacgatgatttcgagaacaaactgctgactaaactctcctcattcattcgaatcgaaactatgatggagccaacttcaaactcaagcacctacagcagcacgtattccgtcaaccatacacaagattccaccgtagacttgatccacaacaacaacaaccacaaccacaacaacaacatggatatgttctcatcgatggtggactacacggtatcaactttagacacgatagtttccgctgaatcactgcataacacggtgagtttcagtcaggacaacacggtagaggaggaggagacggatgagttggagtttctaaagacttgtaaagagtcaggtgttgttcatataatggggaacaccgtggtgaaagcaagaactggatcatggcttccaaaaaagattgcgattgattatgtttatgcatttcttgctaagatttgtagggccaatagtgttatcttacatgttcctcatgaaacccttttaaacgttggacaagtcttttatgtttag

SEQ ID NO: 1892 - DNA, 1503 bp, Arabidopsis thaliana
atggcaaaagacaaagatataacggagacgcttctcactgcggcggaagaacgttctgatcttcctttcttatccgtcgacgatattcctccgatcaccaccgtcggtggcttcgttagggaattcaacgtggaaaccaaaaagctatggtacttggccggtcccgccattttcacatccgtgaaccaatattctctcggcgctattactcaggtcttcgccggtcacatcagcaccatcgctcttgccgctgtctccgtcgaaaactccgtcgttgccggcttctcattcggcatcatgcttggaatgggaagtgcgttagaaacgctatgtggacaagcgtttggagcaggaaaattgtcaatgcttggcgtttacttgcaacgatcatgggtgatactaaacgtgactgctcttatcctctctctcctttacattttcgccgcccctatcctcgcgtccattggtcaaacggcggcaatctctagcgcggccggaatattttccatctacatgatccctcaaatctttgcctacgccatcaattttccaaccgctaaatttttgcaatcgcaaagcaagataatggtcatggccgtgatatcggctgttgcacttgttatacacgtgcctctcacgtggtttgtcattgtgaagctccagtggggtatgccaggtctagccgtagtgcttaacgcgtcgtggtgcttcattgacatggctcagcttgtgtacatatttagtggtacgtgtggtgaggcttggtctggtttctcgtgggaggcttttcataatttgtggagtttcgttagattatctttggcttctgctgttatgctctgtttggaggtttggtattttatggcaatcatattatttgctggatatttgaagaatgctgaaatctctgtagctgccctctccatctgcatgaatattttgggatggactgctatgattgctattgggatgaacacagccgtaagtgtgagagtgtctaatgaattaggagctaaccatccaagaaccgcgaaattctcactacttgtggcagtgataacatcgacgctaatcggattcattgtatcaatgattctactcatctttagagatcaatatccatcactttttgtgaaagacgaaaaagtcatcattcttgttaaagaactcacaccaatacttgcactttccattgtcatcaacaatgtccaacctgtcttatcaggtgtggctgtgggagctggatggcaagcagtggtggcctacgttaacatcgcctgctattacgtgtttggaatcccatttggtctattattggggtacaagcttaactatggtgtaatgggaatctggtgtggaatgttgacggggaccgtggttcagacaatagttttaacatggatgatctgcaaaacaaattgggacacagaggcttcaatggctgaggataggataagagaatggggaggagaagtatcagaaataaagcaactcataaactaa

SEQ ID NO: 1893 - DNA, 576 bp, Arabidopsis thaliana
atggggaagaagagaaaatcaacagccacaagcctcgatgaggtagatcggactgtttacgcttcttttcgcaccgccgctaactctttatctcagctttatactcagtctatgaatcatcagaagttatcttttcaagccggtgaacgccatggtttggaaaaactgtaccaatggatatggagacaacaagaaggagggtcaagagtgacacctatggatattgtcaattatattcagaacgagctcgaatgctgcatagacgagcctccaatatccccaagagcgccaccaccgcaaccaacaatgcatgtcacgaatcccgggctcatgaccacttcaggcacctctttcccaacagctgttccagtggttaggtccgagcagtgtgagaaccaggccaagaactcggttttctcaaacgcactttcaagcccaatacggcgtagtcttcagaactaccaaattccgcagggaggctacacatccggcggaaccaccagaagcagtgaagtgaacaggggatctaactctccaggttctattgattcttcaatggacatgcatgcagaataa

SEQ ID NO: 1894 - DNA, 1824 bp, Arabidopsis thaliana
atggacaccaaaatcggatcgatcgatgattgcaagccgacgaacggcgacgtctgtagtccaacaaacggcaccgtcgcaacaatccacaactctgttccttcctccgctatcaccatcaactactgcgacgcgactctcggccgtcacttagctcgtcgtctcgtccaagccggcgttacggatgttttctctgttcccggagatttcaacctcactttgcttgatcacctcatggctgagccggacctcaacctaatcggatgttgtaacgagctaaacgccggttacgctgccgacggttacgctagatctcgtggagtcggcgcttgcgttgttaccttcaccgttggtggactcagcgttttaaacgcgatcgctggtgcttacagcgagaatcttcctcttatctgtatcgtcggaggtcctaactctaacgattatggcactaaccggattcttcatcacaccattggattacctgattttagccaagagcttaggtgcttccaaacggtgacttgttatcaggcggtggtgaacaatttagatgatgctcatgaacagattgataaagcaatatcaacagctttgaaagagagcaagcctgtgtatataagtgtaagctgtaacttagcagcgattcctcatcatacatttagccgtgatcctgtccctttttctctagctccaagattgagcaacaagatgggtttagaagctgcggtggaagcaacattggagtttctgaataaggctgtgaagccagttatggttggtggtcctaagttgcgtgtggctaaagcttgtgatgcctttgttgagctagctgatgcttcaggctatgctttggcgatgatgccttctgcgaaaggctttgtaccagagcaccatcctcatttcattggaacttattggggagcagtgagcactcctttttgctctgagattgtggaatctgcggatgcttacatttttgcaggtccaatcttcaacgactatagctctgttggttactcgcttctcctcaagaaagaaaaagccatcgttgtgcaacctgatcgtatcactgtggccaatggtcctacttttggttgcattttgatgagcgatttcttcagggaattgtctaagagggtgaagcgtaacgagactgcatatgagaactaccataggatctttgtccctgaaggtaagccattgaagtgtgaatcaagagagccattgagagttaacacaatgttccagcacattcagaagatgctctctagtgaaaccgctgtgattgctgaaaccggtgattcttggttcaattgccaaaaactaaagctgccaaaaggatgtgggtacgagtttcagatgcagtatggatcgattgggtggtctgttggtgcaactctaggatacgcacaggcatcaccagagaagcgagtgttggcattcatcggtgatgggagtttccaagtcacggttcaggacatatcaacaatgctgcgtaatggacagaagacgatcatcttcttgattaacaatggtggctacaccattgaagtagagattcatgacggtccttataacgtgattaagaactggaactacactggtctcgttgacgccattcataacggtgaaggcaattgctggactgcaaaggtgagatacgaagaggagttagtggaggcgattacgacagcgacgacggagaagaaagattgtctatgtttcatagaagtgattcttcacaaggatgatacgagcaaagagttgcttgagtggggctcacgcgtctctgctgctaacagccgtcctcccaatcctcagtag

SEQ ID NO: 1895 - DNA, 1821 bp, Arabidopsis thaliana
atgtggaagaacattgctgggttgtcgaaggcagcggcagcggcaagaacacacggatctcggcggtgcttttccacagcgattcctggtccttgcatcgtccacaagcgtggtgctgatattcttcacgatccatggttcaataaggttgtgtgttttcctttgactgagagagatagattagggatacgaggcttgcttcctcctcgtgttatgacctgtgtacagcaatgtgatcgtttcattgagtcgtttcgttcgctagagaacaacacaaaaggagagcctgaaaacgttgttgcattagctaaatggaggatgttgaatagattgcatgaccgtaatgagactttgtactaccgagttcttattgataacatcaaagattttgcccccattatatacactcctacggttggacttgtttgtcagaactattctggtttgtatagaagaccaagaggaatgtacttcagcgccaaagacaaaggagagatgatgtctatgatttataactggcctgctccgcaggtagatatgattgtcatcactgatggtagccgtattttgggcttaggagaccttggagtacagggaattgggattcctattggaaagctcgacatgtatgtcgctgctgcaggaatcaatccacagagagttttgccaattatgttggatgtaggcacaaataatgaaaagctcctacagaatgatctctatttaggagtcagacaacctaggttggaaggagaggagtaccttgagattattgatgaatttatggaagctgcatttacacgttggccaaaggccgtcgtacagttcgaagatttccaagcgaaatgggctttcggaacattggaaagatatcggaagaaattttgcatgttcaatgatgatgtccagggaactgctggtgttgcactggctggactattgggaactgtaagagctcaaggtcggccgatatccgactttgtgaaccaaaagattgttgtggtgggagctggaagtgctgggcttggtgtaactaagatggcagtacaggcagttgccagaatggcaggtatcagcgagagtgaagcaacaaaaaacttttacctgatagataaagatggtcttgtcaccacggagaggacaaaacttgacccaggagctgtactttttgccaaaaatccagctgagatacgcgagggagcaagtatcgttgaagtggtgaagaaagtgaggccacatgttcttcttggtttatctggagttggtggtatctttaatgaagaagttctcaaggcgatgcgagaatctgactcatgcaagcctgccatttttgccatgtcgaatcccactttgaatgccgagtgcactgctgctgatgctttcaaacacgccggaggaaacattgtctttgcaagtggaagtccatttgagaacgttgaacttgagaatggtaaagtaggacatgtgaatcaggctaacaacatgtatttattcccggggatcgggctagggactcttctctctggtgcacgtatcgtaactgatggaatgctacaagcagcttctgaatgccttgcgtcctacatgaccgatgaagaagtccaaaaaggcatcctttacccttcaatcaacaacatccgacacataacagctgaagtcggggcagctgttctacgagctgcggtgactgatgacattgcagaaggacatggtgatgttggtcccaaagatctcagccacatgtctaaggaggatacagtgaattacattacacgcaacatgtggttccctgtttacagccctctcgttcacgagaaatag

SEQ ID NO: 1896 - DNA, 456 bp, Arabidopsis thaliana
atggcaccaaaagccggaaagaaaccagcagagaaaaagcccgcagagaaagctccagcagaagaagagaaagtagccgaaaaagcaccagcagagaagaaaccaaaagccggaaaaaaactaccaaaagaagcagtcaccggaggagtcgagaagaagaagaaacgagtcaagaaaagcacagagacatacaagatctacatcttcaaggtgttgaaacaagttcatccagatattggaatctcaagtaaagctatggggattatgaacagttttatcaatgatatattcgagaaacttgcgcaagaagcttcaaaattagctaggtataataagaaacctacgattacttctagggagattcagacagctgttagactagtgttacctggtgaacttgctaagcatgctgtttctgaaggaactaaggctgttactaagtttactagctcttag

SEQ ID NO: 1897 - DNA, 76 bp, Arabidopsis thaliana
ctcttatgatgtcaaaactttcgttctcctgagatttcaatatgctgaaaaaaattggagacctgaactgaaagag

SEQ ID NO: 1898 - DNA, 498 bp, Arabidopsis thaliana
aagagaagggcagaggctgctaggattagagagaagtatcctgataggattccggtgattgttgagaaggctgagaagagtgatataccaaccatcgacaagaaaaagtacctagtcccggctgatctgactgtggggcagtttgtgtatgtcattcgcaaaagaatcaaattgagtgcagaaaaggctatcttcatattcgtggacaatgttcttcctccagcaggtaaacagatagatctcctctgtattcaagactcaggagtttcattatcttttaacacaagtaacaagagcataagaaggcgtctacttatatgttccccggtgcgctcatgtcttctgtgtacgaagagaaaaaggatgatgatgggttcctctatgtcacttacagcggagaaaacacatttggatttggatctccataatagagacctcttgctggatatttcattttactcctctctattttcaccaaatatttcatcttcttattaa

SEQ ID NO: 1899 - DNA, 864 bp, Arabidopsis thaliana
atgttctcagtcttggtattccctctcttactcaattgtttagtttacttgttcaacgccattgccatcaaacccgagataacaaacttgatccttgaatcaagtttgttacctatgacagatccaaacaccccggaatttgctgcccatcttatgagagtctttgtagattttcgccagtttgtcaattctttatacatcttcatcgccgtctcctccatcatcaaccttttatccactcttgtcatggttcatgcatcggctcttactcataaagatgatagcttcgagatcaaagattttccgattctgacgcttaaatattggaagggacctcttgtgaccaatttctatattgttctcttcagtcttggctattggttcctattctttatagtcctattttctatcgttttcttctctacaaaactcgattccttggcagccaaatctcgcgctttattcattgtatttgcagtctttgagtcttacttagctatcgtttggaacttatctatggtcatatcgatactcgaggatacttatgggatccaagctttggggaaagctgcaaagattgttaaagggatgaagccaaaactattcctcttgaatcttttctttgggttattgtcatttggattagttcaaatcttgcggctggtcgattggagtagttcattctcggttaccttaaccaccggtttggtccttatgagttcggtctttgtggtgaggatgtttcagcttgtgacttacaccgttgcttatttccaatgtaagagcctgcaaggacaagactcgctgagggatgttgaatatacgaaattgtcatccactactctcatgggaggattgccttga

SEQ ID NO: 1900 - DNA, 336 bp, Arabidopsis thaliana
atgaagaggaacggcgagacgaaacggcggaggaacgtggcggaggaggcagagcagggagaggatccggcgatgtgggagaatcttgaccggaatttcagacaagtgcaatcagttttagacagaaacagatcactgattcaacaagtcaacgacaatcaccaatcgagaatggctgataacatgtcgaagaacgttgctttgattcaagaactcaacggaaacatttccaaggttgttaacatgtattctgatctcaatactagtttctcgtcgggctttcacggtgggaagaacggtcacgatggtggtggtgctgccggaactagagcttaa

SEQ ID NO: 1901 - DNA, 2640 bp, Arabidopsis thaliana
atgaccggagctagccgtcggagcgcgcgtggtcgaatcaaatcatcatcattatctcccggctccgatgaaggaagcgcttatcctccgagtatccgccgcggcaaaggcaaggaacttgtatcgatcggtgctttcaagacgaatctcaagatattggttgggttaatcatattagggattatagtaatctacttcgtaatcaatcggctagttcgtcacgggttgttgtttgatgagtcccagaagcctagggttatcactccttttcctgctccgaaagtcatggatttgtcaatgtttcagggcgagcacaaagagagcttatactggggaacttatcgtcctcatgtttattttggagttcgagctagaactccattgtccttggtagctggcttgatgtggcttggtgtcaaagatgagatgtatgttatgcggcatttctgtgaaaactctgatgatttaagtacatttggctggagagaacataatggacgggattatggtcggcaagagctggttgaaaacgatatggtaatagagacgagttttgtgaagtccaagggagacggccttggttatggtggggattgggcagttcggattgatgtaaaaaataaagggttgaatgatgatgtgaagagaagtgcacatctcttcttttatttagctgatgaaggtggcaatgttttaaatttaggccaagatggtttagatttccaagggagctctctcctggtttcggggtcacgtgaagatgtaggagactggcagatacacttaaaatcacagaatcagctcgagacacattattccggtttcaagacgcctcacatatataatttgtctgatctagttcagcaaaatcttgctctgcaggcaaggaagtttggacgacttcagctctctgacacatcagaggattcttctaacatttacatctttcaggtaatcagtcttaataaagatatttctgggaggctaccatttacgattgatattcccttcatctccgggatcaaaggagaaagttcaaatgtggaaaagcgtttaacaagtctcacaggtttgccactctctgatctacttaaaaagaaacatcaagaatttgatgcaaagtttaatgaatgcttcaagctttctgaaaagcatgattcagaaacattgggggttggaaggactgcaattgcaaacatgcttgggggcattggttacttctatggccaatcaaaaatttatgttcctaaaagcactcagcctggaagtcgggataatttcttgctgtattggccagccgagctgtacacagctgttccaagccgacctttttttcctagggggtttttgtgggacgaaggtttccatcaattgttgatctggcggtgggatattcgtataaccttggatatcgttggacactggttagacctattgaacatagatggatggattccacgtgagcaaattttgggtgctgaagctttgagtaaggttccagaggaattcgtagttcaatacccgagtaatggcaatccaccaactctgtttttggtgatacgtgatctgattgatgctataaggatggaaaagtttgtcgcatcagaaaaggatgaagtattgtcattccttgagcgagcttctgtacgcttagatgcttggtttcagtggtttaatacttcccagaaaggcaaggagatcggaagctacttttggcatggcagagacaacacaacaactcaagaacttaaccctaagacgctttcgtcggggctggatgattatccccgggcttcgcaccctagtgaagatgagcgacatgttgatcttagatgctggatgtaccttgctgcagattgcatgcattccatcacagagcttttaggaaaagaagacaaactttcaaaggttagcacaagatggaaaagaaagggatgccaacaattttctcactttaacttcattaattttctttttcttctcaccattctctattctcattcatggataatttctgagcagatgcactatgatagtgactatggggcttactttgactttggcaatcatacagaaaaagttaagttgatatggaaagaggtaattcaagaaaatggtcaattatctcgacaacttgtaaggaagacttttgggaagccaaagctaaaattggttcctcacttgggttacgtcagcttctttcccttcatgtctagaatcatcccacctgattctccaattctcgagaaacagctcgatctcatttcaaataggagcatcttatggagtgactatggactagtttcgcttgccaaaaccagttctatgtatatgaaacgtaacactgagcatgatgcaccatactggagaggtcctatatggatgaacatgaactacatgattctttcttctctttaccattactctatagtggatggaccgtatagagaaaagtcgaaagcaatttacacggaactaaggagcaatttgataaggaacgtggttagaaactattacgagacggggtacatctgggaacaatatgatcaagttaagggaacaggcaaaggcacgcgtctcttcaccggctggtctgcgcttaccttgttaattatgtcagaagattatcctattttttag

SEQ ID NO: 1902 - DNA, 1629 bp, Arabidopsis thaliana
atggagtttcttctctttcttggatgtataacagtgtttctctatgcaggtaagggattgttgttgccaatggggtggctaactaaaatccttaaaggttctagccataagttttctgatggacaatgtaatggaagatatagagaagatagaaacttggaaggtcctcgttattctgcggaaggatctgattttgacaaagaggagattgaatgtgctattgcactttctctttctgaacaagaacatgtaattccacaagatgacaaaggaaagaaaataatcgagtacaaatctgaaaccgaagaagatgacgatgacgatgaggatgaggatgaagaatacatgagagctcagctagaagcagcagaggaagaggaaagacgggtagctcaagctcaaatcgaggaagaagagaaaaggagagctgaagctcaactagaagaaacagagaaactgcttgcaaaagctcgattagaagaggaagaaatgaggcgttctaaagcccaactggaggaagatgagctactcgccaaggcccttcaagaaagtatgaatgtgggatctcctcctcgatatgatccaggaaatatacttcaaccatatcccttcctcattccttctagtcacaggatatgtgtcggttgccaagctgagataggacatggaaggtttctgagtgcatgggtggcgtttggcatcctgaatgtttctgttgcaatgcatattccgacaaatccagctggtcttattgagtatagggcacatcccttttggatgcaaaagtattgtccttcacatgagcgtgatggaactcctcgttgttgcagttgtgagcgaatggagccaaaagatacaaaatatctcattcttgatgatggtcgaaaactgtgtcttgaatgtctcgactcagccattatggacactcatgaatgccaaccattgtaccttgagatacgtgaattttacgaaggcttacatatgaaagtggaacagtcaaattcctatgcttttggtggagagatcagctctaaacgagctatggaaggagagaaacacggacatcatcatttacctgaaactagaggactttgtttgtctgaagaacaaactgtcaccacggtgttaaggagaccaagaattggggcaggctacaagttaatagacatgatcacagagccttgcaggctgatacgtcgttgtgaagtcactgcgattctcattttatatggacttcctcgtttgttaaccgggtcaatccttgctcatgagatgatgcatgcatggcttcgactaaatgggtatccaaatcttagaccagaagtggaagaaggaatatgtcaagttttagcacacatgtggttggaatctgagacttatgctggctctacattagtagacatcgcatcttcttcatcatctgctgtggtgtcagcatcgtccaagaaaggtgagaggtctgattttgagaagaaacttggtgagtttttcaagcatcaaatcgagtcggattcttcatcggcatatggggatgggttcaggcaaggtaaccaagcagttcttaagcatggtctgaggcgaaccctcgaccatattcgcttgaccggtacatttcctaaatggatttaa

SEQ ID NO: 1903 - DNA, 1011 bp, Arabidopsis thaliana
atgggtttggtcatgaggtttgatctttaccttatgtttgtgatgttgatgggtttagggtttacgatatcaaatggatacaagttctatgttggtgggaaagatggttgggtcccgactccttccgaagattattctcattggtctcaccgaaaccggtttcaagtcaacgacactcttcccactcaggttcctactttttcattagtggcaactctcaaaactgtcttaaaggagttgtcttcgccggggccttctccaggagtggaaccatcatctgattcaaactctcgtgttccagctccaggaccggctacagctcccaattcggccggtttggggatctctacctcgagacaattgcaggcgagtgaagagcctgtatcatcacctttgtcatctccagctctgttgggtagtggaaaagaagaagagcagaagattatcccaaagcgtcagaaagttcaggctgtcctcaagtctataaagcagagtcctaagaaggtcaacctggttgcagcactagtccgtggcatgcgtgttgaagatgctttgatccaattgcaggtcacagtcaaacgagctgcacaaactgtgtaccggcatacaacttgttttgttaatacaatgcttaaaggagttaaatacattatactgcaggttatccacgctgcccgggcaaatgctactcataaccatggactagatcctgaccgtctccttgttgtcatagttagagagacgactccagaggaagaagctgagattgcaaggctcaaagttcacaattttaagaagaaaagcaaacgggagagacagcttgtaccacacaagctcatcgagacaagtccaatatggaaccgcagaggtaccaaagccaatcatcggtcctcagagttggtgttaacaatcattttggatgtaacttgtgttggaaacatggaaaaaaatcgtctggataatttgacgaatcaaaacaacatttatcatcataatcccgaaggtccataa

SEQ ID NO: 1904 - DNA, 1224 bp, Arabidopsis thaliana
atggcggaagaaatctcaaagacgaaggtgggatcttcttctactgcttcggtggctgattcatctgctgctgcgtcggctgcaacgaatgcggccaaatcaagatggaaaattttgtggcctaattcgctccggtggattcctacgtccaccgattacatcatcgccgccgagaaacgtcttctctccatcctcaagacgccttatgtacaagagcaagtcagtattggttcaggaccaccaggttctaaaatcaggtggtttaggtctacgagcaatgagtcacgttacatcaacactgttacatttgatgccaaggagggagctcctacactcgtcatggttcatggttatggtgcttctcaagggtttttcttccgtaattttgatgctcttgccagtcgatttagagtgatcgctattgatcaacttgggtggggtggttcaagtaggcctgattttacatgtagaagcacagaagaaactgaggcatggtttatcgactcctttgaggaatggcgtaaagcccagaatctcagtaactttattctattaggacattcttttggaggctatgttgctgctaaatacgcgcttaagcatcctgaacatgttcaacacttaattctggtgggatctgctgggttctcagcagaagcagatgccaaatcagaatggctcactaaatttagagcaacatggaaaggtgcagtcctaaatcatttatgggagtcaaatttcactcctcagaagctggttagaggattaggtccttggggtccaggtcttgtaaatcggtatacaactgcaagatttggtgcacattcggagggaactgggctaacagaagaggaagccaaattgctaaccgattatgtgtaccatactttggctgcaaaggctagtggagagttatgcttgaaatacatcttctcatttggagcatttgctaggaagcccctcttacaaagtgcatcagagtggaaagtgccaacaacgtttatctatggaatgaatgattggatgaactatcaaggtgcggtggaagcgaggaaatccatgaaggtcccttgcgaaatcattcgggttccacagggtggtcattttgtgttcatagacaacccaattggttttcattctgcagtgctttatgcttgccgcaagtttatatctcaagactcctctcatgatcaacaactcctagatggtctacgattggtttag

SEQ ID NO: 1905 - DNA, 1092 bp, Arabidopsis thaliana
atgtcgtctccggcgactactatcaccttctttttcttcttcactctctcatccttcttctacatcacttcttcactccagaacaacaacaacaacaaacacacagcaaccgttaactccttaaatatcccctccgccgcggcggagattacgctagtaaacccaaagcttccgccgcggagtctctccctcacatcctccaaaaaattcgaaggatcttcaaatctagtccacctccgttaccacatgggaccagtcctctcatcttctccgatcaacatctacgttatctggtacggacaatggtcacgcccacacaaatccctaatcagagatttcctcaattctatctccgacgctaaagcaccttctccctccgtctccgaatggtggcgcaccgcttctctctacacagatcaaaccggatccaacgtctctagatccgttttaatcgccggagaatactccgattctaaatactcccacggccaacaccttactcgtctcacgattcaggaagtcatcgcctccgccgccagatccgcttcctttccggtggatcataaaaacggaatgtatctagttctgacgtcacacgacgtcacgatgcaagatttttgccgcgccgtttgtggatttcactatttcactttcccgtcgatggttggttacactatgccttacgcttgggttggtcaatcgggaaaacaatgtcccgaggtttgtgcttatccatttgctttaccgggttacatgggacacggtggtcccggagagctccggccaccgaacggagagactggagtagatgggatggttagtgtgattggtcatgagttagctgaagttgtatcgaatccgttgattaatgcttggtacgccggagaagatccgacggctccgacggagatcggtgatttgtgtgagggattgtacggaagcggcggaggaggagggtatattggtcaagttatgagagatagagaagggaagacttttaatatgaatggtaaaggaggaagaaagtttttagttcaatggatttggaaccctaatttgaaagcttgctctggtcctaactctgtcgactaa

SEQ ID NO: 1906 - DNA, 759 bp, Arabidopsis thaliana
atgtttcaggtgccctgcagtaaggacaactatgcttatctgttgcacgatgaagacaccggaacagttggagtcgttgatccttctgaggctgcacctgttatagaagcattgagcaggaagaattggaatttaacttacattttgaatactcatcatcatgatgatcacattggggggaatgctgaattgaaagaaaggtatggcgcaaaggtgattggatcagctgtagataaagatcggattcctggaattgacatacttctgaaggatagtgataagtggatgtttgctggccatgaggttcggatacttgacactcctggccatacacaaggccatattagcttctactttcccgggtcagcgacaatattcacaggagacctgatatatagcttatcctgtggtaccctttcagaaggtacccctgagcagatgctttcatcactccaaaagatcgtgtctctaccagacgatacaaatatatactgcggccgtgaaaacacagcaggcaatctcaagtttgctctatccgtagaaccaaagaatgaaactcttcagtcctatgcaactcgagtcgcccatcttcgcagccaggggctcccatcgattccaacgactgtcaaggttgagaaagcgtgtaacccattcctcagaatatcgagcaaagatatccgaaaatctttaagcattccagactcagcaaccgaagctgaagcattgcgtcgtatacagagagccagagatcgtttctga

SEQ ID NO: 1907 - DNA, 855 bp, Arabidopsis thaliana
ggatccggaggtgcgcgagctagatcagaagtgggcactctttcaagaaaaggatgccctccgggctaggcagatagccgaatggagggagacgttttcggaggatttagcggcgggaagggagaaagaagcccgccttgcattactaaattcgtggctcaaggtgatcatccatacacggaataaccaacccccccaaaactaaagctttcgttctcttctttttttttacttgattggcaggtgtacaacaaccttaaccgcgcaagcctgggctgggcctacctccatccttagaggagccgtatgaggcggaagccccacgtacggttttgaagccgagcctttccagcaatggggcttagggaccgatatgatgattggtttaggtagggcggccggcctactacgggcacccgcctgtagggattagtgcgtgagaccgcgatccacaaactgacgcatgggactcaccctttacttgagaataaagaggggaaagatagcatgtcccaagagcgaggcgagttttggaaccctacagcgggagggacgcctcgcgagccgggcttccagagatgaggccttttggcgaagccaagtttctttcgggccaccaaaccctgcaactgatgagaaagaaggccctatggagtaaagggaagcgtgtacgttgtcacactccctgccttccaaaggtgcctagaggacgggccagacgcagcggagcgacaacccgggagcagagtccccaccggcagggggacaggagacggccatctcaaggcacatcacgacctacaggtaagaccggcgagaccagggaaggcaacccgattgggagtcagaggatcc

SEQ ID NO: 1908 - DNA, 1896 bp, Arabidopsis thaliana
atgaatttatttacaagaatctcatctcggactaagaaggccaatctttactacgtaaccctagttgctcttctctgcatcgctagctaccttctcggtatttggcaaaacacggcggttaatccacgcgccgccttcgatgattcagacggtacaccgtgcgagggattcaccagacctaattctacgaaagatctcgacttcgacgcgcatcacaacattcaagatccacctccggtgacggaaaccgccgttagtttcccgtcgtgtgccgccgcgttgagcgagcacacgccatgcgaagacgcgaagcgatcgttgaaattctcgagggagagattggagtataggcaaaggcattgtcccgagagagaagaaatcttgaagtgcagaattccggcgccgtacggttacaaaacgccgttccgatggccggcgagtcgtgacgtggcgtggttcgctaatgtgcctcacacggagcttacggttgagaaaaagaatcagaattgggtccggtacgagaatgatcggttttggttccctggtggaggtacgatgtttccacgtggcgctgatgcttacattgatgatatcggacggttgattgatctcagcgacggctctatccgtacagccatcgataccggttgcggggtggctagcttcggtgcatatcttttatcaagaaacattacaacgatgtcatttgcaccaagagacacacacgaagctcaagtccagttcgcactcgagcgtggtgtgccggcgatgatcggaatcatggctacaatccgcctaccgtacccttctagagcctttgatttagcacattgctctcgttgccttattccgtggggccaaaacgatggggcttacttgatggaggtggatagggttttaagaccaggagggtactggatactttctggaccgccgattaattggcagaaacggtggaaagggtgggaacggaccatggatgatttgaatgcagagcagactcagatcgagcaggtcgcgagaagcttgtgttggaagaaagttgttcaaagagatgatcttgctatttggcaaaaaccctttaaccacattgactgtaagaaaaccagagaggttttgaaaaatccggagttttgtcgtcatgatcaagatcccgacatggcctggtatacgaagatggattcttgtttgacaccattacctgaagttgatgacgctgaggatctaaagacggtggccggagggaaggtagaaaagtggccggctagattaaacgcgattcctccgagagtaaacaaaggcgctctcgaggaaatcacacctgaagctttcttggagaacacgaaactgtggaaacagagagtttcttattacaagaagttagattaccagttgggtgaaaccgggagatacagaaacttagtcgacatgaacgcttacctcggtggattcgcggcggctctagcggatgatccggtctgggtcatgaacgttgtcccggtcgaggctaagctcaatacgctcggtgtcatctacgagcgtggtctaatcggaacgtatcaaaactggtgtgaagccatgtcgacgtatccaagaacgtatgattttatccatgctgactcggttttcacattgtaccaaggtcaatgtgaaccggaggagatattgttggagatggaccgaattcttagaccgggtggtggtgtgattataagagatgacgtggacgttttgatcaaggttaaggaattaaccaaaggattagaatgggaaggtagaattgctgaccacgagaagggtcctcatgaaagagagaagatttactatgcggtgaaacagtattggaccgttcctgcgcctgatgaagataaaaacaacactagtgctctctcctga

SEQ ID NO: 1909 - DNA, 1077 bp, Arabidopsis thaliana
atggctccaggaactttgactgagctagccggagagtctaagctcaactctaaatttgtcagggacgaagatgaacggcccaaagtcgcttacaatgtgtttagcgacgaaatcccggtgatctctctcgccggtatcgatgacgtcgatggaaaaagaggagagatctgccgtcagatcgttgaggcttgtgagaattggggcatcttccaagtggtcgatcacggcgtcgatactaacttagtggcggatatgactcgtctcgctcgtgacttctttgctttacctccggaagacaagctccgtttcgacatgtccggtggtaaaaaaggaggattcatcgtctctagtcacctccagggagaggctgtgcaagattggagagagattgtaacgtatttctcgtacccggtgagaaacagagactactcacggtggccagataagccggaaggttgggtgaaagtgacggaggagtatagtgagaggcttatgagtttggcttgtaagcttcttgaggttttgtctgaagctatgggtcttgagaaagagtctcttaccaatgcatgcgtcgatatggaccaaaagattgttgttaattattacccaaaatgccctcagcctgatctcaccctcggactcaagcgtcacactgaccctggaaccattaccttgctgctacaagaccaagtcggtggattacaagccacacgtgacaatggcaagacatggattacggttcagcctgttgaaggagcgtttgtcgtcaatctcggcgaccacggccattttttgagcaatgggaggttcaagaatgctgatcatcaggccgtggtgaactctaactcgagcagattatccatagccacgttccagaaccccgcgccggatgccacagtgtatccactgaaagtaagagaaggagagaaggcaatattggaggagccaatcacgtttgccgagatgtataagagaaagatgggaagagatttggagcttgctcgcctcaagaagctggctaaagaggagcgtgaccacaaagaagttgacaagcctgtcgaccaaatcttcgcttag

SEQ ID NO: 1910 - DNA, 1713 bp, Arabidopsis thaliana
atggagtcttttcggcgattctccttgctatccttcattgccctacttgcctacttcgctttcctcgcttctgctgaacatcacgtccatcaattcgtgatcacaccgacaccagtgaagaggctgtgcagaactcaccaaagcatcactgtgaatggtcagtaccctggtccaacgcttgtggtcaggaacggtgactctctcgcaatcactgtcatcaacagagcccgttacaacattagtattcattggcatggaatcagacagctgcggaatccgtgggccgatggtccagagtatataacacaatgtccgatccgtccaggacaaacctacacttacagattcaaaatcgaggatcaagagggtacgctttggtggcacgctcatagccgctggctcagagccacggtctatggtgctctcatcatttaccctcgtcttggttctccttatcccttctctatgcccaaacgtgacattccaattcttcttggggaatggtgggatagaaacccaatggatgttttgaagcaagcacaatttacgggagcagcagctaatgtctctgacgcttacacaatcaacggtcaaccaggcgatctttaccgctgctcgcgggctgggacaatccgttttccaattttccccggggagacggtgcaactccgtgtcatcaacgctggtatgaaccaagagctcttcttctcagtcgccaaccaccagttcacagttgtagaaactgattccgcctacacgaaaccattcaccacaaatgtcatcatgatcggtcctggccaaaccactaacgtcctcctcacggcaaaccagagaccaggccgctactacatggcagctcgagcctacaacagcgcaaacgccccgttcgacaacacaaccactactgctatcttacaatacgtcaacgctccaacaagacgtggccgtggtcgtggtcaaatcgctcctgttttcccagtcctccccgggttcaacgacaccgcaaccgcaactgctttcaccaaccgtctccgatactggaaacgagctccagtaccacaacaagtcgacgagaacctctttttcaccgtcggattagggctaatcaactgtgccaacccaaacagtccccgttgccaaggtcctaacgggacccgattcgcagcaagcatgaacaacatgtccttcgtgctaccacgaagtaactccgtcatgcaagcatattaccaaggcaccccaggaatcttcacaacggattttccgcccgttccaccggtgcaattcgattacacaggtaacgttagccgcgggttatggcagcccataaaaggaaccaaagcttacaagcttaagtacaaatctaatgttcagattgtgttacaagacactagcattgtcacgccagagaatcatcccatgcatctacacgggtaccaattctacgtggtcgggtcaggtttcggtaatttcaacccgagaacagacccggctaggtttaacttatttgacccaccagagaggaacaccattggaacacctccaggtggttgggtggcaattcggttcgtcgctgataatccaggagcatggtttatgcattgtcacattgattcacatttgggatggggtttggctatggttttcttggtagagaacggtcgtggacagttgcaatcggtgcaggctccaccattggatcttccaagatgctaa

SEQ ID NO: 1911 - DNA, 1353 bp, Arabidopsis thaliana
atgtctatattcaatcctgattcaatcaacaacgagctatcgaaaccaacatcgatctttggtctaaagctttgggtcgtcatcggaattttactaggatctcttatagtcatcgctctcttctttctctccctctgtttaacctctcgccggagaaaccgtaagccacgtcacgccgatttcgcatccgcagccgtagcaacgccgccgatttcaaaggagattcaggagatcgttagacctcctgcgcaagaccattgccatccgacgcagcccgttgcggcggagattcaagtggatatagggaagaccgagcaccgtgttgtgttctcggatcgagtctcgagtggtgaaagcagaggaacggttagtgaaacggcgtcgtattcagggagtggttgtgttggacctgaggtttcgcatcttggttggggaagatggtatactcttagagagcttgaagcagctactaatggattgtgtgaagagaatgtgatcggagaaggaggttatgggattgtttatagtgggattttaactgatggaactaaagtcgctgtcaagaatctgcttaacaacaggggtcaagctgagaaggagtttagagtggaagtggaagctatcgggcgtgtaaggcataagaatctcgttaggctattaggatactgcgtcgaaggagcatacaggatgctcgtgtatgactacgtcgataatggcaacttggagcaatggattcatggggatgttggtgataaaagtccgttgacttgggatattcgtatgaacataatactttgcatggcgaaaggattggcctatctgcatgagggtcttgaaccgaaagtcgttcatcgggacataaaatctagtaatattttgcttgatcgtcaatggaatgctaaggtatcagattttggacttgctaagctcttgttctccgagagcagctacgtgacaacccgagtaatgggaacttttggatatgttgcgcctgagtatgcttgcaccggaatgttgacagaaaagagtgatatctatagttttgggatattaatcatggagataatcaccggaagaaatcctgtcgattatagtcgacctcaaggagaggtgaatttggttgagtggctgaaaacaatggttggaaaccgaaggtctgaggaagtagtcgatccaaaaatacccgaaccgcccacttcaaaagctcttaaacgcgtgttgctcgtcgcgctgcgttgtgtggatccggacgcgaataagagacctaaaatgggtcatattatacacatgcttgaagctgaagacttgttctatcgtgacgtaagtcttataatcgtattaatgaacatttga

SEQ ID NO: 1912 - DNA, 918 bp, Arabidopsis thaliana
atggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtcttcttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtag

SEQ ID NO: 1913 - DNA, 2361 bp, Arabidopsis thaliana
atggcaacactaggagatattggagtagcagcagcaatcaacatactcactgcaatcatcttccttttggcatttgcaatcttgaggattcaaccattcaacgatagggtttatttccctaaatggtatctcaaaggtataagaagcagccctttgcattcaggtgctcttgtcagcaagtttgtcaatgttaacttaggctcatacctccggttcttgaactggatgcccgcggctctaaagatgcctgagcctgagcttattgatcatgctggattggattctgctgtctacttgaggatttacttgatagggcttaagatctttgtaccgatagcgttacttgcttggtcgattcttgtacctgtcaattggactagtcatggtctgcaactagctaagcttcgtaatgtgacatctagtgatattgataagttatccatctcgaatatcgaaaatggatcagacagtttgtactttggaaggttttggactcaccttgtgatggcttacgcattcacattctggacttgctatgttcttatgaaagagtatgagaaagtagctgctatgcgtttggcatttctccagaacgagcaacggcgccctgatcagttcacgaaccttggactgagccagttactttcccaggttttggttaggaacgtaccagcggacccagatgagtccattagtgacagtgtggaacatttctttctagttaaccatccggaccattatcttacgcatcaggttgtgtacaatgcaaacgatttggcagcattagtagagcagaagaagagcacacagaactggcttgactattaccaattgaagtatacaaggaaccaggaacataagccgaggataaagacgggttttctcgggctatggggaaagaaagttgacgcaatcgatcattatatagctgaaatcgagaaattaaacgagcaaataatggaggagaggaaaaaagtgaagaaagatgatacaagtgtaatgccagccgcttttgtctcgtttaaaacacggtggggtgctgcggttagtgcacagactcaacagtcgagtgatccgactgaatggttaactgaatgggctcccgaggcacgagaagtgttttggtcgaaccttgcaataccttatgtctctttaacagtaagaagacttataatgcacattgcattcttcttcctcactttcttcttcatgattccaatagcctttgttcaatcccttgcaagcatcgaaggcattgagaaaaatgctcctttcctgaaatccatcatcgagaacgatcttttcaaatcggttatccaaggttttcttccgggtatcgtgttaaagctctttctaatatttctgccaagcattttgatggtaatgtcgaagttcgaagggtttgtatcgttatcatcgttagagagaagagcggcttttcgatattatatctttaatctcatcaatgtcttcctcggaagcgtaatcaccggctctgcatttgaacagcttgattctttcctaaaacaatccgcaaaggagattcctaagacggttggggtagcgataccgataaaagcaacgttttttatcacatatataatggtggacggttgggctggtattgcaggggagattctgaggctgaaacctcttatctttttccatataaagaactccttattggtgaaaaccgaaaaggatagagaagaagcaatgaacccgggacagatcaattatcatgcgacagagcctcggattcaactctacttcctcctcggtcttgtctacgctcctgtgactccagttctactccctttcattatcatcttcttcgcattggcttaccttgtctttcgtcatcagatcataaatgtgtataatcaggaatatgaaagcgcggctaggttctggccagatgttcatggtcgtataatatcagcattgatcatcgcacaaatccttttgatgggactattaagcactaagggagctgctcagtccacgcctttcctactcttcttaccgatcataacctttttcttccaccggtactgcaaaggccggtatgaaccagcattcctccgtcaccccttgaaggaagctatggtcaaagatacattggaacgagcaagagaacccaattttaatctgaaaccgtatcttcaaaaagcatacattcatccggttttcaaagacaacgactatgaagatagccggtttgatgaaatatccggttattgcatcgaagattcggatgaagagtgtgttactgtaccgaccaaacgtcagtcccggataaatacgcctgctgttagccatgcaagccgcggttcttcgcgttcaccaccctcaaagtaa

SEQ ID NO: 1914 - DNA, 882 bp, Arabidopsis thaliana
atggtggtgtcactcttctcttccagaaatgttttctatacgttaagcttatgcttatttgcagcattataccagccggttatgagtagaccggctaagtttgaagatgactttaggatcgcatggtccgatactcatatcactcaaattgacggaggcagagccattcagctcaaattggaccctagctcaggatgtggatttgcttcgaagaagcaatacttgttcggccgtgtgagcatgaaaatcaaactgatccccggtgattctgccgggactgtcactgccttctacatgaattcagataccgattcggtacgagacgagcttgattttgagttcttaggaaatcgaagtggacaaccttacacagtgcaaaccaatgtgtttgctcatggtaaaggcgatagagagcaaagagttaacctttggttcgacccttctcgtgatttccacgaatatgccatctcatggaaccatctccgtattgtcttctacgtagacaatgtgcccatcagggtttacaagaacaatgaggcaaggaaagtaccatacccaagattccaaccaatgggtgtatattccacgttatgggaagccgatgattgggcgacacgtggaggaatagagaaaatcaattggtcgagagcgccattttatgcttattacaaagattttgatatagaaggatgtccggttccaggacccgcagattgtcccgctaattcgaagaattggtgggaaggcagtgcgtaccaccagttgagtccggtggaagctcgaagttatagatgggtccgagtgaaccatatggtctacgattattgcactgacaaatctcgttttcctgttccacctccagaatgctcggctggaatctga

SEQ ID NO: 1915 - DNA, 3504 bp, Arabidopsis thaliana
atggctacctcatcctcggtggtcagcagtgtacctcagcagcaccaagtgttcctcaatttccgtggggacgaacttcgtaataatttcgtcagccatctggataaggccttaagagggaaacagatcaatgtcttcatagatgaggctgtggaaaaaggtgaaaatctagataaccttttcaaggagatcgaaaaatctagaatcgcgctggctatcatttcccaaaagtacacagagtcaaaatggtgcttgaacgagctggttaaaatgaaagaactcgagggcaaactcgtgacgattcccatcttctacaatgtggaacctgctacggttaggtatcagaaggaagcgtttggtgctgcgctcacaaaaacgcaggaaaatgatagtgatggccagatgaagaaatggaaagaggctttgacgtatgttagtctcctggtgggcttcccgtttaacagtaaaagcaaggagaaggagaccacgctcatcgataaaatcgtcgacgccgttttgcaaaagctgagtaaaatatcgtcggaagaaagcacaagtggatcagtggatcaaggtcggggagaagaagtagaagaagcaaaggctgataagatttccgggctcaaccagcgcctaaaggaactggaagaaaaggtagccattacgggtgacaagagagacgagactcgtattgtcgaagttgttgggatgcctggcattggtaaatccactctcttgaaggccttctatgagacatggaaaaccaggttcttgagcagcgccttactccaaaatataagcgaacttgtaaaagcaatgggattgggacgcttgactgggatgctcttgaaggagttgctcccagatgaaaacatagacgaggagacatacgaaccatacaaggagaaactacttaaaaacacagttttcattgttctagatggcataagtgacgagacacatatacaaaaacttcttaaggatcatcgaaaatgggctaagaaaggaagcaagattgtgattgcaagacgcgcagtgactcgtgatctgcttcatgaggattcaatggtccgttatacttattttgtaccgctgttgagccatcgagatgggttaaatcacttttgtcactatgcgttccgtcattttgcggcccaccaaaacaacaaggaagctttcatgaaggagtcaaaagagtttgtgcgttacgcgagaggccacccactaattctcaagctattgggtgaagagcttcgtgagaaaagcctctcttactgggaagagaaactaaaatcactcccaaaaagtctcagccaaaatattcgagaccgtgtcttgcaggtaacttatgatgaactgagtcaagtgcaaaaggatgcgtttcttgacatagcttgtttcagatcccatgatttggtttatgtaaagagcttactggattcatctggtcccgccttttctaaagcgacagttacaatagacgctctcaaagacatgttcatgatttacatttctgatagtcgagtggagatgcatgatcttttgtatacgtttgccatggaacttggtccagaagccagggatgacgatggaagagggagacaccggatatggcatcatcacaaccaagataataaaggcaggctcaataggctgctaaaaagaccaggaggcagcaccagtgtgagaagttttttcctcgatatgtatgtcatgaagacggacgtgaccttaggcactgattacctcaagaacatgcgaaatctccggtacctcaagttttacagttctcattgtcctcaggaatgtacgcctaaggaaaacatacacatccctggagaacttgagcttccacttgaagaggtccgatgtttgcattggctaaatttccccaaagatgaacttccacaagatttcatccccaagaatctcgtagatcttaagctcccttacagtaagattagacagatttggagagaagagaaggatgcaccaaaactaaggtgggtcgatctcaatcactcaagtaagttggaaaacttgtcagggctatcacaggctctaaatcttgaaagattgaaccttgaaggttgcacagcactgaaaacgttgcttctgggtccggaaaatatggcaagtcttgttttcctgaatttgaaagggtgcacgggtcttgagtctcttcccaagattaatttgagatctctgaagactctcatcctcagcaactgttcaaacttggaggagttttgggtgatttcagaaactttatatacgctatatttggatggcactgcaataaaaacacttcctcaagacatggtaaagctaacaagcctcgtcaaattatacatgaaagactgcgagatgctcgttaagcttcccgaagaatttgacaagctgaaagttctgcaagaactagtatgctctggttgtaaaagactcagtagtctcccagatgtgatgaagaacatgcaatgcttgcagattttactgcttgatggaacagcaataacaaagattcctcatatatcctcacttgagcgtctatgcttaagcagaaacgagaagatcagttgtctttcgaatgatattcgtctgctttctcaactgaaatggctggacttgaagtactgtacgaaacttgtgtctattccagagcttccaacaaatcttcagtgcttagatgcaaacggatgtgaatcattaacaacagttgcgaatccactggctactcatttgccaacggagcagattcattccacattcattttcacaaactgcgacaaattagaccgtactgcaaaggagggttttgttccagaggctttgttcagcacttgcttccctgggtgtgaagtaccttcatggttttgtcatgaagcagttggatccgtcttaaagctcaacctgctcccacattggaacgaaaataggtttgtcggaatagctttatgtgctgttgtgggatccttaccaaattgccaagaacaaaccaactcttgttcagtgacatgcacgtttaacatagcaagtaaagattccaagaaaggggatccttacaaaatctcctttgatcgactggttgggcgttggaacaaacatggcaacaaactagacaagaaaggcaacaaactaaagaagacggaatcagatcatgtctttatctgctataccagatgctcaaacagcataaaatgtcttcaagaccagcactcaggtacatgtactccaaccgaagctttccttgaatttggtgtgacagataaggaatctcgactcgaggtgctcaagtgtgggttaagattggtatatgcatctgatgaaccccagaagacaaactcagatatggatctttcattatcatcatctgattcaactccgacaaggaacggcagttccaacactactacatctagtggaagtgtatctaccaataccattagagaagaagattccaatatcttacatgaagcacaatctcaaaatgggagaggactttga

SEQ ID NO: 1916 - DNA, 873 bp, Arabidopsis thaliana
atggtcggtatggatttgttcaaatgtgtaatgatgataatggtgttggttgtctcttgtggtgaagctgtttctggagctaagttcgatgagctttatcggtcaagctgggctatggatcattgtgtcaacgaaggcgaagtcacaaaactcaagcttgacaattactctggagctgggtttgaatcaagaagcaaatacttgtttggtaaagtctctatccagattaagcttgttgagggtgattcagcaggaacagtcactgctttctacatgtcttcagatggtccgaaccacaacgaattcgattttgagttcttagggaacactaccggcgagccttacatagtccagaccaatatctacgtgaacggagttggaaacagagaacaaagactcaacctttggttcgatcccaccactgagtttcacacttactcaatcctctggagtaaacgcagtgttgtattcatggtagacgaaacaccgattcgagttcagaagaatcttgaagagaaaggtatcccatttgctaaagatcaagcaatgggtgtttacagctccatttggaatgcagatgattgggctacacaaggaggtcttgttaaaactgattggagtcacgctcctttcgttgcttcttacaaagaattccaaatcgatgcatgtgagattccaacaactactgatctaagcaagtgtaatggagaccagaagttttggtgggatgaaccaactgtctctgagcttagccttcatcagaatcatcagcttatttgggttcgagctaatcatatgatttatgattattgttttgatgctactaggtttcctgttactcctcttgagtgccaacatcatcgtcatttgtag

SEQ ID NO: 1917 - DNA, 1839 bp, Arabidopsis thaliana
atggccggaggaatcgtctcaccggcctctctactcgacctaatcgctgatatcgtcgagattccactcaacaccggaatgttcaagaaggattgcgcagatctcactcgacgagtttgtctcttaacgcatttgttagaggagattagagactcaactcctatcgattccgccgcttcgtcgtcgtcggagaatgattggtggtctgatctcgtggtcggacttcaagccgcgaagcgtcttctctccacagctcgattccaagctcgcgattcctctgatggtgctgcgaagagaatctcatttcagttccaatgtgttacatggaagcttgagaaagcattgagcaatcttccatatgatctttatgatatctctgacgaagttggagaacaagtggagctagcgagatcacagttgcgaagagcaatgcagagatatggatcgttgaattcgaacaagttctcgagtgctttatctgagccaatggagagagatggttttagtaatgttataaagatcaaagctgaggaaaagcttgagagtgtttcagaaacacttcattttggtgaggaggaggagaaacaaagttcgccgcctctaaggagaagctcttccatttctttggcttattatttgtccaaagatgctgatactgatagattagacaaaatggttaacaagaacactgatgaatcgaagaaatctgataaactcacgattccggttgattttctttgtccggtgtcgcttgaactgatgaaggatcctgtcattgttgccacaggacagacttacgagagggcatacatacagagatggatcgactgtgggaatctaacatgtcctaagactcagcagaaactcgaaaactttacgcttacaccaaactatgttctcagaagtctcatctctcggtggtgcgctgaacacaacattgagcaacctgcaggttacattaacggcaggacaaaaaacagtggagatatgtcggtgatccgggccttggttcagagactctcaagccggtcaacagaggatcgaaggaatgcggtttctgaaatccgctctctgtcaaagagaagtacggataatcgcattctgattgcagaagcaggagcaatccctgttttggtgaatcttttaacctcagaggatgttgcaacgcaggaaaacgcaatcacatgtgttctcaacctctctatatatgaaaacaacaaagagctgataatgtttgctggtgcagtcacctcaattgttcaagtccttagagccggaaccatggaagcaagagaaaacgcagcagcgacactttttagcctgtcgttagccgatgagaacaagatcataataggcgggtcaggtgcgatacctgccttagttgatctgctcgagaacgggaccccgagagggaagaaagatgcagcaacggcattgttcaatctctgcatttatcatggaaacaaaggtagagcagtcagagccggtatagtaactgcattggttaagatgctcagtgattccacccgccaccggatggttgatgaagctttgacaattctctcagttcttgcaaataatcaagacgcgaaatccgcgatagtaaaagcgaatactctacccgcgttgataggtattctccaaacggatcaaactagaaaccgagagaacgcagcagcgatattgctttcgctgtgtaaaagagacactgagaaactgatcactatcggtagactcggtgcggttgtcccgttaatggatttatcgaagaatggaacagagagaggcaaaaggaaagccatatctttgttagagcttcttcgtaaagcatgccaataa

SEQ ID NO: 1918 - DNA, 1320 bp, Arabidopsis thaliana
atggatacgagtgaagcaaggaaccgtaaagttgttgcagttgaacaattcgatctcgaagtccctgagactgctcatcagattagcagcgattcatggtttcaggtagcttttgttctaacgaccggtataaacagtgcctatgtgttgggatattccgggacagtcatggttcctttgggttggattggtggtgtggttggtctcattcttgctaccgcaatctctctttacgcaaacactcttatcgccaaacttcatgagtttggtggcaaaagacacattcgttatagagatcttgcaggcttcatctatggtaaaaagatgtatcgtgttacatggggattgcaatatgtcaatcttttcatgattaattgtggcttcatcatacttgctggttcagccttaaaggctgtttatgtactttttagagatgatagtctcatgaaactgcctcacttcatcgccatcgcgggtgttgtatgcgcgattttcgcaatcggtattcctcatttatcagctcttggaatctggctaggagtttcaacaatcctcagcataatctacattattgttgcaatagttctatcagctaaagatggagtaaacaagcctgaaagagattacaacatacaaggatcatcaataaacaaactctttaccataacaggagcagctgcaaatctagttttcgcattcaacacgggaatgctcccggaaatacaggccacggtgaagcaaccggtcgttaaaaacatgatgaaggctctgtattttcaattcactgttggtgttttacctatgtacgcggttacattcatcggatattgggcttacgggtcctcgacatcgacttatctcttaaacagcgtcagtggacctgtttgggtcaaagcactcgctaacatttcagcttttctccaatctgttatctctttacatatttttgcaagtccgacttatgagtatatggacacaaagtatggagtcaaaggaagtccattggcaatgaagaatctgttgtttagaacagtagcaagaggaagctacattgcggtgagcactcttctctctgcgcttttaccgtttctcggagatttcatgagccttaccggagcgataagcacgttccctctcacattcatattagcgaatcacatgtatcttgttgctatgaatgatgagcttagtcttgtgcaaaagctatggcattggctcaatgtttgcttctttggattaatgtctcttgctgctgctattgctgctgttagactcatctctgttgactccaagaacttccatgtttttgctgatgtttga

SEQ ID NO: 1919 - DNA, 2676 bp, Arabidopsis thaliana
atgcaacgtttgttaacaccttgctcaaaaatcgcatacacaacaagatacattgcaaatccaaccctaccttacccaaacccatgtgatattttcatcaatcatcgtgggatcgataccaagaagactatttcaggcctactatatgattgtttcactagacaacgtttgactgctttcttggatagtaagagtttaaagcctggagacaggctttttgtcgagatcgacatggcaatcaaagcatgcggggttggtattgcggttttctctcctcgttactgtgactcttacttctgtctccatgaactcgcattgctcgtgaagaacaagaaaagagtcatccctatattttgcgatgtcaagccatcggaactctgcgtaaaagacgacaagacacgtccagctgccgagatccggaggtttcaattggctctcgaggaagcaaaatataccgtaggactcacgtttgatacatctaatgggtttgtgagatttgtaaacacgcctgcgattatcgaaagatttgcgactctggagaaagagattttgcagattgagaattctattcaagctaatgaaattgccaatgctgctgatgctctgcaattacaagacgggagtaattctggagatagcagtaatctaaagaagtcgaatgagtcctctaagaaggaatctgagaatggcaatgaggtggtaggagaggaaacctctaagattcaacttcaacgtcttcttgaaactagaagaacattgcttcgaagagagcaagcaatggcttatgcacgaggggttgttgctggttatgaaattgatagtattgatgatctcattttatttgctgatgctttcggggcttcaaggttaagagaagcatgcataatgtataaagaactatggaagaagaagcacggtgatgggctttggatggcggaattagcagctgtgaaagcgtgtgctccagtggacatgtcattgttgggttcctcaggcatcatcctcactaatgaaggtgctgctctatcactaaatgggacagactcaatgccatctaatacagatgacaagtcagttaatttagagcaacatccgtccggtgttccaaactttcaagcaccaatgggatggccaaaccatatgcctcaatacttttacccgtctccataccaaggctatccgtaccctcctatgcaacacatgccaaatcaaaaccaaggaaacatgccatggccttcaaggggcaaaacatccaagaaaaaagggaagggggattctgatggagatgagtctagtgaatcaagtgaatctagtgaatctgaatcggccagcgatgattctgcttcatctttggaagatcaaggtaaaagacactctcgtacaagtaaaaactcacgccgatcaaagaaaaaccggaagaagtcatctaaaactgttatcatccgtaatattaactatataaccccggagggaagaaatggagacatggagggaaatgagtttacggacaacggttccatcaaagagactgtagatgctgctgttggaatgctcaacgaaaaaagagctcatgagggagaagtttctggtgaagaaaaacgaagcaacgagaattgggattcatttcagaatattttgatgaggcacgatgatggctcagatgtgcattcaatggatgtcatcggtcaggagcatttcacacatagaggcgctagtgtgggtgcaaattctaatggcttgcaaacaaagaacactgcctcgggtgattccatcatcacaacgcataagtacatagaagatggaggagatagctttgatcattttgaaagtgaggatagtgctcgcaggcttccaagaacgagggactcgactgaagaatgtatgttactgcttaagagatcagaaatgttaggagatgaaagcaaagacatgtataatgctacaaggggtgaatcgttggtgaagaagtcagggagtggagaggattggtttactgcttcgggtaatcgtgctgggaaaccggaaatcaactacgggagaatgtcatttgatgacagcattttgacatctcaaggttctgataagagcaagaaacaagaattcgttgatgattctttcatggtccattcatcatcgcttgctgctgatgatctttatgactctcggtggagaccagacatggctgctgatattgttttagcctctgacgttgacaacgggcatgctaatgaaaaacacgattcatgggaaccaaatgatctttgtatgattcctgaacgcaattcaggagactctttggctaatgattattcgattgatttctctgctgaagcaaatgcaaggctatccagtaacggaacagctcaggagaaagaagataagagcggcgagaagaaaaacaatgtgaagaacccggaaactcgtaagtctaaaactccaagtagaaccagagcggaaacaatgtccaagactgcaaagaaaccaacagtagctagcagaacaatggcacagaagaacaagtttgaaaaggaagaagagatgcggaagagaatagaaaaccttgtaatggaaaggcaaaaaagaatcgcagagagatcagccatgactgcatctcgtaaagtttctctagacaaaggttcgagcagagctcctttggttcgcgaaagggctacataa

SEQ ID NO: 1920 - DNA, 1134 bp, Arabidopsis thaliana
atggcagatggtgaagacattcagcctctcgtctgtgacaatggaaccggaatggttaaggctggatttgctggagatgatgcaccaagagctgtattccctagcatcgttggtcgtcctcgacacactggtgtcatggttggtatgggacaaaaagatgcttacgttggtgatgaggctcagtctaagagaggtattttgacattgaaatatcctattgagcatggtattgttagcaactgggatgatatggagaagatttggcatcacactttctacaatgagctccgtgttgcacctgaagaacaccctgttcttctcactgaggctcctctcaaccccaaggccaatcgtgagaaaatgactcagattatgtttgaaactttcaacactcctgccatgtatgtcgctatccaagctgttctttccctctacgctagtggtcgtactactggtattgtgttggactctggagatggtgtgagtcacactgttccaatttatgaaggatatgctcttccacatgctattctgcgtttggaccttgcaggccgtgaccttactgattacctcatgaagatcttaaccgagcgtggttactcattcactacctcagcagagcgtgaaatcgtaagggatgtgaaagagaaacttgcttacatagcacttgactacgagcaagagatggaaacagcaaacacaagctcatccgttgagaagagctatgagttgcctgatggacaggtgatcaccattggaggagagagattccgctgcccggaggttctgttccaaccgtctttggtgggaatggaagctgctggtattcacgagaccacttacaattccatcatgaagtgtgatgtggatatcaggaaggatctgtatggaaacattgtgctcagtggtggaaccaccatgttccctggaattgctgataggatgagcaaagagatcactgctttggctccaagcagcatgaagattaaggtggttgctccaccagagaggaagtacagtgtctggattggaggctccattctagcatcactcagtaccttccaacagatgtggatagcaaaggccgagtatgatgagtcagggccatcaatagtccacaggaagtgcttctaa

SEQ ID NO: 1921 - DNA, 549 bp, Arabidopsis thaliana
atggcttcgtctctcaccactagattatcggcggtaatcggatctcgacggagttttccgatcgtcggagcgttttgcgttctgtcaactctctcaatctcttctctttcttcttcatctcccttcaaatcgggttgtgcacagtctttctctgttgttcctctcttaaggtctaagtttagcagtaaggctttttcttcgtcgatcagaatggaggagagcagcaaaactgtgcccagcattgttgtctatgtcactgttcctaacagagaagcagggaagaagttggctaacagcattgtccaggaaaagcttgcagcgtgtgtgaacattgtgcctggcattgaatcggtgtacgagtgggaggggaaggttcagagtgattcagaggagctcctgataatcaaaacaaggcaatcccttctagaacctctaaccgagcatgtcaatgcaaatcacgaatacgatgtgccagaagtaattgcgttgcccatcactggtgggagcgacaagtatttagaatggttgaaaaacagtacaaggaactga

SEQ ID NO: 1922 - DNA, 744 bp, Arabidopsis thaliana
atggcttcaagaaaacctgttaatcgcccatccgtgaggcacgcgagtcacaaccatccgctgcgtgtctttaaagctcgagacgaagatgaggtcgtttgctctggatgcgagctcgagctaaccggacaagctttcaagtgtatgaagtcagattgtgattacttcttgcacaagtcatgtttcgacctacctcgtgaaaccaatcacaagtctcacccaaaccactctttgaccctgcttcattccccaccgtacggtcagtcttacacatgcgacgcatgcggtgagtacggatctggtttcacttacaattgttctgaatgtcaatatgatgttcatgtcggatgtgcttttatccctgagaccgtggagcgcgaagatcacgaacacccactcacgcttctctacaacacaccatgcaaaggtcgtgaggacggtgctaagttcatatgtgatgtttgtgaagaaaaaatgtcggaaaatctttgggtttattactgcaaagagtgtgattatgggacgcatgtgcattcttgcgcggtctatgaagatcatgagtcagagaaaagaggaggaggtagggaagaaggagaagcgagctctgcggtttcaaggatgaaatcgttgatgaaggctcaagatgagatggcggcgttacagctcgaggcacgtattagaaacgacactaataatgctatactcgatttatgggatagtccaaagcggagatattattattga

SEQ ID NO: 1923 - DNA, 1182 bp, Arabidopsis thaliana
atgtcgtcgcgtttttctttgacggtggtgtgtttgattgctctgttaccgtttgttgttggtatacggttgattccggcgaggatcacgagtgtcggtgatggcggcggcggaggaggtaataatgggtttagtaaacttggtccgtttatggaagctccggagtatagaaacggcaaggagtgtgtatcttcatcagtgaacagagagaacttcgtgtcgtcttcttctagttctaatgatccttcgcttgttcacatcgctatgactttggactcagagtatctccgtggatcaatcgcagccgttcattctgttcttcgccacgcgtcttgtccagagaacgtcttcttccatttcatcgctgctgagtttgactctgcgagtcctcgtgttctgagtcaactcgtgaggtcgacttttccttcgttgaactttaaagtctacatttttagggaagatacggtgatcaatctcatatcttcttcgattagactagctttggagaatccgttgaactatgctcggaactatctcggagatattcttgatcgaagtgttgaacgagtcatttatcttgactcggatgttataactgtggatgatatcacaaagctttggaacacggttttgaccgggtcacgagtcatcggagctccggagtattgtcacgcgaacttcactcagtatttcacttccgggttctggtcagacccggctttaccgggtctaatctcgggtcaaaagccttgctatttcaacacaggagtgatggtgatggatcttgttagatggagagaagggaattacagagagaagttagagcaatggatgcaattgcagaagaagatgagaatctacgatcttggatcattaccaccgtttcttttggtgtttgcgggtaatgttgaagctattgatcatagatggaaccaacatggtttaggaggagacaatatacgaggaagttgtcggtcattgcatcctggtcctgtgagcttgttgcattggagtggtaaaggtaagccatgggttagacttgatgagaagaggccttgtccgttggatcatctttgggagccatatgatttgtataagcataagattgagagagctaaagatcagtctctgcttgggtttgcttctctgtcggagttgactgatgattcaagcttcttgtga

SEQ ID NO: 1924 - DNA, 900 bp, Arabidopsis thaliana
atggttcttcaaacactatcttcttcttctcctccaattcaccgtctctatcttcaccattctcagattctcccttcttctgggtcacccagcaagatttctcttcagaagaagattatgtggaatctgaacaagaacagagtcaaaatttacccttttattttgttcatgaacttgctaatcttcctccttgtttttgaacttgtggatgaaggcagatacatggaaggactttggccattcgatcttttcatgagcttgttgatggtttctgctcacccacagttggcagcagcagcagaaatcataaagcctgaaccgatttacgaagttggagagttatttgaacttagtattcagctttcttacttgctgttactactggggttgcttggagttggtactttctatgtgatccgtcaagtacttgtacgcagagaactagacctctccgctaaagaattgcaggagcaagtaaggagcggagatgcaagtgcaacagagctctttgagcttggtgcagtgatgttgagaaggaagttttatcctgcagccaacaagtttttgcaacaagctatccagaaatgggacggtgatgatcaagatcttgctcaggtctataacgctcttggagtgagttatgtacgagaggataaacttgacaaaggaattgctcagtttgaaatggcggtgaagctgcaacccggttatgtaacagcttggaacaaccttggggatgcttatgagaagaagaaggagttgcctttggcattgaatgcgtttgaagaagttttgttgtttgatccaaacaataaggtggctcggcctcggcgagatgcgttgaaggatcgcgtgaagctttataaaggtgttgtggctgttaagtctaagaaacggtga

SEQ ID NO: 1925 - DNA, 1191 bp, Arabidopsis thaliana
atgtcttgctccgtcgccgtatgtaattctccggtgttttcaccgtcgtcttctctattctgcaacaaatcttcgattctctcgtcaccgcaagaatctctttctctaacgctttctcatcgcaaacctcagacctcttctccttcctctccatccaccaccgtttcttctcctaaatctccatttcgtctccgtttccagaaacctccgtccggattcgctcctggtccattatcttttggatctgaatctgtttctgcatcctctcctccgggaggtgttttaaagaggaaacgacctacaaggcttgatataccgattggtgttgctggatttgtagctccgatttcttcatcggccgctgtggctgcgacgccgagagaggagtgtagagaggttgagagagaaggtgatggttattctgtttattgtaagagaggaagaagagaagctatggaggatcgtttctctgctatcaccaatcttcatggagatcgtaaacaggcgattttcggagtctatgatggtcatggaggagttaaagcggctgagtttgcagctaagaacttagataagaacattgtagaagaagtagttggtaagagagacgagtctgagatagctgaagcggtgaaacatggttacttggcaacagacgcgtcgtttcttaaggaggaagacgttaagggtggttcatgctgtgtcacggctctggttaacgaagggaaccttgttgtgtctaacgccggtgactgtcgtgctgttatgagtgtaggaggtgtagctaaggctttatcttctgatcaccgcccgtctagagacgatgaacggaaaagaattgaaaccacgggaggatatgttgatacgtttcacggtgtttggagaatccagggatctttagctgtgtcaagaggaattggagatgctcaacttaagaaatgggttatagctgaaccagagacaaagatttcgagaatcgagcatgaccatgagtttttgatcttggcatctgatggtttatgggataaagtgagtaaccaagaagcagtagacattgctcgtcctctctgcttaggaaccgagaagccattgttgttagctgcctgtaagaagcttgtcgatttatctgcttcacgaggctcgtctgatgatatcagtgtgatgttgatccctttacgccagttcatatag

SEQ ID NO: 1926 - DNA, 738 bp, Arabidopsis thaliana
atgaccacagaaaaagagaatgtcactacggccgtggccgtgaaagacggcggagaaaagagtaaggaagtgagtgacaagggcgtaaagaagagaaagaatgtaactaaggccctggccgtgaatgacggcggagaaaagagtaaggaagtgcgttacaggggtgtaaggaggagaccatgggggagatatgctgcggagatccgtgatccggtaaagaaaaaacgggtctggctcgggtccttcaacacgggggaggaagccgccagagcctacgactccgctgccataaggtttcgaggatcgaaagctactactaacttccctctaatcggatactatgggatttcttcggcgacgccggtgaacaacaacctttccgagacggtgagtgatggaaatgccaacctccctctcgttggagacgatgggaatgctttggcttctccggtgaacaacaccctttccgaaacggcgcgtgatggaacacttccatcggattgtcacgacatgttatctccgggggtggctgaagcggttgctggatttttcttagatctgcctgaagttattgcgttgaaagaggagcttgatcgagtttgtcctgaccagtttgagtccattgatatggggttgactattggtcctcaaaccgccgtggaagagcctgagacttcctccgccgtggattgtaagctgcgaatggaaccggatcttgacctcaacgcaagtccctaa

SEQ ID NO: 1927 - DNA, 1176 bp, Arabidopsis thaliana
atggacgtgcgtgaatcaatctcactgcaaaaccaagtctccatgaatctcgcaaaacacgtaatcaccaccgtctctcaaaactccaacgtcatcttctcaccggcttcaatcaacgtcgtactcagtataatcgccgctggatccgccggcgctaccaaagatcagatcctctcgtttctcaaattctcttccactgatcaacttaattcattctcttccgaaatcgtctccgctgttctcgctgacggtagtgctaacggtggtcctaagctctcggtggctaatggcgcctggatcgataagtctctctcctttaaaccttcctttaaacagctcttggaagattcgtataaagctgcttcgaatcaagctgattttcaatcgaaggctgtggaggtgattgctgaagtgaattcatgggctgaaaaggagacaaatggtctcatcactgaggttcttccagaaggatcagctgatagtatgaccaaactgatatttgcaaatgcattgtacttcaagggaacatggaacgagaaattcgatgagtcgttaacacaagaaggcgagtttcaccttcttgacggtaacaaagtgactgcaccattcatgaccagcaagaagaaacaatacgtaagtgcttacgatggtttcaaagttttgggacttccttacttacaaggacaggataagcgacaattctccatgtacttttatcttcccgatgcaaacaacggactgtctgatcttctggacaaaatagtttccactcctgggttcttagacaaccacatcccacgcagacaagttaaagtccgcgaattcaagattccaaagtttaaattctctttcgggttcgatgcttcaaatgttttaaaaggattgggactgacttcgcctttcagcggtgaagaaggtttaactgagatggttgaatctcctgagatggggaagaatctatgcgtatcgaacattttccataaagcgtgtatcgaagtgaatgaagaaggaacagaagctgcagctgcatcagctggagttataaagctaagaggattgcttatggaggaagatgaaatagattttgttgcagaccatccgtttctattggtggtcacagagaacataacaggagtggttctgttcattggccaagttgttgatccgttgcattaa

SEQ ID NO: 1928 - DNA, 1083 bp, Arabidopsis thaliana
atggcgaaatctccagaaacagagcatccgaacaaagtctttggttggggtgctagagacaaatccggtgttctctctccttttcacttctctagaagagacaatggtgaaaatgatgtgacagtgaagatcttgttctgtggagtttgccacactgatttacacaccatcaaaaacgactggggatactcgtattacccagtagttccagggcatgaaatcgttgggatcgctacaaaagttggtaagaacgtgactaaattcaaagaaggagatcgtgtcggagtaggagtgatcagtggctcgtgccaatcttgcgaatcttgtgaccaagatcttgaaaactactgtcctcaaatgtctttcacatacaatgcgattggatccgatggaaccaagaattacggtggctattcggagaacattgtggttgatcaacggtttgttttgcggtttccggagaatttaccgagcgattcgggtgcgccgttgctgtgtgctggaatcactgtgtatagtccaatgaagtattatggtatgactgaggcagggaagcatttaggggttgctggacttggtgggcttggtcatgttgctgttaagattggtaaagcttttggtttgaaagttactgtcattagttcttcttctacgaaagcagaggaagccattaatcatcttggtgctgattcgtttcttgtcacaactgatcctcagaaaatgaaggctgcaattggaacaatggactacattatcgatacgatatcagcagtacatgctctgtatccgttgctcggtttactcaaagtcaacggaaagctcattgctttaggcttacctgagaagcctctcgagctaccaatgttccctcttgttctcggaaggaaaatggttggaggaagtgacgtgggagggatgaaggagacacaagagatgcttgatttctgcgctaagcacaacattacagctgatattgaattgattaagatggatgagattaacactgcgatggagaggcttgctaagtctgatgttaggtacaggttcgtgatcgacgtggctaactccttgagccctccatga

SEQ ID NO: 1929 - DNA, 627 bp, Arabidopsis thaliana
atggagttctctaccgccgactttgaaaggcttatcatgttcgaacatgctcgcaaaaattctgaggctcagtacaagaacgatcctcttgattccgagaatctgctgaaatggggtggagctttacttgaactttcacagttccagcctattcctgaagctaagctcatgttaaatgatgctatttccaagttggaagaggccttgacaataaatccagggaagcatcaggctctttggtgtattgccaacgcgtacaccgcccacgcgttttatgttcacgatcctgaagaagcaaaagagcactttgataaagccactgaatatttccagagagcagaaaatgaggatccaggtaatgacacatatcgcaagtccttggattcctcactaaaggccccggaactgcatatgcagtttatgaatcaaggaatgggacagcaaatactaggtggaggaggaggaggaggtggaggaggaatggcttcatctaatcagagtagtaagaagaagaagaggaacactgaattcacttatgatgtatgcggttggataattctcgcttgtgggattgttgcttgggttggcatggcaaaatcccttggccctccacctcctgccagataa

SEQ ID NO: 1930 - DNA, 1140 bp, Arabidopsis thaliana
atgttaccctcaagaaaaactaagagagtcttctcctgtgactttactccgggaagaaaacgccgacgatgtgttgttgttccttcctctgtttctccggtaccggaaaacacaaccggagccgatttgctagattcaattccagacgatcttgttatctctatactttgtaaacttggctctacttctcgatgtcctgctgatttcatcaacgttttgctgacatgtaagagattaaaaggattagctatgaatcctattgtgttgtcgagattatctcctaaagctatcgctgttaaagctcataattggtcggaatattctcaccggtttttaaaaaggtgtgtcgacgccggaagtctcgaagcttgttacactctaggaatgattcggttttattgtttacaaaacagaggaaacggcgcgtcgttaatggctaaagccgcgattagttctcacgcgccggcgttatattccttagcagtgattcagttcaacggaagcggtggttcaaagaatgataaagatcttagagccggtgtggctttatgcgcgcgtgccgcttttcttggacacgtcgacgcgctacgtgagctaggtcactgtcttcaagatggttatggagttcctcaaaacgtctctgaaggtaggaggtttttagttcaagccaacgctcgtgaactcgccgccgttttatcttccggtatacaagctaggtcaacgtggctttctttatcacagccaccacctccggttgttcctaaccatggtcaacaaacttgtcctttgcttagtgattttggatgtaatgtaccggcaccggaaacacatcccgcgaataggtttttagcggattggttcgctgttcgcggcggagattgtcccggagatgggttgagattgtgttcacacgctggttgtggacgaccggagacgaggaagcatgagtttaggagatgttcggtttgtggcgttgttaattattgttcacgcgcttgtcaagctttagattggaaactccggcataaaatggattgtgctccggtgcaacggtggctagaggaaggtgacggtggtgaaggtaacgttcagattgacggaaatggtaacggtgataatgttttgcttccaatgagttaa

SEQ ID NO: 1931 - DNA, 1599 bp, Arabidopsis thaliana
atggagatgaagcagatgaagtttcttactcaccaagctttcttttcctctgttcgatcaggagatcttagtcaacttcaacagttagttgacaatttaaccggagatgagctaatcgatgagtcatcgccgtgttctgctgtggctgagcttatgtctgtgcaaaacgacgccggagagaccgccgtctatatctccgccgcagagaatcttgaagacatttttcgttacttgattaggttttctagtttggaaacagttaagatcagatccaaatccgacatgaacgcttttcatgtcgctgccaagcgaggtcacttgggaattgtgaaggagttactgagactatggccagagctttgcagaatctgcgacgcttccaacacgagtccgctttacgcagctgcggttcaagatcacttagaaatagtaaatgcaatgcttgatgttgatcctagctgtgcaatgattgtgagaaagaacgggaaaacatctttgcacactgcgggaaggtacgggcttcttcggatagtgaaagctctcatagagaaagacgcagcgattgttggtgttaaagataagaaaggtcagactgctcttcacatggctgttaaaggacgaagtttggaagtagtcgaagagattttgcaggctgattacacaatattgaatgagagagatcgaaaagggaacactgctttgcatattgctactcgaaaggcgcggccacagataacgagcttattgctgacctttacggcgattgaagtgaatgcgattaacaaccagaaagaaactgctatggatttggcggataagctgcaatatagcgaatctgctttggagatcaatgaggctttggtagaagctggggctaagcatgggaggttcattggtcgagaagatgaggcgagagcattgaagcgagcagtgagtgatatcaaacacgaggtgcaatcgcagcttttgcagaatgagaaaaccaaccgtcgtgtctctgggatcgcgaaagagctgaggaaactccacagagaagcggttcagaacacgactaactccataacggtagtggcggttctgtttgcttccatagcgttcttggccatattcaacttgccgggtcagtatttcacggaggggtcgcatgtgggacaagccaatattgcagggagaaccggattccgcgtgttctgtcttttaaacgcgacatctctgtttatatcgttagcggttgtggtagttcaaataactttggtggcgtgggacacacgggcgcagaagaaagttgtgtctgtagtgaataagctaatgtgggcagcttgtgcttgcacattcggagcatttttggcgattgcatttgcggttgttggaaaggggaactcgtggatggcgattaccataacgttgcttggagcaccgatcttggtagggacattggcaagtatgtgttatttcgtgtttcggcagcggtttaggagcggcaacgattcacagagaaggattaggagagggagtagtaagtcgttttcatggtcttactctcatcatgtatccgattttgaagatgaatcagatttcgagaagattattgctctttga

SEQ ID NO: 1932 - DNA, 1359 bp, Arabidopsis thaliana
atggcggctgctgtatcatctgtttgggcaaagcctggtgcttgggctcttgaagccgaggaacatgaagctgagctcaaacaacaaccctctcccaccaaccagaaatcctctgccgaagattcctccgatttcccttccttagccgctgcagcgaccaccaaaacgaagaagaagaagggccaaaccatctctcttgctgaattcgctacctacggtactgctaaggcaaagccggctccacagacggagcgtctcactcaggctgagctggtcgctcttccgaccggtccacgtgaacgctctgctgaggagcttgatagatctaagcttggaggtggtttccggagctatggtggtggtcgttatggagatgagtcgtccagctcgaggtggggttcgtctagggtttcggaggatggggaaaggagaggcggtggattcaaccgggatagggaacctagcagggattcgggtccgtcgcgtgcggatgaggatgataactgggccgccgccaagaaaccaattagcggaaacggattcgagagaagagagagaggcagcggcggaggattcttcgaatctcagtctcagtccaaggctgatgaagtcgatagctgggtctccactaagccatcggagccccggagattcgtttctagcaacggcggcggcggtgacagatttgagaaaaggggaagttttgaatccttgtctagaaaccgggattctcaatacggtggtggtggtggttctgaatcggatacctggggaagaagaagagaagaaagcggtgctgctaatggctcgccaccaccgagcggtggttcacgcccaagattggtgttacagccacgtacacttcccgtggccgttgtggaggtcgtgaagccggagagtccggtcttggtcattgtggagaaacctaaaggtgctaatccttttgggaacgcaagacctagagaggaagttctggctgagaaaggccaggattggaaagagattgacgagaagctcgaggctgaaaagcttaaggacattgctgcagccatggagaagcctaatgagaaatctacagggaagatgggctttggtcttggcaatggccgtaaagacgaggaacgtattgaaagaagttggaggaaaagcacggagcattctgaggaggatgctcaagaggaggaaccagctgtagaaggggcaaagaaggaagagactgaggacaaaccggctgtagaagaggctaagaaggaagaaactgagggtgaacaggctgtagaagaggctaagaaggaagagactggtggcgaaccggctgtagaagaggcaaagaaggaagagacggaggacaaaatctaa

SEQ ID NO: 1933 - DNA, 891 bp, Arabidopsis thaliana
atgctcagatccggtctggcttcgttaatcgtcgatgtcaatttgcggcgcacgttacgtccatccccaaccttttcttttccggcgcatcttagccgttgcattatcacttcccgttactcctcccgtacatctctaaggtttccgattcaaatatctcgccaccaacaccgtctatcctacttttcttcatcctcttcgtcggagcaaagcagaccaacttcctcttcccgaaacagtttcagtggtcacggtcagcttgatagtgatgataattcttcaccgcctccgtcgcaatcatcttccaaagttcttacattgcctaccgtattaacacttggtcgtgtcgccgccgtcccgcttctcgtcgcaaccttttacgttgatagttggtggggaacaactgctacaacaagcattttcattgcagcagccattacagactggcttgacggctatcttgcccgcaagatgaggttaggttctgcgtttggtgcctttttggatccagttgctgataagcttatggttgcagctacattgattttactgtgtacaaaacctatccaagttgctgaattaggaccacttccatggttattgaccgtaccttctattgcaatcattggtagggagattactatgtccgcagtaagagaatgggctgcatctcaaaatggaaagcttttagaggcagttgctgtaaataacttgggcaagtggaaaaccgccacgcagatgacagcactaaccatacttcttgcaagccgagatagcaatgttggatggctcgtagcttcaggtgctggcttgctttatgtatcagcaggactatctgtttggtctttagccgtttatatgaggaagatatggaaagtactaatgaagtag

SEQ ID NO: 1934 - DNA, 498 bp, Arabidopsis thaliana
atggaacttcaagtccttgttcttcgtccaatcttcttcttcttcttcttcgtcttcttgacaattctacaacaatcctcttctgctcgggttcttacaatcaccaagcctgatagacatgactacgccgcaagtgctcgttggcttgtctctcagaattcttggggtgttcttagcacactatccgttgatcataaaggcgctcccttcgggaatgttgtatcgtttagtgatggtttacccgagaaaggtaacggtataccttacttttacttaacaacacttgatccaactgcaagaaacgcacttaaagaccagagagcttcacttgcaattagtgaatctcctcttggaacttgtacaagagatccaatgaatcctacttgctctaaactaacccttaccgggaagttgctgatattggaaggaggatctgaggaagcagaagtagccaaaaaggctttattcacaaagcatccagagatgatgggtgattaa

SEQ ID NO: 1935 - DNA, 2265 bp, Arabidopsis thaliana
atggctgctaagagatctatctactgtcttcttcttcttcctctgctcttgtctttactgatctggattccttcgatctccttagctgctactaaccctgatgatgttgctgcaattaacggattattcgctgcacttggagcacctgttcttcctggttggattgcttctggtggagacccatgtggtgaagcttggcaaggcattatctgcaatgtttcagatattataagcataactgtaaatgctgcaaatttgcaaggagagcttggtgacaacttagctaagttcacttctatcaggggaatagatttcagcaacaatcgcattggaggaagcataccttctactttgccggttacattgcagcatttttttctttcagctaatcagttcaccggaagcatcccggaatctctaggaacattgagttttctgaatgacatgtctttgaacgataaccttctctctggagagctacccgacgtgtttcaaaaccttgtcgggctgattaatcttgatatatcatctaacaatataagcggcacattgcctccttctatggagaatttattaactcttacaacattaaacatagagaataacctcttctctggacccataccggacaaattactaagcattccgaaattcctacatgaaggaaacccgttcaatgccacaatgatcaattccacctcgactgcaccatcattgtctccgtctctatctccaacaaaaccagctccaacgcgaccattttctggagttccacctcctccaaatgagaggaatcgagggaaagttgctgatggaccttctgattcagaaggatcgagctctgagaattcaaagggaaagaactcttcacatactaaaaagataatccttattgcattcgctggcgtcctcgtcttcataattctggttttggcaatactcttgctgttgccaaaatgtgcaagacgtagagaacatgctaacagagttttcaaaccgcatcaagttggtgctgatagaggaagcagagagaatgctctggaaaacgggactccggtactgccaccacctggtcgatctgaaaaagttcaaagagaacccttcaagaaagctggagaggaaccaaaggtcttacatgaccttgagaggctgcggagacctgcacctatatcaagacaggaaagtcaagatattgacttttcaatgttgatgcctcctcctccaccacctccaccaccaccaccacctcctcctttggatgagaaggtcacggttatgccaatcatatcacccgaaagacccgttaagaaaacttcccctaaacgcttacccttaacttctgtgaagcactattctattgcttctcttcaacaatacacggaaagcttcgctcaggaaaatctcattggctcaggcatgctcggtagtgtttatagggcccggcttcccaatggaaagttgtttgctgtcaagaagttggacaagagggcttctgaacaacaacaggatcacgaatttatcgaactagtgaacaatatagatatgattcgccactccaatatcgttgaacttgtgggttactgtgctgagcacgatcaaagactattggtctacgaatattgcagtaacggtacgttacaagacgggttgcattcagacgatgaattcaagaagaaactttcgtggaatacccgtgtcagtatggcacttggagctgctagagcccttgagtacttgcatgaggtgtgtgaaccacctatcatacacagaaacttcaaatcagccaatgttctactcgacgatgacctgagtgttcttgtctcagattgtggtttggccccactaatatcatcaggctctgtgagtcagttatcagggcaattgctagccgcttacggatatggagctccagagttcgactctggaatctatacatggcagagtgatgtatatagttttggtgttgttatgttagaactattgacgggtagaatgtcctacgatagggaccggagtagaggagagcagttcttggtgaggtgggcaatcccacagcttcatgatatcgatgcattgggcaaaatggttgatccatctcttaatggacaataccctgcaaagtcattgtcacactttgctgatataatatcccggtgtgttcagtctgaaccagaatttagaccactgatgtcagaagttgttcaagatctactagatatgatcagaagagagcgtcatggttcgggtgattctaccgcggactag

SEQ ID NO: 1936 - DNA, 1275 bp, Arabidopsis thaliana
atgagagactcttcaacaactgcatccaccaaatcctcaccgttatggaaaccctttgcctcaaactgttgttccgttgatgaccaaaccgtctttggcaatctcagccgttgccgaccttcgagatcagaattctccaagaaccatctcggaccacttccttcttttcggcgactctcctttgctgatctaagccgttcttcttcggctaggatcaatgaagatcttgcacagactcttggagccgacttagtggattttcagatgtgtgaactcaagatgatcactcagagtttctccgggaactatcttctcggagaaggtgggttcggtaaagtgtataaaggttatgttgatgattatctccgacaaagtctcaaggctcagcctgttgctgtcaagctattggacattgaggggcttcaaggacatcgtgaatggctttctgaggtcatatttcttggacagctaaaacacccgaatttagtcaaacttattggttactgctgcgaagaagaggaacgagtactcatctacgagtttatgccacgtggtagcctagaaaatcacctcttcagacggatatcactatcgttgccgtgggcgacgcggctgaagatagcggtcgcagctgctaagggtttggcgtttttgcatgatttggagagtccaatcatttaccgtgatttcaaaacttctaatatactacttgattcggattttactgcaaaactctcagattttgggttggcaaaaatgggaccagaaggatccaaatctcatgtcacaactcgagtcatgggcacttatggttatgctgctcctgaatatgtttcaacagggcatttaacaacaaagagtgacgtgtatagttatggcgtcgttttactcgagctcctaacgggaagaagagccacagaaaagtcacggccaaaaaaccagcagaacatcatcgactggtcaaagccttatctaacaagcagccgccgactccgatgtgttatggacccgaggctcgctggacaatactccgtcaaggcggctaaagatacagctcttctagccttacaatgtgtgagcccaaaccctaaagaccggcccaaaatgcttgccgttgtggaagctctagagagtctcatacattataaggacatggcggtttcttctggtcattggccactgtctcctaaatctcagggcgggaaggtttccccgaaggttcgaggggatcatcggagtggtagaaaatcagctccgggttcgttaagatcgtga

SEQ ID NO: 1937 - DNA, 2067 bp, Arabidopsis thaliana
atggatggtgaggaacatcaaatagatggtgatgaagttaataaccatgagaacaagttgaatgaaaaaaagatgagctggagaacaacgatgagtttggcatttcagagcctaggagtggtgtatggagatatcgggacatcgccattatatgtgtatgcaagtactttcactgatggcatcaatgacaaagatgatgtcgttggtgttctctcgctcataatctacactattactctcgtagcgctcctcaaatacgttttcattgttcttcaggctaacgataacggtgaaggaggaacatttgcattgtactcactgatatgtcggtatgcgaaaatgggactaattccaaaccaagaaccagaagatgtagaactctccaactatacacttgaacttccaaccacacagctcagaagagcccatatgatcaaagagaagctcgagaactctaaattcgctaagatcattctcttcctagtcactattatgggaacttccatggtcattggtgatggaatccttactccttccatctcagacacggtggtgggtgtttcggttgcaatcttgattgttctattcgcatttcagcggtttggcaccgataaagttggattctcattcgccccgatcatcctcgtatggttcacatttctgatcggaattggtctctttaatctgttcaagcatgacattaccgtcttaaaggcacttaatccactctatatcatttactactttagaagaactggtagacagggttggatttccctcggaggtgttttcctctgcatcactgatccgttatactggccaacatttgtggtagcggtggcagcatcaatcatcgcgagccaagctatgatatcgggcgccttttcagtcatctcgcaatctctacgtatgggttgtttccctcgagtgaaggtggttcacacctcggctaagtacgagggacaagtctatatcccggagatcaactacttgctcatgcttgcatgcatcgctgttacccttgcctttagaactactgagaagattggtcacgcttatgggatcgccgttgtaaccgtcatggtcatcacaaccttaatggtgactctcataatgttggttatctggaagaccaatatagtgtggattgctatcttcttggtcgtctttggctccatagagatgttatacctatcttcggtcatgtacaagtttacaagcggtgggtatttaccacttacgataacggtcgttttgatggcgatgatggcgatttggcaatatgttcatgtcctcaaataccggtacgagctgagggagaagatctctcgtgaaaatgctatacaaatggctacaagtcctgacgtaaaccgggttccagggattggtcttttctacacggagcttgttaacggtataactccattgttctctcactatatatcaaatctttcgtccgtccactcggtgtttgtattgatatcgatcaagacacttcccgtgaaccgagtgacgtcatcagagcggttctttttccgttacgtggggccaaaggattccgggatgtttaggtgtgttgtgagatatggttacaaggaagacattgaggagcctgatgagttcgagcgtcattttgtttattacttaaaggaattcattcatcacgagcacttcatgtctggaggaggaggggaggtggacgagacggacaaagaagaggaaccaaatgctgagacaacagttgtgccttcgtctaattatgtcccttcatcggggcggatcgggtccgcccattcatcttcgtcagacaagattaggtcgggaagggtcgtgcaggttcaatccgtggaggatcaaacagagttggtggagaaagcgagagagaaagggatggtttatctaatgggagagaccgagattacggcagagaaagagtcttctttgtttaagaagtttatagtgaaccatgcttacaatttcttgaagaagaattgtcgggaaggagacaaagcacttgcgattcctaggtcgaagcttctcaaggttggcatgacctatgagttataa

SEQ ID NO: 1938 - DNA, 1062 bp, Arabidopsis thaliana
atggagaagaacgcatcgacttcgtcgttgaaggacttgggtccgagtggtctagatctaaccagcgcctttttcaaaccgatccacaactccgatccttctctcccttcaaaccgacgtaccaaagtctccgtcgtcggagtcggaaacgtcggaatggccatagctcaaaccatcctcactcaagatctcgcagacgagatcgctctcgttgacgccaaacccgataagcttcgtggcgaaatgcttgatctccaacacgccgctgctttcctccctcgaactaagatcaccgcttctgttgattacgaagtcaccgctggatctgatctttgtatcgtcactgctggtgctagacagaatccaggcgagtctagactcaatttgcttcagaggaacgtcgctctcttccgtcatatcattcctccactcgctaaagcttctcctgattctatattgatcattgtttctaatcccgttgatgttttgacttacgttgcttggaaactctctggctttccggtgaatcgggtgcttggatctggtactaatctcgattcttctcggttccgattcttaatcgcagatcatctcgacgttaatgctcaggatgtacaggcatttattgtgggagagcatggagacagctcagtggcattgtggtcaagcattagtgttggaggcattcctgtcttaagctttttggagaagaaccagatagcttacgagaaacaaactcttgaggatatccaccaagctgttgttggtagcgcctatgaagtgattggactcaagggttacacttcttgggccattggctactcagttgctaatctggctcgtactatcctccgtgaccagcgcaagatccacccggttactgttcttgctcgtggattttatggtgttgatggtggtgatgttttcctcagtcttccggctttgcttggaaggaatggtgtggttgctgtgaccaatgtgcatatgactgatgaagaggctgagaagctgcagaaatcggcaaagactatattggagatgcagagccaattgggactttga

SEQ ID NO: 1939 - DNA, 1254 bp, Arabidopsis thaliana
atggaggaagagaatgttactagttcaccttcaacaccggtacataggcttaggcatcgaagacgttctaatgaggttgttacggatggggataaagtgaatgcaagtcctttgttggttaatgatcggaataagtacaaatctttcatggtccggacctactctacgttatggatgattggtggttttgttttggttgtctacatgggtcatctttatatcacagctatggttgttgttattcaaatatttatggctaaagagttgtttaatctgctgaggaaagctcctgaggataaatgtctcccctatattaaacagctcaattggcacttctttttcactgccatgcttttcgtttatggacggatccttagtcaacggttagccaataccatgactgcagatcagttcttctatcggctagtcagcggcttaatcaaataccatatggcaatctgttacttgttgtatattataggtttcatgtggttcattctcacattaaagaagaagatgtacaagtaccagtttggccagtatgcttggacccacatgatcttgatagtcgtgtttactcaatcgtcgttcactgttgccaacatatttgaagggatcttctggtttcttctcccagcatctttaattataatcaacgacatcttcgcctacattttcggtttcttctttggaagaacgcctttaataaagctgtctccaaagaaaacatgggagggattcatcggagcctctgtgacaactatcatctctgcatttgttctggcaaatattttgggtcgtttcccttggttgacatgcccacgacaggatttgtccactggctggctacagtgtgacgctgatccattgttcaaacctgaaccttttgctttacctgcatggattccagaatgggaaatgacgatcctccctgttcagtggcatgctttatgcctcggtttgttcgcttcaatcatagcaccttttggaggatttttcgctagcggtttcaaaagagcattcaaaattaaggactttggtgatagtattccaggacatggtggaatcacagatagaatggactgccagatggttatggcagtatttgcctacatatatcttcaatcatttattgtctcccaaagcgtttcggttgacaaaatcctagaccagatattgacgaaccttacctttgaggaacaacaagcgctcttcgtgaagttaggacaaatgctgaaggacaagctctcatag

SEQ ID NO: 1940 - DNA, 2970 bp, Arabidopsis thaliana
atgatcggcggtggtagggtttattgggggaagaagttagataaagagatggaagatgcggcggttgttgacggtggtggatctaacggtgttgttgtgatctttgtttggagctcgattaacgagaaccagcttatgaatttcgttgatctttattcttctcttggttggaattctcttgtttgccgcgctgattttctcaccgcggtttatcctgaaatggctctttctttagcattccatcttctttctgaacttgttgaggagttaaagagtagaccatgtcctgttatctttctagctttctctggtgctcctaaagcttgtatgtataaagttctacaggtgatcatggatgattgtgaagctcaaattcatccggatgatagccagttggttagaacctgtctttctggacatgtctatgactctggcccgttggattttacgagtgatttgaatgtgaaattcgcactacatcccaccatacgacgaatgtctggtccttctagactagtatcttgggtggctaaagggatttcttccgggcttgatggtttatatcttacaagatttgaatcccaacgtagtgagtactggcaggccctctactcatcggttaatgatgaacttgctcctctacaagtaatttcaagctttacccatcaattgcaggaactgggaggagaagttaaggttgtcaagtggaaaaattctcctcatgcaggacactacgcacataaccctatacaataccgggctgttatctccaactttctggagaaagccatatcagttcacttacataaaatccggcagctcggagaaagagctcacacgcatgatgaaatctctgagttaatatgcgaccttcagaaagttgctgtgaactctaaccaaagcctaagaagagtagccactgggccatgtgaccactttttcttacctagctcagcaccgtatcaaagcaacagcaacaacagcgatccatcatcttcacaagaagaacagagagaaagatcgtccttccgcccactccaaccaacgagcataaacgctcacagcgtactcgggcaattcctattcgactcatgtgttccaaagaacatcgaaggatgggatatcagatttgcgggttgtctcaacggtcaaccatatgccacgtcctcctcccaaacgctttttccgttcaagactatgaatgaaatcgcagaaactgagcaagagaaaatgtcttctctaatggccattcgttgcgcacgaacccagaatatcgtcacaatcggctctctccttcagttacgttcttcatttcccagactctcctctcaattccacttctccggtaccctaaactcaattccgatcaaacacctaagcacatccgccgccgcaaacgattaccaccagaatcctcaatctggatcaccgtctcagcatcaacgcccatatccacctcaaagcttcgattctcagaatcagaccaacactaatcaacgagttccacaaagccctaatcaatggtctactcaacacggtggtcaaatacctcaatacggtggtcaaaatcctcaacacgggggtcaaaggcctccatacggtggtcaaaatcctcaacaaggtggtcaaatgtctcaatacggtggtcacaatcctcaacacggtggtcacaggcctcagtacggtggtcagaggcctcaatacggtggacctggtaacaattatcagaatcagaatgttcaacaaagtaatcagagtcagtactacactccgcagcagcagcaacaaccgcaaccaccacgaagctcgaatcaaagccctaatcagatgaatgaggtagctcctcctcctagtgttgaagaggtgatgaggttatgtcagcgtaggctatataaagatgctattgaattgcttgataaaggagctatgcctgatagagaatgtttcgttttgttgtttgagtcttgtgcgaatttgaagtcgcttgagcattctaagaaggtacatgatcatttccttcagtctaagtttagaggtgatccaaaacttaacaatatggtgattagtatgtttggagagtgtagtagtattactgatgctaagagagtgtttgatcatatggttgataaagatatggattcttggcatttgatgatgtgtgcgtatagtgataacggaatgggagatgatgcgttgcatttgttcgaagagatgacgaaacatgggttgaagccgaacgaggagactttccttacggtcttcttggcttgtgctactgttggtggtatagaagaagcgtttttgcattttgattcgatgaagaacgagcatgggattagtccgaagacagagcattatttgggtgttttaggtgttcttgggaaatgtggacatcttgttgaggctgagcaatatatccgtgatcttccgtttgaacccacagctgatttctgggaggctatgcggaactatgctcggttacatggtgatatcgatttagaggattacatggaggaattgatggttgatgttgatccttcaaaggctgtaatcaacaaaattcctactcctccacctaaatcattcaaggaaacaaatatggttactagtaagagtaggatccttgagtttcgaaatctgactttctacaaggatgaagcaaaggagatggctgcaaagaaaggagtggtttatgttcctgacacacggtttgtgcttcatgatatcgatcaagaggctaaagaacaggcactactctaccacagtgagaggttagcgattgcttatggtatcatatgcaccccaccaaggaagaccctaacaatcatcaagaatctccgtgtgtgtggggattgtcacaactttatcaagatcatgtccaaaatcattggtagggtgttgatcgtgagagacaacaaacgtttccatcacttcaaagacggtaaatgttcttgcggggattactggtag

SEQ ID NO: 1941 - DNA, 750 bp, Arabidopsis thaliana
atggctaaaacctctcttcctctcgccgcctccttcctcctcctcatctccttctcctccgccgtagacacttcccgtctcttcctcaccgtcgtcaacaactgtcccttcactgtctggccagccattcaacccaacgccggccaccccgtcctagagaaaggtggcttcgctctcccaactttcactcaccgctccttcaacgttccaaccacacactggtccggtcgcatctgggccagaacctggtgtgcccactacaacggaaaattctcctgcctcaccggagactgcggaaaccgcctggaatgcaacggtctcggcggggcaccaccagcttctctagctcagttcgacctccaccacggtggtcaccacgacttctcctcttacggtgtctctctcgttgacggttacaatgttccgatgaccgtgactcctcacgaaggccatggtgtctgtcctgtcgttggttgtcgtgaagatctaataaaaacgtgtccggctcatcttcaggtccggtcacacagtggacacgtggtggcttgtaagagtgggtgtgaggctttccatacagacgagctgtgttgtcgtggtcattacaatagccctaacacgtgtaaagcttcgagccattcgctgttctttaagcatgcgtgtccttcgagtttcacttttgctcatgatagtccttcgcttatgcatgactgtgcttctcctagagagctcaaagtcatcttctgccactaa

SEQ ID NO: 1942 - DNA, 1584 bp, Arabidopsis thaliana
atggagaaattgctcgtgatctctttgctactactgatctcaacatcagttacaacttcacaatccgtgaccgatccaatagctttcctccgatgtctcgatagacaaccaacggacccaacaagtcctaactccgccgttgcttacatcccaacaaactcttctttcaccactgtcctccgcagccgtatacctaacctccgtttcgacaaacccactactccaaaacccatctccgtggtggctgccgccacgtggacacacatacaagctgctgtaggatgcgcacgtgagctctctctccaagtcaggatcagaagtggtggccacgacttcgaaggactctcttacacttccaccgtccctttctttgttctcgacatgttcggttttaaaaccgtggacgtaaatctcaccgagagaacggcttgggttgattctggtgctaccctcggagagctttactatagaatctctgagaagagcaatgttcttggatttccggcgggtttgtctaccacattgggcgttggtggacactttagcggcggaggatacggtaatctgatgagaaagtatggtttgtcggtggataacgttttcggctccgggatcgttgattcgaacggaaatatcttcaccgatcgggtttcgatgggggaagaccgtttttgggcgattcgtggaggtggtgcagcgagctacggtgttgtcctcggctacaagatccagctagtaccggtgcctgagaaagttacggtttttaaagtcggaaaaactgtcggagaaggagccgttgatcttataatgaagtggcagagttttgctcatagtacggatcggaatttgttcgtgaggttaactttgactttagtcaacggtacgaagcctggtgagaatacggttttagcgactttcattgggatgtatttaggccggtcggataagctgttgaccgtgatgaaccgggatttcccggagttgaagctgaagaaaaccgattgtaccgagatgagatggatcgattcggttctgttttgggacgattatccggttggtacaccgacttctgtgctactaaatccgctagtcgcaaaaaagttgttcatgaaacgaaaatcggactacgtgaagcgtctgatttcgagaaccgatctcggtttgatactcaagaaattggtagaggttgagaaagttaaaatgaattggaatccgtatggaggaaggatgggtgagatcccgagttcgaggacaccattcccacatagagcaggcaatttgttcaacattgagtatatcatagactggtcagaagctggagataatgtggagaagaaatatttggcactcgcgaatgaattttatagattcatgaccccgtacgtgtctagtaatccgagggaggcgtttttgaattaccgtgatcttgacatagggtcaagtgttaagtctacgtaccaggaaggtaaaatctacggggctaaatatttcaaggagaatttcgagagattagtggatattaaaaccacgattgatgcggaaaacttttggaaaaacgaacaaagcattccggttagaagataa

SEQ ID NO: 1943 - DNA, 1401 bp, Arabidopsis thaliana
atggcttcaaagtcggatgtgaatataatagagacatcctcaaaggttcatttctcaggatttcatcaaatggatggtttagcttcaaatagaccagagcaaatggctgaggaagaagaacatggtcaaccttttgtgatcggagttgctggaggtgcagcatccgggaaaacaactgtctgtgatatgattatgcagcaactgcatgatcagagagctgttgttgtaaatcaggattctttctaccataatgtaaatgaagtggagcttgtaagagttcatgattacaattttgaccatcctgacgctttcgatactgagcaattattgtcttccatggagaagttaagaaaaggacaagcagtagatattcctaattatgacttcaaaagttacaagaacaatgtttttccacctagaagggtgaatccttctgacgttataattctggaaggtatactcattttccatgaccctcgggtgcgagatttgatgaacatgaagatatttgtagacgcagatgccgatgtgcgtctagcgagaaggataaaacgcgatactgttgagaagggcagagatattgccactgttcttgaccagtactcaaagtttgtgaagccagcatttgaggatttcatactcccaacaaagaaatacgcagatataataattccccgaggtggtgataaccatgttgctattgatttgattgtgcaacacatccatacgaagctcggtcaacatgatctctgtaaaatttatccaaatctttatgttattcaatcaacttttcagatacgtggtatgcacactctaatccgcgactctaaaacaacaaagcatgactttatcttctactccgatcgattgatacgtttggtcgttgaacatggcctcggacaccttccctttacagaaaagcaagtggttactccaacaggatctgtgtattcgggtgtggacttctgtaagaaactgtgtggtgtctcagttatcagaagcggtgagagtatggagaacgctcttagagcatgctgcaaaggcatcaaaattgggaagattctgattcatagagaaggcgacaatggtcaacagcttatctacgagaagctaccctcagacatttcagaaaggcatgtgcttttactggatccaatcctcgggacaggaaactcggcggtgcaagcgataagactgctcataagtaaaggcgtgcctgaatccaacatcatatttctcaatttgatatctgcacctgaaggagtaaatgtggtgtgcaaaaagttcccaaggataaagattgtgacttcagagatagaactcggtttaaacgacgagttccgagttgttcctggtatgggcgagtttggagaccgctattttggaaccgatgatgagtga

SEQ ID NO: 1944 - DNA, 600 bp, Arabidopsis thaliana
tggagcagtcagaagagggtcaacagcaacagcaacagggagtgatggattatgtacctcctcatgcttatcagagtgggccagtaaatgcagcttcccatatggcattccaacaagctcaccacttccaccaccaccatcagcagcaacaacagcagcagcttcagatgttctgggctaaccaaatgcaagagatcgagcataccactgatttcaagaaccacacccttcccctagcccgcatcaagaagatcatgaaagctgatgaagatgtgaggatgatctctgcggaggctcctgtgatttttgccaaggcctgtgagatgttcattttggagctcactctacgtgcttggatccacaccgaggagaacaagaggaggaccttgcagaagaacgacatcgccgctgccatttccaggaccgacgtgtttgatttccttgtggacataatcccgagggacgagctgaaagaagaaggtttaggcgtgaccaaagggaccataccatcggtggtgggttccccgccatactattacttgcaacaacaggggatgatgcaacactggccccaggagcaacaccctgatgagtcttaaa

SEQ ID NO: 1945 - DNA, 1581 bp, Arabidopsis thaliana
atggcggtttatcctaacgttaatggcgataagaagcactggtggttcactcacagaaagcttgttgataagtatataaaggatgcaacaactttaatggcaagtgaggaggcaaacgacgtcgcttcagctcttcatttactagacgcagccttatctatctccccgcgtttggaaactgcgttagagctcaaggctagatctctcctcttcctccgtcgtttcaaggatgtcgccgatatgcttcaggattatatccccagtcttaaactcgacgacgaaggatccgcttcttctcaaggctcttcttcctccgacggtatcaaccttctctccgacgcctcttcccctggctcctttaaatgcttctctgtttccgacttgaagaagaaagtcatggcaggcatttgtaaaaaatgcgacaaagaagggcaatggaggtatgtggtgttgggtcaagcttgttgccatctaggactaatggaggatgccatggttctcctacaaaccggtaaacgcctcgcctccgccgagttccgtcgccggagtatttgctggtccgacgatagcttccttctcctctccgaatcctcctctgcttcttctccaccacccgagagcgagaacttcacccatctcctcgctcacatcaagcttcttctccgtcgtcgcgccgctgcaatcgccgctctcgacgctggactgttctccgagtcgatccgtcacttctccaagatcgtcgatggccgtcgccctgcgcctcaaggattcctcgccgaatgctacatgcatcgagccgccgcttatagatccgccggtagaatcgcggaagcgatcgccgattgcaataaaaccctagctcttgaaccctcgtgtatccaggcgttagaaaccagagccgcgcttctagaaacggtcaggtgttttccagattcgcttcacgatctagaacacttgaagcttctctacaacaccattttacgcgatcggaagcttccgggtccggtgtggaagcggcacaacgtgaaatacagagagattcctgggaaattgtgcgttttgacaacgaaaacgcagaaacttaagcagaaaatcgcaaacggagaaactgggaatgtcgattattacggcttgatcggagtcagacgcggatgcaccagatcggagctcgatcgagctcatctattgctatgtctcagatacaaacccgatagagcctcttctttcatcgaacggtgcgagttcaccgatcaaaacgacgtcgattcggttagagatcgagccaaaatgtcgtctctgttgctttaccgtttgattcagaaaggatacaccgccgtgacagcgatcatagccgaggagcagaggaagaacgccattgctcacgctcaaaagattgaagaacgcaaaccggttgaaaaatccggttctattaagagaaccggaaacgctgaaacgaaaccggtaaattccaatgcgtaccaaggagtattctgtagagatctcgctgcggttgggaatctactaaccagggctggtttcaaccatccaatcccggttaaatacgaagcgctcacctgctaa

SEQ ID NO: 1946 - DNA, 816 bp, Arabidopsis thaliana
atgggtctactgtcacttgaagacaccataaaagagaagctaaaggaccgcaaaaacgctcacttcatgttggttgacggaatgtctaagctactgacggaaaaagttaagaattgtcagtcattggatttccaagtttctggtgtcaaatggaggttggttatacgcttatctaggggaagaaaagaccatctatcttttgttctggagatcacagatgaaaagtgtaccgggtctacttgggacgtcaaattcaacttcaaaatcggcatagtccctcagactggaccagattattgcttcgttttggtggggcatcaaaacgaaaaaaaacgtagtcaagggttagccaacttcatatcacacacggatttgaaggagaggtttcttgtgaacgacaaagcggggttctatgccgagataagcgatgtccaaccaaacttccccgttacccgtatccctcgaacaatggggacagcagaacgctttaaactgatagagttttctccgaaaaactccagattcacctggaagatcacgcagttttcctccttcgatggtgaagagcattcttcttacgagttcacggttggaccacggagatggaaactagtaatgtacccaaaaggaaacggagatggaaaaggaaattcgttgtctttgtatttgtttgcatccgattacgtcaccaatggtcctaagggtggaacattggccatctataaattgagagtgttggaccaactcaatcgcaatcactgtgaaactggtatgtgtatatatacacttaattcactaatttatacttttttctaa

SEQ ID NO: 1947 - DNA, 723 bp, Arabidopsis thaliana
atggacgtctacggcatgtcttcaccggacttgcttcgtatcgacgaccttctcgatttctccaacgacgaaatcttctcttcctcttccaccgtcacttcctccgccgcttcctccgccgcttcttccgaaaaccctttcagctttccttcttccacctacacttctcctactctcctcaccgacttcactcacgatctctgcgttcccagtgacgacgcagctcatctcgaatggttatcgcgattcgttgacgattcattctccgatttcccagcaaatcctttaaccatgaccgttagacccgagatttcattcaccggaaaacctagaagtcgccgatcaagagcaccagcaccttccgtagctggaacttgggctccgatgtctgaatcagagctttgtcactccgtcgctaaacctaaaccgaagaaagtctacaacgctgaatcggttacggcggatggagcgaggcggtgcacgcactgtgcctcggagaaaacgccacagtggagaactggaccgcttggacctaaaacactttgtaacgcttgtggagttcgttacaaatcagggaggcttgtaccggaatacagaccggcgtcgagtccgacgtttgtattgactcagcattcgaactctcatcggaaagttatggagctccggcgacagaaggaacaacaagaatcttgcgttcgaattccgccgtttcagccgcagtaa

SEQ ID NO: 1948 - DNA, 1965 bp, Arabidopsis thaliana
atgggtaacggaatcgggaagctaagtaaatgtttgaccggaggtgctggtcggaacaaaaaacccgagttatcaattctcgaaccagatcctttagacgaagggttaggacactctttctgttacgtcagaccagacccgacacgagtttcgtcttcaaaagttcactcagaagaagaaacgacgacgttccgtacaatctccggcgcttccgttagtgctaacaccgccacaccactctctacttctctctatgatccttacggacatatcgatagagccgccgcgttcgaaagcacgacgtcgttttcgtcgattcctttgcaaccgattccgagaagttccggtccgattgtacccggttcgggtcctttagaaagagggtttttatccggtccgattgaaagaggtttcatgtccggtccacttgatggttcttccggtccgattgatggtaaaaccggttctgatcaatttcagagaagtttctctcatggtttagctaatctccgggtcgggtcgagaaaaggatctttagttcgggttctccgtcgtgcaatttcgaagacgattactagaggacagaactctattgttgctccgatcaaaccggttaaagagcccgattgggtattcgggtcggataaaacccggatccatcagatcgagaataatctcactgttaatagcttgaattttagtagtgaaggaagtttactagacgacgacgtttcgttagagagccagaatcttcaatgggcacaaggtaaagccggtgaggatcgtgtacatgtggttgtatcggaagaacatggatggcttttcgttggaatctacgatggattcaacggtccagatgcgccggactatttactctctcatttatatccagccgttcatcgtgagcttaaaggattgttatgggacgatcccaaaacagatgcaaaatcttccgatgaagctgatgtagagaatcgtgactcgagttctgagaaaaagtcaaagaattgggaagaaagtcaacgacggtggagatgtgaatgggatcgagatcttgaccgtttactgaaagatcggagtaatgggttggatctagatccggatccgaattcgtctgatgtactgaaagctttgtcacaagctttgaggaagacggaagaagcttatttggagaatgcagatatgatgctcgacgaaaatcctgaactagctttaatgggttcttgtgttttggtaatgttgatgaaaggtgaagatgtttatttgatgaatgttggtgatagtagagctgttcttgggcaaaaagctgagagtgattattggattgggaagattaaacaagatttggaacgtatcaatgaagaaactatgaatgattttgatggttgtggtgatggtgaaggagctagtttggttccgactttatcagcttttcagcttactgttgatcatagcactaatgtagaagaggaagttaatagaattcgaaaggagcatcctgatgatgcgagcgcggtttcgaatgaacgggttaaaggttcgttgaaggtcactagagctttcggtgcgggtttccttaagcagcctaaatggaataacgcgcttctagagatgtttcaaatcgattacaaagggacgtcaccatacatcaattgtttgccatcactttaccatcatagattaggctcgaaagaccagtttctgatactatcatcggatggtctttaccaatatttcacaaacgaagaagcggtttcagaggttgaactattcatcacgttacagccggaaggtgacccggctcagcacttggttcaagagcttcttttccgtgctgctaagaaagctggtatggatttccatgaactgcttgagataccacaaggggaacggagacggtaccacgatgatgtttccattgtagtgatctctttagaaggaagaatgtggaaatcttgtgtataa

SEQ ID NO: 1949 - DNA, 1482 bp, Arabidopsis thaliana
atgggtagagattttctagttctaagtattctcattctacttctctctgggattgtatcttcagctccttcagctaattctcctgcaactattgcaacgagatcgatggtgaaattcgaaaatgggtatagtgtagagactgtgtttgatggaagtaaacttggtattgaaccgtattctattgaagtcttaccaaacggagagttacttattcttgattctgagaacagtaacatctacaagatctcatcttctctttcattatatagcaggccaagactggttactggctcccctgaaggatatccaggtcatgttgacgggagattacgtgatgcgaagctgaaccatcctaaggggcttacggttgatgacagaggaaatatatatgtggctgatactgtgaataatgctatccggaagataagtgaaggaggagttacaactattgccgggggcaaaacggttcgaaatggagggcatgtggatggaccaagtgaagatgcaaagttttcaaatgattttgatgttgtttatgttggaagtagttgttctctgcttgttattgaccgtggaaacaaagctatcagagagattcaactccatttcgatgactgtgcttatcagtatggaagcgggtttcctcttggtaaacttacaaaagtaccaaacttttttttatggattgctgttcttgttgctgcaggtttctttggttatatgctagctctgttgcaacgaagagtcggctctatcgtgtcttctcataatgatcaagaaatgttcgaagctgatcctgatcaaaagcctatgaaacattccagaccatctctgattccggctggagacgagcagctagagaaacaagaggaaacatttgtggtatcgctgggaaaactcgtttcaaatgcttgggagtcagttatggagatccttagaaaaaagcagacaggcaccagctttcagcagtaccatgggacaacaaagcagtctgctgcatttagcacatcaactccatggccaattcaagagagctttgtgattcgagacgaagacggacctcctcctgttgagcccaggaacccaactccaagaaagacttatgcttttatgtccaaagatgcagagaaaatgcagcagctacgtcagagccgcgcattctacagtagctgggacgctgagttccccaaccagcagcaacagcagcaaaagcagcaccagaagcatcagcatcagcaacaacagcagcagcagcatcgaaggcattactcatcgatcccgcatacttattatgagcaggacagtgaaaagtctaatgagatagtctttggagcggtccaagaacagagcagcaagcgtgtggctaagcctaagccgaagcctatagagtctggagatcaaatgaataataatactcaacagaatcttcactacagatctcattctgttagttacccatatggatactatcctaatacatga

SEQ ID NO: 1950 - DNA, 792 bp, Arabidopsis thaliana
atggttcagtgtagcaacaatctcctcggaatcctcaatttcttcacattcctcctctcaatcccaattctctccgccgggatctggctcggcaaaaatgcagcaaccgaatgcgaacgtttcctcgacaaaccaatggtcgtactcggaatcttcctcatgttcgtctcaatcgccggactcgtcggtgcttgttgccgtgtctcttgcctcctctggctttacctcttcgctatgttcctcctcattctcctcggcttctgtttcacaatcttcgctttcgcagtcacaaaccgcggcgccggtgaggttatatcggatcgagggtataaagagtatcatgtcgccgattactctaattggttgcagaaacgtgtcaacaatgctaagaattgggaacggatcaggagttgtttgatgtactctgacgtttgctccacttatcgtactcgttatgccagcattaacgttgaagatttctacaaatctaatcttaatgctcttcagtctggttgttgtaagccgtccaatgactgtaacttcacctatgtgaacccgactacttggacaaagactcctggtccatacaaaaacgaggactgtaatgtgtgggacaacaaaccaggaactctctgctacgactgtgaagcctgcaaggctggtctgcttgacaacatcaagaactcatggaaaaaggtggctaaggtcaacattgtcttcctcatattcctcattatcgtctactctgttggttgttgtgcgttcaggaacaacaggaaacgcagttggtaa

SEQ ID NO: 1951 - DNA, 798 bp, Arabidopsis thaliana
atgctgcaaggctttctcttcctcctctcagtcgtactcctcttctcctcatctgcagccgcctgcgaccgatgtcttcacagttctaaggcagcttatttctcctctgcatctgctctctcctctggagcttgtgcatatggctctatggctaccggtttcttcgccggacacattgctgcggctctgccttccatctacaaagacggctccggctgcggagcttgcttccaggtcagatgcaagaacccgacgctttgcagcagcaaaggaaccacggtgattgtcacagacttgaacaagaccaaccaaaccgatcttgtccttagcagcagagcctttagggccatggctaagcctgttgttggcgccgacagagatcttctcaaacaaggcattgtcgatattgaatacaggagagttccttgcgattacggtaacaagaagatgaacgtgagagttgaagaatcaagcaaaaatccaaactacttggcgataaagctcttgtaccaaggaggccaaactgaagtggtagccatttacattgctcaggttggttcgtcacattggagttacatgaccagaagccacggagccgtgtgggttactgacaaagtacccaacggagctctgcagttcaggttcgtggtgaccgcaggctacgacggcaaaatggtctggtcgcagagggtccttccagctaactgggaagctggaaagtcctatgacgccggcgttcagatcacagacattgctcaggaaggttgtgatccatgcgacgatcacatctggaactga

SEQ ID NO: 1952 - DNA, 558 bp, Arabidopsis thaliana
atggcaacagaaggaaaaaaccccatcaacatgaactctatgtcttcaagtcttgcaagaaccggtcaatgggttttttctcaagatattccgaccgatgttgttgttgaagtcggagaagccaatttctctcttcataagttcatgttagtggctaagagtaactacataaggaagctaataatggaatccaaagatagcgacgtgacaagaatcaatctctcggatatacccggaggtcctgagatatttgagaaagctgccaagttctgttacggtgttaacttcgagatcaccgttcagaacgtggcggctcttcattgcgcagccgagtttcttcagatgaccgataagtactgcgacaacaaccttgctggtcggacacaagacttcctttctcaagtagctctctctagcctctctggagctatcgttgtcctcaagtcttgcgagattctccttcctatttctcgtgatcttggtattgtccgccgttgtgtcgacgtcgtcggtgctaaggtattattttactcagaactcattctcacttctttgtaa

SEQ ID NO: 1953 - DNA, 1089 bp, Arabidopsis thaliana
atggaggttttcttagagatgcttctcacggcggttgttgctctcttgttttctttccttttggccaagctcgtttctgttgctacggtggagaacgatttgagttctgatcagccgctcaagcccgagatcggtgtcggtgttacagaggatgttcgttttggtatgaagatggatgctcgtgttctcgaaagccagaggaatttccaagttgttgatgagaatgtggaacttgtcgatcggtttcttagcgaagaagctgatcgagtttatgaagtcgatgaagctgttactggaaacgctaaaatctgtggtgaccgtgaagctgagtcctcggctgcagcctcgtcggaaaattatgtgatcgccgaggaggtgatcttagttcgaggacaggacgaacagagcgactcggctgaagctgagtccatttcttctgtctcgccggaaaacgtggtagcggaggagattaagagtcaaggacaagaggaagtaacagaattaggaagaagtggttgcgtagaaaacgaagaaagtggtggagatgtcttagtcgctgaatctgaggaggttagagttgaaaagagtagtaatatggtggaggagagtgatgctgaagcagagaatgaagagaaaacagagttgactattgaagaagatgatgattgggaaggaattgagaggagtgaacttgagaaagcctttgcggctgctgtaaatcttttggaagaatccgggaaagctgaagaaattggtgctgaagctaagatggagttgtttggccttcacaagatcgccactgaagggtcatgtagagaggcacaacctatggccgtcatgatctctgctcgtgccaaatggaatgcgtggcaaaaacttggaaacatgagtcaagaagaggcaatggagcagtatcttgcacttgtctcaaaggaaatccctggtttgacgaaagctggtcatactgtagggaagatgtcagaaatggaaacctctgttggcttgcctccgaattcaggatcattagaagatccgaccaacttagtcacaactggtgttgatgaatccagcaaaaatggtattccctaa

SEQ ID NO: 1954 - DNA, 900 bp, Arabidopsis thaliana
atggcttcagaggatcaatcggcggcgagatctaccgggaaggtgaactggttcaacgcttctaaaggctatggtttcattactcctgacgatggcagcgtagagcttttcgttcatcaatcttcaattgtctccgaaggttaccggagtttaaccgtcggcgatgcggttgagttcgctattactcagggaagcgacggtaagactaaagccgtcaatgttactgctcctggtggtggttctctcaagaaggagaataactctcgtggtaacggtgctaggcgcggcggcggtggaagcggttgctacaattgcggtgagttaggtcatatctctaaagattgtggtattggtggcggcggcggaggtggtgaacgtagatctagaggaggagaaggttgttacaattgtggtgatactggtcacttcgctagggattgtacttcagctggaaacggtgaccaacgtggagccaccaaaggtggaaacgatggttgctacacttgcggtgatgttggtcacgtggctagggattgtactcagaaatcagttggaaacggagaccaacgtggagcggtcaaaggtggaaacgatggttgctacacttgtggtgatgttggtcactttgctagggattgtactcagaaggttgctgccggaaacgtcagaagcggtggtggtggtagtggaacttgttattcatgcggtggagttggtcacattgcaagagattgtgcgactaagagacagccttctcgtgggtgttaccagtgtggtggttctggtcacttggctcgtgattgtgaccagagaggaagcggtggaggaggtaatgataatgcgtgctacaagtgtggtaaggaaggtcactttgcaagggaatgttcttctgtagcttaa

SEQ ID NO: 1955 - DNA, 1482 bp, Arabidopsis thaliana
atgtctctattactggaagagatcattagatcagtagaggctttgctgaagctcagaaatcggaatcaggaaccctatgttgacccgaatctaaacccggttcttctagttccaggaatcgctggatcaattctaaacgccgttgatcatgagaacgggaacgaagaacgtgtttgggttaggatctttggtgctgatcatgagtttcgaacaaagatgtggtctcgatttgatccttcaactggtaaaacgatatctcttgatccaaaaacgagtattgttgttcctcaagacagagctgggctacatgcaattgatgtcttagaccctgatatgattgttggccgtgagtctgtgtactatttccatgagatgattgttgagatgatcggatggggatttgaagaagggaaaaccctttttggttttggttatgatttccgccaaagcaacagactgcaggaaacgttggaccagtttgctaaaaagttggaaactgtttataaagcctcaggagagaagaagattaatgttattagtcattctatgggaggactattggtgaaatgtttcatgggtctgcatagtgatgtatgcaaatccctctttctttattcatattcgagaagtatgtacagaattggattgctattgctgctccatttcgaggtaagttctctgacttgtggtacttctgatagtactggagacaactaccacactgattggtttcgcattattgattcaggtgctcctggatatatcacatcgactttattgaatggaatgtcgtttgtcaatggttgggaacagaactttttcgtctctaagtggagcatgcatcagctgagctgtggagagagaaagagagcaatgatggagttggaacctcttatgttgttcttgagtcttactgtagcctggagagccttgaagtttttacgaaatctctttcgaataatacactatgggaatgagaagatgcccgttaaagatctaacgaatctaagatacttccagccgacatatatatgcgtggatggtgatggcacagtcccgatggaatctgccatggcggatgggcttgaagcagtagcaagagttggagtccctggtgagcaccgaggaatcctcaacgatcaccgtgtcttccgaatgctcaaaaaatggctaaatgtaggcgaaccagacccgttctacaacccagtaaacgattatgtcatccttcccaccacatatgaatttgagaaattccatgagaatggactcgaggttgcttccgtgaaagaatcgtgggacatcatatcagatgacaacaatatcggcacaaccgggtcaaccgtgaactccatatcagtctctcaacctggagatgatcaaaaccctcaagctgaagctcgtgcaaccttaaccgtccaaccacaaagcgatggtagacaacatgtagagctcaatgctgtaagtgtctctgttgatgcataa

SEQ ID NO: 1956 - DNA, 1215 bp, Arabidopsis thaliana
atggcggcgtttttgcaaactaacatccgtctggagatcataccgggaagatacagttctctcaccgatcataagtttcgtgcgccgtatcgaattaggtgcgccgccgcttcaccggtgaaaaaacggtataacatcactctgcttcccggcgatggtatcggtccagaagttatatctgttgctaagaatgtgcttcagaaagctggatttctccaaggactagagtttgatttccaggagatgcctttcggcggagcagctttggatttggtcggagttccattgccggaggaaacttccactgctgctaaacagtctgatgccattcttcttggagctatcggagggtacaaatgggacaagaatgagaaacatctgagacctgagatgggtctgcttaacattcgaagagatctcaatgtctttgctaatttgagacctgctacagttttaccacagctagttgatgcttccacactgaagaaagaagtagcacaaggtgttgatatgatgattgtaagggagctcactggaggtatttactttggagagccaagaggcattacgatcaacgaaaatggcgaagaagtcggttttaatacagagatctacgctgctcacgagattgacagaattgctcgtgttgcattcgagactgctaggaaaaggcgtggcaagctgtgttctgttgacaaagccaatgtcttggatgcatcaatattgtggaggaaaagagtaacagctttagcctctgaatatccagatgttgaactatcacatatgtatgtcgataatgctgcgatgcagcttgtccgtgacccgaaacagtttgacacaatcgtcaccaataacatttttggtgatatattgtctgatgaagcttcaatgatcactggtagcattgggatgcttccatctgcaagtcttggtgaatcgggacctggactctttgaacctatacatggttcagcaccagatatagctggacaagacaaggcaaacccattggccaccattctcagtgcggcgatgcttctcaagtatggacttggagaagaaaaggctgcaaagatgattgaagacgcggtcgtggatgctctgaacaaaggtttcagaaccggagacatctactcccccggaaataaactggtgggatgcaaggaaatgggtgaggaggttctcaaatcagtggactccaaagttcctgtttaa

SEQ ID NO: 1957 - DNA, 3186 bp, Arabidopsis thaliana
atggggaaaggaggtgaagattgcgggaataagcaaactaatagttctgaattggtcaagtctgatacttttcctgcttggggtaaagatgtgtcggaatgcgaagagaagtttggtgttagtcgtgagaaaggtttgagcactgatgaggtgttgaaacggcatcagatctatggtttgaatgaattagagaagcctgagggtacttctatttttaagctgattttggaacagtttaatgatacattggttcgtattcttttggcggctgctgttatttcctttgtcttagccttctttgatggcgacgaaggtggtgagatgggtatcaccgcatttgttgagccgcttgttatttttctcatcttgattgttaatgccattgttggcatctggcaagaaactaatgctgagaaggcgttggaagctttgaaagagattcagtctcagcaagctaccgtcatgcgtgatgggactaaggtttccagtttgcctgcaaaggagcttgttcctggtgatattgtggaactgagggttggtgataaggtgcctgctgatatgcgtgtggttgctttgatcagttcaactttgagagtcgagcaggggtccttaacaggagagagtgaggcagtgagcaaaaccaccaagcacgtggatgagaatgctgatattcaaggaaagaaatgcatggtgtttgcaggaaccactgtcgtgaatgggaactgcatatgtttagttacagatactgggatgaatactgagattggaagggttcactcacagatccaggaagctgcacaacacgaggaagatacccctctgaagaaaaaacttaacgagtttggggaagttctgactatgatcattgggttaatttgtgcgttagtgtggctcatcaatgtcaaatactttctgtcatgggagtatgttgatggctggcccagaaactttaagttctccttcgagaagtgcacatattactttgagattgctgttgcactggcggttgctgcaattccagaaggtctgccagcagttattaccacatgtttggctcttggcactaggaagatggctcagaagaatgctctggttaggaagctacccagtgtggagactcttggatgcaccaccgtgatatgctctgacaaaactggaactcttacaaccaatcagatggctgtttcaaagctcgttgctatgggttcgaggatcggaactcttcgatctttcaatgttgaggggacctcgtttgatcctcgagatggaaagattgaagattggccaacgggtcggatggatgcaaatcttcagatgattgcaaaaattgctgccatttgcaacgatgctaatgttgagaaatctgatcagcaatttgtgtctaggggcatgcctactgaggcagctttgaaggttttggttgagaaaatgggatttcccgaaggattgaatgaagcttcatccgatggcaatgtcttacgttgttgtcggctatggagtgaactagaacaacggattgccacccttgagtttgaccgtgaccggaaatcaatgggagttatggtggattccagctcaggaaagaaactgctactggtcaagggtgccgtagaaaatgtattggaaaggagtacccatattcagctacttgatggttccactcgagagcttgaccaatactcaagggatcttattttacaaagcctacatgatatgtccttgagtgcattaagatgtctcggatttgcatactcagatgttccatcagattttgccacttatgatggcagtgaagaccatcctgctcatcagcaacttctcaacccatccaattattcatcaattgagtccaatctagtatttgttggatttgttggtttaagggatcctccaaggaaagaggtgcgtcaagccattgcagactgcagaacagcaggtattcgggtcatggttatcaccggagacaacaagagcacagcggaagcaatctgccgtgaaattggcgtatttgaagcagatgaagatatctcctcgagaagcttgacaggaaaagaatttatggatgttaaagatcagaagaatcatctaagacagacaggagggctcctgttctcaagggctgaaccaaaacacaaacaagagattgtcaggttactgaaagaagatggagaagtggttgccatgactggagatggagtcaatgatgctcctgccctgaagttggctgatattggtgtggctatgggcatttccgggacagaggtagcaaaggaggcatctgacttggtgttggcagatgataatttcagcaccattgttgcagctgttggtgaaggcaggtccatctataacaacatgaaggccttcatcaggtacatgatctcttccaacatcggtgaggttgcatcgatattcttgacagctgctcttggaatcccagaaggcatgatacccgttcaacttctgtgggtgaatctcgtaacagatggtcctccagctactgctttgggattcaacccccctgacaaggatattatgaaaaagcctcctcgtaggagcgatgactctcttatcactgcgtggatcctcttccgctatatggtgattggtttgtatgtgggagtagcaacggtgggagtattcatcatatggtacacacacaacagctttatgggcatagacctgagccaagacggtcacagccttgtgagctattcacagctcgcacattggggccaatgctcttcatgggaaggcttcaaagtgtctcctttcacagcaggctctcagactttctcgttcgactcaaacccttgcgactattttcagcagggtaaaatcaaggcatccacactctccctctcggtgttggtggccattgaaatgttcaactctctgaatgcactctcagaagatggcagcctggtgacgatgccaccctgggttaacccgtggctgctcctggcaatggctgtctcatttggactccactttgtgatattgtacgtcccattcttggctcaggtgtttggtattgtgccactgagcttgaacgagtggctgctagtgctggctgtgtcgctgccggtaattttgatagacgaagtgctcaagtttgtaggaaggtgcacgagtggctaccgctactcacctcgcactccctcagctaagcaaaaggaggagtaa

SEQ ID NO: 1958 - DNA, 1533 bp, Arabidopsis thaliana
atggcttttcgagcttatattattaactttgtgatcttatgcattctcgtggcatcgaccgtttccgggtacaaccagaaagacgtgaaagcatggtgcagccaaactccaaaccctaaaccttgcgagtatttcttaacccataactcaaacaatgaacccataaagtctgaatccgagtttctcaaaatctcaatgaaactcgtattagaccgagccatcctcgccaaaacccacgcgttcacactaggaccaaagtgccgtgacacacgtgaaaaagcagcgtgggaagattgtatcaagctctacgacctcaccgtctctaaaatcaacgagacaatggacccaaacgtgaagtgctcaaaactcgacgcgcaaacatggctaagcacggctctaaccaatcttgacacatgtcgagctgggttcttagagcttggtgttaccgatattgtccttcctttgatgtcaaacaacgtctcgaatcttctatgcaacacactcgccattaacaaagttcctttcaactacaccccacccgagaaagacgggttcccttcgtgggtcaaacctggtgaccggaaacttttgcaaagctcgacgccaaaagataacgcagtggtggcgaaagacggatctggcaattttaagacgataaaagaagcgattgatgctgcttcggggagtggtaggttcgttatatatgtgaagcaaggcgtttacagtgagaaccttgagattcggaaaaagaatgtcatgttgagaggtgatggtatagggaagacgattattaccggaagcaaaagtgttggaggaggaacgacaacctttaactcagctactgtcgcggcggtcggagacgggtttatagctcgtgggatcacgtttcgaaacacggcgggtgcaagcaacgaacaagcggtagctctaagatccgggtcggatctgtcagttttttaccaatgcagtttcgaagcttaccaagacacactctacgttcactccaaccgtcagttttaccgcgattgcgacgtttatggaactgtcgattttatcttcggaaacgcagccgcggttctccagaactgcaacattttcgcacgtcgtcctcgtagtaagaccaacacaatcacagctcaaggaagatccgacccgaatcaaaacacggggattattatccacaactctcgggtcacggccgcttcggatcttcgacccgttttgggatccacaaagacttatttgggtagaccttggagacaatattctaggacggtttttatgaagacttctcttgatagtttgattgatccacgtggctggctcgagtgggatggtaatttcgctttgaagactttgttctatgctgagtttcaaaatacgggtccgggtgcttcaacttcgggtcgggtcacatggccagggtttcgggtccttggttctgcttcagaggcttccaagtttactgttggtactttcctcgccggtggctcttggattccatctagcgtgccgttcacttctggtctctag

SEQ ID NO: 1959 - DNA, 1557 bp, Arabidopsis thaliana
atggattgtattttacttattctgactactcttgttgccattttcatcgtcaagattgttctcctagtcactaaacctaacaaaaaccttccaccgtcgccaaatatatgttttccgatcatcggacaccttcacctcctcaaaaagccactgctacaccggactctcagccatctctcccactccctcggccccgtcttttctctacgcctcggctctcgccttgccgttatcatctcatctccaacggcagccgaagaatgcttcttgacgaaaaacgacatcgttttagcaaatcggcctcgtttcatcatgggcaagtatgtggcttatgactacacctccatggttacggctccttacggtgaccactggcgaaacctccgtcgtatcaccgctttagaagtcttctccacaaatcgactcaacgcttcagcggaaatccgacatgacgaagttaagatgcttctccaaaagcttcacgatttatctgtcgaacgcccggctaaagtggagttacgacagttactaacgggtcttaccctaaatgtgataatgagaatgatgaccggaaagagattcttcgaggaagatgatggcggaaaggcggggataagtttggagttccgggaactagtggcggagattctagagctctctgcggcggacaatccagctgattttttgccggctctacggtggtttgactacaaaggtttggtcaagagagcaaagaggattggagaaaggatggatagtttattacaagggtttttggatgagcatagagctaacaaagacagattggagtttaagaacaccatgattgctcatttacttgattctcaagaaaaagagcctcataactacagtgatcaaaccatcaaaggtcttatactgatgatggtagtaggaggcacagatacatcggccttaaccgtggaatgggcaatgtcaaatttattgaatcatccacaaatactagagaccacgagacaaaacattgatactcaaatggaaacatcaagtagtcgtcgtttgttgaaagaagaagatttggtaaacatgaactacttgaaaaatgttgtgtcggagacactaagactttaccctgtggcaccacttatggttcctcatgtgccatcttctgactgtgtaatcggtggattcaacgttccacgtgatacgatcgtgttggttaacttgtgggctatacatcgagatccaagcgtgtgggatgatccaacgtcatttaagccggagagatttgaagggagtgatcagtttggacattacaatggtaaaatgatgccgtttgggttaggaagacgggcttgtcctgggttgagtttggctaaccgggttgttgggttattattgggttcgatgattcagtgctttgagtgggaaagcggctcaggaggtcaggttgatatgactgaaggtccaggacttagtttgcctaaggctgaaccattggttgtcacgtgcagaacacgtgagatggcttccgagttgttgttcttcggatcagagccaagcaataagaatgtctag

SEQ ID NO: 1960 - DNA, 990 bp, Arabidopsis thaliana
atgtcgtcagcttattgttcctccgccgtggctgtatccgccgcagccaccgcttcctccgccgctacctttaatccattactctcctcccactccaattcccaactcttctatcgctttacaccaaaatccttcaaactcgttgccaattgccctaatccactaatcctccactcaaatatccgccgccaccgcttcttctgcgccgccgaaaccgaagctagttccgccgatgatgaaatccaggcatcagtagaagaagaagaagaggtagaagaagaaggagatgaaggtgaagaagaagtagaggaagaaaaacagacgacgcaagcgagtggtgaagaagggaggctttacgttgggaatttaccttacacaatcacttcttctgagctctctcagatttttggagaagctggaactgtcgtcgatgttcagattgtttatgataaagttactgatagaagcagaggatttggatttgtaacaatgggaagcattgaagaagctaaagaagcgatgcagatgtttaacagctctcaaattggtggtagaacggtgaaagtgaacttcccggaggtgccgagaggcggtgagaacgaagtaatgagaaccaaaatccgtgataataaccggagttatgttgatagtcctcataaggtatatgcaggaaaccttggttggaatctaacctcacaaggtttaaaggatgcatttggtgatcaacctggtgtgcttggtgctaaagttatctatgaaagaaatactgggaggtctagggggtttggtttcatctcgttcgagtcagcggaaaatgttcagtctgctttggctacaatgaatggcgtggaagttgaaggacgagcgctgaggctaaatttggcttcagagagagagaaacccactgtgtctcctccttccgtagaagaaggagaaaccgaggaggccagtctagagagtaacgaggtgctttcgaatgttagtgcatga

SEQ ID NO: 1961 - DNA, 1068 bp, Arabidopsis thaliana
atgttgaaagtagagagtaactgggcacaagcctgtgatacatgccgatcagccgcctgcaccgtgtactgccgggctgattctgcctacttgtgctccagttgtgatgctcaagttcatgctgccaatcgtcttgcttcccgccatgaacgtgttcgagtctgtcaatcatgtgagcgagccccggctgcctttttctgcaaggcagatgctgcatctctatgcacaacctgtgattcagagattcattccgcaaacccacttgctagacgccatcaacgagttccaattctgcccatttctgagtactcttacagttccacggccactaaccattcatgtgagacaacagtgacagatccagagaacagacttgtgcttggtcaagaagaagaggatgaagatgaagcagaggcggcttcatggttgttgcctaattcagggaaaaacagtggtaacaacaatggcttctcgattggggatgagtttctgaaccttgttgattatagttcgagtgataagcaattcacagatcaatccaatcagtatcaactagactgcaacgtacctcagaggagctatggggaagatggagttgttccacttcaaattgaagtatcaaagggcatgtaccaagagcaacagaactttcagctgagtatcaactgtggctcctggggagctcttcgaagctccaatggttccctcagtcatatggtgaatgtttcatctatggacctgggagttgtgccggagtcaacaacgagtgacgcaacagtatcaaacccaagatcgcccaaagcggtaacagaccaaccaccttaccctccagctcagatgctcagtccaagggacagagaagctagagtcctgagatacagagagaagaagaagatgaggaaatttgagaagacgataagatatgcttcaaggaaagcgtatgcagagaaaagaccacggatcaagggccggtttgcaaagaagaaagatgtcgatgaagaggcaaaccaagctttctccacaatgataacatttgacaccggatatggaattgttccatcattctga

SEQ ID NO: 1962 - DNA, 462 bp, Arabidopsis thaliana
atgtcgatgattccaagtttcttcaacaacaacagacgaagcaacatctttgatccattctctcttgacgtatgggatccattcaaggaactaacatcatcatcactttctcgtgagaactcagcgatcgtgaacgcacgtgtggactggagagagacgcctgaggcccacgtgtttaaagctgacttgcctggattgaagaaggaggaagttaaagttgagattgaggaggatagtgttttgaagatcagtggagagagacacgtggagaaagaagataagaatgacacgtggcaccgtgtggagagatcgagtggacagtttacgaggaggtttaggttgccggagaatgtgaagatggatcaggttaaggctgcgatggagaatggtgtgttgactgttacggtgcctaaggctgagactaagaaggctgatgttaagtctattcagatctctggttga

SEQ ID NO: 1963 - DNA, 2034 bp, Arabidopsis thaliana
atggttgacttttttgtttgtggacgtggtagtaactattctggagcagatctagatagaattgaggcacaaagcggaggagttggcaccacgtcacctacgggcgacaccgaacctgtgccaaagttccgtactaaccttaaattgtcggatcttttcgctctccctggtgaagatgtcgagatgactccggagatttttggtggaatgagtaatggggaaaaagaatgtctggagaagttgagaagcaatggaacgccaatggaacgtgtcaagagcaatacaggagattcaattcttcatattgctgctaaatggggtcatctggaactagtgaaggagattatctttgaatgtccatgccttctattcgagcaaaactcaagccgtcagacaccgctacatgtggctactcatggcggtcataccaaagttgttgaggctcttgttgcatcggtaacatctgctttagctagtctgagtactgaagagagtgagggactgaatccacatgttcttaaggacgaagatggaaatactgctctgtactacgccattgaaggacgctatttggagatggctacctgtctggtgaacgcggacaaggatgctccttttcttggaaataacaagggaatatcttccttgtacgaagccgtagacgctggaaataaatttgaagaccttgtgaaagcaattttgaaaaccacagacgacaacgtggaccgtgaagtgaggaagtttaacttagattcgaaattacaagggaacaaacatcttgcacatgttgctttgaaggccaaaagtataggtgtccttgatgttattcttgatgaatatccaagtcttatggacgagcaagatgaagatggtaggacttgtctttcatacggagcatccattgggtattataaaggactatgcaacatcttaaaccgatcaacaaagggtgtttatgtctgcgaccaagatggttcttttccaattcattcggctgcaaaaaacgaacattacgaaattattaaagagtttataaaacgttgtccagcttcaaaataccttcttaacagacttggtcagaacattctccacgtggcggcaaaaaatgaggcctctcttactgcatatatgttgatgcatgataaagatacgaaacatctgggtgttgggcaagatgtggacgggaatacacctttgcaccttgccgtcatgaactgggactttgactccattacttgtcttgctagccgtaaccacgagatactgaaattacgaaacaaaagcggcttaagagctagggatattgccgagtcagaggtgaaacccaactacatctttcatgagaggtggacactggcgctcttattatacgctattcactcaagtggtttcgaatctgttaagtcattaacaatacagtcagtgccactagaccctaagaaaaacagacattacgtcaacgctcttctcgtggtagcggctcttgtagccacagtgacgtttgctgcaggctttacaataccaggtggttatatcagcgatagcaaaaaaccaaacttgggcagggcaactttggccactaacccaactctcttcatttttctgctttttgacatcttggcaatgcaaagttctgttgcaacaatatgtactcttatttgggcgcagttgggtgatctagcactcatcctcaaatccttacatgtggccttgcccttactacttttttcattactatgcatgcccgtagcattcctttttggcgtgatcactgcaattgcccatgtgaaatggcttttagtcaccattagcattatatctggtggattcttccttttcgcaatctttatccttggccctcacgtcatgctacagcgctcacaccttccgcccagttctgtggataccagtttactaatctctcgaatttatgaaccacattcaaaggagatgagtttaacaaaaaaaaaagggggaaaggttgtgtcttttgatgataatttgacgaaccctaatgtatctgaaagctgttaa

SEQ ID NO: 1964 - DNA, 987 bp, Arabidopsis thaliana
atggccgagaaagcaggcaaggcaacgaatggtggagaagcagagaaatctctaaaggaaaaaggaaatgagttcttcaaagctggcaactttcttaaagccgcagctctctatactcaagccatcaagctcgatccttctaacgctactctttacagtaaccgagctgctgcatttttgagtctagttaagcttagcaaggccttagcagatgctgagactaccattaaactcaaccctcagtgggagaaggggtacttcaggaaaggttgtgtgcttgaagccatggaaaaatacgaagatgctttggctgcatttgaaatggctctgcagtacaacccacagagcacagaagtttctagaaagatcaagaggctcggtcagttgcagaaggagaaacagagagctcaagaacttgagaatttaagatctaatgttgacatggccaagcatcttgaaagttttaaatctgaaatgtctgaaaactatggaactgaagagtgttggaaagagatgttttcttttattgttgagactatggaaacagctgtgaagtcgtggcacgagacatctaaagtcgatactagagtctatttccttcttgacaaagagaaaacacaaacagacaagtacgcaccagctgtcaacatcgataaggcttttcagtctccggacacgcacagtaactgctttacgtatctgaggcaatacgcagaagagtcattttccaaggctgcttgcttagtaacaccaaagagtagtatatcctacccacaggtgtggaaaggtgtaggctcaaggaaatggaaactcggaccaaatgatggaatctttgttcagtttgaatctccctctcttcggaaagtttggttcatatctagctcgaaagaaaagggacaaactttgtgcagggaaccgcaagctctggatatcggcgcacatgagattctccctcgcattttcaaggagaaatcgaaaagctcgtag

SEQ ID NO: 1965 - DNA, 1626 bp, Arabidopsis thaliana
atgaacacttttacctcaaactcttcggatctcactaccactgcaaccgaaacatcgtcctttagcaccttgtatctcctctcaacacttcaagcttttgtggctataaccttagtgatgctactcaagaaattgatgacggatcccaacaaaaagaaaccgtatctgccaccgggtcccacaggatggccgatcattggaatgattccgacgatgctaaagagccggcccgttttccggtggctccacagcatcatgaagcagctcaatactgagatagcatgcgtgaagttaggaaacactcatgtgatcaccgtcacgtgccctaagatagcacgtgagatactcaagcaacaagacgctctcttcgcgtcgaggcctttaacttacgctcagaagatcctctctaacggctacaaaacctgcgtgatcactccctttggtgaccaattcaagaaaatgaggaaagttgtgatgacggaactcgtatgtccagcgagacacaggtggctccaccagaagagatcagaagaaaacgatcatttaaccgcttgggtatacaacatggttaagaactcgggctctgtcgatttccggttcatgactaggcattactgtggaaatgcaatcaagaagcttatgttcgggacgagaacgttctctaagaacactgcacctgacggtggacccaccgtagaagatgtagagcacatggaagcaatgtttgaagcattagggtttaccttcgctttttgcatctctgattatctgccgatgctcactggacttgatcttaacggtcacgagaagattatgagagaatcaagtgcgattatggacaagtatcatgacccaatcatcgacgagaggatcaagatgtggagagaaggaaagagaactcaaatcgaagattttcttgatattttcatctctatcaaagacgaacaaggcaacccattgcttaccgccgatgaaatcaaacccaccattaaggagcttgtaatggcggcgccagacaatccatcaaacgccgtggaatgggccatggcggagatggtgaacaaaccggagattctccgtaaagcaatggaagagatcgacagagtcgtcgggaaagagagactcgttcaagaatccgacatcccaaaactaaactacgtcaaagctatcctccgcgaagctttccgtctccatcccgtcgccgccttcaacctcccccacgtggcactttctgacacaaccgtcgccggatatcacatccctaaaggaagtcaagtccttcttagccgatatgggctgggccgtaacccaaaagtttgggccgacccactttgctttaaaccggagagacatctcaacgaatgctccgaagttactttgaccgagaacgatctccggtttatctcgttcagtaccgggaaaagaggttgtgcggctccggcgctaggaacggcgttgaccacgatgatgctcgcgagacttcttcaaggtttcacttggaagctacctgagaatgagacacgtgtcgagctgatggagtctagtcacgatatgtttctggctaaaccgttggttatggtcggtgaccttagattgccggagcatctctacccgacggtgaagtga

SEQ ID NO: 1966 - DNA, 354 bp, Arabidopsis thaliana
atgatgatgaagtcgttgatctgtctctctctcatcctcctcccacttgtctccgtcgtggaaggtctcggtggtggtggtggtcttggtagccggaagccgatcaagaatgtatctgatccggatgttgttgcggtcgccaagtatgccatcgaggaacataacaaggagtcgaaggagaagttggttttcgtcaaggttgtggagggaacgacgcaagtggtctccggtacaaagtacgatctgaaaattgcggcgaaggatggtggtggtaagatcaagaactatgaggctgttgttgttgaaaagctttggcttcattctaagagccttgagtctttcaaggcgttatag

SEQ ID NO: 1967 - DNA, 963 bp, Arabidopsis thaliana
atggcttgccaaaacaatctcgttgtgaagcaaatcatcgacttgtacgaccaaatctcaaagctcaagagcttaaaaccttccaaaaatgtcgacactttgttcggacaactcgtgtccacgtgcttacccacggatacaaacatcgatgtcacaaatatgtgtgaagaagtcaaagacatgagagctaatctcatcaagctttgtggtgaagccgaaggttatttagagcaacacttctccacaattttgggatctttacaagaagaccaaaacccacttgaccatttacacatctttccttactactccaactacctcaagctaggcaagctcgagttcgatctcctgagccaacactcaagccatgtccccaccaagattgccttcgtgggttcgggtccgatgcctctcacatccatcgtattggccaagtttcacctccccaacacgacgttccacaactttgacatcgactcacacgcaaacacactcgcttcaaacctcgtctctcgcgacccggacctctcaaaacgcatgatcttccacacaacggacgtactaaacgcaaccgaaggccttgaccaatatgacgtcgttttcttagcggcgcttgtagggatggacaaagagtcaaaggtcaaagccatcgagcacttggagaaacacatggctcctggagctgttcttatgctaaggagtgctcatgctctcagagctttcttatatccaatcgttgactcgtctgatctcaaaggctttcaactcttgaccatctatcatccaaccgatgacgtggttaactcggttgtgatcgcacgtaagctcggtggtccgaccacgcccggggttaatggtactcgtggatgcatgtttatgccttgtaactgctccaagattcacgcgatcatgaacaaccgtggtaagaagaatatgatcgaggagtttagtgccatcgagtaa

SEQ ID NO: 1968 - DNA, 903 bp, Arabidopsis thaliana
atggaaacaccgttaagggaagtgagaccaaaggtgacacttgtggtacgaatggtagcttcagtgggtaactacgattacatcattgattatgagttccaaactgatggggttatgagagcaaaggttgggcttagtggaatgttgatggtgaaagggacaacgtacgagaacaagaaccaagtgaagaaagacaaagaaggtaatgaagaagagctttatggcacgattctgtccgaaaatgtaattggagttattcacgaccactacgtcactttttaccttgacctcgatgtcgatggcccggacaattcctttgttaaagtgaacctcaagaggcaagagacggcgccaggtgagtcacctaggaaaagttacatgaaagcagttaggaacattgtgaaaaccgaaaaagacggtcagatcaagcttagcttgtacgatccatcagaataccacgtcattaatcctggtaaaacaactcgagttggtaacccgacgggttacaaggttgtccctagagccacagcagctagtctacttgaccatgatgatccaccgcagaagagaggagcttttactaataaccaaatttgggttactccctacaataagtccgagcaatgggctagtggtttattcacttaccaaagccatggtgatgatactcttgcggtttggtccgacagagatagagatatagagaataaggacattgtggtgtggtacacgcttgggttccatcacattccatgtcaagaagattttccgataatgcccactgtttcttcaagtttcgatttgaagcccgtaaattttttcgagcgcaatccaatccttaaggccgctccaaactttgaatatgaccttccggtttgcggagccaaatctgattctgcttga

SEQ ID NO: 1969 - DNA, 1923 bp, Arabidopsis thaliana
atgcccttatcctttgaaaggtttcaaggggagggggtgtttggtttatcttcttcttctttctattcagattctcagaaaatctggtccaatcaagacaaaaccgaagcaaaacaagaagatcttggttatgttgtcggtggttttttaccggagccgacgtctgttctcgacgctctaagaagtcctagtcctctcgcttcttattcttctaccaccaccacgctgtcttcctctcacggcggcggtggtaccaccgtcaccaacaccaccgtaaccgccggtgatgataacaataacaataaatgtagtcagatgggtttggatgatcttgacggtgttctctctgcttcttctcctggtcaagagcagagtatcttgagacttatcatggacccgggttctgccttcggtgttttcgacccgggtttcggattcgggtctggttccgggcctgtgtctgctccggtgagtgataattcgaatcttctgtgtaacttcccgtttcaagagattacgaatccagcagaagctttgatcaatccttcaaatcattgcctgttctataatcctccgttatctccaccggctaaacggtttaattccggatctcttcatcaacccgttttccctttatcggatccggatccgggtcacgacccggttcgtcgtcaacatcagtttcagtttccgttttatcacaacaaccagcaacaacaattcccgtcgtcttcttcttccacggcggtggctatggttccggttccgtcgccgggaatggccggcgatgaccagtcagtcatcatcgagcagctgttcaacgcggcggagctaatcggaaccaccggaaacaacaacggcgaccacaccgttctcgcgcaagggatattggcgcggctcaatcaccatctcaacactagtagtaaccacaagtctccgtttcaaagagcagcttctcacatcgctgaagctctcctctcactcatccacaacgaatcatcaccaccgttaatcacgccggagaatctgattctccgaatcgccgcttacagatccttctccgaaacctcgccgtttctccaattcgttaacttcacagcgaatcaatcgattcttgagtcctgcaacgaatcagggtttgatcggatccacattatcgatttcgacgttggatatggaggacaatggtcgtctctaatgcaagaactcgcttccggagttggaggaagaagaagaaacagagcatcgtctctgaaattaacagtctttgctcctccaccttctacagtctccgacgagttcgagcttcgtttcacagaggaaaatctcaaaacattcgccggagaagtcaagattcctttcgaaatcgagttactaagcgtagagcttcttctaaacccagcttattggccactctctctacgttcatcggaaaaagaagcaatcgcagtgaatcttccagtaaactccgtcgcctccggttaccttccgttaatcctccgattccttaaacaactatcaccaaacatcgtcgtttgctcagacagaggatgtgaccgtaacgacgcgccgtttccaaacgcagtgattcattcgcttcaataccacacttctctgcttgagtctcttgatgctaatcagaaccaggacgattcgagtatcgagaggttttgggttcaaccatcgatagagaagctgttgatgaaacgacaccgttggattgaaagatctccaccgtggagaatcttgtttacacaatgtgggttttctccggcgagtttgagtcagatggcggaagctcaggcggagtgtttgttgcagagaaatccggtgagagggtttcacgttgagaaaaggcagtcttcacttgtcatgtgttggcaaaggaaagaacttgttactgtctctgcttggaaatgttag

SEQ ID NO: 1970 - DNA, 912 bp, Arabidopsis thaliana
atgggattccgtgggaagtacttcttcccaattctcatgactctatcgttatttctaataatcagatacaactacatagtctccgatgatcctcctctccggcaagaactccccggtcgccgatcagcttcttccggagatgacatcacatataccgtcaagactccgtcaaagaagacaaagagactgtttcacacggcggtgacagccacggattccgtgtacagcacgtggcagtgtcgggtcatgtattattggtacaacaggttcagggacgaacccgggtcggatatgggcgggtatacccggatcttgcattcgggtcgacccgatggactcatggatgagatccctactttcgttgctgaccctcttccctccggtgttgacaagaaatatgaatcggttctccgcaaattcttccccaaagagaatggaccaatatcaagaatcgatcccatcgggaattctccagtgatcgtcactaagaatgcattaatgaaaattgctccaacatggatgaatgtttctttggctatgaagaatgacccacaaacagataaagcttttggttgggtccttgaaatgtatgcatatgctgtttcttctgcgttacacggcgtgagcaacattctacacaaggacttcatgattcagcctccttgggacactgaaacaaagaagacgttcataatacattacacttacggctgtgatttcgacatgaaggggaagatgatggtagggaagattggagaatggagattcgataaacggtcttacggggataaaccacccccaagaaatctcacactgcctccccgaggtgttcccgagagcgtggtatatatatatagcttcaaacaaaacttctctcatttgtttccttttggttttcttgcacagtcctaa

SEQ ID NO: 1971 - DNA, 1224 bp, Arabidopsis thaliana
atggaagtgtcgaaaaagaaaggtggagattttcagcaatgtcacgaattgattcccggtttaccttccgaactagctttggagtgtttggtcagagttccgttccaattccaatccgccatgagatccgtttgccgttcttggcgtagcttactctccgactcttcttttatccaagaacggcggagatgcggcaaaacagagcttctcctctgcctcgttcaaccgctaacgccgccaattccagcgtctaaatcggttgacgagacattaatggttgacgagaaaaaatcagaggatgagtcacacccgcgcgttttctgcacgccgcgttttggattgagcgtttacaacgctgcgatgtccacgtggcatcgcgttgcgtttccagaggaggagcagatcccgcttttctgcgagtgcgtcgtgcttcaggacgccgggaagattctgctcatcggcggttgggatccggagacgttacagccgacgagagacgtttacgttctggaattcgccggaaggaagtggagacgaggtgcgccaatgaaggaatcacgatcattcttcgcctgcgcctccgtaagtccaacgaaggtatacgtcgccggaggtcacgacgatcagaaaaacgctttacgctcggcggaggtgtacgacgtcgagaaagacgagtggtcgtcggttactccgatgacggaaggaagagacgaatgtcaaggattcgccgttggtatgggtctaaggttttgcgtgctgagcggttacggaacggaatctcaaggaagattccgatctgacggagaaatttacgatccagcgacagattcatggtcgagaatcgacaacgtctggcgatttccagatactagcccgagaggtcgcaccgccggagactttagaagctcctctacgttatggtgtttcacagacactgatttacagagtgaacgtcgatgggaaactaacgatgattcgagaaatttgaaactggatcttcaatctatacagcttccgatgacaggaagctcagttttcgccggaagcttaggaggtgaatcggtggtaatgattggcggtaaaagagagagtgaaggtgaaggtgaaggaggagtgatgatgaagatgacgactgagaagaaaatgggaaaatggagtcatcatgttcatataccttgtgatttctctactcttccattttcgcatgcttcaatctatgtttga

SEQ ID NO: 1972 - DNA, 567 bp, Arabidopsis thaliana
atggagatggactcaactactacgatcaaaccggagaccctatccaccgtgagttcctcacctccggagaaaatccatctccggccaatgactctttccgacgtcgacgatttcatggtttgggccactgactcaaacgtcacacgcttttgcacgtgggagccttacactagccgagaagccgcgatcgcgtacttaaacgacgctcttttgccacacccttggcttagagctatatgcttagataacgaccgtccgattggctcgatctccgtaacgccagtcgatgagatcagaggagagattggttatgtcctcggaagcaagtattgggggaaagggatcgccactgaagcggtgaggcttgtggcgggggagatattcaaggagaagccagagatgcagaggcttgaggcacttgttgacgttgacaatgttggatctcaaaaggttcttgaaaaagttgggtttgtgaaagaaggtgtgatgaggaaatttatgtatcttaaaggaaatgttagagatatggtcatgtttagtttcttgccttctgattcgttgcactga

SEQ ID NO: 1973 - DNA, 822 bp, Arabidopsis thaliana
atggcttttcttctttctaatctatcatctccgtcaatccatcttcaaaccggaaaatacccaaaccttaaacccattttcagtcaatctctatcgtcttcgtcttctgttagctacgaatttgtagaagagaatctatctacactctctctattgagcatccagtctcctcctcttaaagacacgcaagttcagacaagacacagttcgcaagataagcataataaccacgacagagatgaattctatatcaatcttggtgtcgctgtccgtacacttcgtgaagatttgcctttgctcttcactagagatcttaattacgacatctacagggatgatataacatttgtggatccgatgaacacattcactgggatggacaactacaagattatcttctgggcactcagatttcatgggaagatattgttcagagatatctcacttgagatcttcagagtatggcaaccatcagagaacatgattctcatcaggtggaatctcaagggtgtgcctagagttccatgggaagctaaaggagagtttcaaggcacttctcggtataaactcgaccgtaatggcaaaatctatgagcataaagtcgataacttggccttcaatttccctcaacagctcaaacctgcagcttcggttttggatttggtgactgcttcccctgcaagcagtcctaatcctacgttctttttcagtcctgtggactcttattcatcttcatgggttaagttttatcaagcggtgagagggacattggagacagaggatatgtttgtaacaacagactgtttagtcacatgctcatag

SEQ ID NO: 1974 - DNA, 717 bp, Arabidopsis thaliana
atggtgacttcggagggattagcaagcgttgattcttggttatatcgccaaggtttcaacgttgattcatggttgctttctgataccttctctcacgacaacgatttgctcgcaagagctctccataccaccgtcacagcccctcatactctcactccttcctctgctttcttcgattcctccgctgtttctcacccttcttccactaacacactctcctctaccgtctccggtgcttctgatccagaaatcatcggcggaggagctaaacggaaacgtaactgccttcttaccgacggtaaagccgccaagcgccgcgctcgtgcttccaagaaatctcagactactttcataacggcggatccgtccaactttcgtcagatggttcagcaagtgactggcgccaagtacatcgatgactcttcttcctttggtattttcgatccgattgtcaagccggagccgcttaggttcgttaacaaactgccttgtggtccttcggatcgatccacggcggttccaatgctcgacacatcagcatttttgtctaatcatcaccaggagaatctcgcagtgggaaatgctttctccggtaacagcagcagtgtaggattaccgtcggggaagccaagtgcaacggccgaccccggtggttctgccgtggagtttgataattacccaacatttccaacgcttgaatcgtggaaggttatgtga

SEQ ID NO: 1975 - DNA, 846 bp, Arabidopsis thaliana
atggcggatcctgatctgtcttctcctttgatccaccatcaatcctccgatcaacctgaagttgttatctctatcgccgacgacgacgacgacgagtcaggactcaatcttcttccagccgttgttgaccctcgtgtttcacgaggttttgagtttgaccatcttaatccttatggctttctcagcgagtcagagcctccggttctcggtccgacgacggtggatccattccggaacaatacacctggagttagcggattgtacgaagcgattaagctcgtgatttgtcttccgattgctctgattagacttgttctctttgctgctagcttagctgttggttacttggctacaaaattggcacttgctggctggaaagataaagagaaccctatgcctctttggagatgcagaatcatgtggattactcggatctgtaccagatgtatcctcttctcttttggctatcagtggataagaaggaaagggaaacctgctcggagagagattgctccgattgttgtatcaaatcatgtttcttatattgaaccaatcttctacttctatgaattatcaccgaccattgttgcatcggagtcacatgattcacttccatttgttggaactattatcagggcaatgcaggtgatatatgtgaatagattctcacagacatcaaggaagaatgctgtgcatgaaataaagggatgtaaatacagagaaaagcttcctgcgatagatttcctcgtctgctgttattccccgaaggaaccacgactaatgggaaagttcttatttccttccaactcggtgctttcatccctggttaccctattcaacctgtag

SEQ ID NO: 1976 - DNA, 639 bp, Arabidopsis thaliana
atggcgactccggcatggagtcatgccaaggctcaatgggtagtcgccatgttggcgttactcgttggctcggctatggctaccgaaccttattactatagctctcctccaccaccgtatgagtataaatctccacctcctccggttaaatctcctccaccgccttatgaatataaatcaccaccacctccggttaagtctcctccaccaccgtattactatcattcaccgccgccgccagtgaaatcccctccccctccttatgtttacagctctcctcctcctccggtgaagtcccctcctcccccatactactaccattcaccgcctcctccggtgaagtctcctcctcctccatactactaccattcaccacctcctccggtgaaatccccaccaccaccatattactaccattcaccacctcctccggtgaaatccccaccaccaccatactactaccattcacctcctcctcctgtgaaatctcctcctcctccatattattaccactccccacctcctccggtgaaatccccaccaccaccatacctttacagctctccaccaccaccggtaaaatctcccccacctcctgtctacatctacgcttctcccccacctcccacacattactag

SEQ ID NO: 1977 - DNA, 1275 bp, Arabidopsis thaliana
atggcagtgttcaagaagaagaaaacatcattgacatctctgttcttggggtgttacaaggcaaagaacgcaagcaaatacgaaggaggggagaaggctgtaatgaaaataagaacttgtccagcgttcaagaggctgtctttatcggacataagcgatccaagctcgcccatgtcggttatggatgatctctctcactccttcacatcgcagaagcttcgtttgttcacgttgtctgagctgagagtgattacgcataatttctctagaagtaacatgttgggggaaggagggtttgggccggtttacaaagggtttattgatgataaggttaaaccgggtatcgaagcccaaccggttgctgtaaaggctcttgatcttcatggccatcaaggccatagagaatggctggcggagatattatttttgggacaactaagtaacaaacatcttgtgaagctgatagggttttgttgtgaagaagagcaaagagttcttgtttatgagtacatgcctcgaggtagcttggagaatcagctctttcgaagaaatagcttagcaatggcttggggaataaggatgaagatagctctcggagccgccaaaggtttagcttttctccatgaagcagagaaacctgtcatctacagagactttaaaacctctaacatattgttagactccgactataacgccaaattatctgacttcggtctagccaaagatggacctgaaggcgaacatacgcatgtaactacccgagtgatgggaacacaaggttatgctgcgcccgaatatatcatgactggtcatttgacgacgatgaatgatgtatacagttttggagtagttttgttagagctgataaccggaaaacggtcaatggacaatacccgaacacggagggaacaaagcctagtggaatgggcgcggcctatgttaagggaccaaagaaagttagagaggataattgacccgaggctcgcgaaccagcacaaaacagaagcggctcaggtagctgcttccctagcatacaagtgtctaagccaacatcctaagtatagacctacaatgtgtgaggtggttaaggtcttagagtctatccaagaagttgatattaggaagcatgatggcaataacaacaaagaaggaaagaagtttgttgatataaataagtttaggcatcaccgtaaaggcaaaagacgtgtgaacatcgcttattcagattctctcgtttacaaggaatccaaggcaaagcaaaacgatggcatttga

SEQ ID NO: 1978 - DNA, 1470 bp, Arabidopsis thaliana
atggcggagaaaatcacgagagagacgtcgttacctaaagagagaagcagcccacaagctctaatcctgggacgatacgaaatgggtaagcttctcggccatggtaccttcgctaaagtttacctcgcacgtaacgtgaaaacaaacgaaagcgtagcaatcaaagtaatcgacaaggagaaagttctcaaaggaggtttaatcgcacacatcaaacgcgagatctcgattcttcgacgtgttcgtcacccaaacatcgttcagctattcgaagtcatggcgacgaaagctaagatctatttcgtgatggagtatgttcgtggaggtgagttattcaataaagtagctaaaggtcgtcttaaagaagaagtagctcgcaaatatttccagcaattgatctctgctgttactttctgtcacgcgagaggtgtttatcatagagatctgaaacctgagaatcttttgttagatgagaatggtaatcttaaagtctctgactttggacttagtgctgtctctgatcagattcgtcaagatgggctttttcatacgttttgtggtactcctgcttatgttgctcctgaggttttagctaggaaaggttatgatgctgctaaagttgatatttggtcttgtggtgttatcttgtttgtgttgatggctggttatttgccgtttcatgatcggaatgttatggctatgtataagaagatttacagaggggagtttaggtgtcctaggtggttttctactgagcttaccaggttgttgtcgaagcttttggagacgaatccggagaaacggttcactttccctgagattatggagaattcttggtttaagaaagggtttaagcatattaagttttatgtggaggatgataagttgtgtaatgttgttgatgatgatgaactggagtctgactcggtggagtcggatagagattccgcggcttctgagtcggagattgagtatttggagcctaggaggagagttggagggttgcctagacctgcgagtttgaatgctttcgatattatatcgttttcgcaaggttttgatttatcgggtttgtttgatgacgatggggagggttctaggtttgtttcgggagctccggtttcgaagattatatcgaagttggaagagattgctaaagttgtgagctttactgtgaggaagaaggattgtagggtaagtcttgaaggttcaagacaaggagtgaaaggtccattgacgattgcagcagagatattcgaattgacaccatcgttggttgttgtggaagtcaagaagaaaggaggagataaaacagagtatgaagatttctgtaacaatgaattgaaacccaagttgcaaaacttgacagctgatgatgtagtagctgagcctgtcgcggtttcagcggttgatgaaaccgctatcccgaattctccaaccatttctttcttgccgtctgacactgaatag

SEQ ID NO: 1979 - DNA, 981 bp, Arabidopsis thaliana
atgtctttaaccacagtccctacgctcgccatcagatccggaccatccggtcatcactcgatgccggttcttggttttggaaccgccgcttctccgctaccggaaccaacgatgctgaaagagacggtgattgaggctattaagcttggttatcgccatttcgacacctctccaaggtaccaaacggaggagccgatcggcgaagctttagcggaggcggtttcactcggcttagttcgatctcgatctgaattctttgtcactaccaaactttggtgtgctgatgctcatggtggtctcgtcgtaccggcgatcaaacggagtttgaaaaaccttaaactggactatcttgatctttatataattcattggccggttagctcgaaacctggtaaatacaagtttcctattgatgaagatgattttatgccaatggatttcgaagtagtgtggtctgaaatggaggagtgtcagagacttgggctcgcaaaatgcataggagtaagcaatttttcatgtaagaagcttcaacacatactctctatcgcgacaatcccgcctagcgtcaatcaagttgagatgagtccaatatggcaacaaagaaagctaagggagctttgtagatcgaacgacattgttgtcacagcgtactcggtgttgggatctagaggagctttttggggaactcccaaaattatggaatctgatgttctcaaagaaatagcagaagcaaaggaaaaaacagtggcccaggtgagtatgagatgggcttatgaacaaggagtgagcatggtagtgaagagctttaccaaagagagattagaagagaatctaaagatatttgattggtctttgacagaggatgagacacagagaatttcaactgagattcctcagttcagaaacgtccacggagaggtttatacctctaagaaaggtcccatcaaatctgtcgccgagatgtgggacggggagatctga

SEQ ID NO: 1980 - DNA, 1077 bp, Arabidopsis thaliana
atggctgtaacaagctcttcttctacttgtgatggtttcttcatcatcagccttattgttatcgtttcttcattgtttgggacatcatctgcgcagttaaacgcaacgttttactcaggcacatgccctaacgcctctgccatcgttcgcagcactattcagcaagctcttcaatccgatgcaagaatcggaggcagcctaatccgccttcattttcacgactgttttgttaatggttgcgatgggtcgctcttgcttgacgacacttcaagcatccagagcgagaagaacgctcctgccaatgcaaactcaactagaggattcaatgttgtcgatagtatcaagacagccctcgagaatgcttgtccgggcattgtttcttgctctgacattttagctcttgcctcagaggcctctgtgtctttggcaggaggaccttcatggactgtgttattaggaagaagagatggtctcaccgcaaacttgtctggagccaattcgtctcttccctctcccttcgaaggccttaacaacatcacatcaaaatttgtagctgtcgggctaaagacaaccgatgtagtatccttgtctggagcgcatacgtttgggcgtggtcaatgcgtaacgttcaacaatagactattcaacttcaacgggacaggaaaccccgacccgactctgaactcaacacttctcagcagtcttcaacagctatgtcctcaaaacggcagcaatacagggatcaccaatctcgatctgagcacacctgatgcgttcgataacaattacttcacgaaccttcagagtaacaatgggcttctccagtcagaccaggaactgttctcaaacaccggttcagccaccgtcccgattgttaattcctttgcaagtaaccagaccctgttttttgaggcgtttgttcagtctatgatcaagatggggaacattagtcccttgactgggagtagtggagagattagacaagactgtaaggtggttaatggacagtcatcagccactgaagcaggggacattcagttacaatctgacggaccagtgagtgtagcagatatgtga

SEQ ID NO: 1981 - DNA, 1473 bp, Arabidopsis thaliana
atggcgattatagtagtaacaacgatcttcatccttctgtctttcgcactctatctaactatcagaatcttcaccggaaaatccagaaacgacaagagccacaaattatacgattacgagacagagatcgcgaggacaaagcctactttcaggttcttgagtccaggacagagcgagatattcactgcagatcctcggaacgtggagcatattctcaagacaagattccataactatagtaaaggacccgttggtacagtgaatcttgcggatcttctgggacatgggatcttcgctgttgatggagagaaatggaaacaacaaaggaagctcgtgagctttgagttctccactagagttttaagaaattttagctactctgtttttcggacaagtgcttctaagcttgtcggttttattgcggagtttgctctctctggaaaatcttttgattttcaggatatgttgatgaaatgtacattggactccatctttaaagttggattcggtgtggagttaggatgtctagatgggtttagcaaagaaggggaagagttcatgaaggcttttgatgaaggcaacggcgcaactagttccagggtcaccgacccgttttggaagctgaaatgttttcttaacattggatcagagtcaagactcaagaagagcattgctattatagacaagtttgtctatagtctcattaccactaaaaggaaagagctttccaaggaacagaacacttctgttagagaggacatcctatcgaaatttcttctcgagagtgagaaagatccggagaacatgaatgataagtacctgagggatatcattttgaatgttatggttgctggtaaggacacaaccgctgcatcactctcttggttcttgtacatgctctgcaaaaacccacttgttcaggagaaaatcgttcaagaaatcagagatgtgacatcaagtcacgagaaaacaaccgatgtaaatggtttcattgaaagtgtaaccgaagaagctcttgctcagatgcagtatctccatgcggccttgtctgagactatgaggctttacccacctgtgcctgagcacatgaggtgtgcagaaaatgatgacgttcttccagatggacatagagtgagcaaaggggataatatctactacatatcctatgcaatgggtaggatgacttacatttggggtcaagatgctgaggaattcaagccagagagatggctcaaggacggcgtattccaacccgaatcacaattcaaattcataagctttcatgctggtccaagaatctgtattggcaaggatttcgcataccggcagatgaagatagtatcaatggcacttcttcacttctttcgcttcaaaatggctgatgagaacagcaaggtgtcttacaagaaaatgcttacacttcatgtcgatggaggactacatctctgtgcaatcccgaggacaagcacttga

SEQ ID NO: 1982 - DNA, 1026 bp, Arabidopsis thaliana
atgattttatttggtctctgtaggagttatggaaatgcaaacgaaacagagcatacaagattcaccttcgatgaaatctacgacgcgaccaagaacttctctccgtcctttaggatcggacaaggcggttttggcactgtttacaaggtcaaactcagagatggcaaaacctttgctgtgaaacgtgccaaaaagagtatgcatgacgaccgtcaaggtgcagatgcagagtttatgagtgagattcagacattagctcaagttactcatttgagtttggttaaatactatggatttgttgttcataacgacgagaagattctcgttgtggagtatgtagccaatggaactcttagagatcacttggattgtgagtacacatcctactactatcttctttttgaaggaaagactctcgacatggcgactcggttagatatcgcaaccgatgtagctcatgccataacctatcttcacatgtatacacgtaagtccattgtatacatagagccacctatcatccacagagatatcaaatcttcaaacattctcctcactgagaattacagagccaaggttgctgatttcgggtttgcaagattagctccagatactgattcaggagccacgcatgtgtcaacacaagtcaaaggaaccgctggttacttagacccagagtacttaacaacgtatcaactcacagagaaaagtgacgtctactcttttggtgtactgctcgtcgagcttctcacaggtcggcgtcccatcgagcttagcagaggacaaaaagaacgcatcaccattagatgggcgatcaagaagttcacgagtggagatacgatatcggtattggacccgaagctagaacagaattcagcgaacaacttagcattagagaaggtattggagatggcgtttcaatgtctagctcctcatagacgttcgagaccaagcatgaaaaaatgcagtgagattttgtggggaattcgtaaagattacagagagttgctcaacacaagtctttga

SEQ ID NO: 1983 - DNA, 999 bp, Arabidopsis thaliana
atggaagcagaagaaggtcatcagcgtgaccgcctctgcgactattgcgactcctccgtggctcttgtctactgcaaagctgactccgccaagctctgcctcgcctgcgacaagcaagtccacgtcgccaaccaactcttcgccaaacacttcaggtcacttctctgcgactcctgcaacgaatctccctcttcccttttctgcgagactgaaaggtctgttctttgccagaactgcgactggcaacaccacaccgcctcttcctcccttcatagccgcagaccctttgaaggatttaccggctgtccctccgtgcctgagttgctggccatcgttggcctcgatgacctcactctcgattccggattgctttgggagtcacctgagatcgttagcctcaacgaccttattgtttcgggcgggtcgggtactcataacttccgggccacggatgttcctcctctgcctaagaatcgtcacgccacctgcgggaaatacaaagatgagatgatccgacagctccgtggactatccagatctgagcctggttgtctgaaatttgaaaccccagatgctgagatcgatgccgggttccaattcctagcgccggatttgttttctacatgcgagctggagagtggactgaaatggttcgatcagcaagatcatgaggactttccatattgctctctgctaaagaacttgtcggagtcagatgagaaacctgagaatgtagaccgagagtcatcggtgatggttcccgtttccggctgcttaaaccgatgtgaggaagagactgtgatggttccggttatcactagtacaaggtcgatgacacatgagatcaacagtcttgagaggaactctgctctctctcgctacaaagaaaagaagaagtctcgaaggtacgagaaacacatcaggtatgaatcacgcaaggttcgtgcagaaagcaggacaagaatcaggggacgtttcgccaaggcagcagatccatga

SEQ ID NO: 1984 - DNA, 1389 bp, Arabidopsis thaliana
atgagcgaagaacaaccacacgccaatctagcggttcccgcgtttaaaactgagaaagagcccataacgcaaacacgaaatggtcaaagtagcgtttggcgtttcggtggaagtgataaggcagcgaaagcatccaccgtaacgcttagaggtgtcatctacatgctcttcgacaactgcggcaaagacgtcaataagaccattttacccctcggccacggtgacccttccgtctacccttgcttccgtacctgtatcgaagctgaagacgccgtcgtcgacgtccttcgctccggcaaaggcaattcttacggtcccggagctgggattctccccgcaagacgagccgttgctgattatatgaaccgagatcttccgcacaagttaacgcctgaagatatttttctgaccgctggatgcaaccaagggatagagatcgtgttcgaatcgttggctcgaccaaacgcaaacatcttgctcccacgtcctggcttccctcactacgacgctcgtgctgcttacagtggtctcgaggttcgcaagtttgatcttcttcccgagaaagaatgggagattgatcttgaaggtatcgaagccattgcagacgagaacactgtggctatggttgtaattaaccccaacaatccctgtggaaatgtctactctcacgaccatctcaaaaaggttgcagagacggctaggaagctcgggataatggtgatctcagacgaagtatatgaccgaactatattcggagacaatccatttgtttcaatggggaagtttgcttcgatagtccctgtattgacactagcaggcatatctaagggatgggttgttcctggatggaaaattggctggatcgccttgaatgatcccgagggcgttttcgagaccaccaaggtgttacaatccatcaaacagaatcttgacgtaactcctgaccctgccacaataattcaggctgcacttccagcgatcctggagaaagcggacaaaaacttctttgcaaagaagaacaagatactcaaacataatgttgatttggtgtgtgataggctcaaggacatcccctgtgtcgtctgtcccaagaaacctgagtcttgcacttacttattgacaaagttggagctgtcattgatggataatatcaaggacgatatagatttttgcgtaaaactggccagagaggagaatctcgtgtttctaccaggggatgctctgggtttgaagaactggatgaggataaccatcggagtcgaagctcatatgcttgaggatgcacttgagagactgaagggtttctgtacacgtcatgccaagaagacagagacagaaactgagtcacttcaagctttgaaactgagtgataataatctcgaaatgtaa

SEQ ID NO: 1985 - DNA, 2076 bp, Arabidopsis thaliana
atggacgaactttttgtctcaatctcgtcaacctttagcaaaacctcttgcattactgatcttcttcttccacttgagctagatagaattgaggcacaaaggtcaacagatgcgtctcatgatcaacagaacagaacatacttacccatgaacatacacggttcacaagacttctctcaaagcggaggagatggcgtcacgccacttacaggagacaccgaatctgtgccagagttccttactaaccttagattgtcggatctttacgctatccgtggtgaagatgtccggatgattccagaggtttttagtaaaataagtgatgggaacaaagaatgtctggagaagttgagaagccgtggaatttcagtggcacgtatcaagagcaatacaggagattcaattcttcatcttgctgttacatggggtcatctagaactagtgaaggagattgtctgtgaatgcccgcgtcttctcttggagcaaaactcaagcggtcagacaccgctacatgtggcggctcatagcggtcataccactattgttgaggcttttgtcgcattggtaacattttcttcagctagactgtgtaatgaagagagtgagagaatgaacccatatgttctcaaggacaaagatggaaatactgctctgtactacgcgattgaagggcgctatttcgagatggctgtatgtctggtgaacgcaaaccaggatgctccttttcttggaaataagtatggagtatcttccttgtttgtggcaataaatactggagatgtatctcttgtgaaagcaattttgaaaatcataggcaacaaggaccttaaagggaagaagtctaacttggagtcaaagttacaagggcagaaatctcttgcacatgttgctttggtgacccagagtataggtttgtttttcgctttaaccagtagcagctgcatttattctattcaaatatgtaaaaccagtttgagacgggaatttcctcctcaaggcggtgtccttgatgttattcttgatgaatatccaagtcttatggacgagcgagatataaatggttggacttgtctttcactcgcagcacatatagggtattatgaaggagtatgcaacctcttagaacgatcaacaaaggctgcagagaaaggtcatgaaaatattgttgaagagtttataaaacgatgtccagcaaaaaatgggaaattttggatttcgaacatgttgataattaataaagatacggaacatctgggtgttgggcaagatgtggacgggaatacacctttgcatcttgccgtcatgaactggcactttaaatccattacttggcttgctaggagtagcaagatactgaaagtgcggaacaaaaacggcttaagagctagggatattgccgagagagaggtgaaaccccactacatctttcaggagaggtggacactggcgctcttattatacgctattcactcaaggggtttcgaatctgtacactcattaacaaaaccgtcagtgccactagaccctaaaaataacagagattacgtcaacactcttctcctggtagctgctcttgtagccacaatgacgtttgctgcaggttttacaataccaggtgggtttaacagctctgctccacacttgggcagggcaactttggccactaatccaactctcttcatttttctggtacttgacatcttggccatgcaaagttccgttgcaacaataggtattcttatttgggcgcagttaggtgatccagtgctcattcgctcatccttacatgtggctttgcccttactgctttttgctttactctgcatgcccttggcattcctttttggcgtggtcactgcagttgggcatgtgaaatggcttgtagtcatcatttgcattatatctgttttattcttttcttgggcgatctttgtccttggccctcacgtcatgctacaacggtcatacgtttctcccaagtacgctggtgactttctcgtgacttttatgcagtataaagacataattgggctttttgtgtctttgataaagtttcttttttgtggttgttattaa

SEQ ID NO: 1986 - DNA, 762 bp, Arabidopsis thaliana
atgccgacgtctgactccggtgaaccacggcgaatagctatgaaacctaacggcgtaacagttccgatttctgaccagcaagaacagcttccatgtcctcgttgtgactcatccaacactaagttctgttactacaacaactacaacttctctcagcctcgtcacttctgcaaagcttgtcgtcgttactggactcacggtggtactctccgtgacgttcctgtcggtggtggtactcgtaaaagcgcgaaacgttcccgcacttgctcgaactcttcttcctcctctgtttctggtgtcgtctctaactctaacggtgttccgttacaaacgacgcctgttctcttccctcagtcgtcaatctctaacggcgttactcacacagtaactgaaagcgacggaaagggaagtgctttatctctctgtggaagtttcacctccactctgttgaaccataacgctgctgcgacggctacgcatggatccggttcggttattggtatcggaggttttggaatcggactcgggtcgggttttgatgacgtcagctttggactcggaagagcgatgtggccgttttcaactgttggtactgcgacaacgacgaatgttgggagtaacggtggtcatcacgctgttccaatgccagccacgtggcagttcgagggtttagagagcaacgctggtggtggatttgtctccggtgagtactttgcgtggccggatctttccatcacaactccgggaaactcactcaaatga

SEQ ID NO: 1987 - DNA, 1431 bp, Arabidopsis thaliana
atggatcttctctttctctttttctctcttctcctctcttacctctttttcaagatctggaaactcatagactcaaagcaagacaaagattgctacattttagactaccaatgtcataaaccaaccgacgatcgaatggtgagcactcaattcagtggagagatcatttatcgaaaccaaaaccttggtttaaccgaatacaagttccttctcaaagccatagtaagctcagggattggagaacaaacctacgctccaagacttgtctttgaaggtcgagaagagcgtccttcgttacaagatgggatctccgagatggaagagttctacgtggacagcatcggaaaactcctggagagaaatcaaatatctcctaaagacatagacatcctcgtagtcaacgtctccatgctctcttcaacgccatctttagcttcaagaatcattaaccattacaagatgagagacgacgtcaaagtcttcaacttgaccgggatgggatgcagcgcaagtctaatctccgtagacattgtcaagaacatttttaagagctacgcaaacaagttagctcttgttgccacctccgagtctttgagccctaattggtatagcggaaacaaccgttcaatgatcttagccaactgtttgttccggtccggtggatgtgctattctcttgactaacaaacgtagcttgagaaagaaagcaatgtttaaactcaagtgtatggtacggactcaccatggagctagagaggagtcttataattgttgcatccaagccgaagatgaacaaggccgtgtcgggttttacttggggaagaatctaccaaaagccgctactcgtgcttttgtagaaaacctcaaggttataacacccaagattcttcccgtaaccgagcttataaggttcatgttaaagcttcttatcaagaaaatcaagattcgtcaaaaccctagcaagggctccacgaatctcccaccggggactccattaaaggcaggaatcaacttcaagaccgggatcgaacatttttgcatacataccggaggaaaagctgtgattgatgggattggacatagcttggatttaaacgagtatgatattgaacctgcgaggatgactcttcaccggtttggcaatacttcggcgagtagtttgtggtatgtgttggcttacatggaggccaagaagagattgaagagaggagatagagtttttatgataagctttggagctggttttaagtgtaatagctgcgtttgggaagttgtgagagatcttactggtggtgaatcaaaaggaaatgtgtggaatcattgcattgatgattatccaccaaaatcgattctgaatccttatttggagaagtttggctggattcaagatgaagatcctgacactttcaaggtccctgacgctttcatgtaa

SEQ ID NO: 1988 - DNA, 918 bp, Arabidopsis thaliana
atgactcaaaagctgtttatacagtatagtctacggtcttacatcgtattttggaaatatgaccaaattaccccttggtttgtccataaatatcaagctccaacaatgcaattcttcccttttccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatga

SEQ ID NO: 1989 - DNA, 1614 bp, Arabidopsis thaliana
atgtatcacatctttcagatctccagcgaagttttcagagcttttggtttgaagatgaagattctgctaacactagtctttagtggcttactaatttggtctgtagtgttagtttcattctcaaacgacttcaacaaccaacttcttgttgctacttccaacgtttcaagggaatccgaaacaccgagagatagactgatcggagggcttttaaccgcggatttcgatgaaggttcttgcttgagtaggtatcagcaatctttgttgtaccggaaggcttcaccgtacaagccttcggaatatcttgtctctaagcttagaagttacgagaagcttcacaagcgttgcggtccaggcacggatgcttacaagaaagcaacagagattcttggtcatgatgatgagaattatgcaagcaaatctgttggtgaatgcagatacattgtgtgggttgcggtttacgggcttggaaacagaatacttactcttgcctctgtcttcctctacgctctcttgacagagagagttgttcttgttgatcaaagcaaagatataagtgatctcttctgcgagccgtttccaggtacttcatggttacttcctcttgaattcccattgatgaagcagattgatggctacaacaagggatactctcgttgttacggaacaatgttgaacaatcaagccatcaactccactttgatcccgccgcatctgtatcttcatattcttcatgattcaagggataatgataagatgttcttctgtcaaaaggatcaatctttagtggacaaagtcccttggttgattgtcaaagccaatgtctactttgtcccatctttatggttgaatccaactttccaaaccgaactaatgaagctgttcccgcagaaagaagccgtctttcaccatctcgctcggtatctttttcacccgacgaatcaagtttggggcttgatcacaagatcctacaatgcctacttatcaagagcagacgagacgcttggtattcagatacgggtattcagcgatcgagctggatattttcagcatgtaatggatcaggtcgtagcttgtacacgaagagagaaccttttgcctgaaccagctgcacaagaagaaccaaaagtcaatatatcaagaagccagaaacttaaagctgttcttgtcacatctttgtatccagagtactctgaaaccttaaagaacatgtattgggaacgaccgagttcaacaggggagatcattgaagtttatcagccaagtggagaaagggttcaacaaacagacaagaagctacacgaccaaaaggcgctcgccgagatgtatcttctaagtctaactgataaaatagtcacaagtgcaaggtctacatttggatatgttgctcatagtcttggaggattaaagccatggttactctatcagccaacaggtcctacagctcctgatccaccgtgtattcaatccacgtcgatggacccttgtcaccttactcctccgtctcatggatgtgaacccgaatggggaactaactccgggaaggtagttccttttgtaaggcattgtgaggatcgtgggaacgatggtcttaagctatttgatgagttatag

SEQ ID NO: 1990 - DNA, 1512 bp, Arabidopsis thaliana
atgttttgtcattcattgttagctcaaagaattctccttttgacctttttttttgttatatgttcagacgaatccgaaacaccggggcgggatagactaataggagggcttttaaccgcagatttcgatgaaggttcttgcttgagtaggtatcataaaactttcttgtatcgcaagccttcaccatacaagccgtctgaatatcttgtctcgaagcttagaagctatgagatgcttcacaaacgttgcggtccagggacaaaagcttacaaggaagcaacaaagcatcttagtcatgatgagaattataatgcaagcaaatcagatggtgaatgccgatacgttgtgtggctcgctgattacgggcttggaaaccgactactcactcttgcttctgtgttcctctacgctctcttgactgatagaatcattcttgttgacaaccgcaaggatattggtgatctcttatgcgagccatttccaggtacttcatggttgcttcctctcgactttccattgatgaaatatgctgatggataccacaagggatactctcgttgttacggaacaatgttggaaaatcattccatcaactcgacttcattcccgccacatctatatatgcataaccttcatgattcaagggatagtgataagatgttcttctgccaaaaggatcaaagtttgattgacaaagtcccttggttgatatttagagccaatgtttactttgttccatctttatggtttaatccaactttccaaaccgaactaacgaagctgtttccgcagaaagaaaccgtgtttcaccacttgggtcggtatctttttcaccctaaaaatcaagtttgggatatcgtcactaagtactaccatgatcacttatccaaagcagatgagagactcgggattcaaattcgggtttttcgcgatcaaggtggatactaccaacacgtcatggaccaggtcatatcctgcacacaaagagagaaacttttgcctgaattggctacacaagaagaatcaaaagtcaacatatcgaacattccaaaaagtaaagctgttcttgtcacttctttgtctcctgagtactctaagaaactagagaacatgttttcagagcgagcaaatatgacgggagagattattaaagtatatcagccaagtggagaaaggtatcaacaaacagacaagaaggttcacgaccaaaaggcgcttgctgagatgtatcttttgagcttaaccgataacattgttgcaagctcaaggtcaacatttggatatgttgcttatagtcttggaggattaaagccatggttactttatctgccaaatgataacaaagctcctgatccgccgtgtgttcgatccacgtcgatggagccttgtttccttactcctccgactcatggatgtgaacctgacgcatggggaactgaatcggggaaagttgttccttttgttaggtattgtgaggatatatgggggcttaagctttttgatgagttatag

SEQ ID NO: 1991 - DNA, 1803 bp, Arabidopsis thaliana
atggagaagggaaatggaaaaaatcagactaatcgaatctgtttgttggttgctttgtcactctttttctgggcattgttgttgtacttccattttgttgtcttagggactagtaacattgataaacagctccaattgcaacctagttatgctcaatctcagccatcatcagtctctcttcgtgttgataaattccctatagagcctcatgcagctccatcgaaaccacctcccaaagagcctttagttactatcgataagccaatactccctcctgcaccagtagccaattctagttccacctttaagccacctagaattgttgagagcgggaagaaacaggagttttcgtttataagagccttgaagacagtagacaacaagagtgacccttgtggagggaagtacatttatgttcacaatctaccctcaaagttcaatgaggatatgcttagagactgtaagaagcttagtctctggactaacatgtgtaagttcacaaccaatgctggccttgggccgccgcttgagaatgttgaaggtgtcttctctgatgaaggttggtatgcgactaatcagtttgctgttgatgtgatattcagcaaccggatgaagcagtacaaatgtttgacaaatgattcttcccttgctgctgccatctttgtgccgttctatgctggattcgacattgctaggtatctgtggggatacaatatctcgagaagggatgctgcttcgcttgagttggtcgattggctcatgaagcggcctgagtgggatataatgaggggaaaagatcatttccttgtggcgggtaggataacgtgggattttaggagattgtctgaagaagaaactgattggggcaacaagcttctcttcttaccggctgccaagaacatgtctatgcttgtggttgagtcgagcccatggaatgctaatgattttgggatcccgtacccaacctacttccacccagcaaaggactcagaggtttttgaatggcaagaccggatgagaaacctggaaaggaagtggcttttctcgtttgcaggagccccacgacctgacaatccgaaatctatcagagggcagatcattgatcaatgtcgaaactcaaatgttggcaaattattagaatgcgattttggggagagcaaatgccatgcaccaagcagcattatgcaaatgtttcaaagctctctcttctgcctgcagccacagggagactcttacacccgaagatcggcatttgactcaatgcttgccggttgtataccggtcttcttccatccgggttcagcctacacgcaatacacgtggcatctacccaagaactacacaacctactcggtattcatccccgaggatgatgttcggaagagaaacataagcatcgaggagcgactcctccagattccagccaagcaggtcaagataatgagagagaatgtcatcaacctcatcccaaggctgatctacgcagacccgagatcagaactggagacgcagaaagatgcatttgatgtctcggtacaggctgtgatagacaaggtgactcggttaaggaagaacatgatcgagggccgaaccgagtatgactacttcgtggaggagaacagctggaagtatgcgttgctggaggaaggccaacgggaagcagggggccatgtgtgggacccgttcttctccaaaccaaagcccggagaagatggcagcagcgatggtaatggaggcacgactatttcagcagatgcagctaagaattcatggaagagtgagcagagagataagacacagtga

SEQ ID NO: 1992 - DNA, 1173 bp, Arabidopsis thaliana
atggagaggttggtcagcggagagacaacgacgtcgtcgaacatgaagaagaagaagaagaaggtgtcgtcgacaacaaatccgtcacttcccgatgatttggtattggtcatcatcgcacgcgtctcaatattatactatcctattctctcactcgtctccaagagctttcgatctctcctggcttcaccggagctttacaaggtcaggtcactcttgggccgcagggagagtcgtctctatgtgtgcataaatatgtattcttataaaaacggccctagctggttcaccctctgccggaaaccggatcgaacaacaaccagtagtaataaggaggaggacaggtcaagtggttatgtcttggcaagaatcccaattccccattctcctttgactcagagatatagcctcgcggcggttggttctaatatctataacattggcgtaaccagataccaccatttgacctcctctagtgtctgggttctggattgccggtctcacacgtggcgccaggctccaagcttgccggtggagctatttagagtttctgttagcgtccttgatcaaaagatatatgtagcagggttacaccaagaagatggctcggattccttgaagaactcggttacggtgttggacacagaaacacaagtaagtgatcgggtggctatcccatgcagcgtgtcacaaggcaaggagatcttcataagcacaagtgttggcggaaaggtcaacctcgtgactgggagaaaggtggttgattacaatccagtggaaggtagctgggaggaggttggagataccatgtgtgagtttatgttttcaaaatgtttttgcgtggttggtaatgttttgtactcatgtgctattgaccgagtgttcagatggtatgacactgaggtaagaacatggagaaatttggagtgtttgataggaggacgactacccaagttatctccgcgtgcttttgttagtttggctgattatggtggaaagctcgctgttttttggaaccaaggtgtcggcgattggcagatgctttggtgtgcagtgattgcgcttgaaaggcgcaatacttgtgaaattttggggaatgttgagtggtctgatcatgtgcttcatgtccctaagatacgttcttactacaacgctctttctgctactctctga

SEQ ID NO: 1993 - DNA, 1059 bp, Arabidopsis thaliana
atggtgcggacaccgtgttgcaaagctgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatga

SEQ ID NO: 1994 - DNA, 891 bp, Arabidopsis thaliana
tggggaaaggaagagcaccatgctgcgacaagaacaaagtgaagagagggccatggagccctcaagaagatctcactctcatcacttttattcaaaaacatggccatcaaaactggagatctcttcccaagcttgctggattgttgagatgtgggaaaagttgccgactaagatggataaactatctgagaccggacgtgaagcgaggcaactttagcaaaaaggaggaagatgctatcattcactaccatcaaacccttggaaacaagtggtcaaagatcgcgtccttcttgccgggaagaactgacaacgagatcaaaaacgtgtggaacacgcatctcaagaaacgactcactccatcttcttcttcttcatccctctctagcactcatgaccaaagcacaaaagcagatcatgacaagaactgtgacggggctcaagaagaaatacattcagggttaaatgagagccaaaactcagctacttcgtcacatcaccaaggcgagtgtatgcacacaaaaccagagcttcatgaggttaatggactcaacgagatccagttcctgctcgaccatgatgactttgatgatataacctctgagtttcttcaggataacgatatcttatttccgctagactctcttcttcataaccaccaaactcacatttcaacccaagaaatgactcgagaggtaaccaaatcgcaatcatttgatcatcctcaaccggatatcccatgcggatttgaagacacaaacgaagaatccgacttgaggagacagctggttgaatcaaccacacctaacaatgagtacgacgagtggttcaacttcattgacaaccaaacttactttgatgattttaatttcgtcggagaagtatgtctatgaa

SEQ ID NO: 1995 - DNA, 1182 bp, Arabidopsis thaliana
atggcgtcaagcactgcgactatgctcaaagcctcaccggtgaaatctgattgggttaagggacagagtcttctcctccgtcaaccttcctctgtctcagctattcgcagccacgtggcaccttccgctctcaccgtccgagccgcttctgcttacgccgatgagctcgtcaaaaccgctgtaattaactctataatccaaaaaacaatcgcgtctccgggacacggaattatggcgatggatgagtccaacgcgacttgtggaaagcgtttggcgtcaattgggctagagaacacggaggctaaccgtcaagcttacaggacgttgcttgtgtcggctccaggacttggacagtacatctccggagctatcctgttcgaggagactctgtaccaatccaccactgatggcaagaaaatggttgatgttctcgtcgagcagaacatcgtccctggcatcaaagtcgacaagggtttggtgccacttgttgggtcttacgacgagtcatggtgccaaggacttgacggtttagcctctcgcaccgctgcttactaccaacaaggtgctcgtttcgccaaatggcgtactgttgtgagcattccaaatggaccctctgctttggctgttaaagaagcagcttggggacttgctcgctacgcagctatttctcaagacagcggtctggtgccgattgtggagccagagattatgttggacggagaacacggcattgacaggacatacgacgttgcagagaaggtttgggctgaggtcttcttctacctcgctcagaacaacgtcatgttcgaaggtattctcctgaagccaagcatggttactccaggagctgaggccacagacagagctactcctgagcaggttgcttcctacactctcaagctccttcgcaacagaatccctcctgctgtccccggaatcatggcaattcttgtctggtggacagtccgagttggaggcgaccttgaacttgaacgcaatgaaccaggcaccgaacccatggcacgtgtccttctcctacgcacgtgccttgcagaacacttgcttgaagacatggggaggcaaggaagagaacgtgaaggcggctcaggacattctcttggccagagccaaagccaattcgctggctcagctcgggaaatacactggagaaggcgagtctga

SEQ ID NO: 1996 - DNA, 1176 bp, Arabidopsis thaliana
atgatggcaaacaactgtaatttagtcagtgttctatgtgtaattttggtattgaccctctttcacaaccccatcactgtcgccggacagaatagtccggtggtcgccttgttcacctttggtgactccaacttcgacgccggaaacaaacagactctcaccaaaaccttagtcgctcaaggtttctggccgtacggaaaatctcgagatgatcccaacggcaaattctccgacggcctcatcactccggacttcctcgctaaattcatgaagattccgctcgcgatcgcgccggcgcttcaaccgaacgtcaatgtctcacgtggagctagtttcgccgtcgaaggtgctactctactcggagctccggtggaatctatgactctgaatcaacaagtgaaaaaattcaatcaaatgaaagcagcaaattggaacgatgatttcgtggcaaagtcagtatttatgatatacattggtgcaaacgattacttaaatttcaccaagaacaaccctaccgctgatgcatctgctcaacaagcttttgttacttccgtgaccaacaagttaaagaacgatattagcgcgttgtattcatcaggagcgagtaaattcgtgatccaaaccttagctccattgggttgcttacccatcgtcagacaagaatacaacaccgggatggatcaatgctatgagaaactcaacgatttggctaaacaacacaacgaaaaaattggaccgatgttgaacgaaatggctagaaactctcctgcatcagctcctttccaattcaccgtctttgatttctacaatgccgttcttactaggacgcagaggaaccaaaacttccggtttttcgtcacgaacgcatcgtgctgcggagttggatctcacgatgcttatggttgcggtttacctaacgtgcattcgaagctatgtgagtaccaacggtctttcctattcttcgacggacgtcacaactccgagaaggcgcaagaaatgtttgcccatcttctttttggagccgatacaaatgttgtccaaccgatgaacgtccgtgagcttactgtttacccagtcgatgaacccatgcgtgaattttgggtgcctccaacgccagctactgtccacgccagcgactctagctcgtccactagccgcggttacgagtattactga

SEQ ID NO: 1997 - DNA, 1575 bp, Arabidopsis thaliana
atggaaacggcgtcttctaatttctctctctcgcagatcctcaatattgaggaaccctacagctccgtaatgctcggtgtcgccgctctcttggccgttgtttgctatttctggatacaggggaagtccaaatccaagaacggaccaccgttgcctccgggaccttggccacttccgatcgtcggcaacctcccgttcctaaactctgacgtcctccacacgcaattccaagccctaaccctaaaacatggccctctcatgaagatccacctcggttccaaacttgcgatcgtcgtctcttcccctgacatggctcgcgaggttctcaaaacccacgacatcactttcgccaaccacgatctccctgaagtcggaaagatcaacacttacggtggtgaagacatcctctggtctccttacggtacccattggaggagacttcgtaagctctgcgtcatgaagatgttcactaccccaactctcgaagcttcctactccactcgccgggaagaaacccgacaaaccattgtccacatgtcggaaatggctcgtgaaggatcaccagtcaacctcggagagcaaatatttctttccattttcaacgtcgtgacaagaatgatgtggggcgccactgttgaaggagacgagagaacgagcttaggaaacgagctcaaaaccctaatatctgatatctccgacatagaagggattcaaaactactcagatttctttccgttgttctcaagattcgatttccaaggattggttaagcagatgaaaggccatgtgaagaagcttgatctcttgttcgatagagttatggagagtcacgtcaaaatggtgggaaagaagagcgaagaagaagaagatttcttgcaatacttacttagagttaaagatgatgatgagaaagctcctctgtccatgactcatgtcaagtctctcctcatggatatggttcttggtggtgtcgacacatcggttaacgcatccgaattcgccatggcagagattgtgagcagaccggaagtgttaaacaagatccgactagaacttgaccaagttgttggcaaagacaacatcgttgaggaatcacatttacctaagcttccttacctacaagcggttatgaaagagactcttaggcttcaccctacgcttcctcttcttgttcctcacagaaacagcgaaacctcggtggttgcgggatacactgtgcctaaagactccaagattttcatcaacgtttgggcgattcatagagatcctaagaattgggatgaaccaaacgagttcaaacctgagaggtttttggagaattcgcttgatttcaatggaggtgattttaagtacttgccttttgggtcaggaaggaggatttgtgcggcgattaacatggctgagagacttgttctgttcaacattgcttcacttcttcactcttttgattggaaagcacctcaaggacagaagtttgaggttgaagagaagtttggtcttgttcttaagttgaagtctccacttgtggctattcctgttccaaggttgtccgatccaaaactctatacagcttaa

SEQ ID NO: 1998 - DNA, 930 bp, Arabidopsis thaliana
atggcaggaaccggagttgtggcggtgtacggcgaaggagccatgacggagacgaaacagaaatctcccttctccgtgaaagttggtctcgctcagatgcttcgtggcggtgtaatcatggatgtcgtcaacgcagagcaagctcgaatcgctgaagaagctggcgcatgcgccgtgatggctcttgaacgtgttcccgccgatattcgagctcaaggcggtgttgctcgaatgagcgatccagagatgatcaaagaaatcaaaaacgccgtgacgattccggtgatggcgaaagctagaattggtcatttcgttgaagctcagatcctggaagcaatcggagttgattacgtcgacgagagtgaagttctcactctcgccgacgaagataatcacatcaacaaacataatttcaaaatcccttttgtttgtggatgtaggaatctcggtgaagctttaaggcggatccgtgaaggagccgccatgataagaaccaaaggtgaggctggaactggtaacgttgttgaagccgttaggcacgtgaggagtgtgaacggagctattcggttacttagaagcatggacgatgacgaggttttcacttacgcgaaaaagatcgctgcgccgtatgatttggttgtgcagactaaggagcttgggaggttaccggtggttcagttcgctgctggaggagtggcgacgccggcggatgcggcgttgatgatgcagttgggatgtgatggagtgtttgttgggtcgggtgttttcaagagtggagatccggtgaagagggctaaggctattgttcaggcggttacgaattatagagacgcggcggtgttggcggaggtgagctgtggtttaggtgaagccatggttggtcttaatttggatgataaggttgagaggttcgctagtcgttctgagtaa

SEQ ID NO: 1999 - DNA, 936 bp, Arabidopsis thaliana
atggctgccttgtcggataagttagcggatgcttaccagaacgcaaggccgagatatccgatcgattggttcacgaaacttgctgctcgaaccggtcagcacaaatcagcttgggatgttggtactggcaacggtcaagcagctattggtcttgcagagtatttcgagaaagttacagcaaccgacataaacgaagcacagttaaaacgagcggtaaaacacgaaagaatcagttaccatcacactcccacaacaatgtccgaagaccaaatggttgctctagtcggcggagataactccgttgatctaatcgtggcagcacaagccgttcactacttcgatctcgcaccattctacaacgtagcaaaacgtgttcttcgcaaagaaggaggattaatcgcagtttttgtctacaacgacataatcatctctcctgaagttgattccatcatgaaacgtcttgtggactccacgttcccgtttagaactcctgtaatgaatcttgctttcgacggttataaaacgttgccgtttccgtttgaaagtatagggatgggatcagaagggaagcctataatgcttgacattcctcataagctatcgcttaaagggtttatcggtttcttgagatcgtggcagcccgcaatgaaagctaaagaacgtggagttgagcttgtgactgaagatttgatctccaaatttgaagatgcttggggtgatgatgatgatgttaaagatattttctacaaagctcatatgattgttggaaaactttcggcttcagatatagagcggcatcgaaagagatttgatacgaactgcgtagttacaacactaaaggatcataacaactcggctgttattgcttcagtgactgctgctgcatttgctggagtggcggcttactgtgcttactctgcaaggaagaacagttag

SEQ ID NO: 2000 - DNA, 1140 bp, Arabidopsis thaliana
atgtctaccaccggacagattattcgatgcaaagctgctgtggcatgggaagccggaaagccactggtgatcgaggaagtggaggttgctccaccgcagaaacacgaagttcgtatcaagattctcttcacttctctctgtcacaccgatgtttacttctgggaagctaagggacaaacaccgttgtttccacgtatcttcggccatgaagctggagggattgttgagagtgttggagaaggagtgactgatcttcagccaggagatcatgtgttgccgatctttaccggagaatgtggggagtgtcgtcattgccactcggaggaatcaaacatgtgtgatcttctcaggatcaacaccgagcgaggagggatgattcacgatggtgaatcaagattctccattaatggcaaaccaatttaccatttccttgggacttccacgttcagtgagtacacagtggttcactctggtcaggttgctaagatcaatccggatgctcctcttgacaaggtctgtattgtcagttgtggtttgtctactgggttaggagcaactttgaatgtggctaaacccaagaaaggtcaaagtgttgccatttttggtcttggtgctgttggtttaggcgctgcagaaggtgctagaatcgctggtgcttctaggatcatcggtgttgattttaactctaaaagattcgaccaagctaaggaattcggtgtgaccgagtgtgtgaacccgaaagaccatgacaagccaattcaacaggtgatcgctgagatgacggatggtggggtggacaggagtgtggaatgcaccggaagcgttcaggccatgattcaagcatttgaatgtgtccacgatggctggggtgttgcagtgctggtgggtgtgccaagcaaagacgatgccttcaagactcatccgatgaatttcttgaatgagaggactcttaagggtactttcttcgggaactacaaacccaaaactgacattcccggggttgtggaaaagtacatgaacaaggagctggagcttgagaaattcatcactcacacagtgccattctcggaaatcaacaaggcctttgattacatgctgaagggagagagtattcgttgcatcatcaccatgggtgcttga

SEQ ID NO: 2001 - DNA, 1998 bp, Arabidopsis thaliana
atggcagcttccaatcattcatctggtaaacctggaggagttttaagtgatgctttatgtagggagctctggcatgcctgtgctggacctcttgtaaccctacctcgtgaaggggaacgagtttattatttccctgaaggccacatggagcagctcgaggcatcaatgcaccaaggtttggagcaacagatgccttccttcaacctcccatctaagatcctctgtaaagttatcaacatccagcgcagggcagagcccgagactgacgaagtatatgcgcaaataaccttattgccagaactggatcaaagcgaacccactagcccagatgcccctgttcaagaacctgaaaagtgcaccgtacattcattttgcaagacactaactgcttcagacacaagcacacatggtggcttctcggtgctacggagacatgcagatgattgtctcccacccttggatatgtcccaacaaccaccgtggcaagaattggttgcaactgatttgcacaatagtgaatggcattttaggcacattttccgaggccaaccaaggcgtcatttgctaacaactggatggagtgtttttgttagctcgaagaaactagtggctggtgatgctttcatattcttaaggggtgagaatgaagagctccgagtaggtgttaggcggcacatgagacaacagactaatatcccgtcatctgtcatttcaagtcatagcatgcatattggggtccttgcaacagcagctcatgccattacaacaggaacaatcttttctgtcttctacaagccaaggacaagtaggtcagagtttattgtgagcgtcaataggtatctcgaagctaagacccagaagctgtctgtaggcatgcgtttcaagatgagattcgagggggaagaagctcccgagaaaaggttcagtggcacaatagttggtgttcaggaaaataagtcttcggtctggcatgattctgaatggagatcgctaaaggttcaatgggacgaaccctcatctgtatttcgtcctgaaagagtttcaccttgggaacttgagcccctagttgcaaatagtactccgtcttcacaacctcagcctccgcaaaggaacaaacgaccaagacctcctggtttaccttcaccagccactggtccatctggtcctgttactccagatggtgtgtggaaatccccggcagacactccttcctcagtgccattattctctcctcctgccaaagctgctacgtttggtcatggtgggaacaaatcatttggagtatctattggatcagccttttggcccaccaatgcagatagtgcagctgaatcctttgcttcagcgtttaacaatgaatctactgaaaagaaacaaactaatggaaatgtctgtaggctttttgggtttgagctagttgaaaatgttaatgtggatgaatgtttctctgctgcctctgtgtctggtgctgtcgctgtagatcaacctgtcccatccaacgagtttgactctggccagcaatctgagccattaaacatcaaccaatctgatattccttcggggagtggtgaccctgagaaatcctctttgaggtctcctcaagaatcacaaagtagacagatacgtagctgcacaaaggtgcacatgcaaggcagtgcagtaggcagagctattgatttgacaaggtcagagtgttatgaagatctgttcaagaagctggaagagatgtttgatatcaagggtgaactcttagaatctaccaaaaaatggcaagtcgtttacaccgatgatgaagatgacatgatgatggttggtgatgatccatggaatgagttctgtggaatggtgaggaagatattcatctacacacctgaggaagtgaagaaactttcaccgaagaacaaactcgcagtcaatgcaaggatgcagctcaaagctgatgcagaggaaaatgggaatacagagggcagatcatcatctatggcgggatcaagatga

SEQ ID NO: 2002 - DNA, 501 bp, Arabidopsis thaliana
atgaagatgtttatctctcctcaaaccctagtactattggcattagctcttgtcctagcttttgcagttccactgaaagcccaagaccggcgacaagactaccttgatgtacacaaccatgctcgagacgacgttagtgtgcctcatataaaatggcatgcgggagcagcccgatacgcctggaactatgctcaaagaagaaagcgggactgtcgtctcattcactcaaactcacgcggacgttacggtgaaaacttggcatggagcagtggtgatatgtccggagctgccgcagtgagattgtgggtcagggagaagtctgactacttccacaaatcgaacacatgccgtgctggaaaacaatgtggtcattatactcaagttgtgtggaaaaactcagagtgggttggatgtgccaaagtcaagtgtgacaatggtggaacctttgtgacttgcaactattctcatcctggtaatgttaggggacgtaggccttactaa

SEQ ID NO: 2003 - DNA, 3567 bp, Arabidopsis thaliana
atgagctttcaagtcaggcgagataggagcgatgataggtctcatcgattcaatcatcagcaaacgtggattcctagaaactcatctacctcgagcgtggtggtaaatgagcctttgcttcctcctaatacagatagaaattctgaaacccttgatgctggttctgcatcccgtcctgtttatctgcaaaggcagcataacgcttctggtcctccgtcctataaccaccaccaaaggagtagtaacattggtccacctccacctaatcaacatagaagatataatgcgcctgataaccagcatcaaaggagtgataacattggtccacctcaacctaatcaacatagaagatataatgcgcctgataaccagcatcaaaggagtgataacagtggtccacctcaaccttatcgacatagaagaaataatgctcctgagaaccagcaccaaaggagtgataacattggtccacctccacctaatcgacaaagaaggaataatgcttctggaactctgccagataatcgccaaagagttgcatctaggacgcggcctgtgaatcaggggaaaagggtagcgaaggaggagaatgttgtgttgacagacccaaacttgcctcaacttgttcaagagttacaggagaagcttgtcaagagttctattgagtgtatgatttgttatgacaaggttgggaggtctgccaatatctggtcatgctccagctgttattccatcttccatatcaactgtatcaagaggtgggctcgagcaccaacttcagttgatttgctagctgagaaaaaccaaggtgataactggagatgtccaggttgccaatctgtacagttgacatcatctaaagagatttcctatcggtgcttttgtggaaagagaagagatccaccgtctgacccatatctcactccacactcatgcggggaaccatgtgggaaaccgctggagaaagagtttgcacctgctgagacgactgaagaggatctttgtcctcatgtatgtgttttgcagtgtcatcctggtccatgtcctccctgtaaagcctttgctccacctcgtagctgtccttgtgggaaaaagatggttactactagatgctccgagcggagatctgatcttgtttgtgggcagcgttgcgataagcttcttagttgcgggcgtcatcaatgtgaaaggacatgtcatgttggcccttgtgatccttgtcaggtactggtaaatgccacatgtttctgcaagaaaaaagtggagactgtcatttgcggtgatatgaatgtgaagggggaattgaaagcagaagatggtgtctattcatgcagttttaactgtgggaagcctcttggatgtggtaatcatttctgttccgaggtatgccatcctggaccttgcggggactgtgacttactgcccagtagagttaagacatgctattgtgggaatacgcgtttagaagaacagatcaggcagagttgcttggacccaattccttcttgttcaaatgtatgtaggaagcttcttccttgtaggttacatacttgcaatgagatgtgccatgcaggtgattgcccgccttgtttagtccaagttaaccagaaatgccggtgtgggtcaacatccagggctgtggaatgctacataacaacttcctcagaggcagagaagtttgtgtgcgctaagccatgtggacgtaagaagaactgtgggagacatagatgtagcgagcgttgctgccctctcttgaacgggaagaagaatgatttatctggcgattgggacccacatgtctgccaaataccttgtcagaagaagctaaggtgtgggcagcattcctgtgaatctttatgtcacagtggacattgccctccttgtctcgagatgatcttcactgatcttacatgtgcttgtggaagaacttcgattcctcctccactatcatgtgggacacctgttcctagctgtcagcttccatgcccgattcctcagccttgtggccattctgatacgcatggatgccattttggagattgtcctccttgttctacccctgtggaaaagaagtgcgttggtggtcatgtggttctcagaaacataccctgtgggttgaaagacattagatgtaccaagatttgtggaaagacgaggcgttgtggcatgcatgcttgtgccagaacttgtcacccggagccttgtgacagcttcaatgaatctgaagcaggtatgcgtgttacgtgtagacagaaatgtggtgctcctagaacagattgcagacacacttgtgcagcactctgccatccttctgcgccttgccctgacctaagatgtgaattttcagtcacaattacttgttcatgtggtcgtataaccgctacggtcccttgtgatgctgggggaagaagtgccaacggttctaatgtttactgtgcggcctatgatgaagcctctgttttacagaagcttccagctccacttcagcctgttgaatcgagcggaaaccgtatccccctcgggcagagaaagctttcgtgtgatgatgagtgtgcgaagctggagcgtaagcgggttcttcaagatgcatttgatataactcccccaaatctggaggcattacatttcagcgagaattctgctatgacagagattatttcagacctttataggcgtgatccaaagtgggtactggctgttgaagagcgctgcaagttcttggtacttgggaaagcaagaggaagcacaagtgcccttaaggtccatatcttctgcccgatgcagaaggataaacgagacacggttcgacttatagctgagaggtggaaacttggtgttagcaacgcagggtgggagccaaaacggtttacagtggttcacgtaacagcaaaatcgaaaccgccaacaaggatcattggagctaggggtggtgctatctcgataggagggccacacccaccgttctatgattcgctggtggatatggatcctggacttgtggtttcttttctggatcttccgagagaggcgaatatcagcgccttggtactgagatttgggggtgaatgtgagcttgtttggctgaatgacaagaatgctttagcggtgttccacgaccatgcccgagctgccactgccatgaggaggcttgagcacggttcagtatatcatggagctgtggttgtccagagcggcgggcaatctccatcacttaataatgtatggggaaaattacctggcagctcggcgtgggatgttgacaaaggaaatccatggaggagagctgtgattcaggagagtgatgactcctggggagctgaagattcccccattggaggatcatctacagatgctcaagcctctgcgctgagatcagcaaagagcaactctccaattgttacctcggttaaccgttggagtgttttagagcccaagaaggccagcacatccactttggagccaattgctcagatagaagagagcagtagttcaaaaactaccggtaaacaaccggtggaaggctccggtgaagaagtggtggatgactgggagaaggtatgtgagtga

SEQ ID NO: 2004 - DNA, 2016 bp, Arabidopsis thaliana
atggcgtcgtcttcagcttcggcgacggtggctgttgataaagctaccagcgatcttttgttaggtcctgattggactacgaatatggaaatctgcgattctgttaattctcttcactggcaggcgaaagatgtagttaaagctgtgaaaaagaggctgcaacataagagttcgagagttcaactacttgctcttacgcttttggagacgttggtaaagaactgtggagattatttgcaccatcaagttgcagagaaaaacattttaggggaaatggtcaaaattgtgaaaaagaaggcagatatgcaagtaagagataagatattggtcatggtggactcttggcagcaagcttttgggggtccagagggaaaatatccacaatattattgggcatacgatgagttaaggcgttctggagttgaattcccccggcgttcacctgatgcgtcccctattataacaccaccagtgagtcatccaccgttaagacagcctcaggggggctatggagtacctccagctggctatggagtacatcaagctggttatggagtacctcaagcgggttatggaatacctcaagctggctatggagtacctcaagcggggtatggaatacctcaagtgggctatggaatgcccagtggttcttcgagaaggcttgatgaagcaatggcaactgaggttgagggcttaagcttgtcaagtattgaatccatgagggatgtgatggatctcttgggcgacatgctacaagctgtggatcccagtgaccgtgaggctgtgaaagatgaagtcattgttgacttggttgagcgttgtcgttccaatcagaaaaagctgatgcagatgctaacctccactggggatgatgaacttttaggccgggggctcgatctaaatgacagtcttcaaattctgctagctaagcatgatgcaatagcttctggttctcctctgcctgttcaggcttctggttctcctctgtcagttcaggcttcgaaacctgctgactcgagccccaaatcttctgaagctaaagattctagttccatagctggttccagttccccaataccagccactgtttctacaggaaaaagcccaattgatgaggagtacgaagaggaggaagatgagtttgcacaattagctcgaaggcattccaaaccgccagcatctgtgactacagaccctaccagtttagagtctcataatgctgcaagcaatgctcttgctcttgctctgcctgacccccctcctccagtgaacaccacaaaggaacaagacatgattgacctattgagtatcacactgtgtacaccgtcaactccaccggctccatcctctcagccttctcctcctcctcccgctggctcagatcaaaacacccatatctatccacagcctcagccacggtttgatagctatgtcgctccatgggcacagcaacagcaaccgcaacagcctcaagcacagcagggctattctcaacatcaacagcatcaacaacaacagggctattctcaacctcaacattctcaacaacagcagggctactctcaactgcaacagcctcaaccacagcagggctattctcaatcgcaaccgcaagcacaggtccagatgcaaccgtcaactcgacctcagaacccgtatgaatatccgcctccaccatgggcttcaacatcagcaaatgcatactatactccacgggctaatgcaagtgcgtcatacacagacacatcggccctagccggaagatcactacagcaatccaactcattccccacacgagctggagatcctcaggctacttcaactgcaagcaattcaggtgtatctgtaggacagaagccgtttgttccatcatacagattgtttgaagatctggatgtgtttgggagcgcagacgggaagcataataaaccggcgaacagtagtaatggttctcaaaacttgtctgggtctcagacgcagcagagtatgataggaggaaggaaaatgatttaa

SEQ ID NO: 2005 - DNA, 489 bp, Arabidopsis thaliana
atggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattga

SEQ ID NO: 2006 - DNA, 1641 bp, Arabidopsis thaliana
atggacagaggatggtctggtctcactcttgattcatcttctcttgatcttttaaaccctaatcgtatttctcataagaatcaccgacgtttctcaaatcctttggcgatgtctagaattgacgaagaagatgatcagaagacgagaatatcaaccaacggtagtgaatttaggtttccggtgagtctctcaggtattcgtgatcgtgaagatgaagatttttcatctggcgttgctggagataatgaccgtgaagttcccggcgaagtggatttcttctccgacaagaaatctagggtttgtcgtgaagacgacgaaggatttcgtgtgaagaaggaagaacaagatgatcgaacggacgtaaattgtggacgtgtcataatttggtttacatttgaaatatcaaataaaaataccaaattttgtttcatttttttttttttgataaagaccggtttgaatcttcgaacaactggtaatacaaagagtgatgagtcaatgatcgatgatggagaatcttccgaaatggaagataagcgtgcgaaaaatgaggtaagtttattggtgaaattacaagatgagttgaagaaaatgacaatggataatcaaaagcttagagaattgcttacacaagttagcaacagttacacttcacttcagatgcatcttgtttcactaatgcagcaacagcaacaacagaacaataaggtaatagaagctgctgagaagcctgaggagacgatagtaccaaggcaatttattgatttaggccctacgagagcagtaggtgaggccgaggatgtgtcaaattcttcatccgaagatagaactcgttcggggggttcttctgcagccgagaggcgtagtaacgggaagagacttgggcgtgaagaaagccccgaaactgagtccaacaaaattcagaaggtgaattctactaccccgacgacatttgatcaaaccgctgaagctacgatgaggaaagcccgtgtctccgttcgtgcccgatcggaagctccgatggttcaacgttgcgcggaagacagatcaattctgattacaacctacgagggaaaccataaccatccgttgccgccagccgcggtagccatggcttctaccaccacggcggcggctaacatgttgctatccgggtcaatgtctagtcacgacgggatgatgaaccctacaaatttactagctagggctgttcttccttgctccacaagcatggcaacaatctcagcctccgcgccgtttccaaccgtcacattagacctcacccactcacctccgcctcctaatggttccaatccttcctcttccgcggctaccaacaacaaccacaactcactgatgcagcggccgcaacaacaacaacagcaaatgacgaacttacctccgggaatgctacctcatgtaataggccaggcattgtataaccaatccaagttctcggggctgcagttctctggtggctctccctcgacggcagcgttttctcagtcacacgcggtggctgatacaataacggcactcacagctgacccgaatttcacggcggctcttgcagccgttatttcttctatgatcaatggtacgaaccaccacgacggcgaaggaaacaacaaaaatcaatag

SEQ ID NO: 2007 - DNA, 1248 bp, Arabidopsis thaliana
atgtttccatgtcgaacaccaccaaattggtggacagaggaactctgtatcttagacgtcgacttcttctccgatgtcgtatcttcaatgaagcagagaggtgtcaaaccttcttccttagcctctgcaatcatcacctacacagagaaatccttaagagatctcgtcagagaccattcaggcagaggagtcaaatattccgatcccggagataacgaatccgacgaaagatcccaacagagagatcttgttcaatctatcgtctctcttttaccttcagacaaagggctgttcccagtcaatttcctctgttctctcctccgttgcgcggtcttcttagacacttccttgacctgcaagaacgagctcgagaagcgaatctcagtcgttctagaacacgtctccgtcgacgatcttttgatcccgtctttcacctacgacggcgaacggttactagatctcgatagtgtcagaagaatcatctctgctttcgtggaaaaagagaaaaacgttggtgttttcaacggtggagacttcaacagaggagtctgctctgtttcactacaaagagtagctaaaacagttgattcttacttagcggagatcgctacttacggagacctaacaatctccaaattcaacgcgattgcgaatcttgtcccgaaatccgctagaaaatcagacgacgatctctacagagctatagacatcttcttgaaagctcatccgaatctagacgagatcgaaagggaaaaagtgtgtagctcaatggatcccttaaagctttcttacgacgcacgtcttcacgcttcacagaacaagagattaccagtaaacattgttcttcacgctctttactacgatcagttaaagctaagaagtggagtcgcagaacaagaagaaagagcagtagttgttctccctgaagctttaaagacacgtagccaactgcaagctgatactacgttagctaaagaaaacgaagcgttgagaagtgagctgatgaagatgaaaatgtatgtttcggatatgcagaagaataagaacggtgcaggagcttcttcttcgaattcgtcgtcgttggtgagtagtaagaagagcaaacatactttcttctcttctgtttccaagaaacttgggaagttaaatccgtttaaaaatgggtctaaggatacttcgcacatagatgaagatcttggaggtgttgacattactaagccaaggagacgaagattctcaatctcttaa

SEQ ID NO: 2008 - DNA, 1020 bp, Arabidopsis thaliana
atgaggagttaccgttttagtgattatctacacatgtctgtttcattctctaacgatatggatttgttttgtggagaagactccggtgtgttttccggtgagtcaacggttgatttctcgtcttccgaggttgattcatggcctggtgattctatcgcttgttttatcgaagacgagcgtcacttcgttcctggacatgattatctctctagatttcaaactcgatctctcgatgcttccgctagagaagattccgtcgcatggattctcaaggtacaagcgtattataactttcagcctttaacggcgtacctcgccgttaactatatggatcggtttctttacgctcgtcgattaccggaaacgagtggttggccaatgcaacttttagcagtggcatgcttgtctttagctgcaaagatggaggaaattctcgttccttctctttttgattttcaggttgcaggagtgaagtatttatttgaagcaaaaactataaaaagaatggaacttcttgttctaagtgtgttagattggagactaagatcggttacaccgtttgatttcattagcttctttgcttacaagatcgatccttcgggtacctttctcgggttctttatctcccatgctacagagattatactctccaacataaaagaagcgagctttcttgagtactggccatcgagtatagctgcagccgcgattctctgtgtagcgaacgagttaccttctctatcctctgttgtcaatccccacgagagccctgagacttggtgtgacggattgagcaaagagaagatagtgagatgctatagactgatgaaagcgatggccatcgagaataaccggttaaatacaccaaaagtgatagcaaagcttcgagtgagtgtaagggcatcatcgacgttaacaaggccaagtgatgaatcctctttctcatcctcttctccttgtaaaaggagaaaattaagtggctattcatgggtaggtgatgaaacatctacctctaattaa

SEQ ID NO: 2009 - DNA, 1578 bp, Arabidopsis thaliana
atggctctttccaacgcctcctctctctccaccagatctatctacggcggtgatctttctcaccgtccaagcaaccgtcaatcatccttcacatttcatcccgccgtcaacaccaagcctaaatccgttaacctcgtcacggctgtacacgcggctgagccagctagaaacgctgtttcagtcaaagaatccgttgcgtcttcttcgtctggtgcattgaaatggactccagagagctggaaactgaagaaggctctgcaacttcctgattatcctaacgccaatgagcttgagtctgtgcttaaaacgatagaggcttttcctccgattgtgttcgccggagaagctaggaatcttgaagagagattggctgatgctgctgttggtaaagcttttcttctccaaggaggtgattgtgctgagagtttcaaggagttcaatgctactaatatcagagacaccttcagggttctgcttcagatgagtattgttcttacattcggtggccaggttccggtcattaaggttgggaggatggctggtcaatttgcaaagcctagatctgatgcatttgaggagaaggatggagtgaaattaccaagctacaagggagataacatcaatggtgatacttttgatgagaaatccaggattcctgatcctaataggatgattcgagcttacactcaatctgcagctactttgaatcttcttagagcctttgccactggaggttacgctgctattcaaagagttactcaatggaaccttgattttgttgaacaaagtgagcaagctgacaggtaccaggaattagctaatagggttgatgaggccttggggttcatgtctgcatgtggacttggcacggatcatccacttatgactacaactgatttctacacatcccatgagtgtttgcttctgccttatgaacagtcccttacaaggttggattcaacttctggtctctactatgattgttctgcacacatggtctggtgcggagagcgtaccagacaattggatggcgctcatgtcgagtttctcagggggattgctaatcctctgggcattaaggtgagcaacaaaatggatccctttgagctggttaagctagtagaaatcctgaatcctaataacaagcctggaagaatcactgtaattgtgagaatgggtgccgagaacatgagagttaagcttccccacctgatcagagcagtccgcagatcaggccagattgtgacatgggtctgcgatccaatgcatggaaacaccatcaaagcaccttgcggtcttaaaacacgtgcctttgactcaatactggctgaagtccgagcattccttgatgtgcacgagcaagaaggaagccacgcgggcggtatccatctcgagatgacaggtcagaacgtgacagaatgcattggagggtcccgcactgtgacctacgatgacctcagttctcgctaccacacacactgtgacccaaggctgaacgcgtcacagtctcttgaacttgccttcattgttgcagaacggctcaggaagagaagaacgggtagccagcgtgtgtcttga

SEQ ID NO: 2010 - DNA, 1620 bp, Arabidopsis thaliana
atgggcagtggctgctcttctctctcttactcatcatcttccacttgcaatgccactgttttctctatttcttcttctccatcatcttcttcttcgctgaaactcaatccaagtagcttccttttccagaaccctaaaactctgagaaatcagtcacctttgaggtgtgggagatcatttaagatggaatcacagaaacccattttcgatttggagaaattagatgatgagtttgttcagaaactggtttacgatgctctcgtttggtcttctcttcacggactcgtcgttggtgacaaaagttatcagaaatcaggaaatgttccaggggttggattgatgcacgcacctattgcattgctaccaactgcattcccagaagcttattggaagcaagcttgtaatgttactcctcttttcaatgaattgattgatcgtgttagcttggatggcaaattcttacaggatagtctctctagaacgaagaaagttgatgtctttacatctagacttcttgacattcactccaagatgctagaaagaaataagaaagaggacattcgtttgggtttacaccggtttgattatatgcttgacgaagaaacaaattcacttcttcagattgagatgaatactatctcgtgttcgtttcctggccttagtcgtcttgttagccagctacatcagtcattgcttcgatcttatggggatcagattggcatagactctgaacgtgtacctataaacacatccacaatccaatttgctgatgcattggctaaagcttggttggagtacagtaacccaagagcggtagtcatggtaattgtacagccagaagaacgcaacatgtacgatcaacatttgctgagcagtatattgagagaaaaacataatatagttgtcatcaggaagactctagcagaagtcgaaaaagaagggagtgtacaagaggatgaaacccttattgttggcggccaagcagtcgcagtggtttatttcagatctggctatactcctaatgatcatccgtctgaatcagaatggaatgctaggctgcttattgaggagtcttcagctgtcaaatgcccgagcatagcttaccatttaactggctccaagaaaatccagcaagaactggctaaaccaggtgttctcgagaggtttctggacaacaaagaggacattgctaagctgaggaaatgctttgctgggctttggagcttggatgactcagaaattgtcaagcaggctatcgaaaaacccggattgtttgttatgaagcctcagagagaaggcggaggaaacaacatctatggagatgatgtgagggaaaatcttttgagactgcagaaagaaggagaggaaggaaacgctgcgtatatcctgatgcagaggatattcccaaaagtctcaaacatgttcttggtgcgagaaggcgtttaccataagcatcaagctatatcagaactcggtgtctatggtgcttacctcaggagcaaagacgaagttatagtaaacgagcagagtggttatctaatgcgcacgaagatcgcatcatcagatgaaggcggcgttgcagctggttttggagtcttggacagcatatatctgatttga

SEQ ID NO: 2011 - DNA, 471 bp, Arabidopsis thaliana
atgtctctagttccgagcttttttggaggccgaagaacaaacgtgttcgacccattttcactagacgtatgggatccgttcgaaggattcttgacgcccgggttgacaaacgcacctgccaaggacgtggcagcgttcacaaacgctaaagtggactggagggagacacctgaagcgcatgtgttcaaggcggacgtgcctgggcttaagaaggaagaggtgaaggtggaggttgaagatggtaacatacttcagataagcggtgagaggagcagtgagaatgaagagaagagtgacacatggcaccgtgtggagcggtcaagtgggaagttcatgaggaggtttcggttgccagagaatgcaaaggtggaggaagtaaaggcgagtatggagaatggggtgttgtcggttacggtgccgaaagttcaggagagtaagccggaggtcaagtccgttgatatctctggttaa

SEQ ID NO: 2012 - DNA, 1539 bp, Arabidopsis thaliana
atgaacgcgagagctcttctttgctcttcaaatattcactctctctacacttcaaatcgtccacctgaaaaaacctcttcttctcgcagcctccgtaatctcaaaccatctccaaagtcgttacgggtatggatctacccgcgaaataggtccagtgttttccgggtattagttcggagctccgacaagagtgaaagcagtaattcgtattacgtagaaggagataaagtaagtggaaacaatgacgtcgtttctgattcgcctagctctatcgtcctcccatggtgggaagagtttccgaagcggtgggtgattgtgttactctgtttctcagcttttcttctctgcaatatggacagagtgaatatgagtatagctatacttccgatgtcagctgagtatggttggaatccagcaacagttggtctgattcagtcttctttcttctggggttaccttcttacacagatagctggtggaatttgggcagacactgtaggagggaaaagggttcttggattcggtgttatttggtggtcaatcgctacaattctcactcctgtagctgctaaactcggtcttccttacttgctcgttgttcgtgctttcatgggagttggagagggtgttgcaatgcctgctatgaataatatattgtcgaagtgggttcctgtgcaagagagaagcagatcactcgcgcttgtttacagcggaatgtaccttggatctgtcaccggtttagccttttcgcctttcttgattcatcaatttggatggccttctgtgttttattctttcgggtctcttggaactgtatggttgactctgtggctaactaaggcagagagttcaccattagaagatccaacattgctccctgaagaaagaaagctaattgcagacaactgtgctagcaaagagccagtgaagtcgatcccgtggaggctgatattgtcgaaaccaccggtttgggctctcatcagttgccacttttgtcacaactggggaacattcattctcttaacatggatgccaacttattaccatcaagtgctgaagttcaaccttatggagtcaggacttctctctgtatttccatggatgacaatggcaatatctgcaaatgccggtggatggattgccgatacacttgtcagccgaggtttctctgtcacgaatgtccgcaagataatgcaaacaatagggtttcttggaccagcgttcttcctaacacagctgaaacacatagattctcctacaatggctgttttgtgcatggcttgtagtcaggggactgatgcgttttcacagtctggtctatactctaaccatcaagacatcgctccaagatactctggagtgttacttggtttgtctaatactgctggagtacttgccggagttcttggcacagctgcgactggtcacatactacaacacggttcttgggatgacgttttcacgatttcggtcggtctttacctcgttgggaccgtcatttggaacctattttcaaccggagagaagataatcgattga

(The sequence listing continues in the following parts.)

What is claimed is:

1. An isolated polynucleotide, comprising SEQ ID NO: 1034.

2. A recombinant nucleic acid molecule, comprising the isolated polynucleotide of claim 1 operatively linked to a heterologous nucleotide sequence.

3. A vector, comprising the polynucleotide of claim 1.

4. The vector of claim 3, which is an expression vector.

5. A cell containing the isolated polynucleotide of claim 1.

6. The cell of claim 5, which is a plant cell.

* * * * *